United States Patent 7,550,578 (RICE PROMOTERS FOR REGULATION OF PLANT EXPRESSION) - sequence listing, part 2

SEQ ID NO: 1831 - DNA, 2000 bp, Oryza sativa
  misc_feature (49)..(49): n = any nucleotide
  misc_feature (74)..(74): n = any nucleotide
  misc_feature (172)..(172): n = any nucleotide
  misc_feature (319)..(319): n = any nucleotide
  misc_feature (322)..(322): n = any nucleotide
  misc_feature (383)..(383): n = any nucleotide
  misc_feature (392)..(392): n = any nucleotide
  misc_feature (439)..(439): n = any nucleotide
  misc_feature (446)..(446): n = any nucleotide
  misc_feature (449)..(449): n = any nucleotide
  misc_feature (501)..(501): n = any nucleotide
  misc_feature (504)..(504): n = any nucleotide
  misc_feature (523)..(523): n = any nucleotide
  misc_feature (536)..(536): n = any nucleotide
  misc_feature (551)..(551): n = any nucleotide
  misc_feature (558)..(558): n = any nucleotide
  misc_feature (590)..(590): n = any nucleotide
  misc_feature (595)..(595): n = any nucleotide
  misc_feature (733)..(733): n = any nucleotide
  misc_feature (741)..(741): n = any nucleotide
  misc_feature (761)..(761): n = any nucleotide
  misc_feature (769)..(769): n = any nucleotide
  misc_feature (799)..(799): n = any nucleotide
  misc_feature (805)..(805): n = any nucleotide
  misc_feature (812)..(812): n = any nucleotide
  misc_feature (815)..(815): n = any nucleotide
  misc_feature (819)..(820): n = any nucleotide
  misc_feature (826)..(826): n = any nucleotide
  misc_feature (845)..(845): n = any nucleotide
  misc_feature (861)..(861): n = any nucleotide
  misc_feature (863)..(863): n = any nucleotide
  misc_feature (931)..(931): n = any nucleotide
  misc_feature (939)..(939): n = any nucleotide
  misc_feature (941)..(941): n = any nucleotide
  misc_feature (986)..(986): n = any nucleotide
  misc_feature (988)..(988): n = any nucleotide
  misc_feature (990)..(990): n = any nucleotide
  misc_feature (994)..(995): n = any nucleotide
  misc_feature (1001)..(1002): n = any nucleotide
  misc_feature (1005)..(1005): n = any nucleotide
  misc_feature (1009)..(1009): n = any nucleotide
  misc_feature (1011)..(1012): n = any nucleotide
  misc_feature (1015)..(1015): n = any nucleotide
  misc_feature (1017)..(1017): n = any nucleotide
  misc_feature (1021)..(1021): n = any nucleotide
  misc_feature (1026)..(1027): n = any nucleotide
  misc_feature (1029)..(1029): n = any nucleotide
  misc_feature (1035)..(1035): n = any nucleotide
  misc_feature (1039)..(1041): n = any nucleotide
  misc_feature (1051)..(1051): n = any nucleotide
  misc_feature (1053)..(1053): n = any nucleotide
  misc_feature (1057)..(1057): n = any nucleotide
  misc_feature (1059)..(1062): n = any nucleotide
  misc_feature (1065)..(1066): n = any nucleotide
  misc_feature (1068)..(1068): n = any nucleotide
  misc_feature (1070)..(1071): n = any nucleotide
  misc_feature (1074)..(1074): n = any nucleotide
  misc_feature (1081)..(1081): n = any nucleotide
  misc_feature (1083)..(1083): n = any nucleotide
  misc_feature (1086)..(1087): n = any nucleotide
  misc_feature (1091)..(1091): n = any nucleotide
  misc_feature (1093)..(1094): n = any nucleotide
  misc_feature (1104)..(1109): n = any nucleotide
  misc_feature (1112)..(1115): n = any nucleotide
  misc_feature (1117)..(1118): n = any nucleotide
  misc_feature (1121)..(1121): n = any nucleotide
  misc_feature (1128)..(1128): n = any nucleotide
  misc_feature (1130)..(1130): n = any nucleotide
  misc_feature (1132)..(1132): n = any nucleotide
  misc_feature (1134)..(1138): n = any nucleotide
  misc_feature (1141)..(1141): n = any nucleotide
  misc_feature (1146)..(1149): n = any nucleotide
  misc_feature (1154)..(1155): n = any nucleotide
  misc_feature (1157)..(1157): n = any nucleotide
  misc_feature (1161)..(1161): n = any nucleotide
  misc_feature (1163)..(1163): n = any nucleotide
  misc_feature (1165)..(1165): n = any nucleotide
  misc_feature (1169)..(1172): n = any nucleotide
  misc_feature (1176)..(1177): n = any nucleotide
  misc_feature (1180)..(1180): n = any nucleotide
  misc_feature (1184)..(1184): n = any nucleotide
  misc_feature (1193)..(1193): n = any nucleotide
  misc_feature (1196)..(1199): n = any nucleotide
  misc_feature (1202)..(1202): n = any nucleotide
  misc_feature (1207)..(1207): n = any nucleotide
  misc_feature (1211)..(1212): n = any nucleotide
  misc_feature (1214)..(1215): n = any nucleotide
  misc_feature (1217)..(1218): n = any nucleotide
  misc_feature (1220)..(1220): n = any nucleotide
  misc_feature (1223)..(1223): n = any nucleotide
  misc_feature (1226)..(1226): n = any nucleotide
  misc_feature (1230)..(1230): n = any nucleotide
  misc_feature (1234)..(1234): n = any nucleotide
  misc_feature (1237)..(1237): n = any nucleotide
  misc_feature (1239)..(1241): n = any nucleotide
  misc_feature (1244)..(1245): n = any nucleotide
  misc_feature (1259)..(1259): n = any nucleotide
  misc_feature (1269)..(1270): n = any nucleotide
  misc_feature (1273)..(1274): n = any nucleotide
  misc_feature (1287)..(1287): n = any nucleotide
  misc_feature (1290)..(1290): n = any nucleotide
  misc_feature (1294)..(1294): n = any nucleotide
  misc_feature (1306)..(1309): n = any nucleotide
  misc_feature (1312)..(1312): n = any nucleotide
  misc_feature (1318)..(1318): n = any nucleotide
  misc_feature (1320)..(1320): n = any nucleotide
  misc_feature (1322)..(1322): n = any nucleotide
  misc_feature (1324)..(1324): n = any nucleotide
  misc_feature (1326)..(1326): n = any nucleotide
  misc_feature (1328)..(1330): n = any nucleotide
  misc_feature (1335)..(1335): n = any nucleotide
  misc_feature (1338)..(1340): n = any nucleotide
  misc_feature (1343)..(1344): n = any nucleotide
  misc_feature (1346)..(1352): n = any nucleotide
  misc_feature (1354)..(1355): n = any nucleotide
  misc_feature (1357)..(1359): n = any nucleotide
  misc_feature (1361)..(1361): n = any nucleotide
  misc_feature (1365)..(1365): n = any nucleotide
  misc_feature (1367)..(1370): n = any nucleotide
  misc_feature (1386)..(1387): n = any nucleotide
  misc_feature (1389)..(1391): n = any nucleotide
  misc_feature (1396)..(1398): n = any nucleotide
  misc_feature (1401)..(1401): n = any nucleotide
  misc_feature (1409)..(1409): n = any nucleotide
  misc_feature (1412)..(1412): n = any nucleotide
  misc_feature (1418)..(1418): n = any nucleotide
  misc_feature (1443)..(1443): n = any nucleotide
  misc_feature (1445)..(1445): n = any nucleotide
  misc_feature (1447)..(1447): n = any nucleotide
  misc_feature (1450)..(1452): n = any nucleotide
  misc_feature (1454)..(1455): n = any nucleotide
  misc_feature (1457)..(1457): n = any nucleotide
  misc_feature (1459)..(1460): n = any nucleotide
  misc_feature (1476)..(1476): n = any nucleotide
  misc_feature (1478)..(1478): n = any nucleotide
  misc_feature (1484)..(1484): n = any nucleotide
  misc_feature (1492)..(1493): n = any nucleotide
  misc_feature (1497)..(1498): n = any nucleotide
  misc_feature (1500)..(1500): n = any nucleotide
  misc_feature (1502)..(1503): n = any nucleotide
  misc_feature (1506)..(1509): n = any nucleotide
  misc_feature (1511)..(1511): n = any nucleotide
  misc_feature (1514)..(1515): n = any nucleotide
  misc_feature (1518)..(1519): n = any nucleotide
  misc_feature (1522)..(1523): n = any nucleotide
  misc_feature (1525)..(1525): n = any nucleotide
  misc_feature (1527)..(1528): n = any nucleotide
  misc_feature (1530)..(1530): n = any nucleotide
  misc_feature (1535)..(1535): n = any nucleotide
  misc_feature (1540)..(1540): n = any nucleotide
  misc_feature (1545)..(1545): n = any nucleotide
  misc_feature (1560)..(1560): n = any nucleotide
  misc_feature (1565)..(1565): n = any nucleotide
  misc_feature (1567)..(1567): n = any nucleotide
  misc_feature (1571)..(1571): n = any nucleotide
  misc_feature (1574)..(1574): n = any nucleotide
  misc_feature (1577)..(1577): n = any nucleotide
  misc_feature (1579)..(1579): n = any nucleotide
  misc_feature (1590)..(1590): n = any nucleotide
  misc_feature (1598)..(1598): n = any nucleotide
  misc_feature (1601)..(1602): n = any nucleotide
  misc_feature (1607)..(1607): n = any nucleotide
  misc_feature (1613)..(1613): n = any nucleotide
  misc_feature (1615)..(1616): n = any nucleotide
  misc_feature (1618)..(1618): n = any nucleotide
  misc_feature (1622)..(1622): n = any nucleotide
  misc_feature (1625)..(1625): n = any nucleotide
  misc_feature (1628)..(1628): n = any nucleotide
  misc_feature (1631)..(1631): n = any nucleotide
  misc_feature (1633)..(1634): n = any nucleotide
  misc_feature (1636)..(1640): n = any nucleotide
  misc_feature (1647)..(1648): n = any nucleotide
  misc_feature (1655)..(1656): n = any nucleotide
  misc_feature (1662)..(1662): n = any nucleotide
  misc_feature (1664)..(1664): n = any nucleotide
  misc_feature (1835)..(1835): n = any nucleotide
  misc_feature (1842)..(1842): n = any nucleotide
  misc_feature (1848)..(1848): n = any nucleotide
  misc_feature (1857)..(1857): n = any nucleotide
tactcgcactctggggttggggaaaaaatagagcaagactgagtactanccactgtactcagcaagtcataccngaataggggtatgatgcagggaattatcaaaggagagctagagtggttcatttgcataaagcgagcatttataaacagaagttgaaagaattaaacanttgcaataattaattaatattgatcatccgctgtccaacgctatcccacgttgcaacaggcccaaccatccacctatactatccaatttcattagactaaactagggtgagactaatcacggtgaatctggttgaccgcccataacngcnggcacggctattcgaatagttttactctgatcagaggtgtacagctgtacccacaagacanagccccacnacacgtttccgtgcgccgacatgccaccacgacataccggaaagagnccgtganagnacccttcgcataaccccctctagccaagcacaccacacctcaggtttcaccnccntccccagcgggcgacgggnagtcccctctcgngcctaggtgaatccngaagccncataggccgtcgcagggcccatccaaactccntcacncccacccttgcctggatgcgtcagctagagaaaagctacactacaagcccagccgttgcccacgctggcttgtggtaagtacgataagttcttccagggcatcccgcgaaccggtccttaactgccatgggtgcgacnagcaaaancatgcacccacagcccaccntgtgattnattttaattaaccaacaccaaagcggtggnactaanccaacantancatnngaaccnacagtctaaacattaatangattttccccactgtntnctagttgaactaagcatggctaagcaactcctagtccaacgtctattcatgttataacccaagctaanaaaggagnanggtaccaaaatagcatggctgtaacaataggtaaacatcccatantnanattnnaaaacnnatntagnanntgnangaanacatnngngacatntgcnnnatagtatcancntgancnnnngannancnnganttgcctngntcnncatncnngagcaaaccnnnnnnacnnnntnnaantactacngnancnnnnnaanaaccnnnntctanngncatncnangcannnntctnnatntacngagactatnaannnnctnaaacngagnncnnannanttngtnatgnattntanannnttnnctgtgatttactgngacttgaatnngcnnaaacggagctcgnatnaatnagttatgaattnnnnaanaattcncngngntnannnctatnaannnatnncnnnnnnnanntnnngngtcnannnntcccagcggctgacgnnannnagggnnnagnggcgccgncangcgggncccactcggtcagcggctcaagggngngnggnnnanngngnnccgggaccacgcgggngntccacngccggtcnncggnncnannggnnnngntcnnccnnggnncngnncngacgngcggnggtcnacccggctcggctcngacgngnccgntanggncnagattccgccngccaacgnggnngaatnggacgngnngngagngangcnggntnngnnnnnctcgaannccggccnnctcggncncggcgatggcgacgacgcgcgggcacacgttgccggcgacggcaaccagcggcagaggcggcggcgctaagcggcgtggctaggaaggagagggaggggagtacgaggggagagggcgccgtcaccgaggtgtggccggcgcggtaggagacgagcccgacaggcgaagcncacctgncggcangccacgggngggacgacggcaaccggcggacgggcttcggggtgccctaaggaaggaggagagagagattagagagagggagatgaaccacggcggccggcatccatggccgaaggcggcggtagaggtagaactcaccggagcgcgagggg

SEQ ID NO: 1832 - DNA, 2000 bp, Oryza sativa
  misc_feature (1184)..(1187): n = any nucleotide
  misc_feature (1402)..(1402): n = any nucleotide
  misc_feature (1453)..(1453): n = any nucleotide
  misc_feature (1527)..(1527): n = any nucleotide
  misc_feature (1817)..(1817): n = any nucleotide
  misc_feature (1847)..(1847): n = any nucleotide
ttattctaatacatgaaatccattcatttttaaccattcaagtgcttgggaggagaatttagacagttcaaacttcaatttttgaccattgaggtgactgaaaaatatttttttcacttcaccttggtatttgcttaacaatctgaaaagtaaattttggaatagatagtgagagtggattttaaactctccagagacgatgcttcattgtttacatgtcactcaaatagttataaaaatataaaaaaaacattaacatgtggtatatcacgccacaaacatgcaagttaaaatgtaacttctacgtgttgtaacgaaaaaacaatacgggatattctcttgagagtttagggggtgtttgggtgagagggactaaactttagtccgagggacttattttttggtgttagatgtcggccctgtatagatgggactaaaacttttaagtccctatcacatcggatgtttagacactaattataaatattaaacgtagactattaataaaacccatctataatcttggactaattcacgagacgaatcttttgagcctaattaatccatgattagcctatgtgatgctacagtaaacattctctaattatggattaattaggcttaaaaaatttgtctcgcgaattagctttcatttatgtaattagttttgtaagtagtctatatttaatactctaaattagtgtctaaatacagagactaaagttaagtccctggatccaaacaccacaaactaaagtcacccaaacacccccttagaatagcatctctctcttaaccctagctataagctaggcagagtagtattcctactagtacaggctatatcgcttactccctttgtcctaaaatatagcaatttttgcttggatgggatgtattctagtactacgaatctggacaggaggcttgtctagattcatagtattaggatacgtcccatccaattaaaaattgctatattttgagatggagagagtagatgaatagcttatatttcagtacccaattaaagagcattaactagtatacaccccaaagtgagtgataaattgataataatagagggatagctgttctgaggctatagatgtgtgcatcactgcacaaagtgatcagtgtgtgtgaggaccatctctacaactagttgtactatacttagcaannnnatgctctactcttcacttctactctcatccatacatacatgtcatctaatctatatattcatcatgtagggtagaagtacttctctatggtttggcctctttataagagcctgctttcccctcccttgcagccttttgctagaggagcacactacacacactacccagagcctctctagagagataaacagtttgcttccaaaaaaaaaaaggangaagaatctctagagagagaaacagagagagagaagagagagaagagagcntaaattcctcatagcaatccaaaagtggagtccctgctgcatagctcgctgcaggcaggcaggcatcttgtctnatgcttttcttctcgctaccccctctctctctatctctctctcgccttttgcaccattaccagcagcagctagctactactgcagcctgcaggcccctccctcctcttgctgctgtgctgcctcgagcgtttattgcgtgaatgctctttctgttgctgcaattcatttcatagcccatatgatgatctctgctcctccaacctagctgtgcataactcccatagaatcaacagctagcccacatgtttagatcagctgttgcagtgagccagtgagtaagtagtgctancactctcaccagctcgatccatcgatcaanccaactaaagagtaacgagaggtatgtacacttccatttgatttttgtaattttaagatcagctgcctcatggaggttagatcaggctgcttcttccatctctaacttttctttctttgattcttggtaggttagctacgacgacgacggtgt

SEQ ID NO: 1833 - DNA, 2000 bp, Oryza sativa
tccgtgtttattctattgcttcagccttcagggtcatggaaacgattctaaggttgggtactatgggagagaaggatagttgattgtcacgcccagaaattcataagtaatttccgaactaatttgtgcattaagacccttcgtccaggacttaaccgaggtacacaaactgacaatttaatatacagattcatcaaaataactaaagcaaataaatacttacataagaggcacttagtccttaccatgaagaaaactgcagcggaaaaataaaacctagcgaagcttcagctccactcccacaggcagctcaactgggatctaaaccaaaggtcttctccttctggatcctttttcttcaactgaggtttgatgattattgcaaggtgagtacatggaatactccgcaagccacacagcaagtatgcaagtgcacaaggataccaaaggatggcataatatagggttcatttgcgaaaagcagtatttagcaaagatttaaaaatttgtaaaacagtagagtaattaatcatcaatattaatcaacactgaacagcacacccatgctgctcaggcccaaccaaacctgaacaaccaaccccggtcgtacagatcaaacctccaaaccaggaattatccattctaaaccaggagtcaaattaattatcacattgttatcattaatgagtagtgtgggactaatcacgaaaaacattgttagacccgcccataaccgcgggcacggctattcgaatagttttactctggccagagatgtaccactgtacccacaagacacgattccacacatgttgccatgccccgaagtaccaccacggcactgcaaatggggaaatcgtgacaataccctttgcccaacacaactcaccacagtgcaccattcctggatcataatcaccccctcaaaaaccagaggcatggattccccagcgacccccacggacctctcgccgcttctcagtctggcaccccgtaatgaaccaggctatacaaaaggtaaagctgttgcccacgctggcatgttgttggcacggttaatattttacaacagtagctcgcgaaccggtccttaattgtcatgagcacgaccttcaaaaccatgtgctcacaacccaccatatatcatattttaattatcaattaattatcataacacgattaaccatcgtgagctaccattaaatataaccataagtaatagtgaagcataatttatcccattaatgagctaatgtttctaagcacggctaagcaactataaataacatctagctgaaccaatccgatatataaggtcgatgctagtcaaattataacccataggaaaataaagccatcttcggccataattaaatgagaaaggttcaccacccgatgacattctaaaataatgcataacttgaaataaaacattagctttaaacggattcaacatgcttgccttgcgaaaaagcgtcttcaattcgtcttcaggaacttctccaacgaacgaacgatcctccgaaacaacggaaaactaaacctataacactaataaaaaccaaatgaacagtacaattaaagttcataaataggtagagcttgaatttagatgaattatgggacttgaacgacctcattccgagttcgtatgagttagatatgaattttacaagatttaattccaattaaacctattaaagaaaagactaatccaaattgattaaacaatttacagatgatttatagctgagacaaaagattaaaacatcctccgaaaatagattagatcgtaggtaacatatattaaaaaggaataatatgtcattgaaaagagataacaaaatttatattgattttgcaatggcttgagatgatgtggatgtcagcgataacatcatcaccggcggatggctctggatagcaacgaggactgaacggcgacgctccgacgataaggggacagctccgggagagagaagacgcgacgacgaactcac

SEQ ID NO: 1834 - DNA, 2000 bp, Oryza sativa
  misc_feature (1020)..(1020): n = any nucleotide
atgtaaacacatcggctatcatgcatcggcaacacccaaccgatcatgcattaacccaaacacttgggtaatatctcttcaagtacttgccattaagtgctcgtccataaacttttccatcaagtccttgtaacatataaactcctttggacacaaccttatggatttgaaacggtccttcccaattcggtgactgtcgcgcccggaaaaataccttttccagaacgctagtgtattaatccccgtcccaggaaaagctggggtacaccaaacaaacatgatacaaaaggcacatctttattatatcgataatatttacattattacaaaggcacttaaggcctgacaaacagaaataatcagcagcggactagcgggccgacggttccatcttcacaggcgctcaactagggtataagccaggactccacctacgacttcttctccaaagcttctcttactgaagggggtaaagatagagcaagaatgagtacaaccacaatactcagcaagccacaccggcagatgcatgattaatgcaagggggtacaaggggataataataggggttaagttttgcagtaaacaacatttaaaagttacttcattgcccaaagctattttgtaaagatgattctagagctacacaatgttattaatcaaggctgtgaacccacacgaacctgccttaacccaaggcctacgatgattcagaccgaactagccaccagacccaggtcccagctcgtcccaagccaacccagcccaaccatttcacattttagttgttaagcggttttaagaattaaaacactaacttgagtacattgctaggcttgcccataaccgagggcgcggctattcgcatagattatactctgatcagaggtgtacatcattacccacaagacacgtcttcctcacgtgtaaccacgtgccacataccaccacggcatacggacggacgatgtgacatagttcccaacccatcctagccatagacaagagtaccgacccaancccgcctacggctggaacccccgagacaggtaggtaggattgagcccctagcagcagaacaccggccctgtgccatgacatctcaactaccgagccgcagctcgtgtagccttcatttgtcctagagatgtccatcgagccccgacttcgtccatctccatccgtgtacctttgtttatgaccaaactgagccacaaacttagccttacccactagacatgtggaagtatggtagtgctttgcaatagaggcctgagcttaatccttatagtacccgaggtacgactaacaaaacccaaccacgcacctcgagcccaggctaaaaccattttgggggttttgaatagagggggaggtgtgtgtccaattccaacataaggcaaccagtccatagtgtctaaatgatatgagaattcccaaagtctaaagttataaaaccacctaatgttgcctaattaatcagcgaagcatctacctaagttcatactagtggaaccataaatagagtacccactagttggggttttgtttatcctagggtgaacaaggtaataataacaatagaaataataataaggtcataacaaaggtaaataggcatggctaaataaaacagtgataacgcaggaatttaaataaagagataatgcattaatttaaatcaaaataattttataaactgggattcaatatgctcaaggatgatgtgacttgccttgctcagagagaatggccttccgaacattcggcgacgaccacgaaccacgcttcaggaacctctggaacgacagaagctacacgaagcacacaagcaaagctacaagcctataaagaagcagtaacaatacataaaaaggaagcacatggttctttagtttaatgctgttatctggagatttgcggattattataattaggttttgcaattataaaacatgtgtaagcgctagcctagaaaagacgagaaggctgcgctgttg

SEQ ID NO: 1835 - DNA, 2000 bp, Oryza sativa
  misc_feature (1033)..(1033): n = any nucleotide
caaaactcaccgtttagcagtttgggaaacatatgctaacggaaaaaaaaaagaaggttgctcgttcgatttttctgaaaagaacttagccttacttcagcattgaccaagggattggtctggtatttttaaaatgttcaaaaatttagtagcatattttatttgctactcagcatgattacatgattgttttttggttctaaagcatacaccttgtcttcagaattttcaaataatgaccataatgccctgctatccaatcaatgttccgtgttttcccccatttatgttcgcctctttgttctaaaatacttgatatcgattttcagttaacacaaaggtcgacatgcggttcaatgtaaaagaggctcagtggcttggtgagagaatcaaagaacggatattacaaacggtataaaaaaaatcttcctcttttgcaaatcttcattgtcattttttctgtattgtctcaagaggttgtttatatttgcttggtatacacaggaaaagaaccggataaataaagatggggagcttgtgatatcttctacaaaaactaggacacaaaagtaaatgttactcagttcttttgattgtcttgtttggacagcaactgacacaatttatccttttaggggaaacattgaagatgctttgcagaaaatacaggtatgctttactcatttcagttctttgtcaggaagtaatttgcagaggcttcatgttattgtgctcccctagctttttaactaaacaagtatctccttaacaggcaatcattgatgctgcatcctatgtacctccacccccttcagaagagcaaaagaagaaggttgaaaaaatgtaagctgctattttttcttccatctgctcccttcaatttccgttgttttcagttattttatttctttagaaagtccaatgcagtcatcattacttctgcaatgtgctgatgatgtttgatattttattatccagttgtagattaataatactatttgtgtaattgaatgcaccaagtgtgtatagatcngctttcttaaaaaaatgtaacaagtgtgtgcaagtagctacatacgcttctataaaagataccgcattactctccaaagtgcaaacagttagtagcggttgagattagccaacctttgaacttgtgcaatgttagtttttaggagatcaaagaaacatttttgcatatgcgaactctgaatctttgtagtcatatctctagctcacacttgagaactataaattgtcgaattacactcgtttattcagttgctgctgtgtatttcatttcagtgctgcagccgctgaaaggaagagacttcagaagaagaaagtgctttcgcagaaaaaggaatttaggaggaacaggactagctgggattgactgcaagttattttgcttaaaatcatacctgtatttcgtgcccttttgaggtgattcaagcttcccgcatggtaaacccttattgctttccctgccttaatccccattttttggtcccaaaatgttcctatcactaatatcaatgtgatagtaactcaggttctgacaactagtatttgctccgcgtggttcttgagcgtggagatagggctcacctgatccttgtggcagtaaatatccatgcgcgacaggaacaagttccaaaccggtgaagacgtattggtgaatatggcgagtttcagagccagtttttgctccatcaattggaaggtagcatctgacgggaaaacactgccttttgtcctaaaatgcactgtttgtcagtggtcctgatccctgaacttatcacatgcatcacatgctactgtaacaatcattcacccaattataaagtgtttgcgtgcctgtgctaaacattgatgaactttggcatatccacatatgcacagttaggaacactggatgcatcgcgcggtaacaatgggcatgggtacgggtgatatgcgtgttaaaaaaagagagtaggcattgtgctgccaaggcg

SEQ ID NO: 1836 - DNA, 2000 bp, Oryza sativa
atatctcatttgaatgcagtctaaacagcaacttttttgcgcaatgtctagtacgattctctagtgtaggttagtgcggtgtactgtaaaggagtaactgttttgaaactgaatcaagccaaagacctgttttatgactgttgtacttggatagactgattcagatatctgttttatgactgttgtattgttgcagataaactggaacctctccagcgtgaatgctgcaatggccgtgacaggcgtgtgccagctttcccgtaagataaggtctgttactgcaaaaccaatcctcagcttgctgatttataattccagatgtgatttctgataaattagcaactttcgtgttgatctcttacgattcgatatgtgatttctgacaagttaacaactttcgtgttgatctcttcttttacaggcacgattacttctctgatgagaagagtgctactgcgtcgctggaaggatgataggaagaagaagaaattgttgtcatggaatggaacactaatttcattatcagtcgaccagcacagtgttcactgtgaatgtgtccgcttccatgataacaaatttaacaatcccatgtgtgtgtatgatcattatgaattgggctatgggtatgaaatgtttttataccctttggtatacagatagtaagcgagtctgaacttaactgaaacggacttggtttgagttcagctcgaagtacactcgaattaaacttaactcgaacggccttaactgaaacgagagagctcccttcctctgtgccatacaatatgtttgcaatttcggtttgaaattcccgaaatttcatttcggacttccggcacgaaactatttcgcctgaaattatattttctttctgaatttggtcaaattttattcaagttcggctaaaatttcttcaaatttcaaaaaaaaaaaactattcaaccgagaaaaaaagctcctggaagaaggaccaacagggagaggcacaaaagcggtgaaccagagcacgtaacttactccacaaatacctaaccaatgttccattcttcctctcatcttgattttataacttttagacctaacaaacattattcattaaccaacgctgcgtgttgctttgccctctgaaactactggaacggcaaatagcagcaattgcctccttcttcttcttttttttccccctcctaacaacacggggaaaatgcaaacgctttgcccggaaaactcatcataactgatagcggagagctgcgaatatatgccatcgcgttagctttttccaccggagttgtttttttctgactcctctcgcggcgaaagacgatgccatctgatttcagtcgctgcaggccttcctgccaagtagtagcttttgttgcgtttttcctatcaaacggcagtaaattaagtaaaaggctggtaattattaattaacgtgaggcggcaagactttgttgtgcaaaagcaaagcggcagaatgttaactttgggtaagtttcgaagtaaaatcgtgggggcatcgatctacagggagctggaataaaagaccatggaaatgatggaaaagttggaaggcagcagcacatgatcagatgatctgtttgaaattgagaagcaggtgttccccgatttccacccatgatctgtgtacagtacgtatgcgcaagttccgttaatttctcacgcatcagttacagcctcatcttttcgcttatacttatatacttatcaaccaaaagttaaattttcaatcttaaatttagacttgattttgagattttttttcatcgaagtttatttttcagcttttacttttatatcgctaagaacacgtatataaaagctttattcataaattatttttcgtttgcatatatgtcgtttggcttattccatcgataagccaaatgatggatgaggctcaaaatgatccacttagatggatgagactcctctcacataaagttagagggacatggctactgacatatgggccc

SEQ ID NO: 1837 - DNA, 2000 bp, Oryza sativa
aattgtactcttttattctcataaatacttccataatttattttcttaaattaaattattttaaagaaaaaaaatattaacattttcaacccaaaacaaatatattatgaaaatatattcaattattaatttaataaaactaattttatgttataaatattacttatatttatctacaaacttagttaaatttaaagtagtctgattttgaccaaagtcaaaacgacttataatctgaaaatggagggagttcaaagtatacttgtcattgggttataatgctatttttctgattaaattaagaaatataaggttatattgggtttagagtcacaattgtattttttttgtttaatgatatgattgaatattaataagtacccagctctaatggttgcagagttcagtttagtacattatcaaatctacaaatccgaactcttgaatatttgaaatttatatgtttgatcaactcatgtgtgcttctacttaataaatataacatcatggtttggagtaacaatttttttcttgatagataatccataaatttgaaattacagtatacaaagtcgaactccgcttaaattctttttttaatgatttagttactaaataactctaagtacttaacaagttgtaattagtttgttcatccttataatctaagtgaattgaatgaacaatgattcgtacagccactatcgataatattttcacattatatctagacgaggtatagatgacttataaaaatgttgtctaataatatattacaattaattatttaagttatatagataatatacatattgtatatatggtattccattaagctgtctactataccgtttggtaattaatacggtattcttctctcatctccattacttaaaaaattaaattctacatgacattctcttctctctctctctcttttttttcacgaacgcgtaaaaaaattacttcatccgtttcacgatgtaagactttctaccattgcccatattcatttagatgttaatgaatctagacatatgtatgtgtctagattcattaacatctatatgtatgtgggtaatgctagaaagtcttacattgtgaaacggagggagtacacgtcactatattagaaaaaatacagttttgttacacaacgcaactgaccagatcggtcgttgccggttacaaggaaggagtattctcttcttagactaagatgttataccattattcatgttctaattaagggctgtcgcataaaaaaatgctatacttattcactgtctcctgaaataatgtgaaatatttcatttgattatcatattagtatagaaaaagatttggtagatctatagatagatgatctcaccattatctaaaaaaaatagatagatgatctcatatttcgaaagttcaatggctcagctagtacaaaggaaactttcttccgtccttgtattccaacttcctcctactaactacggcgtattccaaaagccttggccaccattattgcgtggcacagcgaaaccacagacaccatttatcgatcactaatcttcagcattaacgtaaggaaaaaaaatcaagaacagacgcttaacttttaatccacccacgatcctctgggatcctaattttaaccacccatatccgctaccatctttcttctactgcctctgcctccagtaaatttaggcccccttcttttccgtttttattggtgcaacgctccctcctcacgcatcactcgtttcccatcgacgatcgagcgagcgcgcggtgcgagcccgttccgttccttgttccttgcgatgagaggttttaaaagcaagcgtgcgaagtgggtgctctcggaattggactcggctcgtccgcacccctattaaaaccacgcgaggaagttttcttccccgtcgtcacctcccgcttcgcgaaccacccacccgtccgtttctcgcctcgcctcgcctcgccctccctctcttccttcttaa

SEQ ID NO: 1838 - DNA, 49 bp, Oryza sativa
  misc_feature (3)..(3): n = any nucleotide
  misc_feature (5)..(5): n = any nucleotide
  misc_feature (11)..(13): n = any nucleotide
  misc_feature (36)..(36): n = any nucleotide
  misc_feature (42)..(42): n = any nucleotide
  misc_feature (46)..(46): n = any nucleotide
  misc_feature (49)..(49): n = any nucleotide
tcncntcaaannncccaaaataccgcggagtttttnagttgngganccn

SEQ ID NO: 1839 - DNA, 2000 bp, Oryza sativa
tacattctgaattgcaacattttagaaaggaggaggtaactcgtaggggtgaaaatggaacgagtattcataagccgtccgactgatctaaggctcacagtctcacacggaggatataggagagagaaaagaatactcggtacaatgcaagtttaaatttgaattcactacaaattatgtgataggatataaaataagtgtatctttgcttatgttccgtattatcaaacgtgtagtaaatatattataaagttaaaatattgactaatcactattttaattatgagctcacatgtatactgcatattatctttttttttcttggtgtatcgttttactccctccgtttcactatataagtcattctaacatttttcatattcatattgatgttaataaatctagatagatatatatgtctaatatttatttgtgaaacggaggaagtaacacctaggtttaatatttatttgttaattagagatacaaatatatatatatatatttttttttctgaatttgaaacaaggggggaaaatatgggatatgatacatgataagtaataagttatcaaatactatctccgtcgtaaaataactttatttttcacccattccgcacgtaccaatgtaaaagcaaaatgataagaacaccctccactattaaatcccaatacaattgtttttcacttaattcagttctagtatttgttccattctttcacaaacttcaatacaatgattgctcaaagataaatttagtatgggataaagattaccttattttgagatgggggagtactatatattctctattccaactccgagcaagtgagcaacaaatatgggagaggatacataataagtaattatttcacgggtactattcgtttatgagaaatgacagagtcagtgttacagaaaagtatacttcttatacctatatttatgactaccgggaataacgtatacctggtcctttatggaagagtatgttcaaaaatagatgtcagactctgatccgtatgctacaaagtcttatctgttcatagcctatttgaatcacgagttctatttagacaagaggttgtttgtccgtataaatacaaagcccctagggaggagagtgcattggatcataaaccgtaaccacaagccatatcccatatcgaatatcaatcgggaggaaaccctaaatctagtctttgattacaagttgctagtttagtcctcaccgaaggtaagctggtaggccaaattagctagcttgctcttcctttataatcggtgtaacacatctcatagcagctgtacatataaactagattatggctattaccccatttcggatgcttgaccgcttgaaccaaccagtataaaattcattatcttccgttttcttttttccaatattagatataccctcatacgccttttaaaatatcgtcattgagcttaacctttcttaatttttaggggcaattgtaaattcaccactattttgaatcgttattgtaagactgctactaaaaaattgcaaaatgctattagaactgccattaaaatggcatccttgcaaaatttttatggataaaaaaaatgacgtacgtgatccgacagtatccatcctgtaccgctcgaaaaaaattattgagcttgccgagccgagccgagccgagccgtgagccaggaaagaggtgaaaatccacacaaccaacctgttaattatctcccctatccaaaattacaccaagccccctaatatctcggcggaatcctctccaactcccctcccctcacctctctcctctataaaaaccctcccctccccatccacccatcctcctccaactccaacggatcactcaccttgcctcgccctcgccctcgccaccatccaacgacgtcgactcgtcgccggcgacgactccggccgcgcacatacgcctggtaatacgtactacgcgggaaccaaatcttacgcacgcgcgcacgaacgc

SEQ ID NO: 1840 - DNA, 2000 bp, Oryza sativa
  misc_feature (1964)..(1964): n = any nucleotide
gtagtgggctatactgttaaacttactcttaggatgagtttgacaaactgagttggaaatcattcgtcacgcacgtaaaacggagtgacttattcgtacatgattaattaactattagctttgtttgaaaaataaattaatatgattttttaaagcaattttcctaaagtttctttttgtaaaaaatacattgttttgcggtttagaaagcatgcgcgtggaaaacgagtagggtgaagttgggaactgacggagctcgtggctcctcaccgggagaccgcgcaggcccccctttgccagttcggccgggggcttagggtgaaatctcaagctctcactctctctgtatgtggtcagattactcgtcggcaagacacacgagacacgacgatgtatacaggttcgggccgccgcgaagcgtaataccctactcctgtgttttggtggatctgtgtatgaacgagctacaaagtgtccgctgacttctcccccgttctcagctttcaatccgggaaaaaaatcccccctctaaatgggcaaggtcctccttttatatctcaaggggataccacatgcacctttctctttccaaactggactgttctttttctctttaatgggcggagatcggtacggtttccatccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggataaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgaccccccctcgggggaaatcaggaggagggcggacacctcaccctcgggcccgacgtccccgaaggtgccaggccacgcgggcgattgcgtctacctcaagcctctggtcatgatactcccggtcccatatcaccgacaggaacattgagcaaagaacacagacttacggagcaaagcaactacactattgattcaaaccatggtgtttatgcagctgcataggattgccaggtcctaattggctgattctgccactaactagaaatactatacttatattagaactcacgttagatagatagagtagagcatatatagggggtttagcccctctctcctaaacacccccatagttgtgaactcccccatttagatccgagtaccatcttcttattggccttgtttagattctaacttttttttcttcaaattttaaacttttctgtcgtatcgaattttcttacacacacaaactttcaacttttccgtcacatcgttctaatttcttcaaacttctaattttagcgtggaactgaacacagccattggcttgtggcgtgtgtgagatgcaatgtgattgaattttttggaataccctcctttttatttgagaatttttcgtgcagctgtcaaacgctttcaatctggcggggtttatttgtgaccctcgatcggtcaatggccagtagcaatccatccgtccgttcaaatccctctctgggaaacggacgaaacgggagaggcgcggaaaacccccaccccccaaatcggagcgcgnaggcgccgaccaagaaaccctacgccgcttgggcgg

SEQ ID NO: 1841 - DNA, 2000 bp, Oryza sativa
  misc_feature (661)..(661): n = any nucleotide
  misc_feature (683)..(683): n = any nucleotide
  misc_feature (749)..(749): n = any nucleotide
aagggcattgtcgtgagtagtttttatatacatcttctcgtgagatttttaattatttgcataccctcgcattgatatgcccaaataacctgacacgttatcttttgatgacagaacgagatgcttttgtttctgttcatctctcattctactatttattttaagaactgttacaatatactggtagtataaacaatctaagggtgtagattgattttagtacccacttaaatcgactatagtataataggggtaaaatggtttatttttcttatgtgtttcactagttatctaacacgggttaatgtttttatgtgtttgatgaatctatcgatccaatcaaaaacatttggttgtgccctgtattcagccatatccggtcagtaatccgatctgacatacggacaataagaattactatcggagtgaagatataacacgaaataactactgatcattttctattttgcgacatattcccaacataaccttatttatactagcaatatatactaccagtatattgtatagtaaaagtcatcttatttaattccttttcattctgtgcatcaccagattcaaacttgtcacctgatttgctttatttgtcataactttttttttttgtaaagggaccaggtgctaaaaatgtgttacaatncaaagccaagataaggtttcanagttcatgcggtttgtttttacaagacgtcgtcgcagcttacatcagttgcatgtacatatatacncctaccaattaagtaattaattagagcatcatgggtgtgttttacactaatggattgacatcctccttgatgattagaatcaacagagtcactttcattctagaaggttcgtctactgttttccttccaaatgttgaagtgacatgcacaactgaaacaaaggcaaccatacagcctgaatggtaccttcggtttgctggagtacaagtggcaacttctttttttgaaaagacaagtggcaactctgttacaaggagatttaaacaccaggaattaaactcatcaagacaagcacaatggacaattcctcctgtaattaaggccccgtaggctgacccgcggcagcggctcggctaaccggcaacggcaacggtagggtgacgctaacatggtgttcgataaaatggtgacgagagacatggtggcgtggagctgagtaatctagccaaacactttctatacacatctcggcttttataggagctagcttccatttaagttggagtttagagttgagagttagaatttagagttgtgacaaacagggtctaaaaagtgtgacgatgaacgactacgaccagtgattcttttattaccaatacctcccaatcccatatgtaagttcattacagcatgctagctaagctataaaatctctctgttccctcgctgatatgaactcactggtaagttttatcttattttttttctctcttttgagccctcagctcgagctgaagttttcaatttgaggcgtagaaaagaactttaaaatgcacatcccttctcttctcctctcttttagctctcattttatctgaccaagtaccatatttatagatcttgtcaaaatgtactccctgatgaaactgtactaggttggatgtatttatttatcaacaaccatgtacttgcaactcgttgcgagacctaaaccagtactagactcgtatttaatttactacctccgtcctctaatataagtgattttgatattttgcttgcgctgtttaaccacttgtcttattcaaaaaaatttgagcaaatataaaaaacgaaaagttgtgcttaaagtactttggataataaagcaagtcacaaataaaataaataataatttcaaatttttttaataagacgaatgataaaacagtatatacaaaatgtcaaaatcccttatattagaggacggagggagtatttctttgttaacaatttaaactttcaccaggctaataatcagtataaaaa

SEQ ID NO: 1842 - DNA, 2000 bp, Oryza sativa
ttcagggaacaggtctgtcagatacattgaagccgattggtgaaatagatgcttcttccactctacccaccatcggtcaaatactgcacttctcaacatccttagctttatgttattgatgctgcctagaggtggtccttctatgttcagcaaccgatccatcatgagtgttgatgtgatttctcctctactttggatcttgtcggcaaagaacaagctaatcggcagttgacatatgccgaattgccttgcagcacttgtcgaatgatagaactcatagatcatttggatatttttgccttggtgaatgctgacaggaaggatgcaggggctgatggctgttgagtatacttctctggatttctcatacttctcagagttgatttcttcaaaccgaaagtcgcctggtagctcaaaagtgccatgtccttcgtatacaaaccaaattctagtgcttctggggaacccatcataaaaattgttgaaccactctctgaagggctcagccgatagcttggatacggtactgaccgatgctgcttctccaaaggacatacatcggcatgtggtgactgtttctccatcatctttgatgatcggctcaaaccttggaaaccttgcatcggctagcggtggacgtttggcaaccatcctggtgtgcaagttcagccaaatttgaagtagccaccatggacctccagtgccgattaatgctctaaaagctattttggttgttgtagtgttgagagtttgatacagtagggccacagctcggaccacagaacaagaacttctcgagccacatcatgaggaaaactgcgtgctctcttatagaaatcggcccggtttccatgttctttgcaacatagcttgactagccgcctatgcttttagtcttaaactcatgagtgggctggatgttcaagctggtcaggttagccgatgaggttatgtctaggccagtaatcattatgatatccaggagagttggggtcatcggtccttgagagaagaggaaagcgttgatggctgtggaccagaaatgagtggcagctaccatcataggctcatcctttgccatatctgctgcagtcaaggctaaggcttgagatatgccgatttcttcccaatgggtcattttgctagccgacatcctcttataccaagtgggccaactcttttcggccgatggccaagatttgaaggtgtttttccataagctcagatttgggttggcaaatctaaatgggattcggttggtttctccattaatgaactctgtggggtctgggttgccgattgggccaaggaaaaactggaattcatcggttatgctaggaactgctatttggtaagagagatgctacagaagcaagaaaatcgaagattgagcgggagaagaaccaaatctgtgcagtaaagaaaaagattcagccgataatacttacctcgacgtattcggtggccaatgagctcggtggactggtggaagtcgacattgctagcgatgaaggttgggattgcagagaatcgcctttgggtcgccggaaatttcgagggtgtcaccggagagctcaaggaatagattggggaaagtttgttgctaaagcggttaaaacggaagctgacgccgtgaaaagtgcaaagcggtggttactatttaagagggagcacggtaacggccaaaacagaatcggtaatggaagctctagttttaattggaaagggaaattgagcaaatccgccacattacaaatatagcggacttggggggcatgtgttaacgaccaaatttggtaagacatgaaccaggttcggcatcgagatcgaagcggattcggcagaaagttagattcaaagaacagcgtgcgcatcggctgagaaggcatcggttggagtctgaatcggctgaggatgatcggatggaggacagctaatatagccgatggggctgatatagccgatacagccgatggggttaatacagccgattccagcgg

SEQ ID NO: 1843 - DNA, 2000 bp, Oryza sativa
  misc_feature (896)..(896): n = any nucleotide
  misc_feature (914)..(914): n = any nucleotide
  misc_feature (963)..(963): n = any nucleotide
  misc_feature (973)..(973): n = any nucleotide
  misc_feature (976)..(976): n = any nucleotide
  misc_feature (979)..(979): n = any nucleotide
  misc_feature (989)..(989): n = any nucleotide
  misc_feature (993)..(993): n = any nucleotide
ctccttgctcccaaccaatctccctcgttttccgcacgcatgcttttcaaactactaaacgatgcatttttttgtaaaaagtttctatacgaaagttgtttaaaaaatcaaattaattcatttttgaaaaaaaactaatacttaattaatcacgcgctaatggattgctctgttttccgtgcggaggagatgggttcccaaccctacgttacgaatatagcctaagtcatcatcgcatgcagtggtatgaatgaaatgatcattctacccttatatactatatagaaaagaaataaaaaaagaagatgaatggttcacacgtgtatgatcgttttagaattgtcacttacgattgctgtagccaagcactgatcgtataaattcctttgttggccatccatccgcaacaatgctgggcttgggctggcctgttattttttctgtttgtcttttttttcttttctatatggtatatatggggtagaatatgatcatttcattcataccgctgcatgcgaggatgacttggtatactcaggtggcatttttttggtccaaggactatattaacccaaatggttaatttggaggacttgtttggacgacttgaaacatcgaggactaaactgagcccgaagcgaaacttcagggctgtattggctattcacataatataaaattggaaaaattggttatatagcatcaaaagttcacgtttttggttttatagcaccgaaagataccggttcactttaataacacccaaagttcaccatgttcccatttttagcacttccgtcaattctcgatctttttcgtccgtcttgatctagccacacacacgatatgacgtttctaccccctcacaaggtaccaaggtagaatgcatgtcaatngaggggtagacgtcatantcgtgtgcgtagttgggtcaataacgatcaagacggacggaaaaattgnacggaagtgnctntanatgggcaacntgtnaaactttgggtgctattaatgaaccggtatctttcggagctataaaaccaaaaacgtgaactttcgatgctatataacaaattttgcctataaaattgtagtggttaaaattttaaaatttaatctaaaatgagaataaaatgatttattcaaatgttatcaatgtaatcgtatatctagattaatggattcgtgaagatagaaacacacagctttaagaaatcataaataataaaagctaatgctgtaaatttaaaattcaaactagtaatatgaatttgaatttcgcctgcggcagacaagctggagggcaaagtggcaaacgatggagctgataattccgcctgcaccgtaaaagctaactttctaacagtgtgtttacatgatttaccatataatgaaaaccagtccattatctaaaaaaaatataatgaaaaccagtaaacatgaattaatttggactttgctttgatggcgctatccgtttcacattgcagatcagaggagccatcacaggagggatgattccacacagggttgagttgcgtgtcatgatctgaactcaaagtattagcgatctcactacaacgaagaaattggcattctatataggccagtgtatcattaaattgttcagcacaaagaggatgccgctatagttatagacttatagttaacactgctgcatcttttgtgctacagcacaattgtaccattcctacggggtgtacatttcccccttaataataataataaagaaaagaaaaacttagctgattccacagttcagagtaactccagacatttggaaaaatgaattttacggcgcatggttcaaattacgtctataacacgggaaggcgtaaatgtgggtttacgtcaaccctgctcccggaattcgctggtgcagtgtgggcccatgaactaatgtgggcctaaataggcccaaatactcatgactagaaactgagctaagcccacaggggaagagggggagacgcggcgag

SEQ ID NO: 1844 - DNA, 2000 bp, Oryza sativa
  misc_feature (29)..(29): n = any nucleotide
  misc_feature (32)..(32): n = any nucleotide
  misc_feature (39)..(39): n = any nucleotide
  misc_feature (41)..(41): n = any nucleotide
  misc_feature (43)..(43): n = any nucleotide
  misc_feature (117)..(118): n = any nucleotide
  misc_feature (120)..(120): n = any nucleotide
  misc_feature (123)..(124): n = any nucleotide
  misc_feature (127)..(127): n = any nucleotide
  misc_feature (132)..(132): n = any nucleotide
  misc_feature (145)..(145): n = any nucleotide
  misc_feature (678)..(678): n = any nucleotide
  misc_feature (701)..(701): n = any nucleotide
  misc_feature (709)..(709): n = any nucleotide
ctcattccacggctcggatcgggaaaacntcncccaacnangnccggcggcggcggccaatctcgccagcacgccgacgtggccgcgcgcgagaagagcgaagggcgcgcgggctcnngnttnnccnaaccngtatggtgttgcnacgcgcacgcggtgaagcgggacccgatggtcgccgcgtttgaactcggcggcggcgctatgcggcggcggaaggggcggcatggcgcgggagcgggttgggaggccggcgactggggcggcagcctgggaaggttcaaggggacacggggagggtcgcggcgcaaggaatcggcgagagaagggccgacggcggtggattgcggcggcagccatcgccggcggagaaaaggggaaaactcgccggggcaacgggagtccaattcaccggggaaggagcttctacacggctccgggaactcgtttcaagcaacgggcggcgacgagctagcctaggggatcatggcgacggcgagtgatgcccgggacatggcgagggcgcgcggcgagctgtggcgaacggcggcttttgcatgcgcgcagtgcgccacagagaaatgttcgtggggagctcaccgacgagagaaacagcgtcggcggcgcggatggagtcgcgcgagtggacgcgacggcggggcggcgcggcaccgaggntgcgcgccgaaggaggagggagnagaggtgncgatggggcagcccggagctccccgtcacgcgtccacgcacgcaccggctcctccggtgctcggcggcggacggcgacggcgagagcggggcgagcagcaacaatggcgcggcggtgatggaagtgaaacgagaggaggattcgatgggaggggcttgggtttttatagcggaggcgagtcggtttggggaggtggaaaccgacttggcagtcgagcgctcggctggcggtcacgggcgacgcaagagcggcggacgacgaggatgcaaagagcggcgaaggcggtggatcggacggcgtgacttgaatcaagggagcgcgaggggcaatgcggcgagctagtgcgtggtcaaggtggggcgtcgagctgctgcggcagcgtcagcggcgctctgaccgcggcgcaagcgacagaggtagggcgccggtctgggaagggaaaaaggaaaaaaggagagggggaaggggacttggtcccttgccgctttgggtgagggaggaagcagaggcgcaagctctggctcccgtctttttgtggttagcagtgtggagcggcttgggatgatggcggtggtggcggcaaaagcgggcggggccgggcggcacgcggtcacgggcggcgtcagggctgacgcggcggcgaccgagcggctggccacgagcgagcgcgcgcacgtgggaaaccgatgggcggcggcgaaaatcaaatggcggcggcgggaaggttcaaaccccggcggcgggaatcggcaaggcggcggtggtcgactggcgagagagagaggaagagagacgacgctctctcgggcggcacacatgcacagcacgtgcgaggaggaaggaggagataggcagaggggagatgggccgaggggaacatgatcggcccacaaaacttgaggaaggcgatttagactttcacagaggaggctgatttggagagaattggagtttggatttggattcaaatttgatatccgaactcgagggttcagggaggaatcaaggaatggattcgaggtggactcggatatttgtggaattaggacaagtatttggtggggattcaaaggatgcgattgaatttcggagtttgatttcggagacttgagtcggaattggaatcttgaggtgggcgattttgatggcgatgagagggaacaaagatggagattgaattgagatccatggcacgacttagactctcactcaaagaacgaaatttttgaaattaggattttgccgaaatagtttttaacgcctcacgaaaagcggagcgttacaaaagagg

SEQ ID NO: 1845 - DNA, 122 bp, Oryza sativa
  misc_feature (8)..(8): n = any nucleotide
  misc_feature (12)..(12): n = any nucleotide
  misc_feature (14)..(14): n = any nucleotide
  misc_feature (17)..(17): n = any nucleotide
  misc_feature (35)..(35): n = any nucleotide
  misc_feature (37)..(37): n = any nucleotide
  misc_feature (42)..(42): n = any nucleotide
  misc_feature (47)..(47): n = any nucleotide
  misc_feature (49)..(49): n = any nucleotide
  misc_feature (61)..(61): n = any nucleotide
  misc_feature (77)..(77): n = any nucleotide
  misc_feature (89)..(89): n = any nucleotide
  misc_feature (92)..(92): n = any nucleotide
  misc_feature (101)..(101): n = any nucleotide
  misc_feature (103)..(103): n = any nucleotide
  misc_feature (106)..(106): n = any nucleotide
  misc_feature (108)..(108): n = any nucleotide
  misc_feature (110)..(110): n = any nucleotide
aagggttnagcngnaancccgggcgcgggcggctnanggccngggcnanctggcagccctngggcgcgcccgaaagnggccttgccggnacngccgacggnangcngngnacccgggccccg

SEQ ID NO: 1846 - DNA, 967 bp, Oryza sativa
  misc_feature (5)..(5): n = any nucleotide
  misc_feature (17)..(17): n = any nucleotide
  misc_feature (57)..(57): n = any nucleotide
tcatntacgcgaagacnttgaagcctccgtcgtcgtggcgcgcgtaggaagtcgccngtgtgatcgcagccactacgcacccgcacgctgggccaggagtcgctgcgtgcgaatctccccccaaaaaaaggaagggcgccgagcgtgcgtaccggacgtgccgtatcttcggcgcgctccacaggctcgcgtgccgcgggatcactcgattcgatcgtcgcctgggtcgccgtctcgcttggattcttcgcgtcgcgcgagaggccgggagagttcgggcgccgcgcaccacgcgcgcggaggcgggacgggacgtacgccactggccacgtaacgtaacgtgcccgtccgcttccgcgcctcctcgcccgcctgtgtagcaaactagagagaggcggcgcacggatcagatatatggtgcacaactgcacaagtctgcacatgggtggagcccgtgattccggtctcggacgatctggtggatccggagcccacagatatggaagaaacgatatgggtgagaaccagtggattattatttggatttctagaaccatcctatgctgagatttcttcgtcgcccggtggccccggcgggcggcacaccagacaccaaactccaacaccgagggcggaggcgggcgaaatccgtttgcgcgcaaccgacgcgatccatccatccacccaaccagccacgccttgcaaacggccaaaaaaatccagcagacccaccgttttccgccgtctcaaagaaatcgccacggttctcctcacgcaaaaccacatccgcacttcgcgaaacgaccgccttgccaccgcctcgtgccgatgcgacccacgcgcggccgcgccgggacgagggcacggccgtcacttcctacgcgtggggatcaccacaaccaaagccccagtgacgtacgagtactcctgatgtgggtggggccagtgagtcagtgggcggggcaca

SEQ ID NO: 1847 - DNA, 2000 bp, Oryza sativa
tctttttattaggtgcaagcatgcaaaagatttctgggtgaacaaaagaacaaccaaatcagaaaccaatcttggttatttaactggggccttacctttgctatagattttcattcatgaattcaatcatgaatgcatgagaaggattagagcaaagatagtagtgggctataagccagctataaacgtaaaactcacgtggattggaaaaagaaaaaatataaagggtattcactctcatgaataacctagaactacacacatgcttcaacataaataaataaattaaatgcgtaagtgggagaaagatagagaaaagaaaaggtgaaaacaattttaatatgggcttaaagctaacagtgaactatactaataaactttcttcttatcgtgtagattattgtagaaatattattttaatagtggattgaaatatttgggtttgtagttcttgtatgtaatgtagtcatatgcatgcatgcaggacacgacatattaagctaagcagatatccgtcgacagcaagttcgtgagttgttcacctggggctcgatagctctgtcgacctcccacacgtacctctgcaagcaggactcgaactgcaagaacgcatgcaagtatataagttagcaggtactccctccgctccgtttaacaatgtaagaatgttagaatgacttacattgtaaaacagagaaagtatatacgttaaccatccacaagctctattccgggggtccgagattactggagcacgtgcggtgttgggtttagtcgcacatcggtaattgatgatggaggagcacgacttaaaaggtgggggcggtcctcacccatcagactagtcttttggttgtgtaggcccagaacctaaagttgtggctccggttgagcctgtggtggagcagccccaatgtgacctgggtagcccacggttagtgggccgggctgcgcactctaacaagcggctggagaggatgatgatgtgtcgaggcgcacgctggacccgccacatacgacggacgggctgccatggctgtggcctgtgtccgctggcgacgtggacagatgggatatataattaacgtgtgtgcagatggggtatataattaatgtgtgcgcctttgtccgctggcgacgtgggcagatggggtatataattaacgtgagaactcgtagaaagtgggatatataattaacgtgtgtgcagatggggtatataattaatgtgtgcgcctttgtccgctggcgacgtgggcagatggggtatataattaacgtgaaaactcgtagaaagtgggatatataattaacgtgtgtgcagatggggtatataattaatgtgtgcgcctttgtccgctggcgacgtgggcagatggggtatataattaacgtgagaactcgtagaaagtgggatatataattaacgtgtgtgcagatggggtatataattaatgtgtgcgcctttgtccgttggcgacgtgggcagatggggtatataattaacgtgaaaactcgtagaaagtgggatatataattaacgtgtgtgcagatggggtatataattaatgtatgcgcctttgtccgctggcgacgtgggcagatggggtatataattaacgtgagaactcgtagaaagtgctcaactagtacaggtatacgcactgtgaatggccttaccgttgcgccatgcacgcgaggctgacgtggccacgagcgtccgacgtggcaactttccacgctgtacaacggccaagggcccacctgtcagggtgagctgcgacatcgagctgggagcctgggagggagttgagctgttgatcggtggttgagtggagtccagctagcgcaccgagaaatctcatttggggaaagtttccgaaatccccgattcttctccttgtaggaaaaggcattgacttgccccttcctccttcgatccgcggtctagccagctggttgctgattcgctgcttgttcggattgattcgattcgtcgt

SEQ ID NO: 1848 - DNA, 2000 bp, Oryza sativa
agtataaaatcctggctccgccactgacagcaaggggcatggtgaccaacatagccctagaggagttcggtgactggtgcacggaggagatcaacgataagctccagaagaaatttctttttggactttttttattcctagaccagtttgaccataaaaatatattaaacatggattatatattggttcatccgtgattattggaaatctacattgatccaggggtatcgcgagaaacgcccaggaatttttttggctagctccataggtgatgggctaggtgacctgaattcgaaactttacctcttctaattatttgataataattagaccattccttaacatttgcgtctttttatccaggggtaccgcgggcgccattcttcgcctaaatgaagaggttcttcgccgttcgaaggagtcgatgacgttaaatgctccaacaagtgtttctgaaattatcaatatatatgaactgtcgtgacatatctcgcagtcccagcccagtagtcgggtcagtcagcgctgcataaacaaagtttggcttggtcataaaagtgttcactattcagagtacactgtactagcctgcacttcacatgccggccacaattacggcgttattaggcgggacatgggcataggaaaaccggaaaggtgtccaaggcgttgcagagaatgtagtgtgtcggtcataggctgcaagcgagtgcactcccacttgcacccagggatatatattatcgtcatgcatgtgccttatgctcttgtcaagcaatattttttggcaagtttttgtccaggcatctagctttccctccaatgctatccatttctctgaacctagctaattgtcacggtgtgcaagatttctgcttgagatctgatggacatcttggcagggctgtgtctgtgtgtgcatgcgtcaagacaaacagcccaaattatatgcaacctgggaacaaattaagtgtgataaactgataattcatcgaccgcgctctcggtcgtgaactagtaggtcccggtagctagcacgacatgtgtgcaagaatatttgtctgttctgcaaggtaattggaaggccatgaagttccccaattcttcggcaaagcagctactattcccgtttcaaaatataagcatttataatatttaaatttcatacacaatataagtacttttttttctagagaactgatttcaatgcatgagaattcaaacattttgcacccaatcaaatgcttaggtggagaattcaagcaaatcaaaatttgacaaatcagatgcatgattgtaaatggttttatactaccttaaaagaagatagtgatagagacagcgaatccgccactgaaaattttacatattaccctttaaacttcttaatattaaaaattaacatgaatattctctataaaaaaagatggataacatattaatacattatatttttttcatagtaaagcacgggtatttagccagtaacttaaaactgattatatcacatgtttttctaacactgttcctgcctggtccgaatggcgccaagctagagtcggtcaagcgagagagctaaattgggctgataaaaaatttgcattgctcccaatgcgtttcgtccaaagtacagcgagccgccgagcccatccagtatccacgcattccgcctgcccgcgcggccggccgcggctaccaccctccacccttcacggcttcgcacgcgcccgcgcgccgggcagatctagatgctatacccctccgcctgctactgctagctctcccccccccgtcccatgcacgcggttgcacgcgcccacgccggccgtagcatccgttccactataaaaaccccctccggaaccccacccctccacattctccatagcttggccaccgtagtaaagccggcgagctaattctagttctagccagctacacgagatcatcgctgtgacgggcggggcattgagagggcgcgtgtgccggccggggtcgat

SEQ ID NO: 1849 - DNA, 2000 bp, Oryza sativa
  misc_feature (1878)..(1878): n = any nucleotide
gtgcgagcacggggaggtgttggatggagacagatggtggatattgtttggagtggggcagtgatccgtgggtgtcgctatcggtggcttcccattggctgcggttcgagaggggtggatcgatgggcgcaagcatgtggaggcgttggatggagacggacggtggagatgggttgggagtgtggcagcgatccgtgggtgtgggtatcggtggcttcccatcggtaggggttttggtagggtggatcgatgggcgcgagaacggggaggcatcggatggagacggacggtcgagatgggttgggagtggggcagcaatccgtgggtgtgggtatcggtggcttcccattggctagggtttgggtgggggtggttcgatgggcggaagcaccgggaggcatcggatggagacggatggtagagatgggttgaaagtggggcagcaatccgtaggtgtgggtatcggtggcttcccattggctgggctttgggtggggtggatcgatgggcccactggttagttggcggcgcgtgcgtgtggcttgtttttctcttactgcttcaatctatttttggttttgctagtaaaggttaaattgcgaggggaacgagcgagagtgtagtacggacggagggaaatggtaaaaacacaattttggaaatatagaagtttaggagctccgttaaaaatggtaaaaacacaaatggtaaatatacaaatgtggaaatacaaatttgctctaatttttatttaatttctgaaaatgcattatttaatgatttttaatcccgaacaaaaattggggcgttacagccagtcatggatttgtaaaaattagattcatgccattcttagagttgtcggtttagaaatactttatgccgttatcatcgggatagcaaaagcacaagcccatctcacctgtgtttttttattgtacaattgctaagatatgtctagttttgtggaaaagaattattagtttctcttcccgacttgcctaaatcttcccttattattgatgcaatgcaaataaaagaaattccagaaacaagtttctgcatagacactgcagcggtccatgtatgccgaaaattcaaaccctgctgaaactgtattgttagttgagagcaaaatattagcctgccagatccaacatatctcaaaaaattcaaaagattaacagaacatccactctcaacaattcattcagaaatcccaaacgacatagcctttccattaagattagcaaaccataacgattacagcatcacaggataaaataaaaagccagttcacccatcaaacctgaccaaaacatctcctaacctacggacatgaatttaaaaatgtgctagtagccaagaacacagacagaagaagcgcgattggacaagatgatgcccccaaacctaggccttctcgcccctgatgcggcgcgcgagctggatgtccttgggcatgatggtgacgcgtttggcatggataacacagaggttggtgtccttgaagagccccacaaggtaggtctcggcagcctcctgcagcgcaaccacggcagagctctggaagcgaacataggacctaacgtcctgcgcgatctcctgcaccagccgctggaaggggagcttgcggattagcagctctgtgctcttctggtatgtgcggatctctcggagtgcgacggtccctggcttgaagcggtgtggcttcttcagccctgccatcgtcggtgctgacttgcgtgccaccttcatcaccagcagcttcctcggcacattgctggcggtggacttcttcgccgtctgctttgtgcgggccatctctcaccgaaggagaaagagaggagaaggaggaggagaaggagaagaattcanggtgagatttggatttggagcggactcaaggtgaatttgcgggtggtttgagtggtggatttggtgggtatttgtaggggaaggaagaggcgaggcaggagtgggggaaatctttggggcgg

SEQ ID NO: 1850 - DNA, 2000 bp, Oryza sativa
  misc_feature (1848)..(1848): n = any nucleotide
  misc_feature (1892)..(1892): n = any nucleotide
  misc_feature (1948)..(1948): n = any nucleotide
  misc_feature (1950)..(1950): n = any nucleotide
  misc_feature (1994)..(1994): n = any nucleotide
aaatgcagcggaaaattaaaagataactggagctaagccttgacttggaccgcagcgggatcaccactccacaggcatcctcgacggcacggctaagcctactcctcggagaagccaccatctgacgcatactcaaactctggggtttggggaaaatagagcaagactgagtactacccactgtactcagcaagtcataccggaataggggtatgatgcagggaattatcaagggatagctacagaggttcgtttgcataaagcgagcatttataaacagtagttggaagcagtaaaacaattgtaacaattaatcaatattaatcttccactgtccaacgctacaccatgttgcaacaggcccaaccatccacctagactactcaaattcaatagactagactagggtgaaactaatcatggtgaatctggttgaccgcccataaccgcgggcacggctattcgaatagttttactctgatcagaggtgtacaactgtacccacaagacacagccccacgacacgcttccgtgcaacgacatgccaccacgacataccggatagaggccgtgacaggacccttcgcataaccccctctaaccaagcacaccacacctcaggtttcacccccactcctcgcaaggcagcggacagtcccctctcgtgcctaggtgaatccggaagccgcataggccgtcgcagggcctggatgcgtcagctagaggaaagctacactacaagcccagccgttgcccacgttggcttgtggtaagtacgaggaattcttccagggtttcccacaaaccggtccttaagtgccatgggcgcgactagcaaaaccatccacccacaacccaccatttaacatattttaatgaagcgacaccaggatggtggctctaatccaacatcaacactagaacctgaagtctatacattaatatgatttcccccattgtgtgctagttgaactaagcatggctaagcaatccctagtccaatatctagtcatgttatatcccaagctaacaaaggaacatggaacaaaatagcatggctataatagtaggtaaacatcccacggtaacagtataaaataatgtagtatttgaaagaaaacaatagagcatttgcaatataggatcaacatgttcaagtgacaagcatgacttgccttgctctgctgctggaggaacctcggcgactatttcaaagtacaccggagcgtcgggagagccggaatctaagcggcatacaaagcaaacaatataaactggctataagactactgaaacaaagaacaaaaccctttttaatggattctatgcatttttcttgatttactgagacttgaatgggcttaaagggagctcggatgaatcagatatgaattttagaagattcactgtgtttttactataacagaaaaaatccttaattgatttattgagcaataaataaatcccgggagagagaggggcggtgccgacatgcgggccccacatggcagtggctgcgagcgctggtccaggggaaaaggggcgacgcaccacgtggtgacatgtggcgccgacgtggcacgcacgtggcggcctcgtggcagccacgcgggcggcgggatcggatggccccgatctaccgcctggtagatcggacggcggatgcagctcgcggccggcgcgcacgggcacggctcaagccggcccggcggccatggcgcgcggcggcgaacggccggcggcggaggacggcggtgtcgtggcgacgcgggcggcgatagcgacggctaagcggctaggcggtggcccggcggctaagcggcacggaaaaaagggaaaaaggggagnagggcctcaccgacgacgatcgacgatggcgaccatggagggcnatgccacggcgaaacgagctccgggaccacctaagggatcaaaagggatgagttananagggagagggaaaccatggatggctagggcggtgaccgaaggcnccggcc

SEQ ID NO: 1851 - DNA, 2000 bp, Oryza sativa
  misc_feature (14)..(14): n = any nucleotide
  misc_feature (157)..(157): n = any nucleotide
  misc_feature (1542)..(1542): n = any nucleotide
  misc_feature (1546)..(1546): n = any nucleotide
  misc_feature (1935)..(1935): n = any nucleotide
aaaaaaggaaaacnaaaatgaaaaggggaacgggggagactgcgctgatgacatcgcacctatgcatggctgcgacaccaccgcgcaagaccgccgtcgaccacatctgcacctcgccgacgcacggccgagccccgccggccggcaccgggcctgngaatcgccgccgaaaggccgagcccgccggtcgaccgagccgtgccgccgccatccggccgcgctggtcgccaccagccatgccaccgcacggccgggacggccggccatgcccgcgtcctggccgcgccgccgccgtgtgcccacatgccggccacatcgccaccgcatggccgtgtccgcgttgctgccgctgcacggtgtcacgcctagaaattcccaaatagaattccaagcagaatgtgcattaaaatccccgtccaggaccggccggggtacacaaacgacaaagttgacatacagatccacgtcttacaaatattataaaagtcttacataaatgcagcgaaaacttaaaggataactggagctaagccttgacttggtctgcagcgggaacaccactccacaggcatcctcgacggcacggacgagcctactcctcggagaaaccaccatctgacgcatactcgaattctggggtttggggaaaatagagcaaggctgagtactatccactgtaatctgcaagtcataccggaatgggggtatgatgcagggaattatcaagggatagctataatggttcatttgtataaagcgagcatttataaacagaagttgaaagcagtaaaacagttgtaataattaaacaatattagccatccactgtccaacgctaaaccacgttgcaacaggcccaaccatccacctatattattcaattccattagactaatctagagtgagtctaatcacggtgaatctggttgaccgcccataactgcgggcacggttattcgaatagttttactctgactagaggtgtacaactgtactcacaagacacagccccacgacacatttctgtgcgccgacatgccaccacgacataccggaaagaggccgtgacatgacccttcgcataaccccctctaaccaagcacaccacacctcaggtttcacccccactcctcgcaaggcaacgggcagtcccctctcgtgcctaggtgaatccggaagccgcataggccgtcacagggcccattcaaactccatcacgcccacccttgcctggatgcgtcggctagaggaaagctacactacaagcccagccgttgcccacgctggcttgtggtaagtacgaggaattctcccagggtttcccgcaaatcggtccttaattgccatgggcgcgaccatcaaaaccatgtacccacggcccaccatttaatatattttaattaaccaacaccggagcggtgagcattaaccaacatcataactagaatctgattaatgtagtccctcattgtgtgctagttgaactaagcaaagctaaacattccctagtccaatctctagtcatgttacatcccaagttancaanggaacatggtacaagatggcatggctatgacagtaggtacgcatcccatagtaatattataaaacaatgcagaatttgaagggaaacaatagagcatttgcaatataggatcaacatgttcaagtgacaagcatgacttgccttgctctgcagcaggaggaacttcggcgactatttcaaggtaaaccggagcgtcgggagagccggaatctaagcgacatacaaagcaaacaatacaaaagctataagactactgaaacagagaacaaaaccatttttaatggattctacactttttcttgatttactgagacttgaatgggcttaaacggggctcggatgaattagttatgaattttagaagatttactgtgtttttactataaacnaaaaaatccttaattgaattattgcgcgataaataaatcccgaggagagagagggggtggcgccg

SEQ ID NO: 1852 - DNA, 2000 bp, Oryza sativa
  misc_feature (181)..(181): n = any nucleotide
gaagggaaaagctatttttcagacctctgtagaaggatctgacagtgaaattgccatcctttcatcttatttttctttctcactgttagaagaattgactggcattcattatttatcttatgaagctatcaaccggtaccctaacaaagttgttctgaatttaaaattaacccagtcagtngaaagagtttttgccattgtgttgtttctggtaaaggtgatatcgtgaccatctttttcattacataacccgtggttaaaatatttctgtattgtcattattctgaaggaaacattctggtaatcatggaaggaaaaaatgatggaatttaatatgtttcaacggtagatgtgcatggtattatccacataagctaatgtgtccttcaaatttcaggtgcaactttttgaactacaggcggaatatgtcgtgcttccattgtgaacacaaccgtccaccagatgaatacaccaacagccaaatggaagctaatcaatctgttccacgaaagcgattggaaagacctgctcacaaatctgaagtttgtaatgcatggaactttgattttgatgacaatgaatcagatggtgctgatgttgcagcatttgagtttgctgattcatcaaaggccaggaatagcttgtctgtggacaacacgtcttctagaggtggttctaagttctctgaggacaacgaatttggaattaatgaaacatggagagagggaacagagagaaggttttcagaaagagaaagagttggttttgatgactttgatgacgaagaggatgatattgatagttacgagcttgatttatcaaagggtggtcagacagatggaatgtcaaggatgagttatttggactttgaagatgcttgtgactcggcagacctaaatgggcgtgctaaaattaggaactctaagcacggtgaagaggaggatataatagggtctcctgaggatgaggaatttgatcacccttccctgagatctagtcatcttgctgcttcttggaggaaacctgtaagctgcaatggttccaacaaccacagaagggaatcttttggctcggagagtgatgatgggattatttctgatttggatggggatattaatgaaggattgaaattgtaaaggaggccataacaagcattatcctagaagagttgttgttaggcataatgaacttgatgatgtaccattttcagatatggattgtgacataggtggctgtgttcagtcagataggaggaacaggttctcaacaaagttcagtgatgaattccatgccagggcctccaactcaaataggaagaaaatgaatgaacgattcaagagttctgatatgcgtgatggtcacccgccctttgataggactcgtacaagaggtactactgaactacatgatggctcaagagatctacagagtaacgcaagaagaaattgggttaaaagtggtggatttgatgataacaacaggccgctcaggcgtttgaacagaagataggggaatccagttactgtgcagtccttccaactagctgtcgtattagtgttctccgatgtaaggtgcagcttttttaattggaaacatagagctatgagattgcatgcagatctgcggttgatctcaatccaaagatccacatgctaaatttcctgcatgcaatacgggattgatgctattgaatcccaaggtccggctaaaatgtgtgcctagaatatatttctagccttttctccccgactaagcatttctggtcttgagacaaagatgtttaagcattcccagtaaaataaatgtgtaagtattcatcatggttagggtcgtatgaaaagaactgttctcgattttatacgaatttctgttccatcgtattttcaaggagagggaagtatgagtaagagcttattcacatgatcacgtcatatgcttcaatgtgatgtgttgcttcttgtaataagtctgcaatggtgatgtggcgactaatgtggaaa

SEQ ID NO: 1853 - DNA, 442 bp, Oryza sativa
  misc_feature (220)..(220): n = any nucleotide
ctttaaaaatcaatggccgggaatattttgtaatattctttgtgccctaatgtactctccggaattttccgtgaattttcggagctcgagaaatagttttaatagcacaaagatcattgcatcaatttaaataaaaagaaaacaaaataaacttccccttcctccctttcgggctcggccaaattcctccccttccttcctctcccgcggcccgcgcgcntcctccctctctcgggccggctcccttcttccttggcccgcttgcaaaagtctgttttgcgtccctccttctctcccttcgccgacaggtgggaccggcggtcccacccgtcagctcctcctccttcctctggctggccggctgcaaccgccatggccgcctgagccgccccacgtcgccgcaaaatccggcgacctcccgcacccgagctcgcatccaacc

SEQ ID NO: 1854 - DNA, 37 bp, Oryza sativa
  misc_feature (4)..(4): n = any nucleotide
  misc_feature (6)..(6): n = any nucleotide
  misc_feature (9)..(9): n = any nucleotide
gggncnccnacggcggcggcagcggcggcgccaacgt

SEQ ID NO: 1855 - DNA, 2000 bp, Oryza sativa
tatggcttctagatggatactatacatatgtaatactgttgtttgctactaataagtcaagttggggatagcttggtctgggaatatggtttctttgtttgattcatgtgtaggtgacttgatgcctcgggagagtatttgcggtgatggatcgagagtcgacttggtggtaaggcgatgtccgtgactgttagatatcatgcgagatactttggctagagttcaatgcacgtggttggtgatgattctatatggcatatgatggaggtattgtgtacgtatgggttgtggagtcgaatttggaaggagtacaaatttggtatgattggttatgtaaagtttatttcttgtacgagaaggtttcctagggtgattagaacttctagtatgagtttggttcgtggctttaggctgcctacctcatatataaatagagagggagcgtgagacttcccggtatcgcttctaagagaaattgagtttctagtttagttagggttttgagtttagtcgaaatttttgtaaggagtgctgttggtgtactttgtaaacacagagaaaagcaataaagttgtcatctactttgagagttcttctatttgtgttttcttgggtgccggcggtccaaccggcggagacaccggcagtcagaccggtggcatcgcgtcggtcagaccggcggaggagcggtgctcatcaaaccggcggcggcgacaggagctggcaggcgatctcagcggttcgaccgaagttccaacttcggtcagaccgacgttcttcaggcagtcagatcggcatatacacttcggtcagaccgcaatctgtcgaatttgagggtaacttttaattccgctaaaagttttggtttttgggtaagccaaccattctcccccctttggttggcttagttcttgtgtttcgatcctacaaattgaattaggctctgttaagaccccaccgtaaaatttttcatcctattatattgaacgtttgagcacctgcatgaagtattaaatatagggtaaaaaaataactaattgcacatattgcgactaatttgcaagacaaatcttttaagcctaattgctctatgatttgacaatgtagtgctacagtaaacatttgctaatgacggattacacctctggatctaaacacccctgagtgatttttcaggtgatcgtcagttgcgctctgtttctagctgaggtttggtgtgtattgtagagaactgatttagcttctcatgatgcttaatttgcataacgttttgcccctggagggcatttccttttgattaaattataatttagtggatgtttttatcagtttactttttggtgctgtatggtgtctctgagatggtttctgaaccattgcatgccttctgatcttactgggagaccatcatcaacgttgtccaagaaacgaaggaaaaaagaggaaccgtttatatttaagaaaaatatatagtgaaaattactgttgaatccaaaaatagacttttaaaaatttgtctacgtcattaagactcaagagtaaaaaaaatttactcccagtaaaacttttactcataattaaatttacaagtaaaacttttacccttgataaaattaacaaattccatgcatctatttttatctaatgataacttttaggtttgcaccacatattttcggtttatctgtttcaattttaaaagctgagcagttctgcagttgggacttgcagcgcgaggggaggagagagaatacggctttttgccgccactgccactcgtgagacccccaatcctcgcatgccaactcacctgtgttgcttttgccggtagctatatggggattttttttttgttgactactagtctccgtttcagcgaaatcaagtgatggaatggaatagcgcgaaatggatttttcaaccgggtttagatcaattacctttcaccttctcgtctagaccagccaaagccatagccgaaactcacggtcacggtgcgt

SEQ ID NO: 1856 - DNA, 2000 bp, Oryza sativa
cccatccctatgcgctgcaaattaaccccccaggtgattagccatctaatccatacaattaactcattagttagttgcaagttgagcctatacataactgaccaatagattttagttttacgtgattacctgagttaattaatgtaactaagcgatgtggttgcaagtctccaaaactaaatcggataaatagaaatgatgtattgtcattcatgtattcaataaattcggtgctatttagttgcctaattttaaaaaatgattcttttatgttatattaatgtgcattcggacatacaccctctatcctaaaataagttcagtttttttacatgaacctagaagaatgtgttgagatatatctaaagtcatatcaacaatcaatttatttacatattagtgcaaaataaccacaaaattcaaaatataattatacgaggtgcaactacacatattaaagcgaacaagaggtgaggtgaggccaatctgccactcagcatgaactgagccatcaagatctacaccattatctaccgagacgctggcgagttcttacatctcatgaccagcacaccctatcactaaatcatggcttcgccactgcctctactcctctatatgataccttatgtacacatacctatctccctcagctcgaaataacgtgaacccagatgtatactgaaagatattttcaaatatggatgcttacatgcatgagaagataggacaatatctcctcgataagaaagactatgcaattcgactcagctttgaagggactacttcgcccatatcctatttaggaattctgagtcctacttatttaagagacgatttttgctacaaataaaaggcttccgaggaggggagcgtatcctatacacacaggctcttgcgtgtacacaccgtgtataccaactaaaaattatcacaaaaaattctaggaaaattcatacatgtactttcaatataattacatctacgtgcaaagtcgtatcttcaaattcattctacatagagaataacaaaaaagataaaattctgacaaaattgcaaccttaaaactgtcagatttttttttgttacgactaaaatataatgaatttgacgttaagattttaaccctaggtataatacaattgaaagtatgtgtatgattttttctagattttttggtgatattttttaagttggtgtgcacgtgtgtacacgtgaggacctgtgtgtataggatatgttgcctccaagaagagaatggcttataatattaagcaatagacatccacaagccaccatcttcacgacgattctacatatagagagagcccacaagtagctgccaactacattgctactgtaacttctaccgagattagttgttaggctagacgagagatcccgcctcatactttatatatactctgtgtgatactagatcccaaacagggtttacatttttggatcgaaatttctgaaatttcaaaaatttcggttctatacaaacccccgatacgatattattttggtcgaaatttttaatttttttatattttttcgtgaatttggtaatattttgtttaaattttattaaaaaaaattatataatttcagcccgaaattccaccaccgataaaaacactaagtccttgttcgtttctgcttgtagcggaggataaaattttagattatcgtgccacatttttaaactgctaaacaatatgttttgtgcgaaaactttctatatgaaagttgttctaaaatatcagatgaatttatttttcaaatttgtaataattaaaactcaattaattccacgttattatcacctcattttacgtgaaacacttaatctttatattcatcttcaggagattcaaacaccacctaaaccgaaagattaaaccattatcccaagcctctctcgccagcgtgcgccgccgctgccaccggctttccgtcgtggttcgccacacgctggcccgcctccatcgcacaag

SEQ ID NO: 1857 - DNA, 2000 bp, Oryza sativa
ttttcatggctcgggaaaaaatataattccctcatttcttctcttatatatcaaagaactttacaatgttctgtcgatgtgtcatatcccttaaaaatcatttataatatgggatagggagagtaataaaagcatcgccggagctgatccctggctccctgcttgtacttgcacgtacggtcattgtctcattgatgttcatagctgtacaatcgatgcatatcatgcatatacgttatgggcaatggttatcaagttgcaaaacgcatgaaaaacatataaagataccgtacacctgatcaatgaataagagggtggaacccacaaatgcgtcactcaactggcacgcgaatttatgttgattataaaacataatattttatcagcaacataaaaatgaattcatggataaaattttatatacgtgtcattaatgattttaaaaccaatgttagaaacaaattacaattgaaaaaaccttaaaatcaacttaaaagttgagttttaaaatttaaaatttggcaactgcctataagttgaaaggcaacaatgaggctgtttgttgcacaattttacacgaggttagatttaaaagtgcgattggattttgaaggtgtgaggaggaccaagaaatgatgcaacatgccattatttagagatgatggctatacttctaatcatggatggaaatttagcaatacaatttgcttctaaaaatgtcttatcattcgagttatgttagcaaccgttaatgcttttgcgatgcagacatatgggctgcggaatgtataatattaatagcttggttatagcttttaattaataaataaatgaaaggttaggattatcctaatatctataaaagattggattttatttagcacaactatttatttcattttcatagatatatttgtacgcattgattaatccttccgttatacactagaatgaatcatttgcaacatctcttagggcagtcccagccctccatctaggatggtgtctatggcattaactacattgccatgtaggacttttagtttatgtggcactatattaattgagagagagtgaagagaggaagaaactgggtctcatgcaagacacaacttcaacacgagaacctatgcactagacactatcaagttttgcattgggagagaattatcaagttttgcattgggagagaatattgtcttcataatagataaagaataaatatgattggtagagaagaaagatgatgtatttattaatggtctaatttaagaaagtatgggttgtagagtatagtttctattgtgatgtcttattgacatggcaccatagacactacttatggacaccataggttgggactgcccttagtacctgttcctttcaaagcggctattgctttgggcaactcctttttgtttgttaataggtttactggacggctaaacggagtatgttttatataaaaaataaatttatttttaagcttatattaattaatacctaattaattacgagctagattcacctttgtttccgagcctgtaaccgttgattcaagctacatgtggacttgctttttttagtggtttaactgttaaccgtttctgggtccgttacagacctgacaggtagacacgtagctgaaatcagaggagtccaaggtccaaatccaactggcatgcccagtcaccacactgcttctgaacacctggacggttcgatcgtacagtcaaacctgccaaacagcgtatccacctggccggacagcggaatccacatcctcccgcgagacccggcgcgcgccacgctatcgcgacgttctcgtcgatcgtcctcctcacaggtcacagctcacctcgacttgaccactcctacacggccctttactatttagtacgactccgcacgctgcatgcgcagggaagacgactagccaaggcgccctcgcctcccgccgccgaccacgcgcgctatctgcatgccaagttgccgagcta

SEQ ID NO: 1858 - DNA, 2000 bp, Oryza sativa
  misc_feature (709)..(709): n = any nucleotide
  misc_feature (820)..(820): n = any nucleotide
  misc_feature (1266)..(1266): n = any nucleotide
  misc_feature (1900)..(1900): n = any nucleotide
  misc_feature (1910)..(1910): n = any nucleotide
  misc_feature (1933)..(1933): n = any nucleotide
atccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcgtgccgcggtgaatccngcagccgatcaaccggacaccccggccgacccaactccatcacgcccaccctcgcctgggtacgtcggctagagaaaagctacactacaagcccagccgttgcccacgctngcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcaatggcataagggaaacaacatatagctgagtaataggacccatcccacatgatattgtaaaacaattgcaatatttaatagaaatgcgggacatttgtaaattaggtacaatatgatcaattgcaatgtatgacttgccttgctctcgcactgatgagaccacagcaacgtcttcgagnaaccacgaatcgacgaaacggccgaaatctacgcgacaaacaaagcacacaagcaaaacatgctataagactactgaaacaggaaacaaaaccatttttaatggattctacacatttttcttgatttactgagacttgaatggacttaaacggagctcggatgaattagttatgatttttagaagattatctgtgtttttactaataaagaaaaacccttaatcaatttattgcgcaataattcatcccagggctgacgtcagcaaggggtggggcggcgccgacatgcgggccccactggtcagcggcacaaggggagagggaggggtactggcaggcggggcccaccgggcagtggcacaaggcgggaggggcgcggctggtggctcggctcggcttcaagccggccggccggttatggcgagggcggcggcgcgcgcgcacggttgccagcgacggcaaccggcgacgggaggcggcggcggacggcgcaaagacggcggcggcggccgaagcggcggcgcgagcgaccctagcggcggcgctacacggcgggcggcgcggcaaagggagagagaggaagagagggagaccgatcctcaccgaggggctcggccggcgcgagggaggagcnacggcgaacngcaacgatgagagacgggaggangacggcgacgggctccgggaggacctagagaaaaggttgggaggggttagagagagggaggtggtcc

SEQ ID NO: 1859 - DNA, 2000 bp, Oryza sativa
  misc_feature (140)..(140): n = any nucleotide
  misc_feature (303)..(303): n = any nucleotide
accaaagacagcaattgctggacggcgaagtgtaaagggtgacgaaaccagggatgacgtaatttcagttttcaaatggtccgtcgtgccacattcgcaattaattccaagtgtcccctcctccaaaaacaaaccaaatnaaaatctctatctgaatactggaccaaaagggaccaaaaataaaggcattaaaaaaaaggagatgagaaattattcatcaccaaaatggggacaggcacatggtgcgagccaaaccccatccacagcgtcgtttactcggatcagactcgctttctccacgtncacacgcgtacaccatcaatgcccaacacaaggacagcgacatcgcttcccgtactgtcatttgtaattaacacgcgattaattagcataaccaaagtcattacgagagtgcttactgagtaggagtaatccataaaggctgggttcgttcctagggttcccaactactccctccgtcccataaaaaaacaaatctagaaccggatgtaacatattctaatactgtgaatctggacgaatatatgtctagattcattgtaataggatatgttacatccagtattagcttgttttttaataggatggaggaagtactctgcagtgcatgtgaaacgaaactatcaattaacgcatgattaattaagtattagctaacttttttaaaaaataaatcaatataattttttaaaacaatttttgtattttttttttacaaataacgcatcgttaagtaatttaaaaagcttacgcgcggaaaataaaagagattagttggaaaaacagagtaacaaactcaaccacttatggtggaatcagaattaagtcataaccatcatatatgtattctttctacccatcaacagcagtaagacgtttcttataacctcatcaatttcaagatatatcgctttaatattttgtagattgcttattagaacagacgcacatttatatgaattagtgtacgcgtttgtggtgtgtttgacgaaaaggttactaagggggtgtttagatccaggatgtaaaggtttggtatgtcacatcagatattatatagggtgtcgtatagagtgtttggcactaataataaaactaattacagaatccgtcagtaaaccacaagaagaatttattaagcctaattaatttatcattagtaaatgtttactgtagcacgatgttatcaaatcatggagcaattaggctcaaaagatccgtttcgcaaattagtcgcaatccgtgcaattatttttttaaaactatatttaatactttatgcaagtgtttagacgtttgatgtgacatgatgtaaaatttttaggtgggatttaactgcctcatcgtttggcctttttcgtaataagccaaaacggcttattagagaataaaaataaatttgtaggtaaaacttttatatatgtgttatcggtgacttaaatgtcaatgctgaaaaagaaactacgttgaaaatatctcaaaatcaatattaaaattaagtttgaaaatttaaattttggttttttcttttagctgaataggccatccgatgggtgcctaaactaaggcctagcagatcaaatacacaacagaagtagtagcgtgcgtagcagtaattaacatgtgatcgccacattaaaaaaacgaagcgataataatcagtggtggccggaggcatcaatcggccgggctcgcgcacgcgcacgttgtcctcgcgtgcctggctcggcgggcccacccgcggttgaattcccgcacgttttccgcctggtcgccacgcggtcccggagaccagacgcgtccgtgtccaggtgtgggtgtgcgcgtccccccccgtgggccccacctgccagcctcacccctctcccagtatatattggctcggcgactcggagagagacaagtgagctcggagtcggagagagacacaagccaacctcgaactcgaagcagagcaaacgcgaagcagagcaagcgcc

SEQ ID NO: 1860 - DNA, 2000 bp, Oryza sativa
  misc_feature (348)..(348): n = any nucleotide
tcttcctcttcttcaaccattcaatactcgtaactcgtagtaacatgacaaataaaatagggataattacatatgtacccctactttaaaagccaattgctgttttacccttatttttcagggtttgcatttttacccccactttttaatctgaagcaaccgtctaccctcacttgtgacagccgtttgatgggtcccacattgtgcgttaaagaaatacaaaggaaaataaaaaaagggtaattatgaaattacctttgtacccctgagagtggatagggttgagtgagtcttccacccgtgcgtacgggtaaagaaacagtagaatcctagcgcgcggcgcgcgangcgacagcgagagcgcgcggcggggaggcggcggtggccgagggcttgcggccgcgccggcgcccgctccaggaggtagacagcccgcctcttcttcctccgcacggaacagtgcctgcgcgcgcgcacaggacgggaagccctggcggcgcgcattcgctccgctccgctcgtcctgccaccgctcgcggtgctgctcctcttcgcgctcctcgccgtcgcggtggcgcgggcacgcggccgcggatggaggaaccatgaggggaggaggagagcaacctccgcctgccgtctgagcgcggcgtggcggatgacgcggtggcggaggacgacgccgccgaggacaccagatgggccgtcctcatcgccggctccaacggctactacaagtaccgccaccaggtgattttgctcgcccgcaacccctcgaaaacaaaccacgctctcgccgcgcggttaatcgtggcggcacgtatggtttggtttggttcggtttgatccttcgcgtgtgtgcgctcttcgttcggtttgatttggttggtttcacgggattggttccatctccaccaacgcgcgcaatcgccgcagaagtagaaaccctgagccgtttcgtgttgccgcaaattccaaacgtctgttaaatctctcgttaatctgattcatgataaacgtaatccacaattaatttgagattactgccgtgaagagagaattcgtcgtgaagagagaattcggcgtgcaaaatcacacgaagctgaaaaaattggagcaaaattgcaataaccactgagagcataattgtccttttcctctacaagtaacacagataaaaccggctgttagaagcaggggcacatggctgcttcagattcaaaaagtaggggtaaaactgcaaactctaaaaaagtgggggtaaaacagcaattggcttcgaaattggggtacagatgcaattgccacaataaaatattatccacatatggcagtgttcgtttctaaaaaaaataagaaaaccattaacgcatagttaattaatttttaagtattataaatttgaaaattttatttcatattttaaatcaacttttatatataaaattttctcatagaatgtacctacttaaaaccatggtaataaaaaatgaggtaaaatttatatcttaacgagaaaaaaaaattagattcatattactatcaaacttacgtaatgaactaccagtgattctttgagattacgacagaatatcgctgtatcagttcacctccctaacctttgcctctcactcacacaaagtgcaaaccatattttcgtcggtctacttctgggaattcgttgtgagcgtgcgtcgcaaccaaccgtttctcacaacagcaaccactcaccgaacgaacccggcccctgggccccaccgttgcagcccaaccacacaccgaccccacctcatccctggccccacatgtcatccacccaaatcacccacttgggtcggggtgggtcccaccacatctctctctctccctggctctgattaatttctccccaaccccactcactcgccgcgtcggcgaccaccaccactcgagctctaaatggcagccgccactagatctcgccaccatcaccgacgacggcgacctcaccgccgccgggg

SEQ ID NO: 1861 - DNA, 2000 bp, Oryza sativa
  misc_feature (1347)..(1347): n = any nucleotide
acggccgccctcggctcgccgtcgatggcgaacccgccggaacccttcgacctttgcttccagaatgcggcggtcagcggcgtgccggacctcgtgttcacgttccagggcggcgccacattgacggcgcagccgtcgaagtatcttctcggcgacgggaacgggaacggcacggtgtgcttgtccatcctgagctcgacgcggctggactcggctgatgatggcgtgagcatcctgggaagcttgctgcaggagaacgtccacttcctcttcgacctggagaaggagacgctctccttcgaacctgcagactgcagctcactcacctaatggctgcgagatttgctcctgtttcacgaaaagtacttcgaggtaccagtatctcactgtactaaatcgttttcaatcgttggatctagttggacaggatgtgcattgttaaatccaacgatcggaaacgatttggtatcgtgaagtatcagtatcttaaggttctttttattggaccagagcaaatatcaatggctgctgcttcttcctggaagcatatatatggtgattgatatatgtacacatgtatgcagtgaggtgtgtgtgtgtttgtgattattgccagaataaacgcagctatagacggcatgtgctgcggtatgttttactgtgctcttcagtgtgtgtcactcactcacctgcgtgtgcttgtcatcataggctgatatgatgtcagttatatgtgaatgtgagtgcagacaatatccagtcctgatctggagttcatgtgtctaatggttcatcaaatggattcattttgtctagcatagtttcctgtggcagaaataatgctatgaatgctgttctgtaaaagtaaacataccataccagtggagtgcatacagagtatggcttcatacctcaatttcaagtggtgatacatattaacagcttcagaaacaaacaaaaaaatgattattaccgcagtcaaccctaacacacagaaatcagtaatcaaacctttaaaatcaagcaggtcaagtaccacatggtctaaaaaaattgaaacacaattgtaacttgtaagacatcttttcacggcattttcgcatattgtcaggagactttgtttaagatatataatcttgccttatgactactgcacggtaagaacaaatatgacaactggaaatcttaacagcaacataaggatatgtttgacaaagacaccttgcattctgaaacacccatgcactggtgcatggatgctcagacaaagaacttccacaaaagccgcatcacactgccctactcgaggtaaataatcacatatatgtagcatggagagtgatcacnaataaacataaaattatcatggcgacatcagacttaaaagtacaggagcagaggcattgtgaaacatggtactccctccgtccaggattataagagattattccctatttggcactcattaaggaagagaaaaaaatgcatctagtaatatgtggaagtacacattggcacattaaataagctgcagaatgtacttatttggagtaaactattgcttttggcaggaaaaagagcatctaaggacagtgacttgatctctgctgtactggataaccaaaatcccctgaatcatggacaaaccaaggcgccattatccactataattgtggccagagggagtacctttgttgctcggagaaattttcctttcaagaagactcgaaagaagaatatgtacgctttatagtgcccaggttttagcaaaatgccaagaaatttgatcaattttaatcatactgcagacatgtgaaaataccatatgggcaaaaggatagtggttcaacaattctaacacaaggatctaaaaagtaaatgaacagattcactcaaaaaagagtgctagtaaaagtatgtcaagcttgcttattactgtaccataaaaaaattgcacggatcaaagtgacaaataatcagccttcagggttcacgcagag

SEQ ID NO: 1862 - DNA, 1015 bp, Oryza sativa
  misc_feature (36)..(36): n = any nucleotide
gcggcgcgaggcgacggcgtgcggcgaacggcgacncgggcctcggggcggccggatccgtggtcggcagccctggtgccgcgggatccgaggtcgtgaggcgacggcgacggcgggggctcggcagtgcgaggcgacgacgtgcggcggacggcgacgagcggaaccggcgacgcggccctcgatgcggccgggtcacggtgacggcgggaactcggcagcgcgaggcaacggcttccggcggacggcgacgccggcctcggggcagccggatccgtggtcggcagccccggtgccgcgggatccgaggtcgtgaggcgacggcaacggcgcgaggcgacgacgtgcggccgacggcgacgaggggatccggcggcgccggcctcggggtggccggatcacggcgacagcgggaactcggcggcccaaggcgacggcgtgcggcggacaacaatgatcgtttttgagtttttcgatgttgttattttggatttggctgttgattttttttctggatatccggcaaaaaaaggtcgtatagtttccgaccgaatccgagttccgacggataccatcgctactgtattcgaattcgtatccgagaaaaactatccgaattcgtatccgaatccgaaaatatccgaaaaaaatccgaccgcagcaatccgtattcgaaaaacaggatcggaattcggaaattatccgtaccactttcatccctacatataggatgtagattgtgagtacacgtcaactcgcgtgaaaaaaaaaaatccaaccaagaattttattaactgttgccgaatacgaatatctcgttggccatccatgtagcagtcgggctgggccggcccagcccagaccagcccagcccaccaggaagaggaaactgagtcagagtcagacatgggctgcctctaatatacagtgcgtcgagcccgaagatgatccgtctccctttcttctccccaaagaaagaagcgagagagagagagagaaagcttcgcaggcgacg

SEQ ID NO: 1863 - DNA, 2000 bp, Oryza sativa
  misc_feature (541)..(541): n = any nucleotide
  misc_feature (548)..(548): n = any nucleotide
gtcgcccacagcaacctcgcccaccgccatgtcatgggaagtggagagaaggcaacggcgaagcatcgatgatagaagcttaccgaccacgctgcctatattcactgagagagtcattttacaccagttttaatagttgggagtcaagatatcctaatagttgggagtcaagatatccggtattgcagttgatggatacaaaccagattggactagtaagttaaagtgcaatattataagttcgctttaggttcctcaatttgttactgagtccgagactcagtaggtcccacttgtgtcaaccaaaactgaccattatattatatttggttcaagatgttattttgagttgtgagatgagctgtaccgacgaatctcagactcgataacaaattaagggacccaagtaatcttattgaagtgcaattatacctttagattgtatatacatgggccataaatcagtatgggctgaaaacacacttaaaaaggccgaaaaagaaacgccgttgccggggatcgaacccgggtcacccgcgtnacaggcnggaatactcaccactatactacaacgacatgcttgaggcaaaaatgctcctaaaactaacgtttgtttcactaacactgtagcaatcgtcgtcctaaaaatcttttgcctattcaacggttcagaaactagtgactgtatggaagcagcaacaagtccgttccaggtaaagatattaaaatttatccacaaatataagaatttatagagtactacctaccattcacagaattcatagggtactacttctcatttactcctttctgagtgaattacacattgggctacctcttattaccagagttacacattggactaggggcaaagtaatatttgcactttgcactagacaacttcacacaagtttcagattggaccagtgtttcctcaatctcccttctcttctcttcctcgttgagctcgttgagctgaagccactatacgtgagcttgagtttgagcactaccatgtcctcccttgtattgatagctaaaattagcatgctaggtgaggtgatacgattagtttaatttggtcattagcatactaatgatcattgatagcataacgagaacatgttaggagagatgataatagcagcaaagagaggggcaacggtgatgggctgcctgacttggagacgatgagggtgtggtgaagagtgaaacaaatggcaaggttatgtagtccaaagtgaaaatcatgactaagatcctgtccaagctgcaacaagggtaaaaaatacatgacccaaactgcaatttactccttttttatcttagttcaaactacaatctcaactagcaatttatagaaaatttatagaaaaatagttcacatctacaatactaaataaatgcactgtcaagacttattttatggtggattttaattaaactagtttgatgttggagtgaaatgcatggtcggttcttatagttacacggtggtatcacctaggtcccacatcgtgtaaaatacataattagattcataattttggtttgatgtatcacaataggcccaaacctcgtttgaccatgtatgactgcactactgatgtggcgctccactggcacacattttgcatttacccccctccccccaacaataggatgggttgcacaagagagtagacgctagacagtgaacacaagtgtggatccagccatgtccactcttagcgatgccggtggtggtccaggtgcgcgatgagcaaggtaatgggaggttccatcaccaccgatgcatagggtggctagtgcagagcttggaggccagggatgggtggggcagcgtagtggtggtgtgaacctcctcctcttcacgtatatcgcccccttctctcctcccccttcctgatgtagccaccagtgcacacctccacctgtccgacagcgcagaggcaacgccgatggtcgctagcaccatgtctagtgtggctggtgctcag

SEQ ID NO: 1864 - DNA, 2000 bp, Oryza sativa
  misc_feature (1814)..(1814): n = any nucleotide
  misc_feature (1817)..(1817): n = any nucleotide
aattagtgagctatggtgaaaatgatttactccaatgccatttgcaagattagtagttgtatggatctaaagcgatcacaaacaattaatgagctaaggggaaatgatttactcctataacatttgcaaattagcagttgtattgggtctaaactctaaagcaaccaggtattggatttgtgtaattgcaccttcggctttcctggccctattgtagaacggcacggccgtgtagactacgcctccaagcaccatctgcaccctgagaaaaatacgagagatatcaatcgcaatggttctcagaacagcagtacaatacggtatttcttcccccaattcctaccaaattggaagcatcggtaacggcgagaacccaagctgtcggtggccggcgtcagcggcagcggcagccaaatccgccggaactatgtcagatttccccagaacaacccatctgaccacacaaaccaaccatcttaatacaagcccttgacctaaaattctccaaaaatcaagcaagagaaagcgctgttcttgctcagagaccacatacccggagtcgatgccgctcgaatctcccgcaccatcgccaggattcttgatcccgctgcatcgagacggagcaaatccaacaaatcactcgatttcacatccaactttggttaaaggtaaaattctttagaaataagcaaccaagggaacgcataccttgggtcttcctggccgggttgcgcggcggctccggtcgccggcagcgtgagggttgccatggggagagatcaattaggggaacaagcggtaggtggacggagggaagaaacgacccatatgttattgccgtgttctatcgtgtttctgatgaagtgattagtcatccgcattaaaaattcgataaaaacgacttggagtagtagaggaggaagaggaacgagtacaatttacgcatgaggattacctgatgatcaatcaatcgctttcgtgacgcagaccttaattacctcccgtttacgtgggcctgatgggccgacttggcacgtactccttcgggacggcccagcaattcttatgctggcccgggtcatattttagtcctcccctcttggtccagtactcccagtcaaacgcagcagtgtcgtttcaaaatcgcaaggagaattcagagaccatcaaatacttggcggtggaaagtttcagaaaaagcttatcgatgatggtgattttgcgattgatctcccactgattgcgttaggatttggattaaatatattgcctaacagagccaacccgattccgtcggacaaaaattaccctaaacagcggcggcgtcacaaagtcgtccactgtcggccacataattaacccgtgcagtcgtcgtcttctccattactcgtagtattaagtagtgacacttcactgtcatggccccaaatagggccactaacgaaatctcgctgcctctctcaccaacgaactgaggccgtcagatgccaaaaccaacggggtagatctcttcaacttgctactgccgttctacagatacgggagaataactccttcagctttcctttcgcctgcagtgtttccattcaaaattaggattatcgcctttgactttccgtaaaccgaggtcgccgcctgctgctatgtgcacgaccatacgttacagcaaaaccgattgcttgtcactgagtagtgggccccaatttgtgtcttggcaatctggacccacagtatcagtgactgcatacaaaagattaggtcattctgtagctttaattttttgggcactcgtagcgtgtgtgctctccagctcnacntccacgcattcccccccaaacctttaccaaacccaacaacaacgaccaatccactccacgtctccaccccaattccaccaccaccgccgccgccgccgccgcggggtactcacaccgatgcgcgccgccgtcgccgccgccgagctgccaccgccggatcgtcgctaggtgttccgcgccgcc

SEQ ID NO: 1865 - DNA, 2000 bp, Oryza sativa
  misc_feature (1913)..(1913): n = any nucleotide
  misc_feature (1962)..(1962): n = any nucleotide
tgccgctgccagtggggcccgcatgtcggcgccgcccccccccccttggatgacgtcagccctggggcaatattgcgcaataattaattaaggacttttctttattagtaaaaacacagtttatcttctaaaattcataagtaattcatccgagctccgtttaagtccattcaagtctcagtaaatcaagaaaaatgcaaagaatccattaaaaatagttttgttctcctgcttcagtagtcttatagcctgttttgcttgtgtgctttgtttgtcgcgtagatttcggccgtttcgtcgatccgcagtttctcgaagacgttgctgtgatctcatcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattatcgtttgtgtaccctggctggtcctggacagggatttaatgcacattcagcttagaaattctggttcgagaatttctgggcgtgacacgggctccgaaactacacgcgaaacgggacaactcaacaaactgcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaaggaaaagnaaagaaaaggaaagagggagggattatagacttttcctcgggcggctanggcgcggcccaagggaaaaggagcggaccggccgagct

SEQ ID NO: 1866 - DNA, 2000 bp, Oryza sativa
  misc_feature (735)..(735): n = any nucleotide
ataaccgcggtcacggctattcgaatagttttactctgatcagaggtgtacaactttacccataagacacagccccacgacacgtttccgtgcgccgacatgccaccacgacataccggaaagaggtcgtgacaggacccttcgcataaccccctctaaccgatcgcaccacacctcagggttcgcccccgtccccagcaggcaacgggtagcccccctctcgtgccacggtgaatccgaaagccgatcaactggacaccccggccgacccaactccatcacgctgttgacgaaaaaatcgaacacaccggcctgggagatctgcttagctcctgtgcaggtccaaaggttgatgagacgcgggcgtgccaatcagtttgatcctgcaactgacaagatatgcaaattgtagacaaaacaaccaatcggctgacaagccgatggagtaattccagccgatattagccgatgccgattccagcctatctcgatagggttttgataaatcagctatatatccaatgtagaatctgacacttgatattaataatgatataaaggcaatcggctgatgatgatgtaataaaataacaatgtaatccagtataaaccaatcagctagcattgatatgataaataagcattgatccgaaggttaaagcacacatcggctggtggtccgatgtcatgaatccacaagattagattaatagtgaaccttgttttcatcggctnaatccaacttataagtatatgcaatccttatgagccgatgcaacgtccagataactcacaggctgaaaccccgatgaaacccttattggcagtcaaaaagcaggctagagattatggttctaagcacgacttagtagatcaaacttaactgatgcagcactaagtatgaaaagaaacataatatctagacaatcaagccgttgactgattttcagggtggtagatgcctaggctaatctaatctagcaagacgatttagccgataccggcaaaaactctaaaacgagaagcagccgatagagctaaattgatatgctaagactagattaacagagacatatgataaataggtaggcaaatatatcatccaaaccagagcaatccaagaggtcgaatgtactgatgcagccttgaacgacgcctacgtagacgatacaattgcctggaccggcggaacattggacttatcccttagccggagatcgaagacgatgtagccccgcgtcagctgccaagttccgccgaaacgtaaaaacaaaagtagaagtaaaaagggtggcgatgcgccgaattgtattgatcgtagtgatagattacatagaccccgggtgtacatatttatacccatgggttgatacaagtccttgtcggacaagaaagaatccttcctaaaaataaaaggaaaagataaagtccttataggacactaaacacactttcctaaagataaaaggaaactaacaaactatttctaattaatagataacttgccatgccgcattctctttgaactcggtctcttctggataagcttcctctagtagatcaatttccttaactgaatatagcaagaatccgacaactgacgacttgacaactctcatcggcaaatctcaggacttcgaagccgatgctgactctaagccgatgactactccgggcttaccaaatttcactattaacacacgcccaccctcgcctgggtacgtcgactagaggaaagctacactacaagcccagccgttgcccacgctggcttgtggtaagtacgataagttcttccagggcatcccatgaaccggtccttaatcgccatgggcacgactagcaaaaccatgcacccacagcccaccattcagtcgcattttaattgaataattacgaccatgaagcatggccatatgtcttgagcacgcagctcatcacgatactaaaaaggtctaatactgcaattatcccatcaactgagctagtggtaattaagc

SEQ ID NO: 1867 - DNA, 2000 bp, Oryza sativa
gtatggccaatttgcattaattactctattccttcataccttgggttattataatttgactagttgagctttatatattggttcagctagatgttaaacattagcacacaattgggataactaatgtttcactattacttaatgatggatatttaatgatagctcacgatggtcaatcgttggtcaatcgtgattggttaattaatgtgccaactaaaacttgataatggtgggttgtgagcacatggttttgatggtcgtacttatgacaattaaggaccggttcacgagtttcggttgtgaaacattacccgtgccaaccacaagccagaatgggcaacggctggacactttgtataacaaggctcattacggagcaccagactgagaagtggcggagataagcccacaagggtcgctggggagtccatgcctctggtttttgagggggtgactacgatccaggaacggtgcactgcttttggttgagttatgcgaggggtcttgtcacaactacactaatggtgacatgttcaggcatgggctacatgatgatatggtgacatattgtggagttgtgtcttgtgggtacagtggtacacctctggccagagtaaaactattcgaatagccgtgcccgtggttatgggcgggtcgaacaatgtctttcttgattagtcccacactactcattaataataatgtggtaattgatggtaattaatttagctcctggtttggaatggtacattcctggtttggagatagatctgtgcagccgggtatggttgttcaggatggttgggcctgagcagcatgggtgtgctgttcagtgttgattaatattgatgattaattactctactgttttacaactctcaaatgtttgctaaatgctgcttttgcaaatgagccctatattatgccatccttttggtatccttgtgcacttgcatatttgttgtgtggcttgctgagtatgtcatatgctcaccttgcaataatcaatcaaacctcagttgaagacaagttgcaaaggagaagacgtatggtttataccccagttgagctgcctgtgggagtggagctggagcttcgctagaccgtaattccgctgctgttttcttttcttttgtaattatgtaaagttattattatgatggatttgtatattaaattgtcagtttgtgtacctcggctgattcctggacgagggttttatgcacaaataagttcggaaattactagtgaatttccgggcgtgacaggggaggtgtgtgtatcagttccatcacaagccaaccattccataatgtccaaatgacatgagaactcccaaagtctaaagttataaaaccacctaatgttgcctaattaatcagcgaagcatctacgtaagttcatactagtggaaccatgaatagagtacccactagttggggttttgttttcctagggtgaacgaggtgataataggaagtgctaaataaaacagtgataacgcgggaatttaaataaaatggtaatgcaataatttaaattaaaataattttaaaaactgggattcaatatgctcaaggatgatgagacttgccttgctcagagagaacagccttccgaaccttcggtgacgaccgcgaatcacgcttccgaaacctccggaatgacagaagctacacgaagcaaacaagcaaagctacaacctataaagaagtaataacaatacataagaagaaagcacacggttctttaggttataacaaacattaggagacttgaacgggtcgattcgggattcgtatgataaagatatgatcatacgaagtttaatgctgttatatggagatttacggattattatgattaggttttgcaattataaaacatgtgcaagcgctagcctggaaaagacaggaaggctgcgctgctgacatgcggaccccacatgtcaacctaatggacgacggtagaccaagtacacagagacgatccacgggacg

SEQ ID NO: 1868 - DNA, 2000 bp, Oryza sativa
tgaaagaagaggggtgggcacgggcatatatgaggaatgattgttgggtggttcggaggcccggttgagagggatgagcaagcggaggaagccgcctcctcaaaagatggaagaagccatagccatagccattgccagagagatttgtacgggtacaaggaaacccatcattccttgcttgcttgcaaattcatgcccacagccatgggaacttgcatcgatggacagacagacaaatctctcgttctcctgcccacctttgaatttttgtcctccctcctcctcctcttcttcttcttcttcttcagatcttattctaattaatgttgttaataactaattgatttaggttcatatatgaatcatcagcttaaatttgttgccatcaattggagtacaaggtaggcgatagagtttgttgaaacgcagattgaggacagacaggataaaggcaacttaacagagcactctgctctgcttaattctgtttctcctcttcttcctgttgtccgtcatcatcgatcttgggcacgtttaattcaattttacattatgctgccgatcgatccatcgagtagaatgaatatttgttacatacggatgaaactctaattaataagtcgtatggtataggaagaaaatatacaagtacgtacataggacggcagcagctcatgacagtgcaggctatttgtgtactagtataactgcctgtatatgtgaagcgagacatgaattttaatggagaggcccctcctcttgcttcttgtcttggtagcttccttttttctgtatatggtcccaatcaatttgcaattggacattcatatcaaaacaaccacgcaccattctagtatttctactacccctgtcccctgtttctgttgctacttgctagccagccatggagacacaaagctaatctagtactgtactgtaccctctactccatccgtccaaaaaagaaaaaactaatttaatattgaatgatacacattttctcttcgttaaactaaaaaatgtcttatccaataccaggttggattttttatgtgacagagggggtaagtaactaggtgtattgcgttttccgatgcatatgtatatgagcactccctttgttgaaaaaaaaactcaacctaagaggtgatgtgacccctcttagtataatgaatttgaatagaagattgtcttgatttgttttactaggagggttcacatttccatctaggttatgggtctgtttagttcccacgcaaaaacttttgactctatcacatcgaatgtttggacacatgcatagagtattaaatatagacaaaaaaaaaactaattacacagattgtgtgtaaattgcgaaacattgctccatgatttgataatgtggtggtacaataaatatttgctaataacggattaattaggcttaataaattcgtcttgcggtttacatgtggaatctgtaatttgttttgttattaggctacatttaatactttatatgtgtgttggtatgtccaatgtgaaatgcagaaacttttcacccttggaactaaacagggcctaagttatttttgagaggaagagagcacgtaggaaatcaaaatggcaatgcaaaggcaggtacgtgatgatacacacataatcgaatcgaatcgatagatggatagatagtgatgaacagtagcaagtaatagtgcatatcattcgtatagatgagtgagagagatgatcgaagaagcagtaggcagtgacaatcatccttccccctggcgcccagacacaccatcatatcattcgttccattgctcttgcagtctggctgttgctgctgtacacactagattagcatcgaggactaggagtagctgctgccactgccatgacatctctcctatatgtaggcaccgcaggagtatatacaggcagagaggcagcagccatgaccatgaacactacaaggaaggagtagatagctaggaattaattaattaagctaa

SEQ ID NO: 1869 - DNA, 133 bp, Oryza sativa
  misc_feature (3)..(3): n = any nucleotide
  misc_feature (29)..(29): n = any nucleotide
  misc_feature (116)..(116): n = any nucleotide
  misc_feature (121)..(121): n = any nucleotide
gantgccgcgggtggccgcccgtagtccntttcgtcatctccatcagatctgggtggccagaggcggccgtcgtggtcctctgcctttgccgagagagaggaggcccgaggggganggttnaggaggaggagg

SEQ ID NO: 1870 - DNA, 1644 bp, Oryza sativa
  misc_feature (36)..(36): n = any nucleotide
  misc_feature (45)..(45): n = any nucleotide
  misc_feature (547)..(547): n = any nucleotide
  misc_feature (615)..(615): n = any nucleotide
  misc_feature (742)..(742): n = any nucleotide
  misc_feature (860)..(860): n = any nucleotide
gttctttttcaccttccttcccttccccacttttangttggccangttctccctttatatctcaaggggatacacatgcacttcttctacctactcttcttttgggtggggaccaccctatcttgaccaaatcttgactcgcgcctccgcctggaagctaaatcaccgcttgtccttgagtgatgcccagcgccgtcactcgtcggacacaggggatcaccctatcatttcttcattaatgggaggagatcttcaatggccgctgtctgaatgaccctccgatgggatgggtcatacttacctccactccaccggaagcagatgcaacgtgggagcacggttgtctgccgatgacgtgaccggcgttagtccagtcacagaccggacattcttctccaccacgcgtcagtttagcatgccgcacatctgcccctcttcatacagtgacttccttgcaacggttgcgatgaagcctggcatgaatcgagtcgggactgacgtgctaactccaggagttaccacgccggctccagctcgggacgagtgncaagaggctctcatcattccgacgggacggggcgaggcgtgtgacaggccgcctgctgccacgtaacncgcgatctgaccggtctgtgaccggtcacacattgcgaccggtcacggaccggatatgcgtgcgccgtgctgcattaaatgcggcatggcgcgcttgtccattccgcaataaatgtggtttggtgancgccgctgtgcccacctaacccacacacgtggtccaataccacagggggtcggggcgcccagccctcggggccgaaacaggagcagcccgacccctcggggagacagaggagggggtnggcacgtctccctcgggcccgacccccccgagggggtcaggccacgtgggtgaccgcggctgcccaagtctctagtcatgatactcccggtcccatgtcaccgacactagtatacagaaaactccatactgttctgcacctaagattgggcagctttgagtgctttagcggccacatgcttaagaagtcacgttgcaccgtgccaggtttaagtttttacgttttggaacataggggctgtttggtacagcttcaactcctaaatattacttcaggagttgagtctggagtggagctgtggagctgcataaacccagctccacaactctagtacattttgtgagagagcttcacccaactctactcccagttttagtggagctgaaactgtttagctgagctccagcttcaggagaggtggagctgaaactgtgccaagcagaaccatattattccattattttatccaacaaatcccaatttcccggtggaataaacggagcacgacaggaacgaagagagacagaagaaaaaaaaagaagggccccaccaaatttacccccactaccgcaacggcagtttccgtattcacctccccatactttcccctcttcctccccttccaccaccacccccacccccacgaacgcaaacccccacaagtaccacctcgcaaatgctccattagctcccgaaatccaaaccacccccctcctcccctcacgggctcacggcctcacccacccaccaacccatccatccaactccgcggcggcggcggcgg

SEQ ID NO: 1871 - DNA, 228 bp, Oryza sativa
tttactaaatcacatgaaattctcgggaactccacatacgtatttcatatatgtatttcatacatatgaatagagacaatttcaacgaaagttcgaatttgccaggggtccaaatggaatgaaaatgggtatataaaagaccaacgaaacgacgagtgagaaggataagggggagtagtaggaggagctttcattgaagtagagggagcataaaaatatgtatttgct

SEQ ID NO: 1872 - DNA, 916 bp, Oryza sativa
gttagaaaataccctctctcctccgttggtggctgacaactttcttccctcttttcattttttttcttttccactctcccccaagtgagttctaccaaccacgagtaagtaaactccaaagctagtagacagtaaattttaaaaaggcaggtaaaaaaagaaagcacacacactctctcttaagcgtcacttcagaggttttaacagcttggttagaaaaggatatcccaagccctaatcaccatgttaaagccatcccatcctaaaatttttcaccatgtcacatcgatcgtttggacgcctgcatatagtattaaatttaggctaaaagaataattaattacacagattaagactactttacgagacgaatcttttaagactaattgctccatgatttaataatgtggtgttacagtaaatatttcctaataacggattaatcaggcttaataaattcgtctcgctgtttactgacggattctgtaattaatttttttatcagtgctcaaacactccatgtgataccctatataataaccgatgtgacacgataaaattttacgacgtgaatctaaacaccctagttaagagagagaacagagataagaaaaaaagaagagagaaagtccaaataggagagagtaaatctagaaagtgggtgtggtatctttcccaagattttcttattcttcttcttctcctcctctctcttctcctcttcttgcacctcctcaccttctcctctcctctcctcttcttctccatcaccatccacccatccaactggtccaacttcctccaatcgtttgcttcttcttcttcctcttctcgctgttcttggtggaggaggagattagggtttgattagggtagatagagagagaggggttgggtttggttggtgtttgtgtgg

SEQ ID NO: 1873 - DNA, 2000 bp, Oryza sativa
  misc_feature (530)..(530): n = any nucleotide
  misc_feature (532)..(532): n = any nucleotide
  misc_feature (1922)..(1922): n = any nucleotide
tgcaagtcgatgtgttaccaaagttcaaattcttgaggggattctactctcctttgaagagctcacaatgagccgagtcttttctgaccctatcctctgaggctgcacaaatgcactactccttccaccaagagtatctcttcccttttgaaggtgagatccgaccttcacaaactccttcaatgtccaactccttcacaaactcctgggcaatagggccaagtggttcagaagtaaactcaaaatcatcaatgtgtatccaactcatacaaaattatttcatctagagggtgagtaaatagtttgaaaaacttcggcactgtagaacccatctaaagttaagatcttcttgcaacttctctttcacaataaaattcaagaaactcaagaaaagatgccggggacacaaatttttgttgttcatcaggtagatttggatggtcattagcctctgggtttggatggagtggcatccccgattctcatgcttggggtgtggaaactatcaattcagacttttcttcttcttntncttcttcttcttcttcttcttcttttgcagtttttgtttcgactaattggactacaagaaataagatggacatagagaagaaatttgtctcacaaccctactgttgtgctttacatatgtaaatgtatttcactagtggaggaagacagcatgcaaggttgatctcatatgctccatggtgttagaatgacttcgctgcttccagtcatgatttaagcatcttaaagtttcagcttttgctatgttctccaaaacgccgatcttcatgtggttaggtgataggtcctgttagtgctcttctcctgtggactgtggtccttggatcatcgaatgcccaattattcaggtcatggaaaacctggtactgcaggccatacgacccatactgccatgtatccccatgatttttattgcctatctgaatcaggtctaagcaaaatcatttcatgaatcctctcaattgtattggtctgactggatgttgggaaggtggagtcttgttgttgggattgaagtcatccaattgcttctcattctcaggaaaaagttctctggtttgcgaggagtggatgaaatgaacaataaggctgcgacagagtatcagcaactttgtcgatctcactgaatgtttggactatgggactgtgaccttcttggttatttgctgggattaatgcttccaatccttcctggcctgacttgcaacgaatcacaaataaaagttccaatggagtaatttaatatccaatcaagtttaacaagcttgcagttcttaggacgaatatcgcacaagttaaaataaggtgcgaaacaaggaaataaccaaagataaattatatcacaattctttggagaataatcggatttcaacttcttttttcactccagaaatctggattgttctatcgattttgaacaagttttgtcacagccgaatctgagaaagtctgtacaggcagacatcacacaagtacatgacaggaggaacatgggaatcctacaacgatgcagagcaagcaaaaagaaaaggtgtgaaaaaaaaaaaggaaactaataatgatgttttcctctgttcttgtttcacttctggcacgaaaccaaaactgtctactatcagctaaaagaaagctcgcggctcgcgacgccgcttctcacgctggcagctcgagccgcaggccgatgcgactcgactccgcgctcaagccgctaaggtcgcagcgcgcctccgccgacgaaggcctcctcgaggcgcgcacgacgagcggctggaacccgagcgtgagctccagcccgacctcctcctcctccccctcttcgtgctccaccggcacggggctctgctcggcctggctcacgtgtgagccggtctcgacctcggtatcctccgatnccgcccgcggcggcgtcacgtcggcgatggccatgtcgttgttgtcaccgtcgtcacatggtcgtcgtcgtcgtggtc

SEQ ID NO: 1874 - DNA, 2000 bp, Oryza sativa
  misc_feature (388)..(388): n = any nucleotide
  misc_feature (1863)..(1863): n = any nucleotide
  misc_feature (1996)..(1996): n = any nucleotide
aaaatcttaaggaagatcaccgttagtagtactagtaaagaaaactcaccaaattcctgtaaccacacagtaacaggatatccttgcagaaacaccagtaaactcgacattggatgaacagaattacagcaatatgcatcaatcacccaaatttcgaatagcatcagatataagcttcaagcagtgtgtaaatatgtgaaactctgatctatgaaccaatccggtagtatccattgagatcggcataagacgagagcatcaaacaaactcaaattcatgtataagacagcaacaagttgtcctagaaactccagtaaatttaaacaccatgtggatgaacagcaatgcagcgatatgccagtaatcactcacatttcgaaaaaccacngatataagatataacatttcaaacgctgtaaactctgaattatggaaccagtgcaggagcatccattgagacaggcgttgaacaaacagcaacaagatcaaatgaaacgacagtagaactgtagaagcatgcatcattgccaacaagaactggaattcaagatacagtaaagaaaacaggtattcatctttggaatttccagcctaaacaggcacccagaagaagactgaaactcccttgaattgctcaaagctattggccaaaaacactctcctgaacaaggtccacacaataatagatcaagaggcatctcgcaaggcaagcaccgaaccatggtattcgacatgcctggcacgcatcagaatcaaacgcaggcatcaccaaattcatcacaaaggttacatgacgatcgatgcaagtactaacttcccagttcccagcaaattaacagtgcagaatattgctaacacatagcgaatatactagtagcaaaatagtactaattgcagatcaactacgcagtaagtacgatcatgtagcagagcccaagaaaagcggaggcagagtcgagtgggggtcgaagcggaatcacagcggggagaggagctgtccgatggagggcttggggtcggagttcatgccgatgacgatgacgagggggatgaagccgtagtacgccgccaccttcgccgtcttcatcgtccacgtgctccacttccgcaccgagcgcctcgccgccgccgccgccgcccgggacggatcctccgcggcgggcggcggagcgccgcccctcctccccgcgggcttcgtcctcgctctcagaggcccctgcgctgggttcgccatggcgtggggtggtggtggtggtggtggcgccgctccttcctcctcttcgtcgccgtgcgggaaaaggtaaagtgaaaactaaacaaaaccctactggagcactcggcgagagcgagggaagagagctgctcttgtgggccttcggacgtaagcgggctggtccggtggagaatacctgggcgcgtggagataggcgctttgcgggaaaaagtgcacccaaggtccctcaacttgtcatcgaattacaaaattgtcccccaaccacaaaaccggatatccggcgtcccccaactaaccacaactggtcatagtccctcggcggttttaaccccggtttcgtcctatgtggcggctgactcagcgtgggacccacgtgggccccacatgtcaggctgccacatcagccttctctcttccccctcctctctcccttcctcatctctctctctcccttctctaactcagccagcgggaggaggagggcggcggcagccggcgacaggcgacgtggggggaggagcggcgcgcgggctcctccgccggccgccgcccacgaggcccacgaggcggagggacggcggagggtgacacggcggcgacggcacggcatcggcctcgtcggaggcgancgcggcggccccaccctcctcgaccgcgcggcgcgcgcggccgctgaggcgcgcaaagagggcccccgccgtggcgtcgaagtcgggcgtggagacggcgaggtgggcggcggcggcggcaacggcgggggtnggga

SEQ ID NO: 1875 - DNA, 2000 bp, Oryza sativa
  misc_feature (734)..(734): n = any nucleotide
aacattcgccacccgaatatggtgcatctgttgggtgcttgccctgagtatggctgtctggtgtatgaatacatgccgaatggcagcctcgaggaccgtctcttctgccggtcaggcaccccaccgctgccatggcagctccgtttcaagatggcagtggagatagccactggcttgctctatctacacaagatgaaacctgaagcctttgtccaccgtgatctcaagcctggaaacatcctccttgacaaagatttcgttagcaagatcagcgatgtcggcctcgctcgcatcattccccggtcgatggatgagacggtcacgcagtaccggatgacagatgctgcagggaccttctgctacatcgatcctgagtaccagaagactggattggtcaccacgaaatccgatgtttatgcgctcggcatcatctatcttcagatgatcactgcaaaagatgcaatggggcttgcttacatggtctctgatgcactggaggaaggaacatttgaggggctcttggatcctaatgtcaccggctggcctgtgcaggaagctcagaagtttgctgagctttcactgaaatgctgtgaactccggcacagagaccgtcctgacttggaatccgtcgtgctccctgagctgatccgtcttcacacattcgttgcatcatctggagataattcttccatcgaccaaggccaccagcgttcagtcagcgacaaggtaaaacnaaaaaaaggaaccatcttttctctgcaaattctcaaatgaaggcatcaggatatctccaatatgtgttctgaacttctgaagttatgggtgtttcatctagactaatattgttctactctaaatgcaggagttggctctggaaaatgacttggccgagattctgaacgatgggctagtgaagggggcgtcatttgcagcataaaagtgcaaggggccagtagatgttattctgtcaaagatactggaatctgcagtagttttgattttgctgtaaatactaccctagcccagaaatttttgaataattagatcatttgggaaacgtgtactaacaacaacctgtaaattgaacacaatctatagctctcatctggtagcactgttcacttctatcaactgccaatgggatcaactgaaaccgatttgagcaagggcttgagatcatgcctttatcaggatcaggaatgccagaaatcttttaccctgatatatcacattcttcaagactgttgtataaagaaaagcttagttgttgaactcgcaatatcacaatgcatttgccaaattgtgcagaaagatgcttttacatgattggatgacaaagcctatttcgttttgttgatcataacaagccaaataaacctactgttttgaatgatgattaagtccaccatcaaatcaaaccataggtgatcaataaattttctgttggcggcctgcatgattacatgctagtggtatggggggaaaagatcggcgatggcaccaaaggaagaaatcaccaccattgctctggtctctggtcccatcgtccactacagacaaacaacttccatgttgaaggcttgaagccaccgtttctctagaccaatgagaaaaaaatgatcaatgagattttttttttcatcacgaatttatatgagagatagtttagcaacattgacatttcctttcacctcatttgattttctaattaaaaaaaactgtaaaatttgtgttttccatatattatttagaaaatcgataaaaaaaatctagcctctatatctaaaccggatgtacacagccaaagtattttccacatttgtcccattaaaactcatcaacttaccaagaaatgtaaccattccccttgataaccacgccaaaattttattcacaatagtatgtttttcaagaaatagatttgaacccatttttatgtttctaaaaagggacatatttgaaacacccattttgttaattgttataaaggaaatggaaag

SEQ ID NO: 1876 - DNA, 2000 bp, Oryza sativa
  misc_feature (1840)..(1840): n = any nucleotide
catattgatacaggtagcaatgccaatgacaaggtcgatggtgagtcagcgacacatagggagtacaaagtggcgacgacaagccgcccaagcaatttttgtactagtccccggctttataaatagcaacccataaagcttggccataaaaaaatgtctacaccatacaaattagaataatacacccacttctacttggagttgccacgaagccctcccacctcccaacgtttctcccattgttcatcacctccgtgagcacaagtgaccttcctcccaagtgttgctactaaacctacttggctttccactattttgtcgttgacaaatcacagcctcctcccttgttagctaaaatccaaagccccatggctcgttcccaccgtttggagcttgaggacccatatcatggcttatgtgcactcaatgcttggccttctatcctcctctctgcagctggttagtacattgggatttaaagttttagcttaggctaggcttaggcttggctccaagaaacttatggtttctcaagccccgcccaaaatcttgtatggcccatgaccatgtggagttacctatgtgccatgattacaaatctatagtaaatatttactagaagtacatgatgtccatagcgctatttagttggattgtgttcggccgttatccatttatatgataattgatacatgttgagttgggatttctagcttaatcaacgagccctatctatctatatccggcaatgagctgagcttgagtgaacttggatgcctaggctcaagcccaacatgttttccctttgagcttccaagcaagtttggcttgagctcaatcaagcttgagctcggctgatgagtagaataacatatattttaaggataatatattgataatcatattaatagaagaggagaaaaataataagacaaatacacgatgccaatacatactacctatttgtgtggatacttaatgtgtagtctctctactagtttttcagacaagcaactagactgatttggaacttgagctttggcttagtctcacgctcatttgtagcttgagccaagctcaaataaagcctagggcgagttgagctcgagctattcgtgagtctcaagctattttgatagccctatatatacgaatattagctggataccgagggagttcccatgtttaaaaaatgtagccagttaggtggtttatattgtcgagaccatagatcgtatttagagtttgtacttttaaaaaaaacatgcaattgaaaatattgtgaactctttagtttaagttttaaaaattcaataatccaaaatttggaatagataaatatgaagttgtacttaacataggctctcaattttgtattttagtcatttaattatgaaaccaaaattaataattactagattgtaactgacgtgcactaaattaggctgtgtttgaggagaggagatagaggagattgggaagatatgcaaaacgagatgagccattagcacatgattaattgactattaagtattttaaacttcaaaaatggattaatatgatttttttaaagcatctttcctatagaatttttttgcaaaaaaaacgcaccgtttagtagttcgggaaacgtgcgcgcagaaaacgaagcaaaactcactcacaatcatctagatcacccaggaaagaacacagccttagtgttggcaactagtaagaagaatgtggtatggttcacttgatttgactacaagatggtaaagacaccgaaaagcaagtcctgaacatgaacgctaacaataagaagattaaatcaaagcaaagctaaagctaaagcccnaaaaagaaaaagcaaatgatgcctcccagctctcactcgaactgaagcaaggtatcaatctccgtgtaacttgagctcatgctatatgccgacgaccttacctagcatgtaatgctcttacacacactcgtctcgatcccgtctcgagtgaccaccatag

SEQ ID NO: 1877 - DNA, 1952 bp, Oryza sativa
  misc_feature (1)..(1): n = any nucleotide
  misc_feature (3)..(4): n = any nucleotide
  misc_feature (10)..(12): n = any nucleotide
  misc_feature (15)..(16): n = any nucleotide
  misc_feature (20)..(20): n = any nucleotide
  misc_feature (24)..(25): n = any nucleotide
  misc_feature (28)..(30): n = any nucleotide
  misc_feature (33)..(33): n = any nucleotide
  misc_feature (35)..(35): n = any nucleotide
  misc_feature (43)..(43): n = any nucleotide
  misc_feature (53)..(53): n = any nucleotide
  misc_feature (56)..(56): n = any nucleotide
  misc_feature (58)..(58): n = any nucleotide
  misc_feature (62)..(63): n = any nucleotide
  misc_feature (72)..(72): n = any nucleotide
  misc_feature (75)..(75): n = any nucleotide
  misc_feature (82)..(85): n = any nucleotide
  misc_feature (87)..(87): n = any nucleotide
  misc_feature (90)..(91): n = any nucleotide
  misc_feature (98)..(98): n = any nucleotide
  misc_feature (101)..(101): n = any nucleotide
  misc_feature (104)..(107): n = any nucleotide
  misc_feature (113)..(113): n = any nucleotide
  misc_feature (120)..(120): n = any nucleotide
  misc_feature (123)..(124): n = any nucleotide
  misc_feature (126)..(127): n = any nucleotide
  misc_feature (129)..(130): n = any nucleotide
  misc_feature (137)..(137): n = any nucleotide
  misc_feature (139)..(142): n = any nucleotide
  misc_feature (154)..(154): n = any nucleotide
  misc_feature (171)..(171): n = any nucleotide
  misc_feature (174)..(174): n = any nucleotide
  misc_feature (187)..(187): n = any nucleotide
  misc_feature (198)..(198): n = any nucleotide
  misc_feature (202)..(202): n = any nucleotide
  misc_feature (204)..(207): n = any nucleotide
  misc_feature (212)..(212): n = any nucleotide
  misc_feature (217)..(217): n = any nucleotide
  misc_feature (229)..(229): n = any nucleotide
  misc_feature (232)..(232): n = any nucleotide
  misc_feature (234)..(235): n = any nucleotide
  misc_feature (242)..(242): n = any nucleotide
  misc_feature (253)..(254): n = any nucleotide
  misc_feature (257)..(257): n = any nucleotide
  misc_feature (262)..(262): n = any nucleotide
  misc_feature (270)..(270): n = any nucleotide
  misc_feature (274)..(274): n = any nucleotide
  misc_feature (276)..(276): n = any nucleotide
  misc_feature (279)..(279): n = any nucleotide
nannaaaacnnnggnngtgnacannaannnagngngttttttnaggggggggnggnangggnncccccccanggnaaatatnnnntnggnngattganttnaannnngagaantattacnagnntnncnnatagggngnnnnttttccaggggnggtttaagggacccctntgngattaccctttgngggattattgngagnannnnttaanattgngggatttttagnagntnnggtttcnaagtccctttnngantaccntttagggncaanantgngaattattcggaattaaaaataagaaatattagaaatagagtatagagtccatataggaatttaaaactaactaaaattcagaaaaaaaaaaggagcctccacgttcgttctcatgacctagaaattctcacattaatcggagaaaaagaaaaggcagagtccatattaaaatacaatttagaaatagctaaaatttagaattaaaaaaataaggaatattaaaagaggagactatagtccatatagaaatacaatttagaaatagctaaaattcggaattataaaataaggaatattagaagagaagactagagtccatatagaaatacaatttagaaatagttgaaattcagaattaaaaaataaggaatattagaagaggagactagagtccatatagaaatacaatttagaaatagttgaaattcggaattaaaaaataaggaatactagaagaggagactagagtccatatagaaatacaattaggaaataaccgaaattcggaattaaaaataagaaatattagaagtagagtatagagtccatatagaaatacaattaagaaaaaaaatagaaatttggaattaaaaaataaggaatattagaagtagagtatagagttcatattggaatttaaaaccaactaaaattcggaataaaaaggagcctccacgttcgctctcatggcctagaaattatcacattaatcagagaaaaagaaaaagcagagtccatatagaaatacaatttagaaatagctgaaattcagaattaaaaaataaaaaatattagaagagcagactagagtagttattacacattagtagttttgaaaagttattgcaaaatttaaaattacgttgtcattgtaatatattttaataatataatgagaaaacatatatgctattatatgagagaaaatataatgatgctagccgcgcaatctgcgcgggccatcatgctagttagatataaataaaaataaccggtaatgcacgtcaatctggatgtgtatatatgtgcacagcaacgaacacctcgcgaagtactgagtgataactaaagtatacagcatgcatgtaccgagaaatgtatacgatcgatcgaccttagagcagacgtctagcaataatatttgtatacaagatcctaatatataaaaatacttactcaatatatatatgcgcagtcagcagaaaagaatggacatagctaggtagctagctgcaaaacaatatatatgtgtgtgtacataaacgtacaaaattggaagatgatgaatatattgatgcgcgactagctagcatgagagtaaatagctagctagtcgtaaaacccttcccaggatgcatgctcatacatatatagcgtgcattatttaccagcatgacagacattattgttaattaacccacaccccatattagcaagcttgcaaacactagtagcgagttaattctgtaataattttagagatatgcatcatatcatatccctcctccacacccaaattaaagctagtgacaactcacgcgatcgatatgatggagcctggaggctggagctgtatatatagacatatgaaccacagatcgatggagaggacacctgcgctatagctagtcgtagttgtgaagatcgaagttggttgtgtgattagatagat

SEQ ID NO: 1878 - DNA, 2000 bp, Oryza sativa
  misc_feature (471)..(471): n = any nucleotide
ccataaagttaaaacccactataagtctaaaactcaacatacaactatgccacattatcaccatctagcaataattacatattttacctcatacaaacataaaacatcatatacaatttatttaattgtacaaattaacattcaagcatatttagtcatcacccttcatatcatttgcacaatattttaacaaatctatctatcacttttacaatatttaacatatacttatcttatcaatatgtttcacattaaagcacgggtatcatttgtctaattaaccctgaatggtttcattatttttttccattttactcctaacttggattgtcaaaaaaaatattgagaattgcttagtgattcccggcaacacagtgccggggaaatcacctagtatttcgacgataagtgcccttgatttggtcactttagtggccacactgtcgttagcagggttggaaattttcgganctggaaatttccgaaatttcagacccctccgatacttttatgttggccgacacttctctttttaaaattttttttcatgaactttggtgatatttgttcaaatttaactaaattctgtttaaaatttcagaccgaaatttctaaaatttcagtatatcggtgacctccgatcaaactcggctaaacccaaaaaagtaaaccctggtcattggtgctggatgtcacggctaccagtcctcacctgggatttggatcaggtgcatgactgcaacttaagcagtagcagtacacatcattggatacaagatggatggcctagatcacgcattgcactgtttacatcactgtagcaataaatactgtagcacggagtactgttcatagggttttttgaccgggaatattgccagggttttgcccagtagtttaaattttagaaatagaaatatttacaaagttacagggggatatacaaaagaaaagaaaaggtcataaaaactttagggtctgcaaccaatcagaaacagattgtttaagaggatctttcattctgcacagatgcataataatttctttcttgaagagcaatttccatgattggaaggtaggttgtatattttggaaaatgagtcacagggttattgtagctttgaatctaaaccgttgatcgaaaaatggatgaccaaagttagtgcagtttttaacttaatgtgactgcacctgatccgaattccatcacctgcatgatagatttggtacccggatataggagatccatcgctcaatgatattattgctacatacgacatagtttgtcaccgccaaatttcatatctaccctattactagttgtaggtctcgactagacgagctcttcagtgacggatcaggcaaaaagctgagacgtgccttgagcttttttcttttttggtttcatctctctccatagaccatgctctcttggctgtgtacattccgttggataaatggatgctctcatctaagtcacccaggtcttgtgcaagaaactgttacgcctatcaggctactgttgttgttcttcctcttactgtgcactgacttagctccgaggtggacgcaccaaggccacttgccaatttgccatggtggagcgttggaattgcccttacatgctacaagaaaaaagaaaacttcggtcaaagcattaaccattaattagagtttacaaaccaacaaactcatcagtcatatagttgtaccctccaaaacccccaaaagccaatgttacatccatcttccactttttataaaccccttttgtgtgtacatgttcactacaccacctttctctccttccctcttgtgctcctccttatcttctatctcttcttcttcccctatcttttcttctaaagaacatctgcaatctccagcttcttctgttctgaagcagtggctttttgtggtttatgcacaccattggcagctgctactgtttgctgcttgtgttgtcagaagctaccttattgtttcggtcatcatcggcg

SEQ ID NO: 1879 - DNA, 2000 bp, Oryza sativa
  misc_feature (651)..(651): n = any nucleotide
  misc_feature (751)..(751): n = any nucleotide
  misc_feature (753)..(753): n = any nucleotide
tgtgtttccccttgctgcccgtatccgattccaaactgtggttgcccttgtcgacccatggattgatgcaaactttagtttttagtaataatagcttttttttcttttcaactcgaaattttgaaaatattttataggtgcgcattaaagaaattcaataaaaacaccgcattatcgaaagtgttgtcagcgtgaatctaatgatatactccgtagttttaatattatcaaactatgtagctttgaacatatacttagttgatatgggcagataggctgcagagcaaaaaaataaagaaagaatggaggaagtagtataacttagcatttgttattaggaaaattaatactaactctataagcaacttgaaaccatacctaatagttagttgaaaggggggggggaattaggcgtggtgttaatgtcaatataaatatattagcaaacacggagtaaaaaaaggaagcccattaattcatacgatggcatccatatgtaaattgagaaatttgcaccagctagctacaaactctacaatactgcaaataaacttccgcacaactatattatcttcgattattttgccgcttcttagaaataccacaccatggtcgactaattcaccacttcttagagaaatgttatgtgcncataggcatgaaccaattcacattgttgggtagacctaacaaattgcctccacctgatgtctctctaaactccaaaagccattatccatggcagtgccananactccccccccccccaacatcatgtacaccatcttcttttaataataatattattattacattgatcaagaggggatatacagtaacagaatccacttgcattgcattgccattgcctctctcacacaaatcccctctcatcccacaggaatccatccgccgtagctgtattatagtaaccttttgccatccgtggcttcctttggttggctacttgttgacacgtaaaatttattcacgcaacaacaatgataaccgtcgtgctttcgtgacgacgaacgactagttttcaagcaaactagcaaagatcttcactttcgtggaagaacccgactgattttcagcgcaaaccagtaaaaatcaaccgcaccctagataactaggatttggccaaataaacaagagcaaaagtacgatgaaaacggtagaagaaaataatataggatgataattgttccagagccctaccaagtgcaaaatccatagtatatagtaaaggaatacgctgtactacatatatagaaaactctaggtaaatccgtgattaattctatctaatcaaaaccgtccttttttaacaacagcttccatgcagacgtatacacgcctcagccaaaagtcgcctccatcctgcaacgctgctccagcccaagtttcagaatttgtctccccttgctctggcaacaatgtgatcctgtgtggctagacttcaacaggcatatcatcaaacatagccttgcatccaaccccagccacataaaatcaaccactaaagcctcacatccattgaatcggcaaaagctccatcgctgcatgctagctgcttgaactgacaaaatctgataattgcagcctcccaagtcccaaccttcttctctagtttctgcagctccccagcaactcgtacacctcccggtgcatcacaaattcctgcccttgtcaagctaaccaattcttaagcaaaccactaaaataattacaccaactattctatataatttggcctgtctaaaatgacctaaccaaaagccaaattatgctactaacactactaaaactggaaacggccatccgccggccttcttatagcctcttttccacaattgtgacctccaacctctcattcgccagtacactcccctgagctccccaattaatcctcccattaatctcgccattaattagccacacctgcaaatctcactctagctcctcgatccattcatctgtagcttagctagctagat

SEQ ID NO: 1880 - DNA, 151 bp, Oryza sativa
  misc_feature (3)..(5): n = any nucleotide
  misc_feature (7)..(7): n = any nucleotide
  misc_feature (31)..(31): n = any nucleotide
  misc_feature (39)..(39): n = any nucleotide
  misc_feature (42)..(42): n = any nucleotide
  misc_feature (44)..(44): n = any nucleotide
  misc_feature (49)..(49): n = any nucleotide
  misc_feature (53)..(53): n = any nucleotide
  misc_feature (57)..(58): n = any nucleotide
  misc_feature (65)..(66): n = any nucleotide
  misc_feature (81)..(81): n = any nucleotide
  misc_feature (130)..(130): n = any nucleotide
ccnnntngggacttttaaagggcctgacttnttacatgnccngntcctntagngttnngggcganntgtacaaaacccctnaatggattggctctcatctcatcgatcctgctcacccttcctatctctnctcctcctccccaccccaacg

SEQ ID NO: 1881 - DNA, 2000 bp, Oryza sativa
  misc_feature (1313)..(1313): n = any nucleotide
  misc_feature (1357)..(1357): n = any nucleotide
  misc_feature (1381)..(1381): n = any nucleotide
  misc_feature (1425)..(1425): n = any nucleotide
actactccactctacttgtcacgtgttttgcaaaatgcaaaatgcgagaagatgcagtaatatactccctcggtctcaaaattactccttccgtttcatattacataagtcgttcgatttttttttctaatcatactttgttaaatttgattaaatttataaaaaaaagttagcaatatctaaaatatcaaatcaattacattaaatctaacattaaatatatttcgataatatgcttgttttgtgtcgatgatactgctatatctttttataaatttgatcaaatgacttataatatgataaatcggaggaagtaagagaatttgatggatcgtatacatcatacacaagtacacatccaattaaaatcgaaagtcctaacgggcgatcgatcgctgggcacgatcagtccccctccccacatcgatcacccccttcttcatgtgattttcttttttggcaccgtattactttcctattttaataaatttatacacctaaagtttgtgcacctcaagtttacacatctcaagtttaacagagaccccaaatttataagtcaaaagtttatatatccgattcaaatttgaatctgaattcaaatattttttatatatagtatttctatacatctaaatattatacacctaaagtttatagacccaaagtttatatatccgatttaaatttgaatttcaatttgaatttaaatattttttaatatataattttttctaacgtttgttttttttatttgtttaaaaatttatggtgtagtaggaagagaagtaggggaggaggaaggggagaggagtgtgtttagggggatggggggtgacacccgcgcattagtactacccaattaaaatccctttatgttatgaatccaattaaaggaggctgcaggtaacaggttacgtagagtgggccagcaacaaatattgggcctggcccagtggcagctcagctccaaatccacaagcgcctagccggagcagcccgaccgccatggcactcctcgccgccgccgccgccgcccgccgcttctctcgcagcctccgccgcttcagctcctatgccgcgtctggaggagaagaagcaggaggagtgcccgcgggcgtggtggagcccggagtcccccgtccgcgcgccgccggacgagcagttcgctgcgtgggtcgcgcggctccggcccgggctttcacggccggggggaacctgggcccgaaggcgaatcctccctccgcgaagccgcgaacccggggaccttcggcggcttcggcggcttctttgcccgggttttcggcaagggnccgggttctaactcggggggctgaaccggggcttcttcgggcgncgccccgccgccgcggagaacctngtttacgacgtccttgccggggcttcggccccgacctccgggtnttcaacgcctgcctccggttctgctgcgcccgccgccgcctcttcccggtcgccttcgacatgttcaacaagatgcggtcgctcccggcatccgccgcctgccgcccggacgtcgagacctacacgctcctcctaacctccgtcgtgcgccgcgtccgccgcccgccggcgtccatggtctacctccacgccgtccggtccctctcccgccagatgaaggcctccggcgtggtcccggacaccttcctcctcaacctaatcatcaaggcctatgcccggtgccttgaggtagacgatgcactcaaggtgttccgtgaaatgccgctatacggctgtgaggccaatgagttcacctatggctacattgtcaaggccatgttccagaagggcaggactgacaaaggaatggtgtactttcgggaggcgaggagaagggatttgtgccgactggtggcgtgtacatgacggccgtgtcagcgctagcgttggagtggagatttgaggaatcaagaaatgttcttatagatatgctggattgcaagaggaagccagatatgatcacctacaggacactg

SEQ ID NO: 1882 - DNA, 2000 bp, Oryza sativa
actttaaatatccatgcatttattgaataaaatcccacatattcaacctccttcctccacagtgtcttttctccgtgagctacactggccctaataaatgtgcatcttattgttcaaactagtaaaacagcttcttacttaaaagcatgcaccaaaaagggcaatcaaaattcaatatgccaagtaacaaggccaccaaaattcatctatacaaaacgacccctgcatgggtactgttttataacgaataaccaagtattcctatcttccacgaatatcatccaccatataataaataaataatcagccagcaacaaaaccgccatgcttagtgaccgcggcgttctgaagaaaatcacgcaacgggcatccaagcgtgacgccagtggggatctgagctccattcaacctaccaactgagctcggtaccacgactcccaacacacctccgcgaccccagatcaggatccacgcaacggcaccaacctaaaccccccctccccttcaaaaccctaccgccacccgcaaaaccccaacccgtagaccgccgaccccatcccaaccctcaaaaccaagccgaatcacccaagccatccagcgcagcagatcgaggaggccccgaaacccgcggcggcgcgatccggcccacgacgatgggaggggatgatggtacgaaccggagaggaggggagattcggggattggggcggcgggatccacccccagcgcggagggagggagggaggcgtcgatcgcgcggcggcggcgaacgcaggcggcggcggagtgaggcggcagagctccgcgaggctccaccaccacgcggccgcacgagcggaggagtaaggaggggtggggataggagaggaggaggaagctggtctctcgttaacctacctcgcttgggtaagtacggttttgcccctgggaggaggtgaaatcgctacgtgcactgcgcgtgccacgtggggggctgaggcggatggatgggcccagggcgcagtgagggtggtttgacggtgtggcttaatgggccgtcgagtgggcagatggacatctgccgggccaccgggagcaggatggctgggctgggctcagcttttaaacatgtacgctttgaaaaaaaatccaatctggctgaattccatgattctgaaggccgatactctagaccgatgatgacttcggagtttaccaactttcactattaacacctaggcacgacctcttacgcatggtgataagatgacggaagaatgactacgcttttaagggactccctccgtttcaaaataaactaatgtatcacatcttatattatagattcgtttattttggaacgaaaggaggagtagcagagaagagaaatgaaaaaaaaaatgcccaggcgtctccaacccaactcaagctcaataggtaactctccagcccatcaatgcgggaatccgacccaccaaccaccaccagtagatacctttcctcttgtcccaaccaccaagcaatcgaaccagtacactaccagagtctagatacactgccgggagtggattctaatccatcccctcgtatacctttttcttccaaattcgatgcaaatagttgtgaaaaaatctgaaaaaaaatgacagtgtagagtataatgatacctactagtccacaaaaattcatgttcaaattcgatctacacatcgagaaacaaaaaagacaaatttagatataaacaatacgctactattcatacgctgaatttgtcttttttatatctcgacgtgtgagttgagtttggaattaagattttgtgaagttgtatatatgtgttgtatgaatgttgtcaaattttttcagaatatttcataaccatttagatggtttttgagcaaacgagggaacattccctcgacggattagaatagtttcccatacactgcccccctcccacgtccccacctaccgcgctgctcacagtataaataagtcccctccaggcgcctttctccccg

SEQ ID NO: 1883 - DNA, 2000 bp, Oryza sativa
tcaaggtgttgaactatacataatgtcaggacggagtttacaaatttactttctgttatcaaatgcaaaacaggcaaatagaggagtataaattctcgtaaattgtatagttctatttcctttttttgttgaaaatattctagttctggaaccttatgtttcctggttgctgggtagatacatggatttgtgtttgttatacatgcatgcccatattacacaggagaaatatggggaattcggcagactttgcatctgctgtatatttggtagttaggtttctttaaagttgccaacttaattattcaagcttcttattgagttgtgcttgttgcttgggaaatgtccgaaggtatgttgggttctgatagaatcttactatgctgtagtgttttttagtattatagtaataatagcattctttcttgagatgccttttgtctcaatgatctaagcaaaggtggtgaaccactattactggcaggatgtgtgattttattgtgtcatgtatttgtttggcttttatacatattgatgacattgagccgttttgttcttcagagtgctatgatcttaccatcagcatatagtggcactgtagaaattgttgataagtatttgattaataccgcaggtttgagcatcgggaagagaacaggaaagattgcttgaggacattgtatgctgtagtagaagatgcaaacaaggccaataagttggctgatgatgctagaaatgcatatgttaaaaacagacttaaggccaatgctcaattcatggaaaggttgaaggtgaagacacagaaattgagggtagctgcataaggggctcctggagctacacgctctggaacaattcctctttcatgatatcagtacggtcattttgcaacaaaggatgcggcagtgagacgtagaacgggagcaaaaatgttttgttgtaatttacatgtgttgccttgtttggacggcctgttaggtttatctttagctgaagctacactttttgaatttaccgtgaccgagcaggcctgtttacatgatcgcatagtgaactggctgtatcctgatcttctctacaaataacaaattgcttctgaaaactcagtccgttatccttggcgaaattcattttagcagctatgttcttaaatgcgagacctataatttcatccgttcgcacaacagatcagggtttatattaccggttgaccactaaattttaagccccatcggtatcacggttttgtctgttggcttcttttgggctaatctccctttgcacatcatttgtagctaaaaaaaaaaaagattatgtcaagtaagaggccttgtgtttgcagttctgagctcttgatgcacgaactcatgaagaggattgtgccaattacatggcttcttatgaggctgcaagaattgttggtttcgacatggatcaccatcagcccataatacttgtgcattgtgaagaagaaatatgagacatgcttttctcattctaagactttattttctttcggcaaagatggatttttttaatgctcttttttatgaattgccatgttgatttcgaactaccaaaattacgaaatgcattctcttcaaaatattcaaatttcgccccttgaaagtttatccatagtcctagggcctgttcactttgatgccatttttaaccttatcaaattttggtaaagttgccaaaaaagggctacatttagtttgctgccaaattttggtaactatataagaaatactgccaaaattttagtaagttaccaaaattttagcatacttgctaaaatttcggtaatgctaaaatttgataaagtttttttttatcaaagtgaacatgcctctatttttaaaaactttatcgattctctcgtgatgaggcagctttgtaaactccgacctccttggcacaacgatgaggtgtacattttctagattagtcctccctatccttgataattacgcacgctcacttctcaccattaa

SEQ ID NO: 1884 - DNA, 2000 bp, Oryza sativa
cttaatcaagaaactcaatttgagaggtttttatataccggtaaatattcgttaccgtattcgttccgtctcgtattcgctccgtatctgtattcgataatattcgatttcatttacgtatccgagttttcgattacgattccgattccgaaaaaaaatatgaaaacgaatatgataaagctagtttccgtccgtttctgatccgtttttatccctagtctctactatactgcaatataaattatcgatacattaccaagagatacactcgataatgagtgtgtcccgtgttcaataacaacaaactcacaatttattcttaaaaaatagttggagggagtcaaaatctcactttttttaatattaccgcattgacctgaaaggtccgcttgcaatcccatttaagttatctcccaacaatcacaatgaacatgaaatattaattcctcttgcataggagccaaccctaatttaccgtatgcttgaaagttagtctctctaatgaatcacacgagtggggatattatgcagctagagaaccgaacttgtataatcattctatatgtttttcttactccagagcaactcttagcacaccaaaatgcctcagagcttcactatgatctcccatcatagttccccacgtttatagaagctcgcccctcttatgatagtaaaaatggaaaaaaaagaaagatcaataagaaataatgagaagagacaccaatgtacttacatgtaaataagaaatgagagataagcatcataagtatatgatatagtgagaagttatactttttagttgatgccaaccatagtagtttgttgaagatgaacacttttgagggctgcaaaagtgctcctcaataatgagcaaaaagattcctaacaaccaaagggaaatctttctgcaatatttttcatgtagtactaacttgtagcggtacgtgtcattatggaagtaaaaacacccaatatacatttctgaaaacgacagtgttctctaagcatattcagttcccaacaaacaatggctgacaacctttacaaccgaattcatcaccaatatttgtgagaagaagtgtcaggactcaggacaaatgctcgaatcaaggccatctctgttgcatgattgctgaagaatattgcttacatgcatatccagcattttcagatgatggaaatctttccaatcagaacatatacactcattacgtttgctgttgacaggctatcaagatgataaataccagccattacacttttggtaattcgcttcgcagtgctctcttctcctagaattgacacaggaaaaaaccaagaatctgtctgaaacctgcacatgaatctgaaagggagaatgcattaggaaaccgatgtggacatgagcatttctttcttttgcaagctgcaaagcttgtgagttgggcaagaaaaagacgcattcgctggcgcccccaattagcaaggagttagagctgcgatccactgaattttcgcagcgtaatgccgtgtgatgtgaagagagaagaagctgtgggtaggtcacgggcccacctgacaagtgggcccatcctagtatccccagcttcactgttcacacacatcaatgcatcaccagctgtagccttcgggccttcggggacgcgtggtgtacgaagagcagtaatgcagcttctaatctcagctgttaagctgagtgattaactcttaagcaatcacttagtagtactgttagctcatgaccagctggtgagctgcgcaaacatcaatttttttttcttctcctcattcttcgtcaacatataagtacagctctatcgctttcttctctccagtcgccacacattcttcgctaccacctccaagacaagttgagcactgctcagcttggcagcttgccatccaggaggaagaagatattctagagataatctagagagatcagttgcgttttgcgaggctgcgtgagagagatcatcattatccagcaaaccacc

SEQ ID NO: 1885 - DNA, 2000 bp, Oryza sativa
  misc_feature (930)..(930): n = any nucleotide
gcgctggttttgtccaccgtggcgctttgaccttggtcttcgttgctgagtcaccatcgccacgcgaagctggtgggacggagtggggcagcgatgagcggacacgcgggcggagtggcggcacccgaagccggcggggcggcggagccaagcggaggacgccagcctcatcgtcgtcatcttccggcgtagggcggaggacgccagcctcatcgtcgtcatcttccggcgtagggaggaggcgcgggagctggagccggaggcggaggaggggctccgctagaagccgctgctgtagaaccgggagcgcatcatctcgagctccagctccgacgccgcctcggccgcgtcagtttagccgcgcccccactccgccgccgacgccgccttgtcgtccatcatatcgaacgttgacgcggccgcggtcatcgccttggcactccccgacagcgactcgtccggggcggccctcctgcagccccaccgccccctgcggcggcctcggctcttgcgccgccgcttgcatgacccgccgcatgacgccggcggggaacctgacggtgacgagcagcaggatcgccgctcccttcctcctcctcctcctcctcctctctctctcagggcggccagcagcggtccacttcgtcctcgacctcgccggcggcggcgagctgttctccttgccagcggtggcaggggcatgggcgagagaggatgagctcgaggaggatggagaaggcagtggagcggcaccgcacgggccgctgcttcccccgccgccagcgcccgcccgcacgccgctcctcccccgccgcttgcgcccgccggccgtcccccgtgcaattgcttcccccgcctgcgcgcgcccgcaaccacctccgcctccggtactgaagccgccattgtcgtcgtctacttgtcttcatccanccccaaacgttgttgcgcctagatgtgcgccgccgtgtagccacccctttcccctcgggcgccgattgccgcgccgcgccgatgcgctcggccattgcccaagcggagccgaagccgccgctggcgccccctccaatcggcgccctgaccttctcctcccggcgccactcccttccctccctccctcctctgcccggcgccgccccgattcctcccctctgcgccgcctcccggccgccctaccaagccgccgcaccgcgcagcctctctcctcctacgcgtggctcctgcgcgcaaccgcgccgccaccaggctctctctccctgccgccaagctctcccccttccacgctgtcggccccctcttccccaccgccgccggccatcacctgcgtcgccggcgcccatcctttgctgcgcgcgcgtgacagcgtgcgtgaggaggaaaaaaaggcagagagagaaagagaacggcaaagagaagaaaccgtgagaaagagacaaaattaaaagagaaaggaaagaaaaaggaagtgggacccccctgactcctcctccctgtgaagccatgaagggagagagatgtgacgtggcaacttgacacgtggggcccacgctgactcagctgtcacgtaggctaaaaccgggctcaaaaccatcgaaggacctattatcaccggttttggtaagttaagggaccttcgatatctggttttgcggttcgaggacgttttttaatctcggtgataagttgagggaccttcagtgtactttttccacagaagaaagtggaacgaaagcccaaccaaattattatccaggcccagccaacggcgaccacaaaccgagcagataagcccatccacagatcgggtggctcccgtttgccgcctaacggcaacctccccacccaaaaccaaacgccgtcacctctcaaccccgccccaactcaaagcctcttccaaatggccctcacagccgccgtctccgtccccttcgccgtcacccctctccgccgcctctcctcctcgacgacgacgagggctttcagcttcagggtgtccgcggcgg

SEQ ID NO: 1886 - DNA, 2000 bp, Oryza sativa
  misc_feature (1684)..(1684): n = any nucleotide
  misc_feature (1985)..(1985): n = any nucleotide
  misc_feature (1991)..(1991): n = any nucleotide
  misc_feature (1994)..(1994): n = any nucleotide
  misc_feature (1999)..(1999): n = any nucleotide
tgagtacttgtagctttagaaaagacaagatgaaaatgctatatgtttgtttgggttcccgatttttggtttacatttgagttagagcaagcagagaaaaaaaagaacttcgtctagtgcaaccattttgagcttaaccgctaaaaatacaaaattaagcacgaagtacccgtacgaagcaccatcactccgaccaatctacatggtttcatttcaaccaaggcatcacaaaaagcaaccttccaaacgatacacatgccaacatgttcagttcatatcacactatcagacagtgtttggaaacaagccaaaatggacccctctaatccattaaacagcaaaaggtgtgtatgtccattaccttcctccaacaaatgcaaaaggcgcgaaccatagaatcgacagcccagttgcccaagacgatgatctattcaacatagaaaaccaacacgcagaagtttcgtatgatgatggatgggattcagattttcagagtttgcgttcggtgttagctaatggtacgctatgagcgatgagatcgacagatcgtcctagatgaattcatcactacctattcccaactttccatcacatcatatcacatcaaaaacttttctacacacatacactttcatttttttttcaaactcccaactttcttcaaacttccaatttttttttaagaactaagcacaccctcagaggaaaaattggtctcacaaactgccaatgtgggtaaagtctggaagagttttaattgaagctataacgaacggagaataaaactattgctcgcagatgaatcagtgacgaacatgacaccgataatcgcttcctttctcatgaatagtactgtttggggaacttatagctgaagattattctagaagttgcacctcccataagctcctctaaatagttcatattttcatttagattatgagaagttatagttatagaataaaaagtaatctactccatccgtttcatcatgtaagactttctaacattacccatattcatatagatgttaataaatatagacacatatatatctatattcattaacatctatataaatgtgggcaatactagaaagttttacattgtgaaacagagggagtagaattcagaagctgagtttttcttcgtattctcacccgttacttagagttggtttggtttgaggcctatattggccttaccaatatttggcaatttcagtagtgtttattgtctatttggtttggagctaaattttggcatgcctaagaaaataggccatttcaacagttaatttaggctattttggcttcaatccaaacacaattttacctttgccaaaattagccatgccaaaagttaccaaaatttgatattgataaggtcaatttagggcacacaccaaaccagcccttacaacttacactttgttcagagcaacaagcctacctaccatgcctcgccgcgggtcgctctcccgagccgaagaagagataagggagagatcgtgcgagccaacccgggggcgacacctgttcccccgcgctgggccccaccgcggcgacgaatcgggcgcgacgccatgcagccgtcgtcgtcgcatcccggccacttgccgtgtgacgacgccggtcaaattttcgcctcgacaacgacgagcacatttgccgcctttcccttncccccgcgagactgggacgcgcgcatccaacacacccccaaccccgtcggagtcgagccgagccgagccgcgccgcgcggcggcagcgctggcgaacaaacaggcccgccgagacagggacttccgtggttgggagcgcgtccacgtcgcgcgccccgcgtcgaatacctcgagccgcacggagctcaaatccgcagcctggtggggaggggaggtgggtcgccgaaagcttggctgagattcgcctcgcctcgccttctagctcgcggccgccgctagcgcgagtgagagactgagagtnagttangtngtgtng

SEQ ID NO: 1887 - DNA, 2000 bp, Oryza sativa
  misc_feature (1094)..(1094): n = any nucleotide
  misc_feature (1101)..(1101): n = any nucleotide
caaccttccactattctacttccaaaccgagatttctctcaaccaccctactccaccctccaccaaatgaattgtactttgacaaaagaaattataaatttactctctgcagcaaaatggcacgctgatgtaaaatagtagcaggaaatgtgcaaggtaacaactgcctgatcagtataagttgaaaactccgaaatcatccagctatgggatttatggttgttatagatttaaaaacctccatattgattgtttgtacagaatgatggatgaggatgcaatttcaaaggaatatggttgatctggaccccatgagacaatgcgaggatcactcctgggaatggccaaaaagattctatcatctatggcacacagggctagagtcaagggtgtgaccttagatacagagaaaattaattatccgatcatgaaacctctaagttgcatgcacacctcatgagtaatattttaatataccaaagttgcaatattttgtaagtgaggcaacaggattcactaaaaatcgttaacattaataacacgttcatacatttctaacaaaagggatctcaggcttgaaacgatgaaaaagagaagcgcggcaacaagttacccgtagttcttgggcgcccagaggaaggcaggccccatcaccggagccgcggctgacacctgcgcaaggaggagcatcacggccaccaccgccgcccaggcagccgccatctgatcggatcgggcccaaattagacaccccggaacaaaaatcaggacaactgatgacaaaaaaccgatccgcaccgccaagcacagagatctgagagagatcttaccttggcgcgaagagaagcagggaacccggattggggatttcggactcgtgcaggctctcgccctcctcttcgtggcgagatgttgttgttcgtcgttgtggaagaaggggcaagttgctaaccacgattaccttttttttttcgcgagagagactggcgtgtgggtccggaagtggacctgagtgggccggcccaagcccagacagcattaggccccaagcgtattggggctttttggctgacctggcctgatgtaggatgttnaattttnctttttgaaatttagaggatgtttaatttggttttgaaatttatatgttgcttaaatgattaattaatcagatgtgggttgtattgaatattttcctactggagtaataataatatggaaatatactaacgcttctatgctgtgaactgtgttgcattgcacgtctggagaaacaaacaaatattgtaagaaaaatgtgtaaaaccgctaatagaatatactgatactatggatgaagcttacattacatcataccaagccaatgggtgtaaattttgcttgaagagttcgaatacaccttcgctttctctcactgattaactaacctttattctcaagtttttctcaatgcaggtgagtcatccaaacaaaccctcttcggagaataactaatggagctaaatttctctagagactcaaccagatacaatattcattgtgtgtttttttttcttctcttgagactcaaacaagctaaattattcattatgcatttttcctatttatgcactgctaaaagattactgcaatgttaatcctggagtactctttttttttctgtgaaatttggaggagtgttattgtttcatctaaaattactcttaaaaatgtgtttgaggaaaaaaaatatttgtgtacagtacagcagaagcagactagcagagtgggaccatagggcaacaggagaatccgacaatgaccaagcagtgaacctcgaccaccaacagatgaaggtgaagagcaactgattggccatgagtccagagatagcattgaacacaggacaaacaacctgaattctatctccattgatccacaaagaaatcaagaagcgaacaaaaaagcaaggcactgcattcccctgccactgctgagcagtgagcacaaatcacagacac

SEQ ID NO: 1888 - DNA, 1427 bp, Oryza sativa
  misc_feature (3)..(3): n = any nucleotide
  misc_feature (21)..(21): n = any nucleotide
  misc_feature (36)..(36): n = any nucleotide
  misc_feature (45)..(45): n = any nucleotide
  misc_feature (47)..(47): n = any nucleotide
  misc_feature (50)..(50): n = any nucleotide
  misc_feature (58)..(60): n = any nucleotide
  misc_feature (62)..(64): n = any nucleotide
  misc_feature (79)..(79): n = any nucleotide
  misc_feature (81)..(82): n = any nucleotide
  misc_feature (85)..(85): n = any nucleotide
  misc_feature (88)..(88): n = any nucleotide
  misc_feature (90)..(90): n = any nucleotide
  misc_feature (93)..(94): n = any nucleotide
  misc_feature (96)..(96): n = any nucleotide
  misc_feature (98)..(104): n = any nucleotide
  misc_feature (106)..(108): n = any nucleotide
  misc_feature (110)..(112): n = any nucleotide
  misc_feature (119)..(120): n = any nucleotide
  misc_feature (122)..(124): n = any nucleotide
  misc_feature (128)..(128): n = any nucleotide
  misc_feature (130)..(131): n = any nucleotide
  misc_feature (134)..(136): n = any nucleotide
  misc_feature (140)..(140): n = any nucleotide
  misc_feature (144)..(144): n = any nucleotide
  misc_feature (146)..(147): n = any nucleotide
  misc_feature (151)..(151): n = any nucleotide
  misc_feature (154)..(155): n = any nucleotide
  misc_feature (160)..(160): n = any nucleotide
  misc_feature (163)..(163): n = any nucleotide
  misc_feature (165)..(165): n = any nucleotide
  misc_feature (168)..(168): n = any nucleotide
  misc_feature (173)..(174): n = any nucleotide
  misc_feature (213)..(213): n = any nucleotide
  misc_feature (305)..(305): n = any nucleotide
  misc_feature (1318)..(1318): n = any nucleotide
acnttgggccaagggccggcngcccaggctaacgtnccggaaccntnccngtttcgtnnngnnnccttgccgcgtttgnannggnctncnaannancnnnnnnngnnntnnnacccatnntnnnaacntnntannngaangaangnncgtnccnnaaccnaancntcnaactnncgggtaacggcggtggtgttccggaacattaaccgggancggcgaggcgcgcggaggcgatcaggctggcgtgcagcgacgccgtgccttgcgtcgcatcgtgctcagcgacatcgacctgcgccgcgagnacggcggcggcgaggtgcagaccgtctgcaactgcgccatgggcttcgacgacggccgcgtcagccccgccgccgactgcctcaggaccagcccctgcggcggcatgtcgccggacgactaccaccccgacgacaaagacgacgacgacgaggtccggcataccgagctgtgaactgaactgaactctcatgcgtgaatgctaagatcgatcggcttaagctcaatgaagcccttttgaccctgctattaattacagtagtagtaattaattaattataattaattaatcctactggtgctttcctttttgttacagtgtgctttgtaaattaaatgtcacagtattatatactcactccgtttcacaatgtaaggtattctagtatttctaatatattgatgttaatgaatctagacatacatatctatctaaattcattaacatcaatatgaatgtggaaaatgttagaatgacttacaatgtgaaacgaaggaagtatctcattatgcttgacgtgcatattcgtgcattttttacaacattctcgtagtagattatcaaagaaaaatgataggtagattatctactccctccgttccaaaaagaccttatctaaaagtaggacgaaacataatctagtacaacgaatctgaatacaataaattatgtcccattttaattttagatgggtttttttgacggagtatactgtaataatttagtatatccgataatgtggtatgtgggcctccatttccatggcccataattctcaagtacgacctggcggcccaaagaagtggtaaagccttcggttggtccgtatcaccactcttcacacacggcagtaacaaccaacgctcgagattgctcctgctgctacgatcggacggtcaggatcgcgcagcaccgaccgccagtaactgttttttttttccctcgtggcagcagcggtagcctatctccgtggaggtggaggtggaggcccgtgcgtttggcggccgccgccanggcaacgtgcttctcccgtccacttcttcccaccccccaattcaaagccaaagccacaaatcccaacgcgagcgagagaagaggaggggagcagcagcagcagcagcag

SEQ ID NO: 1889 - DNA, 2000 bp, Oryza sativa
atgttccatgagattattttccctcgttttggaactccacggatggtgataagtgacggagggtctcattttatcgataagaccttttgaaactttttgcaagaacttggggctcagcacaacattgccacttcgtatcatccccagataagtggacaagcagaaacgagcaacaaacaaatcaagaatattctgcagaagactgtcaatgagattgggaaggcatggaagaacaagctacctgatgcatgggcatataggactgcttataagacgcccatcggcatgtcaccataccaccttgtctacggaaagacttttcaccttccagtacagttggaacacagggcgcactgggctatccggacttggaacatggacttaaagaaagccggacagcacagaaagatgcagctctctgagctagaggaatggagggacaaggcctaccacaatgccaagatctacaaggaaagaacaaaaagatgggatgataaatgaatcaagcacaaggagttaaaagctggggacaaggtgctgctgttcaactcacgggtgaagcttatcggacatggaaaacatcgaagtaaatggatgggtccatataccatcgtcgatgcttcatcgcatggagccatcacgctatgcgacaacgaaggtaacatcttaatggtatccaacttagtggtaagtattataactaatcatttccactagtgttggtgaaatatgtgtatgcaggtaatttgaggagaaaacacatccgtcatgtcaaaatgcatctctgcgcattcaggacgcgtttacacggattagtggcccaataagtcaataaaaccatttagaattgggccaaaacataacccaggtggttagaggcccaataagcaacctcccggcccaaggagaggctgggaggagagtttttgggttcggccgaaccaatcatggcgcttcccgccatctgctttcaccgggacggctcggatttcttcccagaggtggttgcagggtgttttagacaattcccatgcccctaaccgttatttggagcctatataaggaggagctcactcacattccaatagacacaactttgagctgaattacaacaggctctattgtatcttttgtacattagaataaggtagagagtgaggggaagctctggaggagtgcccggaagtttggcgctcatccgacttctacctcgacgagtgtagcttcttaggaggaattctggaggagtaccagagttgtcggtacactctgctccaggttcggagaacttcttctaaaaagtaagcatttgtattcctttcttatgttatttaattatttagtctaagtaagatagatttccatctttgcaggttcattgtttagtattcatactaagtgctctagtactaggactctagataaagaaagaagttcctgtacaagtattagagtagtaattaataacttagacgtggtgtctaggttagagattacctttgtttgttgtgtatcccacggatttgtcagaggtaggcggcaggtggtgacagccctgaatcctgtctcagtaatcctccatgttcggatacatcatagagctatagccggaaccacgctggtagaccagcaggggtcgatgcccgaagcaacatataggaaattacctttgcttagcttagataattaaaacacatagaaagtcctctctagcctacctagcctaccttgtccttggattgtcttatccttaggtggattacacacgttccttgagttcgatatccttttggggtcacccgaaggtgaagtgatacagcggtattccgtgcgcttgcggatttatctgtggtcgtaagaaataccaagaaatatttgtatgcatgtaattatggatgaaaaccaccctccacgcgaagagaaacacacctctggccaatctatgggctaactaatcatatgaaactaacataattgaagcgaatttagtatgcaccgtc

SEQ ID NO: 1890 - DNA, 2000 bp, Oryza sativa
cggtagggaagagcccaatccccagtgtcacaggaccacgtacaggagcacccgaggcggagttaccggggcatcgggtcctctcctccgtcatcgcagactaccattgccctctatcctcttcgactgctcaccgccaccttcccatggactgtcggtgagctagagctcgccgactccctcatctccctcctcttctccttttgctgccatggtccacaagagccctctcatcaccgacctcccaccgccgcgctgtctcccgcggacgggcttgccagtcgctgccactctctcctccattgagctcctgggaaagagaggggagaggtggagagatggggaagagaggggatagttgaggagaggaggaggtccacttacatgtggaccacatgttttttaattttctttttgctgactaagatatgacgtcagcccaaaaccaaccatccgtactgtcatggaacttggcttggccggtttcgtctgtataaggggtgaagatttttggtattacggtttagggatgtcaattaaactccacgaaaactgagaggcgatatgtggacttgtttctttctcgttttctcccggaataagttcatctgaggtcccttaacttatcgacgaatccgattttcgtctttcaaccagaaaatcagatataataggtcccttaattatcaaaaccggtgcaatataggtcataaggaggtttggacggcggttttagctgacgtggtgcctacgtggctaatttgactcggtcttcatctaacgcggcattgacgtggcccttacgtggcaatttgatccgaaaaaatagtaaaacccgtgggaaccatatgttagcttcacatacacaataataaaaaatggtgggacccatgtgggccctgcatgttattctcaatcccctcctcttcttcctcctgacctcctctctcccccatctcacctatcttcacctctctcccctctcctccctcctctcaccgacggagatgcggacggcgtggaggcgcgacctcctccactcccgtccccatgggcttaccgccgacagccaccgtgcctgcttcctctgccgctggtcgcaggtgcatctgagcaagaggagccacatgcgggaccagactgtcagcgccatggatgcagctacatggctagggaatggctctaagctgctgccgacgtgcagctcatgggcgatacccttgcagtcacgtggcgcgtgtgttggaggaagcaacggagacggggaggtggccgcgtgtcactgaggaggacgggggcccggcgaaggcaagagcggcaaccgtttctgaggaaggcccgggggcaaaaggcggtgctggagaacggccaccggaggtcgaggcgagggggaagcggcggcgacggcaggaacatccggaggcggtggaggcaggcgtggcgggcgacgaggagaggggtggcggatgcctgtagtaggcccatggggggcgagagtggaggaggctgcgtcttcaagccgtccgtttctccgccggcaagaggagggatgagaggggagagagatgaagacatgggagatggggagagaggaggaagaagaggaagggattgagaccaggggtttatgtgggccccactattcttttttattattgtgtgtgtgaagctgacatgtgggttttataggttttttttttcagatcaaattgccacgtaaataccacgttatatgaaaaaccagtcaaataaaccacgcaagctaaaaccaaaccaccggttttgacaattaaacgacgcattggttgacaagttaagagacaccagatgaacttattcctttttctcccgtagcgcgcgcggcccacagcctacacggcccacctcccgcgctaccccccagtgggcagtggcgacgctatcctctccatccgctcgcggctcgcgctcgcccatccaatccaccgcaagccgaagcgtgagcaaagtgccctcgagcc

SEQ ID NO: 1891 - DNA, 2000 bp, Oryza sativa
  misc_feature (921)..(921): n = any nucleotide
  misc_feature (924)..(924): n = any nucleotide
  misc_feature (932)..(932): n = any nucleotide
  misc_feature (939)..(939): n = any nucleotide
  misc_feature (948)..(948): n = any nucleotide
  misc_feature (958)..(958): n = any nucleotide
tttagactaaaataattcaccaaacacttcaccggttcaccctttgtcctattccgttctgcagagaaaacagtgcttgaggttcagagttagtagaagctgcaactctcagctttgctagctagctagaagcagctatatatcccttatcctcttatcgcctctcaccctctagcttccctctccactgcctccctcgctcgctatctcctgcctaagcgctaagctaagcgacctgcagttctgcaatgctaaggccaacgtagagctgccgcttaatcccgtctcgcttgattggtttctgacaagaacgagattatcgagaggtttcaattcattagcttagcttagctaattagcttgagggacgccagccatggcgcccaaggcagggaaggccaagccgcacaaggccaagggagacaagaagaagaaggaagagaaaggtgcagcttaactgatggctaactgaatcttcttcacttcccatctgaattttcatcgaattcatcagctcggatgattggtttaatttaattcgttttcaagacaaaagttattttcagatgcaaggattaattaattaagctagcttgcctctttcaatatttgaaagttcatattgtttcagtattaacatgtgagtggtttttgcgtggaaatattgatatgatgctgctgcagttctgcccaccgtgctggacgtcaccgttgagacgccggactacacgcagctgacgctcaaggttagcgccggggcgcgtattatctccgtcttctcgcatggatattttcgcgtaattaattaattaatatggaccacccagtattctgaccagtgaccactgtaactgaatatgtactgttccttctattcgatggccttaattgtgcttgcatgttaaacgacaaaatttagtnaantcctctcnagctttnacttgcaanactttcaacntggtttttttaaaaaaaaaggaaaaaaaactttgtttaaagcgaaagtgcctaccacttttctcttagaaacttctatatttatttttttcaattgcacagaaaacgtgtttttcttgtgctaattagcaatggcgagcgaccgagcataagcggcaacttaacaaagctggcaaagaatgaccccactcgttgaaatgtacatgatgagaatttttattttctatacgaacattacacaaaaaagttcatgggcaatttacacatcctaattatttttgagcaagttagcaatggttgtgttagcttaagtacatagtaccattttgtgcaatggcatgtagcctactgattatagtaacctcagtagcgtcccaattcccaaggttttgagttcaaatctcctagtgaattttagattagggctgtgtttagttccacgctaaaattgaaaatttgaagaaaaaagttagaagtttatgtgtgtaggaaagttttgatgtgatggaaaagttgaaagtttgaagaaaaagttgaaaactaaacaagactgggttatttttggggttaaagttccgagtttaaatctcaaatttcatattgggttgtttgtgtggctaaattatcaatttaaatatggtacttataattcgcagtggtaggtgccaactcgctgcctagctcattttgtgtttgtggtgctttgttcagggcatatcaacggacaagatcctcgacgtccggaagctcctggccgtccacgtggacacatgccacctcaccaactactccctgtcccacgaggtcggtcagaggatcccaacggctcacatccgcctcgagattcgtgcccactgacagcctgtactttctccctctctgccaccaatgcaggttcgtggggcccagctcaaggacacggtggaggtcgcctccctgaagccgtgccacgtcagcatcgtcgagggtaagtctgaacgagcaaatcccgtatttctcgaggaccaaaacgcaaaaaaataaaaaactcaccgtctcgtctc

SEQ ID NO: 1892 - DNA, 2000 bp, Oryza sativa
  misc_feature (1890)..(1890): n = any nucleotide
atatgatctcgccactaaccccaatgggcttgacctgtgtgaatcgctaaagcatctgaggaaaaaaaaaagatctatcggattcgagctctttccgccagatatacgtgccgaaccccagggcctttttcactagctgaggaacactttcggtggagatggccacccggatcttatagtaagtgtagctactagaccttgcagcttcttcgtaggtagcgtacactttcgccatggtgtctatatagctcagcagtgagcgaagcattcttgttggggtcaacacttttttagttttagcctgtaatataagcttagattcggccggccacttttcgatctaactatgatgtgcagatcttggccctgaattgttattgtaagaaatagattagacagagtgctcgccattcaggtgagcaatggttacacgaggacaaacattcttcccccaggaagtcacaaatctcaaaaggtttttgacgggtgaatgcttatttcttttttcttaaacgcaatccacattttttttcttcttttgattagcgatactatttgtgcttaagatatttaccatgcaaaatggcttggagagagagaatgtctggactgaagttaaggattatttggagagcttaaaattctgataagcaactgattagtagccaactttgacaatctggaaaagctgggttttctagtttttgacttcaagttcattttctagattctacaaatacagtttctcagaatctggaccaaaagctagactgttttagatagtttttgattctgatagaagttgcaacagccaaaagctctcccaaactcccaaacaggcccttactatcaagtgtcattgcatagtactttgatagttgatggataggctccgaaaaaacaactgcgagaagagtgttgcttgcacaatatgatccatatacaatggctctgcccatcaggttattttccaaccaatggctcccgtccctttgtcacccctgagatcactttcttggttgaggtggtggctttgatctgacatgttagcataaggtcactcgccacaccaccattgtaaatgctcttaagcagcctctctagcgattccataatggtgagtcagtgacagagcaaaccatgatttgagagaaggagcatatttggaatgctatgatatcttggtttcatacagggttcaaaatttaggtgaagtatctcaaatttccaactgttttatatacaaaacaatttattcgatatacgtttttttctctcttcgaagagaacaaaatacttgcatgaatatagtttaggtccatacatccataccctttttacatgggcacacaatccatgcttctccccacagcccaactgttagctagaagaagagattacatgacatgagcaaaccatcgattctattcttccgtagtgctaccaggatcattgctgtgtgaaaactgaaaagccataacgaaaaattccatagtgctcacgaccaagacgtgtgccactaaaaactaacgagtacacgagcagaacgtgtgtgtgcctctcgagtcacgagctgctgtacaccaggtatgcagatgggggaggaggagagtacgagactaccggatgtaaaccagaaaaaatccgtaaaaaagccctccaaaatactactcctcctactgctgctgctgctgcaaaagcgaaagaggattagctgaaaccgggcaaaagggagggcgtttgccacctatttcaccacacggccgcggcgttttgtgtggccttcgtctcgtgttatctcttctcttcttcccaccccctctctctctccttctcctcccttccgccttcatcatcggcggcaaaccccttcttccatccatttccccnaccgaattcgcgcgcgcgcgccccgtggctgcggcggaggggaaggtgaggacggcggcgggcacggccacggcctccgagccgccgatgagattgcgcgccaccgcgac

SEQ ID NO: 1893 - DNA, 2000 bp, Oryza sativa
  misc_feature (1214)..(1214): n = any nucleotide
tttctccatgcgcaaatcacagttttctccatgcgcacgctttccaaactacgaatcattaaatatcatactttaaaaaaatataggaaagttactttaaaaaattaaattaattaatttttaaagtttaaaataattagtccttaattaattatgctctaatgtcttaccttattttgcgtattttctcaatcttttctttttacctcctctcaaacacggtgaccaatgagcactgagctaccactagaaacctaaccaattgagctacatttacttcgctagtatgtaatttataacgtagttctcttgtagaatatatgtttgatcattcatattatttaaaactttttacaaatatatggaaatatatagtaccgttatgacaaagtacttttagtgataatagaaatcacaataaaataaataatcataatattattttttatgaaacaataatcagatgtaaattaataacggcgtatattaaaatcggagggagtactctctatttgaaagcacgagcttccgaatatgatctgtagctctatcctactcctctataaaaaaaaattcaaactggtccagattcatccctacagtttgattttttttacggagagacactactacaggaatgattttccttgacgggggtcattttagattgcaaacggcgtgtaagtagttgcgtctgcgaaaatcgtgctccattttcacgtgcgactctttaagatgactgcacaaaaaaaatcaattatcgcaggcgggccacttaataggtccgcatgcaaaaataggcttgttttcgcgtacggacctgttaagtcaccgcacacgaaaatagcctctcaacttttaatccgccgtcgctgccccacatgcacccactctcatcgctatctccttagatcccatctcacacctgctcctcccatctccctctccgcctcctcctcccatctccctatccgcctcctcctcccactcctccctctccctatccgccccctcctcccactcctcccatctcccagcgacggcggcagcatcggagcggattcgttgccggccgccgcagtgaggatggatccatcgcctgtgaccgcgaggggatccgtcgccggcgacagcggggacgacggcggcgggccttaggcaaggcggcgatgacgacggtggtgacggcgacgatggcggtgacggtttttttngtttcgattttttattttcccgtgcacacgtgaaaatcgcgattttcacagacacttcgttccagacgggtggaagattcgcatgctcgaccgcacagaaaaatcattattgcactagtgggagtatatgttagcagatttgtttcgagcctaatcaacttttattatagttcgtgtgtgcgcctggatcaattatttgtgaactagagagagctgtaccaaagctgaacctaagaacctgattatttgagcgggcgtccactgtctagctttactagtactactattgatcgagtcaatgatcgctctactagtactactattgatcgagtcaatgatcgctctactagtactactattgatcgagtcaatgtaacgatctgtttggtggcatatgatgtattcttgatcagcaaaacgtatgcttgagctgcaagccgatgtataatcaaggaaatgaaaaacaatgagttccacttgccatcttgggaccaacaatatcttttgatctctccgaaccagagactaccattaaattagacgagcttcagaatcttctagttcttccggcgaggtgaatggattaactcttttttttaaaaaaaatccagaaacatgaataccaagttcgtaaaacacgagagaatcgatccaccagccgaacgactgccatcttcatcagctataaaagagccgacaaatctaggtgctccgcacagtgatacagatcacttgcgccatcacaagtcgcaagccaaaaccatctcactgactagctcgagctca

SEQ ID NO: 1894 - DNA, 2000 bp, Oryza sativa
atatctcaaggcacgagtgggagagcacggcaacgaacttggagacgtcgacgttgtcctcggccgcctgccgcggcggtcaagagggacgcggcgcccacaccgacgccggggtcggttggggccaaccggagcctgaccgaggcggaggacaccgaggtggacgcggagcggggcccgatctcggcgacggccgcgcggcaccggaaccgccactcgtcgacgtgccgccgcagcttctcctgctgctcgagtaagactgccgccgggagcaagagcaggcagagttaggggagtgagtccaaccgtggtacggagagagagagagggaggggaaccagcgaggtgcttacgtgacgccatcgccggcggcgaacggtggtcgccggccgtcgagcagatgccgcgaggggagggaaggggagtttgaggaaatcttacatccaagcccttgcaatctccccaaattcttcttctgctttgtgttttattcagatgaacccccaaatttacgagaaattgtaagcgtggctctatcctttgatgcgagtgggccgataaggcccgtgaattgtttgggctctttctcgaaatttccagccgattgggccgaaacaagtctcccgtcacggttgccacaggccatccagtttgtccgattgggtcccttttgagttttttttgttcacgtccctcaacctcaaaatcggattcaaagatccaaaaacttatgaaaccattgcaaaatgagtcccttaacggtttggatggcgttttcgtgctacgtgatgcttacgtggtgttgttgtcctggtctttaactgacatggcataggttatcgaaggcccaaagcccatcttgatttttaccaaaaaaagatcaaacgaaattacaaatgcaaagtcaaaatcgttcaaaaaaagaattttcgtttataatggtgctgtttgttgatgtaacagaaagtattgcatttgtttcatttttttttgtccgaactttgtctgaaccaaccttgaaatggacgatcacatgagaatgacctcggttacgtcaatagaataaaagtgaccgaggacgaaagaattgcggttgacctgagcagcatttttgacaaagttttgaccctaagttgttatgttgtttcattggcatctgtcagctttgattcttgcctttgagttgagaatcaacccaatatacatgcatggaacggtacgatcgagtattattagtttattacaataccttctaaatttttattttttctttttatttgaaaaggtaaaaaaacacaagcgctcataccacgcacacactcacacatattttttcaactctgatatcgtttgcttcgtgaagcacggatacagcaacttaattactaaacaaacagtgccaggtgtgcagtatttctagacaaagcaaaggcgcatttgtccaaaggaggggagattaattaacttaagctctctggatgatctgttcctgcttcctggacagaattctcttgccgattggaacaacctagctagcatttttcttttaaatttctatcagcattattcgttgtcaaaatcgtcatcttggtttggacgatcaaatgccacttcgcctccttctcgtacctgctaaattcgtgcacacacatggacaaatactaatagttataatttgccgaatgatttgcagcctaatactcgtagattagcttgggaagaaatcaaatgatgtgagctccaggaaatcatcggatttcttccccctcctccaagaaaatcaaagctaccactccgtacatcaagagacactgacatgtgggccctacagagaaaaaaaatctccgcgcgccaagtggccccacgccatcctagcttcctctcctcttgaaatagccgccgctgctcgtctcagttcgactcttcaggtggaagccacaaaacgaacgcgaactcgagcggcgaagaagaagagagagagagataaggcggcggcagcg

SEQ ID NO: 1895 - DNA, 2000 bp, Oryza sativa
aaagcctgacctggagattaacagaaagctgagttggagcagactgtcacccactctggcatccacaggagatgtttggcagcttgttgtacagttgaagtggaaaatagtacgctataactggaatatgttcggtagccacgaaaattagcttattactaaactgaacagttagcatgaaaagacatactagactttcgttagctaaaaagtgcaatcatcccaggatggagctacatatatagacatcaggataacaagtctccacggtccatgcatcccaacatgcatgtttgtctgaagtatacttcagtattgaacttaacatcgaacatttaggatgtattaatagctccagtagcaggtaaactttcacctgaaacaaagaatctctgtctgatactaataattagcctaactaggattaatgagaactcagtatagtcagtgcaacaataacaatcaagttgcaaatattgacaaccacatcacgatcaaattgtccttcccctgaaggcacaaatcaaagcctgaatacacgcaaagaatgaaaagaaaccagctgagataatgccactgcaagctgaaagacattaccaacagtccaacactgtcattttctttgtctgccagcctgaggagagggagctacaccgtcttcagacactcagagccacataataaaagatggacgaattttagcaaacctccgtcctactatcgttttgaatttttgtttgtaacgtctaactattcgtcttattcaaaatattatgaaattattacttttttttacttactttattattaaaagtattttaagtatgacttatcttttttatatttgtactaattctttaaataagataaatagttaaacgttgtaagtaaaaagtcaaaacgatatctaatttgggaccgagggagtactagcatgccccccatagtgttcttttagagcctataaatttcccatgcttcaagccgaaaagaaaatagctgtagcttccctggaaagaaaaataaacctaaactctctctttttctttaatagtagagcacaacatgggaggtccccactaaagtctcaaactctcttagcttaagagcagcagttttctttttttaaaaaggagaatttttagaggaattttgtaggattggattaattattgtaaaaagcatgtgaatttcttgcattcgaagcaagccttcagtttcctggtgtccaatataatacctagataaggtgtatgtagtgaatttattcctaggagatgtaaccaaattggtcctcggaaaaaaagaatgatcatcttaaagtatgaactccaatatgccctaaacttgcggcacaagctgagtttcagtcgtatcactgtagcccaatcacgacatattatcatctactaaaaggaattcccataaccgaatcgctgatcatgctagacaaacactccgatgaccaaaagactaccagccaagcgttttttacacagcagcaaaaaaaaaaaatacacttgcttctcattacgcacagatccaaaaatgaaaatgaaataaagaaagaacaaaagaaaaggaagaaaagaaaagaaaagaaaaggagagcatatcgtaggtgtgcatgtcagcaatgaaggatttgattgccaagtaaggcgggttgagagggagagatggtggagagaatcaaaaaacgcaccctgcggccacaaatccatcttgtggctctccaccctcctccgtgggccccaccacctccacccccctccctccctccttaaaactatccccaatcccatcgcctcgcttgtgcgaatgaaaagatttcaagaaatccaaccaaaaatctcgcgctctcctctcctcctcctccgcatgagctcatcggcgttggcgttggcctgtcgtctccgggaggagtagtgcaggcggcggcggggaattccgaaacggagtttgttcgttttggagcggagtggtgaggtgagtcgtcg

SEQ ID NO: 1896 - DNA, 2000 bp, Oryza sativa
cggcctggtccaccgccgcttcccggtggggcccatcgccaacgtgccctacttccggcgggtcgccgccgcccaccaggtccggcccggtcgctctccacctaactgcagccgaccacgcatccctgtctctgagcttctcttgccgtggttctgaatttatgtgagctgatccatccttgcctgccattcattcttgcagatacatcacatggacaagttcgaaggtgtgccatatgggctgttccttggtcccaaggtgaggagatgtgtctcatgctattcatgctttgcttcctcgtgccccatgctaccatggatgcttgttggcttactcctgctccaacggtgtccatttgtcgagtagtttgcatacttgcagtactcctttattgcaagcatgaatttgtgattgggaagctaatgtagaatttgaactgtgttgatataaaaggactggaaattttgaaatgttctaagatgtattacaaatatttgtgatcgtcggaaaaattgtctgaaatgttctaaaatgtctctgttttatgtggttgacaggagctggaggaggtgggtgggattgaggagctggagaaggagatcaagaggaggattaagaggaaagagaccttagatgcgatccaatgagagctacttatcacacatttttttctttttatttgctgtcatctcttattagtttttgcttcagtggcaattgtagccttgtaatatgcttttctgtcctgttaatagaggaataatttagatagatatttggaagctcaatttggacggtggagcacacaggtattagaaatgatgtgctggggctgaatggctgatgcttttgctagtactgctggtaatgatatatattaatcagtaccattctgaatttattagtctggttgagtcgtgctgctgacagtgaggtgttcactgataaaatgtgtactttcttttatattctttatttgccgacattctgtatctcttgttcacgagatgtgccggatgtaaatatgaaagtgatgcatggctgattactttttgaccgtgaagaagaattaatgaagcttatgcacactaggcggttcctccatactgctgaatggctgttcattaaggccctgacaagtgacaaggtcacagactgacagttacttcttgaggtcaaggaggttaatgtagtttatcaggattaggttgcaaactgacaaggaagatattgtccgttgtgtttctactcttggtgtcaagtcgatcctcacaggatcacggtcgtggcattgctggtccttggtagaacaaggtagggcaagcgcaatgttgtgatctgggacctttcaaatcagatcctagtgattgtcccctggttataaagaactgcatgttacggttactgcatgattagttaggcataagcatgtgacgaggatcctcgtcgtgatattccgtccatttttcaatgttgatcaagcgtggcagatctcctgctgatctgccagcaactgttgctaggttcagagtttgcttgatcttgtttaagctcttcatcggcgttttttatgtttgaagtcatcgtttaatggcatactactactatactagtgatgtcctgtagtgcattagaaaatacagaatgggccacatactcaaacactgttaccggttgaccaaaacaaggcatatatcgaaattcacacactgcagacttgcagttgttgactcatgtaactttacccttctcttaggccgtgtttagttcacccccaactcaacggttttgatgggcctaaggcccaaatcaacggttttgatgggcctaaggcctgaaaccatgtcgaacagttcgatgggccgaaccatgacgagaaagcccacctgcgacactggacagcaacggcagccagccacagccaactcgccttatcccgtaatccatccatggcataaagctccctcctcagctcccacctccgtctccgcgcacgctc

SEQ ID NO: 1897 - DNA, 2000 bp, Oryza sativa
gtataattttctcctcacggacgaactaatgaagaattatatatgtacacatcaacttgcgagaaaagaatctcctatcggagtagaaaataggagaatcgaatcgcaccgatcacatcatcagtcacatggctccacctccaaggatcaaggctttccacaacaagtggggatatatagcaacaaaaaatgcatttgatcatgttcttttgctaaatatatacttggtccatcagtacatgtatgtgttgattgctgattattacaagtacatatataccaatgcatttgtttttcaaagtgcttcttattaccataaatttatggtagaaacctactccatccgtccatagaaaaataaatctccttcagtctttaaaaaaacaaatcctaaacacgggatttagttttttttatggaatggatgaactataaactaaattaatggtcaaagttcgttttcagagaaaatcacaccaagtcaaatcatgccttataattaagaaaagatacagaataaagtatatatagattggaacctaattactaactagtacctcttgtgccagagacagccaaattatctgtcttttatattcatttttataaatcatgttctgtctattaaagccatattccgattaacgcatagggaaagcaacagggattgcctttaaacgctcatgaatcgccaaaaagaagggcaaattagaatcagccgcggcacacacacggaagaaatgtctttcactgaatcacataaagaatctttctttccattggtttcaaaaaaataaaataaaaatgaagtagtgggatactaaaaccatggacagagagtcatgcactaaaaggttggagctagattgcttgatattattctctctcagaaaagcaagatatatatgctcctcgatcgatcttacaaccacacacattctttccagtgatggaatccgatctttgcaactagctatttggagacagtgactgaatgttctgaaccaaataattgcacttattacagctctttctacaagtaatattttgattgtttgtttgtttgttcttcggattagctagcttatgcataccgcgaccatttgatcattaatattttcttcagatgcagcagcgtcctcgataactgtgagataaacaattgaatatgtaagcggtaactgaaaattattttcttcagatgcagcagcatccttgataactgtcagaaaaagaatcgaacatccatgcagtaatttaaacaggaagtctgaacatctttgtaaactgaacatgatttatgtatgagaagtgcattttcatttcctcgagggaacttcatatcccttcacgcgtctttaattatttctcgaatacaatgctaataattcccgctaaaaatgaactaactgcgaacagggttcactctatcgggacagccctttgtatcgggggtcaccgaaatcccgaaatttcggttcgaagtttccaaccctgactgcgaatacgaacaaatcttcattacgcgttctaactaaacatccataggtggagtccagatatagctatagcttggattggatctttgaataataggacagagatggagatcgatggaacatatgcgcgataaacaagctgaatcgcgacgcgacaggagcaaattaagagatagaaagagagctaataagctagctttagctagcagagatcctccgcccacctcccggggacagaaatgtttgttcctcctgcctagctgcatgctatctctctacctcatcactcacctccatcgttttgacccttctccggaaaagcacaattctcccggccacacccacgaccatggaatcctctctctcttgctgctgcccacacccagctagctgcctataagtagcgcccattctcacactcctcctcatctcatctcagcacacactaacacagccggcctgcaagcttagcttagctagctctcagttaacttgtgatca

SEQ ID NO: 1898 - DNA, 2000 bp, Oryza sativa
  misc_feature (1524)..(1524): n = any nucleotide
  misc_feature (1565)..(1565): n = any nucleotide
aggcggatagagtgatggacgttcttcagtttttcttccagtttgcgagtatctatcgcttctaatgtcaacttaaaccagatccacttccaaaagttacatcttctggtttctcttttcctctttatcttgtcctcaagggaggatgccaacttctgtaatgatgcaaaggcacattaatagtgtagtaatagtcacttaagtatggcacagattacaacttctacctcaatgtattaattactcacctgaagtgccttgatgtttccaatgtcgtgtactatgtgatacgattggtatgttcggtagtgctttgagaagaagtggtcagcataacacccataagttccatgatctgggcatagtggaattcctcgaactaaaatggtatattggtcaggccgtttcctgtgatacttcaaatgtgcaattcttctgctggacatttctttgtgctcctggttcaattcaagatgccagtgccacatatgtattgaacagcatagttatgtaatagttgaaacgaaatcaagaatacttgcttaggaataggatagtaaataaaaaatagcaaaatattttcaaatggtgggtgatcaaaatttcaacatcaattttcacaactgaacaggggagaaaacacaacaggatcaattgtaagattgtaacaattggatcaattgtaagatttttataaacacgtaccttatgaagcaaatacaccacatagaatgatatgaagcagaggcatgcaaaatgcacccaaagcctgttgtgacaaagaactaactcagttaagagattggcaccatgctgattgctaggcaatacttatctgatgaactttcaactcctatgtactatcattaacactctgtagtctatcagcttaaacaagatatgccagtgtcccttgtgaaaacttgtattgaaagcaaaacagcttgctctattggagaaaactactcatttaaattggaaattataaccagagagcaattcatgaacgtttgattcacaagaatgggtttcctccactgatctctgaaacactagcattttcgacctgactactctgactctgaagaatacctggagaggagggtgaaaggaagctgcagaatagctaacctgttagaaccccttgccacattggataccgtgaaaagttccattgaatttgaccttttggtgtcttgtagaccttcacaggaataatttgttggtgcaaggatgaacaatccaacgattgagcaaacagcgaagcacttgatcctacattcttacaaagaaattagtaaaatactcctattgagagagcaagcagagtaacattagcaattttctcagagtagatgcagatcagtagaacacattcttacccgaatttgaagaggcggacgacgacgagcgcgtcgaggccgtggcgccgcagcacgtcgtcctcggagagccggagcgcggcgcggatccaccggaacgacggggtcaaccgcccgtggccgagcggcagcccgcccccancgccaccggcggccatccgccgcgcaaggtacaccggcgcnttgccgggctgcttcttgagcaaggagaagagcgagagcgccaccagcgccaggcccaggttgatcgccgccgacgccagcaacccctccgcgtccatccccgccgcaacctccgccgcctcgacaaccccgcggcggcatcgcctctaccacggaaactagtagatcgccggtgtgctggccggagccggcgacgtggcggccggaggagagccgggggtgaaacgtggcgcggctcgagctcgacacgtgcggctcgcgctcaaatggctcggcccactcaccatcatgggccaaggcccatctcaccccgggtcggctcggctcggctcgtgttgcgacgcggctcggctttagccgcggatttgtgtgggcacagaggcgataggccaccatcggagaaggagaggtcgccgaggaagaggaggaggaggg

SEQ ID NO: 1899 - DNA, 2000 bp, Oryza sativa
  misc_feature (87)..(87): n = any nucleotide
  misc_feature (1418)..(1418): n = any nucleotide
cttgagctaggaagcaccagaagctcagttctagctgatagaccattaagtgctccattcatgtaaggcctgcatccttttgttttngttttatgtctataattcacagagaaatgaggatcatgcaacaaatacaggattaagggcgaatagtgctgagaaagtgtgaggtctcttccctggccaaactggctaaaaggtgctgagaagtctctccaccgataatttcagctcgtcagtcattcggagcttggtgaagcactaggaaggcactttgcaacattgtatctctagctaagcttcaagccttcaactgcagaatgtgtaagggtgcaaccgtgtacagtaggcttgcacaggtgagatctgtctatagcggtataatagcctaattgtgtatatatgttagccctgaagcgtgtagttttcctcacccaatacctcggtcgccttggcgcgcaaatctttctctagttaaaaggctgttcttagtaatgggaaatggaaaggaaattttgagtgatgctggattgctggttgctccctttttcctccattgagttcagctggtgatggcattctcgtttctgtcatctggcagagaaggcactactgccccaagtgacccatggcatagccagaaacagaatgctccatcagtccatctgatgagatatgtgtgaagaggtttcagctgagctgattatagtgctgtaaagcggcttagcactatgtaaatcatgtgttatgcaccatgtatcatgtatgatccttggaagttctggatgcaaaagtgagttgtgcacttgccatgtaagttctctatgatgaaaaaggccaagtgtactattgtctatgtatatcatttcagtttttgcataactgcaatcggtaaggagtgaaagcctccggatacctaccgggatttgaatatttgatcatgctagactaccccaaatgtgaatgctacattttgtttgggttaagggaattagttatttaaccttgtttggcaactaatctagttagtctagtaatgcgtttggccgtttgcctatcttcataaaaatcgatgagtttgttcatctcacgctgttgactttctctttttttttcggggagtagggttactaatcttggactacaagggtgtgctttaagtaagtttatgataattatttgaggccgtaaagtaaaaagtgtggagtatttcaggaaatgctgatgaataaagttttttaaaaaacaaaaatcgcttagtaagcacgcctatgataatggtgcaccgattgctttttcatcggttgagctacgacttgtaaaagaaaaaattaagcaacaaaaatagtaaaacttttatatatgtattatttgtgaatttaaatttcaagacggaaaaaaaaactgcttttaaaaanccctcacatcaactatataataaaattttagctgttgctgataagttaaaagaaaagtattaaattgtaaaattagtactacattcaccttttcaatatataatatcgttaactttttaatcattcgtcttattaaaaaatttaagtaaatattttttatttgttactaaagggactttaagtattatttatatttctaaattttgtaaaaaaaattaaataaaatgaatggtagttacttcctctgtttcacaatgtaagtcattctagcatttcacacattcatattgatatcaatatgaatatgtgaaaaatatgaatatgtgaaatgctagaatgacttacattgtgaaacggatggagtatatattagtaagaaaaaaaatataagagtgtccccgcccacatcgcatctccggtgccagatgctcgtctcgccttcgccttaccgcaaatacttcggggcttccggcgcacgcaaaaaaaccgcaggttttcttagcattccacagccgaaaaagcccccaaacaaaacagccaagcttgctcggtcgctgcgcgctatctcgcctcgcgacgacg

SEQ ID NO: 1900 - DNA, 2000 bp, Oryza sativa
acaccaacttgatgtgtcgtccattttggagtttcacgtgtgtgttgaattcgaccaggagagctgatttaatacaacttggaagagatcgagctttccgcggttcaagttgcgccgatatgttagcgttggagaaggatgcatagaatgcatacaaaatcttgtaaaatcgagaaacttggaggaatggatgctatttttttcaattgagaatgttccattggaatcaaatccatgtctaatttcctgcaaaacacactaccaattttcatccaagtgcacaaactgggatcgctggggtagaaaatgtttaagcagactatccgtatccctgtctccatggctgtatgcttgagctttggaagccctactaaacccatgatgcatccacatggaaaaaccagcccttatatatctgaataagaatcatgtctgaactctgacgagaggatcgatgatgaaaaaagaagtacataagtaaccacgtacgcgaaaatttaattcatgattcagccatgtctctgtggaaggcaacaactagctagctagctgcactctcagtccaagggcttgggcccaaccacctccatcgtcgcacaaataatccatggctgcctgacacagtgagcccagggccctagcccgaagcccagggtcgtcagacattggctccgacgcttgctagagtaacgtaagaggtaggcagatcatgcagtatgtttcttttccaatgccatccattctcaagtaaactgatgtaacagtgttgctgtagtacgtgtatatgttacaaacacgaacagtgctaaatagaaagcattacctatcacttgccagggatagatctagagtctggacagacgtacgacaggaggaaaatcacttacttggatgggatgatagtttgcttcctgcaaaggatgaagtagatggatagaaaggatgaagtagatggatagaaaaagcttatgaatacgagagtggaagtagccacgggacatataagaagaatcaatactcggttggtggttgtagtaagtatactcccttcagactgataatacttgtcattttagataagggtgaggtcaaactttacaatctttgattatgaatcatttttaaaatatttatctttcatatatggtgattacatgtatagattagtcttaaaaagtactttaataaaatcatatattttttaacattcttatacatattataatgaaaaataatggtcaaagttgtttttttgagaccatgctcttgtccaaaatgacaagaattatcaacccggagggagtactttcttaactttgaagaaagcacggctagaaaagcaaatttccagacgatgacatttttttcaggtaggtaggcctctccgagctaaatgaccacctgcgaaaatgacaaccgtgaggtgaaatcgttgtccacctgcaaaaatacacttaagttgatcagaagttgataactatatataccatgtaggccatataaaggaaactgaacgagatggtctttgtttttttttaacgaatcgcactagagagtgtaaagttctactgatagagtaggaaaaaataacaaaattacaacccttgaagatggtaaccaggaaaaagaaaaaaaaagtatactaccactcacacacccacaacgccaacacatagactcaggagaaggctagcatcagaccagccaccgctaagtgtaaccgacagccactaagccgtacaacggaacacagccgacatcgcccaaaacccgaccattacaactgacacaaaacacagctctatctaaatctttgggattgagggtgagagggtgagagagaagaatgcagccattctccccctaagccctccaacgtggccaacttgcggaagctaggatgccgacataagagaatatgaattagagagagcttgcaccaattgcttgggagattttggcaagggggtgcctacacggcatctctaacgagaggagcg

SEQ ID NO: 1901 - DNA, 2000 bp, Oryza sativa
  misc_feature (1771)..(1771): n = any nucleotide
  misc_feature (1882)..(1882): n = any nucleotide
  misc_feature (1894)..(1894): n = any nucleotide
  misc_feature (1910)..(1910): n = any nucleotide
  misc_feature (1957)..(1957): n = any nucleotide
  misc_feature (1985)..(1985): n = any nucleotide
  misc_feature (1997)..(1997): n = any nucleotide
ctcaaggaggtacaaaagctaaccggatgcatgacatcactaagcagattagtcgctaggatgggagaacgagcacaacctttctacgctctattgaagaaacaagacaaatttatatggacacaggaagccgaagaggcatttattgcactcaagcgctacctatcaaacccccctgtacttgttgctccccaacctactgaagaattattcctctatattgccgccacgccatattccgttagcactgtcattattgtcgagagagagaaagtacagcgatcagtttattacgtcagcgaagctctccatgacgcaaagacaagatacccacagatccaaaaactgctttacgcagtcatcatgacatcaaggaagctgcgccactacttttaagctcacagagtcaaagttgtatcctccttcccccttggagaagttgtgagaaacaaagacgttgtcggccgcattgcgaaatgggtagtcgagctaagccaatttgatgtccactttctgccgcgaacagccatcaaatcctaagtactcgctgacttcgttgccgattggactatgccagacaacaaatcagacaaccaaggcgacaacgaaacatggacaatggcgttcgatggcgcactcaacagccaaggaccaggggcaggatttatcttgacgtctccttccggagatcaattcaagcacgcaatccacctcaacttcagggcgaccaataacactgcagaatacgaaggactactcgcagggatacgagctgcagccgcacttggggccaagcgactaatcgtcaaaggggactctgagctagtcgcgaaccaggtgcacaaagactataaatgctctaaccccgagttatccaagtatctcgcagaagtcaggaagctagagaagaggttcgatgggatcgaggtccgacacgtctatcgcaaggacaacgtcgagccagacgacctagcacgacgtgcgtccagacgagaaccgctcgaacccggcacctttcttgatatcctaacgaagccatcggtgaaagaagttagcggcgaagttagcccgaacacccccgacatcagctcggaggtcaccgaggcagaacgcgccattgctgacatcgaaaccacagacgactggcacatccaattaatcaaattcatcagcagcaaggagttgcccgaggacgatacagaggccgagaaaataacccgtaaagcaaagatctactgtatggtcggtaacgatttatataaaaaagcgctaaacggggtacttctcaaatgcgtctctcctgacgacggcagacacctcctcctcgacatacatgaaggcatatgtgggtcacacgccgccggtcggacattggtcggcaaagcttttcgacaaggctttttctggccaaccgcccttaaagatgcatgcgacatggtccaacgatgtgaagcctgttaattccacagtaaacacacaaagctacccggcgcaagcgctccagactatccctctgacttggtcgttctcgtgctgggggctagatatacttgggccattcccacgaggacagggcggctacagattcctattcgtggcgatcgacaaattcaccaaatggatagaagcagtgcccacgagggaaatcaaggccgacaacgccatcaaattcatcagagggatattctgcagatacggagtaccgcaccgcatcataaccgacaacggctcccaattcatcagcgccgacttccaagattactgcatcggnttgggagtcaaaatatgtttcgcctcggtctctcaccctcaaagcaacggacaagtcgaaagggcaaacggcatagtactacaagggatgaaaacccgcgtctacgatagnctcatgtcacangacaaaaagtgggttnaagaactcccatcagtactatgggccgtacgcaccacaccgacaacntccaataaggaaacaccattcttcctcntgtacggctccnagg

SEQ ID NO: 1902 - DNA, 2000 bp, Oryza sativa
  misc_feature (56)..(56): n = any nucleotide
  misc_feature (1442)..(1442): n = any nucleotide
  misc_feature (1487)..(1487): n = any nucleotide
  misc_feature (1514)..(1514): n = any nucleotide
  misc_feature (1602)..(1602): n = any nucleotide
  misc_feature (1611)..(1611): n = any nucleotide
  misc_feature (1614)..(1614): n = any nucleotide
  misc_feature (1618)..(1618): n = any nucleotide
  misc_feature (1701)..(1701): n = any nucleotide
  misc_feature (1859)..(1859): n = any nucleotide
  misc_feature (1885)..(1885): n = any nucleotide
  misc_feature (1999)..(1999): n = any nucleotide
accatcttcatctgtgtttgcttgaagcacgcagttattacatgtagttgttttgngcccatcagttacaattttctttggtggtttgcagttctccctgtggccattgacatcactgttaacctccctgaccagtctcatgtcattctcaaggttggcagttgcactcttggtgacatgttttttttttctgattctactgaaactcacttttgttgctaagttaaaccacagagaacacacacacttgacacttctacagaaaaaaaatggattttgtgcctgaatttcgtagtagagagcatacacaaattcataaactcagtctaatttggaatgaaaacttgagtttgtaatattcaaatgtacatcaaatcaggttgttctggtaaatcggcttagttgagctgttttctggtctggtgcaggggatttcaactgacaggatcattgatgtgaggcggctgctatgcgtaaacaccgcgacgtgcgccatcacaaactactccctctcgcatgaggtatttactgtttttcaagttaattaactgagcccttatagtttggtttgattagtttgttgataacatattagaacagtaaaagtctattccagtatctgcttcctcctcctaatgtgaaaaaagataaacagcaagggaactaagctgtcatgtaatccacatgcatgtatgaaactcctttggtatcttggttaaggaaagtaagatccatacatgtataaatgaacacgttcccttacacaccactatgtgaatgcctcatatagtgcggaggcgttgttttagcaaacatactcgtgtattatctttcgagattaaatcccaagacaatatgagcacccgtatcctcctgccaactttagaactgctcgccgccatcctcggactttgccggttggtggctcgctgcccgataaactgttgtgaagatcgatcgcaagacgttcgacgtcggggtcatcctcgttacatggttgatttgaaaagagcgcaacacacgggttttcgagggaacggcctcgtcggtcacgcaactgtgtgcgaccatgtgtgatgaatgggaaacatggaaatcagcagggctagttacctcgttgaatgttgttgcagcgccagctttagagagattacagactttgtaatttgctttttgttgtaaaggcggtgctctgacacactgcatttgtacagtttttcccttttccataatatacatcggtcggcattctacgccgtcccggcgaaaaaaaaaactttagaacttgtattttaatctaaatatccacatgtcaaaaccttagtattttcaccataaaacttatgttgaagtttgagccgaaaatttcacacttcggcctttttaaaacttcaaaataggtccttaccaaaaactattttgaaatatgttttgcaaaaggnccaaaatttgaaattttcgaaagtttgagtgtaatgccgaaaagnaaatgaacttgatagatcccaaatatntataagctacaaatgatgagtttgtaatgctatgtgaacaatattcccctaatttttgattatttttttcagctccgtgatggtcgcntgaaggatngtnccgnatattgcaacattgaagccatttacactcaccttggtagaaggtagaagcaataccaccctcaattacctcataatcaccggntctctcttttttcaatttctctaagaaattttaatggcgcataaggttttatagtattgtcaaacaattattatgttgtatttcttttacctaaaaatggtttttatttttttcaattttgttaaaccactctacatttggaatttccccatttttgnttttttttaactgaaaaaataatgcngaggagttcgacgaggagagcccggtggcccacgtacggcggctgcttgacatcgtcgcctgcaccgcctccttcggtccgccgcccccgccgccgccgccgccgtcgccgaang

SEQ ID NO: 1903 - DNA, 2000 bp, Oryza sativa
tcttaacatgtgtgtgtagctgacttatagtctgctattgtaccagctctaagacgtgtaataaaatcctttttcggcgatgtccatgtaattattgtgaagtttgttgtaaaaggggtagataaaatgcccatgtccttatttctaggctaagacataaatattgttcacgatgttagcatgctacatgtactaccctagtatcatcaaagcctttttaacctaccagtatcatccctaataaattaggtaccaccgtattatgtacttcctccatttcaaaatatatctaatcaatgtgtacaactgtacacatgccctaaaagcataagaacaataacgataacatgactattactccatccgtttcacaatgtaagtcattctagcatttcacacattcattttgatgttaatgaatctagctagatatatactccatccgtttcacaatgtaagtcattctagcatttttcacattcatattaatgttaatgaatctagacatatatatctaactagattcattaacatcaatatgaatgtgggaaatgctagaatgacttacattgtgaaacggaggaagtagaagacatcagacttattttccacagagcaacctcaagaatataaatggagttgtgagtacttgttagggttcaaattatttgacttgtgttaaccacaaatgttacgcatgcacgcgtacactctgagtaggacctaaggaatttttcaccgaactccgtccaaaagagtttgttagagaggtacacatccatgaatttggagaagtatatttactttcctattttttttacaatattgtacatacaacaaataatttactttcctatttttttttacataatgcacatacaacaaataatatactctattatgtgataaaaaagtaacagtaaataataataatataatttcaaagtcatttcttaatggggaggtttggacacgagtcacaacccaacccataaaccccatccactcaggagcttctctcattcctcatggcctctccctccctcctaacccgtttccttccagataaggctatataaatacccatcatctccttcctctcttcctcgctctccccaacccctctcggcctctcctcggtggtcgacggcttcaccggaccggaccggaccaccgctcgccgccgggcacccccgcgccgcggtctgtatgtcaaaggtgacgcccgccgcctcatgcacccgccgttcgccgttcgcgcggtgacgcttaggttcattcttgcccggtgcgcgccacgtgtttgtggatatgcccgcccgtgcgcgcgcgcgcgagagagcacgagcacgagcgctagtgaccagtgttcgttcattgtccgtgctgctctgcgtgcggtggcttggctctaggttcttgggcatggtggtggtgggagttgctgtgctatgtagtgtgtgggctcggttccatttccgtggctggttcgcgcgaattggcggcgcgcgctgcagctgtcgcggctgtactgtaacacttttgaattgatagtagcgttggctgtgtgtagtgcggttctgcgttaggctcttgcttttagtgattgaatggcggcgggtactctgctttgccatgtttttcgatgctctgagtgaaatgaaatgaaatgaaactgaattcgcttcctgtttgtggtcttgctgaaattggataagagagatttttgggtgagagattgcatacatgatgggaagtcttgcgcttttccttaggtgtgctattcttttgctcatgatatcttatgcttgtagtgctctctcaattgttgtttcagaatattgtggtgcatttatctcgtactgttgtttgtttacctgattactggatatcggttctcattgcctttttgtctaacaaagttatctacactcgtgcagggtacagaaacaatcaatattctgatatagttgctgggaatttcaatccctaaattcaaa

SEQ ID NO: 1904 - DNA, 2000 bp, Oryza sativa
attcggtcaaaacgcaaaaggaaaagatgttctgagagtcatagtacaagttggctcgaatagctctcaactataagtgtgtgtttaacttggaaaaggctttagtaatttatcagatatcacttgagtacaaaaacactacttgagtacaaaaagactactcgagtgggaaaacactacttgtgtggaaaaacgctacttgagtgggaaaacgttacttaagatgaaaaacactacttgagtgggaagaactacttgagtgaaaaaacactactcaagtgggaaagtactacttgagtaggaaaatactaatcgagtggggaagtactactttagtaggaaaatactactcgaatggtaaagctttgtttgagtaagctaagctaacgctaccgacaagttcagtataggtgggaaagtatgttttccctgtctatcctaagaatgaactcaaacacaaaatgtcatgtctcatcaagtggtattttatattaaatgattccttgtccttgctacatggccttggctggcttatataatcttcaaccatacatgcgagttttcatacatgcgagcttactttaatgcccttacaaagtttacaaacttaggggcattttagtatatcttgaaggtcatcatggtcttttggcgccaactggcagtagtggttataagtagatcccacagaatcttctttcggcgtcttccttatttaagcagtactttctctcaagctccttatagtttctttggtcaaaatgcccttttcatcttgggggctcgaacattcctttctaatctattgaccccttagacttttactgtcacaggtagaaaatccacacaggtaaagcaaactactcgagcatcgttagcttagcttactcaaaacagagctttaccgttcgagtagtattttcgtacttgagtagtactttcccattcgagtagtatttttctactcaagtagtaattttccactcacatagtatttttccactgaagtagcgttttcccactactcaagtagcatttttctactcgagtagtattttttcactcaatggtatttgacaaatacgaaagccttttccaagttaaatacttagttgagagctattcgaaccaacttatactacaattctaagaacatcttttcctttggcgttttgaccgaatgaggaggatggcatctatcccctgatataacaaacttgtgtttaacttaacatgaacattttacccattgcatttcccaaattcagattaggtgtagttatacttacaactgcatataactttagccgtccgttagatttaaagctacatcaaccatgtgaacaatgttctgtgctacaatatttattgctacagtactgtgaacagtacagcacacgatctagatcgtcccatatgcatcccattggccatagtgcatactacgaggacatattcggtgaaaacggattaagtgttagaaacttgtgaaaatcatacctaaatgttttgtaaagtcataaaaaaatattagagatatgtgtagatatgaaatacattctcacccaaatctcaattcaaaactcaactttgtttaagagaaaaaaaaagacaaatttcgagtgaatagtatccggttgttattcatctgcttcacttgcagtcactattgtggctgattcgaatctccatttttaatttctagacattttttttctctaaatggtgggttcacaaaatttcgggcccagtccaatctatcatcagattccttttatacaatatgtccctataaaaaaatatatcctcaaagatgcaaattgttggatgcaggtggtacactcgtattgagatttgagaggcttacacatatcttgtctactacatatacggctccgtataatactatcacgtgttgtattcgccaatatactttgcgaatacgtacaactcggttgcattaaattcgatcgaggctttcgctcccgccacacacgcga

SEQ ID NO: 1905 - DNA, 2000 bp, Oryza sativa
caataagattagccatgtaatgtccttttcgccttcattcgcatgcaccagataagttcatgcaccaaaacgagcattttacaagtttgtgcactagattgcacccacatgacaagttcatgtactggtgatgcaatttactcttaaactaatatggtgttttggatgatactaaatttttctataaaatttgagcaaacttaaaaaatttaccaaggaaaatgtcagggttacggataaggcataccatttatcctacgacttatgaaatataccaataaggtataccttcacgtgtacgtatcgtttccgtatacgccgttaggaatctatctcaaattatggaaaatatctctatgagttaagaaattgccggagtccaactcagaagggggtaaagtctttgttatatcgtgccagtttacatatccctaagacttacttgggggtcaaggtattctacggtattacttgggggtcaaggtattccacggtataaaagggacccttagggggaggtgaaggctatcgcatctcaccgtccacacatccaccaaagtttacgaagctggagtgcacggagccaattcgccgagagatctcgtcgaatctctcgactacgatctcgtcggtactatctgtttcgactactctctttgtaatctgttctcatcgtcatcaatctcatataaactggactagagctattacctgataaggggcctgaactagtataatccttgtcttctgtttgcttgatgtcgtactacgtagactctcgttccaacgtaccccaatacttaactcatccgatccgcaagtatccctcgtcgacagaaaaaaaaatcaaaatggcttataatatgaagtagagggagtagaaaagtagtactacctccgtcccaatataagtgcagttgtgggttttcatgtccaatatttgactgtccgtcttatttaaaaattttataaaaaaaagtcacatataaagtactattcatgttttatcatctaataacaataaaaattctaatcatatttttttaaataagacggacgatcaagcgttggacacgaaacccacaagtacacttatattggaatagaggtggtagtgatcaaagttttatagaaaaacaaaaaatattaacaatattgcatactcgctccatttcatatacttttttttagtttaacccaaatttattgaaaaatataatagtattttcaacacaaaacaaatatatgtttaataaaactaatttaatatttcctccttccctaaatgtttgacaccgttgacctttttaaaacatttttgaccgttcgtcttattcaaaaacttttgtgaaatatgtaaatctatatgtatacataaaagtatatttaacaataaatcaaatgatagaaaaagaattaataattacttaaattttttaaataagacgaacggtcaaatatttttaaaaaagtcaacggcgtcttgtgggatggagggagtattttatatcttgctaattttttctataaacttgatcaaacttaacaaaatttaactataaaaaaaatcaaatgccttaccatataaaatggaattattgtaaatggaaatagaaggagtattaaattgtatatttaatatacagaggtactccctccctaaatgtttgactccgttgacttttttaaacatgtctgaccgttcgtcttattcaaaaacttttgtgaaatatgtaaaattatatgtatacataagtaaatttatcaataaatcaaatgatagggaaaaaattaataattacttaaattttttaaataagatgaaagattaaatatgtttaaaaaagtaagcggaacattttgggatggaaggagtattagccccgtatgcagtagtacagtacacatctgtacgctagagaggctcgaagcagagagaccaaaaacgatatccaacagcagcggccaccacgcgcccaccgctcccggcgcgcgccaca

SEQ ID NO: 1906 - DNA, 2000 bp, Oryza sativa
gcatacgcacacaaacagcgaatacatgtcttaacatacgctaaaaagataatactaaagacatccttaacgtcattaaaatcctatgaagacgccctgacatacgtgtaatatactgtattagtaggcaccattaaattaatactagtgggtgaagttgtatacccatgactactctatcaccacaccgctcgtgcatcctcatgttgcattagacttgttaaaaaaacattcataatagtaagaaataatcagacgattataagtagcaacactctcattataattttaatataaagttatatataattgataagtaattttttaatgaaatcaagataattacattagggtcatacaaccatcttcaaatcattttcggcctctatataaataaggtcctcatcggttgtatatggcttgattatataagctgtaatggtttattagtgataaaaaataattatggataaaacttttcatatgtgtctttagtgacttaaaagccaatactgaaaaacaaactacattaaaaaaaacatcaaagtcgactccaaataaagtttcaaaatttaaactttggcagcggcttataagccatagaacaaacgatgaggccctcagatccatagggctcagaaaacaagcatctatacttctttaaatgttctcggtggtggtgtcgatccattctgccttcccaacgccaccaccatctgacatgtgggaccaaggtccaagccaccaactccaaggaggtctacacgagggcaatccatccaaacgtaccaggaacaattggattttgttgggatccaatccacgccaccgagtccttcgttgtccggagaagacgggagaggcaactgccacggtcaccgactcatcgtcccatgccatgttgaatccaatggcagccgtgtcatcgtcgtcctcctccgtcttcaagcagtggatcgagagctgtcgtcgctcgatatagggccagcgccacctgatcgagggctagtgtcgccgggaggtacatgctagctgaatctggcggcggggtgcccgtcaacctcaatccctcgcccttcttctccctccaaggtgccctctccccttcctcatcagcgtcctctgctcttcatgagaggggaatgcccattgtggagaggctcggcatcctcggcgccgcctgagggaaccgctgtccactactgttgtcgccaaaacaccaccgagcaacgggggtcgccttggcttcttccttgccattccctaggttcttcgctgccgcgtcgatcggtttcttcctcacctcgacccgagctcgctgcgtgccggctagggaaggaggagaggaggggcagcacggtggcagctggtagaggggctggcctgccgaagaaaccgaggggaagggaaagtggagaggagggtctttttttttccttttctactatttttttatcagctgtcctccgcattcctttccttccttaaattcccatgtgcaggagtactacgcaataaggaaagacaacatacaattcacctaattcttcacttagactaaatatgtacttaattaacttaataagctagaaatacaatttattttccgttgcaacgcacaaactcttggctagtatccaaaaattatatagaaacaaagtgtaaaggaccatcaatccaaagacactcaataatcgtctcccatacatttggtcctggataaaacactccctgaccacgtgctccagtggctgacacagcaccacaaccaaatctcatcaacctggcttctaaagatatatgctatataaaatatattctagtaaaaaacaatttatatagtatgacgttatatatgcacatatctgtgcatcagaattggttagtccattttgtcagctagtgatcgatcgagctatatatgcatatattactacggatcctatgctagcgaagatcgagctcactacacagagagagtagctagttagccgccggcg

SEQ ID NO: 1907 - DNA, 2000 bp, Oryza sativa
  misc_feature (69)..(69): n = any nucleotide
ctccagtgatttggaaccaatctgaagagaaagtaagctaagcgccagtatgatatgaagagagaaaantagaacaaaaaaaacaagttgttgagagctcagaatgatgcataatacaatcatagacattgatctcagatgtccagacatagaaataataaagcatcctcatccagagcacctattctcaagggagaaagcaatttgcgtataaaaggaagaagaaataagaagaccgaatagaggtgatggtttccctcgatgccaatccagatggaaggcatggaaactgcagacatatcaacatggcatcagttcagaccgcccgtctgcttgaactctcctcatcggagaaggttcaaacaccacatgtacagcccttgaaagttgaaccaaacggggaattatactacctacatgagcaataacaacatctagaaagacgaactaaatcagacatagcgaggagcaacacgagcggccgccgccgccgcggcggtgtcgaggacgacgaggagaggaaggcggttgagttgtcgtcgaaggtgggggttgtatatagacgaaggggaattagggtttcttctcgagatgggctttgggcccaaataggagtgacgcagtaggccggcgattagattgggtctgttacgaaattaggctctctcttttttctttttcctgaaggagatcgcggccacgtgccgcgaaaatgacctgtgtgtagggggtgaaaacggtacgaaaacagatgaaaacaacctttatcattttcgttttcatatttttttcggaatcggaaaccccagaaacgaaaacggaaacgaatattatcgaaaacgaaaacggagcgaaaacgaaccggtgtggatacggtaacgaaaatttatcggaatacaaaacccctcaaactgagctccacagcaaatatattcttctataacttcatataatttgcataacaaatattctaaacaaattacagcaaaacactatggtacaaggtataaactattagtgctttcactccatcatcagtacatactacatagtcatcaatcatcacatatcagcaacacatatcagttcatcaatatttcagtacttgaagcgtacacagtaacaaagagtgatagaggtggagccgtggaggttgaggaacacctgctgctgctgggctaatggctgctgaaaggcgaggcgtcgtgcatcagtggtggtgaggctgtcggcggtgtggccagtggccggcgtcatcggtgtcgtccgcgtcggcggcgtcggcgtcgttgcctcgtcggtggtggtggcggctacgaaaatggtgggggcaaggacggagcgagagagaggaagggcggcgagacggcgggggcgaggtcgcgaggagcccactagccgaggccggcagccaggcggtcggtggtggcgtgctcgaccccctggaggctggatgcgccgcctctctcgatctgtctctctcatctctagcctctgtagggttagccagttagggacctagggacttgggttgggcgggaacttggggaggaattatggactatttggatgggctttttttacttcggaaattccgacaaactttccgaaatttttccgaccgatttcgagttccgacggaaactgctattatcatattcgattctgtttccgaaaaaatatttccgtttttgattccgtttctgagaaattccgaaaaaattccgaccggttgattccgttttcaaaaacaggtccggaatccggaaaaattccgaaccgttttcaccctacttgtgtgtgaggcggagaacgccgccgcaacggacaagcaaatccgggccgccgatggaggcagccggccgcgctgggacgccgcaaaaaccgcagccactcgaaattcccagcgccgctccccgccacaagtccgcgcctcctcgacgaccgcccgctcgaaacaatctcccgctgcgctgcggcggcgcttcgagggcagggcg

SEQ ID NO: 1908 - DNA, 2000 bp, Oryza sativa
aaatctatcgagtgaggaaaaaagaggaccggtatcgccagtgtgccaccattgatttcaatggatcttaccaggcctaatctaattccaagaatttctttgatttcgatcgccagtcaatagaatataggagtagtaggaatgatcatagtcttgcaagcacaactgttttacccatatcttcacactagtaaaccattgctttaaaatccgaaccactccgctccacacagtaaaataaactatgaaaccaaaagctaacaaactcagcatttttaattctcatctgctacttcttataatatcaagttctcaagttcaccacataggaccaatattattatgaatctactccctccatctttaaatacaattgttttttacaatttaaatttgtccaaagctaccttttaccatctcaaccaatcacaaccatgtaccacttcactatacttgttttcttaatctccatatatacctctaaagatagctatactttgggatggagaaaatagggaaatgtctcctagatcatatatctactaattctttagaggaaaatttgcaaaactcaccccataaaattacttgaagttttacgttcccccacataaatcatttgttgcaaaaacctccctaatatacacatatttaaccgaatcaatttgttttcataaattgtgagcagttaacgtgatcttaatcaaagctaaggctgtgttcggcactacactttcctaaattctactccctcattatccatgcacacgctttccgaactaataaatgatacatttttttaccaaaaaaaatcgtataagaaagttgcttttcaagttttcattaaatcactttttaagttttcaagctaatacttaattaatcatatgctaatctaccactccgtttatgagctggggaaagtttcctaccccaagagaaaacaacctaaatacttttaggtactgtttggctaatgggataaggaaatgatttcccactcaccaaaagacatctttaaatcataaccattcattctctctcttccatttaatcctaacccttcatttattttctaatcccaatctcccctttatttcccattatctaaacacacccttaggagtataatcttgactttatttttttttgagattccataaataaaattgttgatgagagattaaacaatgtcgcacttatttttgctatgtacggtaaaaaaatcgatgaaatataaagaataaatcaaatacaagtacctcgataagattgactcagctagcttagtctgggggtacctctacagtagcaataatagctgatttggttaagccagtgcgcactgggtggttgttacatcaaaactaagtggagtggtgggcatttgaaaaataaataaattacaggatggaatgccaaactgatggtctttataactttccatcattgaaaattttgaaccgtgtgttcaaaccaagtagagtggtgggtatttataacaaagtaagggtgtgtttagttcacgccaaaattagaagtttggttgaaattggaacgatgtgatgaaaaagttagaagtttatatgtgtagaaaagttttgatgtgatataaaagttggaagtttgaagaaaaagtttgtaactaaacaaggcataaattacatggtggaatgtaaaactgatggtttttatagctttttccatccttcaaaaagtttgtgccgtgtgtttggatttctcccacaagggctctcgtgtcaaaatgtgccgtgccagtgtgtgggggcagggggtaggcaggccacacccacaccaccgagtagagcgagtgtacagccaccacgcgtgtccacccctcgcacgagagtctctccaccactcgtcgccgactcgtgcgagcgagagagaagccgctgactgcaccgcaccgcaccgcaccgcacgcaccccaaacgctatccaactcttatccccttcgatcccccctcaaccacggc

SEQ ID NO: 1909 - DNA, 2000 bp, Oryza sativa
  misc_feature (1428)..(1428): n = any nucleotide
accttccactgtgtttgtaattctactttgtgattataactcccattgtactttcactgtgctttttatggaattagttcaactcccattaaatttcttctaagacttggaaggaacacttgatgggttattaatttgtaacttaacacgtaatagtagatttctttaattgaaaaacctcaaaattcccttcactagctctcgtgaatctaaatattggggttggatcgattggggcaccttccatattcttattggagctagtgacattcttccacatcgcatttgttcccattctatttatgtaaatctccttcagaatacaataacggaacactaagcagtaaaataattagtgaagggaatttagcttccaactttaacctatatgatatatcgaggttttcttattattcttggaaccagaaatcttgacatttcccctattcaatatattctattttttcgcatgaaagatacagtataattttcaatagattttttagtgatgtatggaagatagagagtttaatttctcttcaaacatactcaggcccccttttattcaaaggaatttcataggaattttagaggatttcatttctataggaatttttactacaaagccctttgaatcaaagaaatggaccctatggaatcctatgaaattcctatggaatgcctcttcccatacaagttttgaaggaattttatcaagaggtagaacctcatagaaaaaatcctttgagtctttatctctccttaaattcctgtgtttttcctgtggtccaatcaaacggtcattcctacgtttttcctgtgttttgcaatcctctgttttacacttacattcctgtcaaaatcctatgtttttcctattcctccgttttttcatttctgtgattcaaaggggccctcagtgttggactcattttgttttttttcatcatctcaaacatagagacgtagataaaaatacttgctatatgtatgtgatttattagatgtgatattagtaattttcaagcaattcaaaacgaaatacaagcactatatttcttttcttttgatattattttgtcgacttcaattgggaacttttagtagaagttgatggagatatattgttgttgttgaagcgcaaaggaaacaatgcaagagaagagtatttgggacttgtagcctagaagactacagaagtctgtgctctcaaaagtttttttttttcatatgaccttttttttttaccttagtagaatccaagatttatctccaaggtaagcatgccacgtggtccaatcattttgagggcaaggcgccggcttgagaatgttagctttcaatttccctgcaaaccggacgtccctgtcgatgatgcagtgttttacatcgttttggcctttggctttggactttggccctgtttanataccactagaaaattttacacactgtcacatcaaatatttgaacacctatataaagtatattaaatatagtctaaaaaaatactccctctgtcccaaaatataagagattttagagggatgtgacaccttatagtactacggatctggacaggctttttatccatattcctagtactaggaagtgtcatatccctttaaaatccccttgtgttttgggatagagagagtaactaattgcacagattgcgactaatttacgagacgaatcttttgagcctaattgctccatgatttgacaatgtggtgctacagtaaatatttattaatgacagatttattaagcttaataaatttgtctcgcggtttactgacggattatggattatataattagttttttattagtatccaaacacctcatacgacatcttatataatatctgatgtgacactttaaaattttacacatccctacatgtaaacacccctttattgtggaaaaattgagtggctgccaaatgagtcatcctttgccgatgatatcttcgtcaaattaaccaccttgtggca

SEQ ID NO: 1910 - DNA, 2000 bp, Oryza sativa
cctaaaaaattatgattaggaaaatacagtggttaaccccaatataataggaatctttgttatccaactagtttggcagcacggcataccaacaaacaagtactactaattattgatcaccacatttgttgcattgatttaatgagtggataaaccaaaactgatagcaacgatttagtgatgaatttatcctgagattatagcacagtcacacacttatcccattggaaagaaaacggtttgcttgcacggcagagcctttcaagaattgaatagctccagtgatagccacacgaaagggacaggagcgatttgctgatggtgaccagtggaacaggcaagaatgtagtgcacgtgttatccatgaaatccctcacatgtacacctaaggtttatcactaaatacagtaacacacaaatacacaatgcatataaacgtagacttttgagtcaacagttttgtttatcacgaaatatagtaactaacactcaaatacacaatgcatagaaacgtagacttctgagtcaaccgtgttagaatagcttggccaaagatgctcgatgattcgaaatcttcggtcaaaaagcttggaattcatagtataacgaccactgtcactatgctatttggttttaggtagagaaaccaagagttcttcgattcgaaattaggttggttcctcaacctcctcacatggatcggaaggcttcgattcgaagtcgtccgattcacatcggtgccatctacctacccatccccattccccaccgcccacgcccaaccctatcaaatgaaacgcgagattgcaaccccccaaagagaagaaaacggcagcggaaatggcgacgtcccgatcccccacgcggcgtgatggggaagaactcctcaggcgtacgcgcatcggcagcgtcgtcaccgcgaaagcgccccccaaaagagagaggaaatgggtcccagaaaagcgcaaaagggacggaacttggggggttgcttgcctccgcaactgtcgcttggcttgcgcgcgtcgccggcgacgtcgaagccgccggaatccgggaggcgccacgcctgggcgcccccgccgaagcagcatctcgcggcgcgtggcgtggtgatgatgcgtgtggagacgaagccacgcaacgcaacgaggaagacgacgagcgtatgctgggctgggccttatccgaaaacgggtgtcggcccatatcaacccaggacgttcggcccacgttacttgaccacaaacgggattgcggacgacgagcggcccacgacatttgggccttaaccggattgctgacgtgcgtgatagtaagtctattttgcctccctcatgttctctgcgagtcagcctgccacgtcaacaggaaccaccctacaaaccatctaagggttgatctgctacggttttcgcttattcgaatcgtttattagcaaataaaaatttatttatgagtaaaatgtttatatatgtccataataacttaaagcaaatgttgtaaaatataagcattttaaaaaaacaaaaaagcaaattcaaaactaagttctcaaattcaaattttggctcataaatataagcataaccaaacaataagaccgattttcctccattttgcggttgagggaggtaattcaatcaggagcagagatgagaaatgtacaatagattttatctgtgtaggtgcgacctgttcttgttgggtcgagacgggattgcggcttacgtgaggcccgctatatttgagcctgaacgggatcgcggctgacttgggccgtaaggtccgttgtagttgggctggattacgataggcctttcattaggcctttatgagtcttacaagtgggccaatccattcggcctagaggcccatttgtcatgtagaaaagcgctcgccattatcctgtccgcgagcacacgaaggcgttcgttatcctctgctgcttctctgcggtttgagcgagcgagggaggaagaggaggggaggagacgaag

SEQ ID NO: 1911 - DNA, 2000 bp, Oryza sativa
  misc_feature (633)..(633): n = any nucleotide
  misc_feature (666)..(666): n = any nucleotide
  misc_feature (847)..(847): n = any nucleotide
  misc_feature (850)..(850): n = any nucleotide
  misc_feature (856)..(856): n = any nucleotide
ctctgagaacgttataccaaataaaaatgtcacatgtcccacaggccttaatttcttcaggaaaatgtaatgttgagttttgctcccttgaagaaaaaatagaaatggctaaataaaggcaaatcatttaagctttaattccacttttcaccacaatacgttgtgcaatgtatgtctacaatgatcatgatgcaatttgactgatgaaatgctgctgcttaaataatatatgtagataagccacatgttattacatatcctatagatccatgtaatataactaaatagtcgttttagttactttaaaaaggctatctgtagatcatatcaattggtggctatttgattcctttcgttctggacaaaatattgaagcttattttctaggatctcttatgtggacttccatgttactaaatattctaatgaggatgcattagcatagtagcccgtaacatgcccagcttttagtaagcacctatggacttttagttttggccatgaacgtccagggttcaatgttctaaaccaaacacgccgctttgttgagggtcttttttttttttaccttctactgcatctttactaaaccatgtacgttgtcacccattgtaggttggctcagttgctgtnactgctgctgctaagctgcaaatacatgatacnccccgtaaaggttagttgaatgctttgtctaatttgttgcctggcatcttagttacaattactccataaaagatcgttatctgtctttgtacttgggagttcaatgctctgatgtaaccatttcgacaaaaatgaaacctggaaacaccttttgtcttcgtcaattcatcttctggttccngangtgtcngttttgaggggaaagaaaaggaatctggaaacacattttcagtttaggaaaaaaatgtgtgagactttgtttcttcttgaaatgagaaacttacatggaaaaacacactcttgacaggaagaagaggacgtctgcgaaagagcgaaaagaggaagagatcttgagcattctgcctgaatcgtggggtactttggctgcagtactgccccaatctttgaatcagtattggagaacgctaccagacatcaagtgcaggatgaatggtggataatgttctgtataacctaggagttcttttgcacacaaaccttttatatctagactgcactggtactggaaatcaggctactgttgtactggatgcctgaaacgtgtacataatcagcagctgatgtctcactctgatacttctgtagtataggttgactaaaatgtagcagttatatattgtagaacagctttatgcaatgggttgttgacagttgacaccttaagctaagttggaatgccatcatgaatcatgagatgtgcactcttgtgatgccacttgccagcaaggtcgggtgaactgaacgtgctgcttttgctctgtactttctagcaaaggttgtttcattaatctcctcatttttcatgtgaaattttcaagggaaatattaacacgaagattttgtgggaatcattttactccattcaaattttgttgttttagactagcagctgcatcattttgcttatgtttatacttataaggtaacttttgaattttaaattttaattttggagttgattttgtagttttgttcattgtagtttattttacaacatttggatttgaattgctaaggacacatacgtaaaagttttgctcatttttaggttgataataggggattcggatatgcatatgcataaggggcgttgagtatattacaggttgtttggatgttaaggggagaaaccctggtagttagatacccatggcgattatttatgtgaaagtagtcccgcaagggaaagagaatttgaaacaaagccataaaaaatggaaaagtctaaatatcctagtaaactttgatttaggtcggggggtgggggtacgcgcggcgcgacggtaagcagtcgacgaggatgctgtaggtgt

SEQ ID NO: 1912 - DNA, 2000 bp, Oryza sativa
atagaaacactgagctcatgaagattaacaaaggaaatgcgatctttactgaatcacccttctttaaggaaaagatatatacatagtgctatcaagtaacactgagctacatgtattacaactgaaggttaacaaatttccttggaagggattttgactgaatcgcctttggtgaaggaaaagatttacacattactagtgctcttgagcagcagtgggttgcatgtgctacattgaacatcaacaaaaaaaaaaatctcctaagcaatgtttgactgaatcatctagtgatgtagagagaaaatatccagataagagtagaagattccccttggatacataccatgttcttcgacaccttaatctcagagagtagatcagacgagcacttcgaccttcttcttccccttgaggaagacctccctgtcaacaagctcacgcatgtatccatcaaactccacaggaactccaccattgagcctcttcatctccagaaaccacttgctatctctcgcccagagttcctcaaacgcatctaggtaatgcacactgctgtactttgccttcagcgcatccaacaagaccacgttgatgccctctcccgcaacatacacctgccttcctcctccattgagtctctcctcaatccttcttctgaggttcccatcattgccaccaacatgaacagagtcaaaatctacttgcatccttgatatgataccatcaacaatgtccatcaagcttggcgccgtgcgtattgctccctgcggtggacggaggacatgcatcagcttcgcccatcgcacacattgtaccaataattccctggctccacgtccccaaatttcctaacgatcaggggatccctcgacttggagaacttggtgggcgcaaccctgctgtcctcgatgatgcgagactccaagctgaccctgtgctccccacttgtcccaatcctcccagaaccgcttgtgttcaacgatcccgaccacggattgcaggtgctcaatgtcaatatagaaggcgaggcgcttgccctcctcgggcatgcccccggcgtaggcggcggcgagacagacgctgagatcgaggacgagggtgcggttgaggtagcgggcctcggcgatggagcagaggagactacgaagataatgcggcatgggcttgcaccggtcgccgccgccaaggtaagagaggtacttgcccgcggcgaactgggagcgcgagagcgcgggtgggggcggcggggcggtggcgttggtcccgccgcggcggggcttgcgggcgagggggccggagtggtattccccgatggaggtaacggagtaggcgcaggtgacggggtcgcgggcgacggagaagcggcggtagtccttgtagttggcggaggcggtggatcgggcgcgccaggccatgtcgcaggaggacgacggcgggtcgccggggacggggcggccgaagcggttgaagtggacgtcggggaaggcgtcgatggcgcggcgcatcatgaggtggaagagctgcgggtcggcgcagtcgagcgtggaggtggtgtcgcagctggcctgatcctgctgctccaggtgggacgtggtgggcgtcaaggcggcggtgggaggggagagggagatggggaggttgcggagggtgaggaagaggaaggcgacgagcaagagggcggcggcggcgtgggcggaggaggtgatgagggcgccccgccccagcaacggccggctcgggtccatccggcgacggcgacggccgacggcgatgagatctggtggctgattgtgtaataaagccccgtctgcaggcggcggacggtggtgaacttgtttctaggaagacgacgaactgttcctcttaatgggcctaacatgagtgggcctaagacgaaggcccatgatttggcccaagaatcgcatctcgtcgtggataagacgataaagcaacattgtgtggggatagccatagccctgcaccgcacctcgaatccccaa

SEQ ID NO: 1913 - DNA, 2000 bp, Oryza sativa
  misc_feature (1878)..(1878): n = any nucleotide
  misc_feature (1900)..(1900): n = any nucleotide
  misc_feature (1930)..(1930): n = any nucleotide
  misc_feature (1950)..(1950): n = any nucleotide
  misc_feature (1969)..(1969): n = any nucleotide
ctatactaaagctatgttctttccctcattttctatataaaagttattttaaaaaatcatattaatctattttttaaaaaaaattagttaatacttaattaatcatgcaataatacgagcttcgttttacgtgtcgggctagatatgggcccagagcttagaggtgaaaccatccatccgaaatgaatgaatattgtctcaggcgacacctaggcgtcctttttctcctcgttggattccctctcctctccgtctgtggtggccattggtctagaggatggtcgggtttatctcatagtcaggtaaatcccgttgttggtcctctcttttttctttgttgtgcagatcgaaggaggtggtggcgtattcctcctccgtctccatcttagagttctccggcgatggaagcacttgctactccttgcttttggcatatgcggtccggttgatgttcaccgggttagtcccacgcgccatactacttttcggtgtctgcaacttaaagttctccaatttcttttgagaagaggttgcgccggccgttcacttcttttcggtaaccactcacataagggcggtgttcttctccttgggtttcggtgtcagatttgtaaggggcagctgtgatttgtttctttggccaaggtagcttcaaccaccatagtagaggcctcaactggattcgctccttggctatcttttgccatgttttcctcttcaccgtcgccgttagcacaggccaaatcgccgctcccgtggaagaagcagacaaaggacccaattgcttttgccccgttcttttcaagttcttttctacaaattttcgatgtatgctcaatttggccgttactgaggggcctttctacaaattggatgttcttcccgttgttgtgttttatcatgtgccttttgtatctaaacttttataataaactagataaattgtctgtgcgttgtaatgggtgaacactattttaattttgttattgttatacggtttaattaaggtgaaattcactgtgagaatttgcttggatatattgtttttcttaaaattcatgagctgcaattagtagtccgattatctcaagttagcctgtatgtttttttaaagagatttcttatacgactacttctgtattttaaaaaacgaacaaacttaaaatccgactcaaatacatatatgtatttaaaatcgaacgaacttaaaaaccgactcatacacggatgatataccaaagtaccagaaaaacatctcaaattcttataaagtaaagatatgtatcaaagtaccagaaaaacatctcaaatttttataccagtaacacatgcatgaccttaaaaaaaagaaatgaatgaacattctccaacctttgccacagcagagacgccgtctccaagcgaaatactcctactccgtcgacttatcaacggtctagatcgccttaagattcgtgcgaagaagagaaaaaagaacaccttatccctccctaccctcttcctctgccaccaccactcgaggagcctcctcggtgtctcccgatccgccgccgccgccttctccggcgatccggcagccgcatcctgaacgctcgccttcccgttgcccccgccgcctcgccgcggcgccctcaccgccgcccaggcctgacctccaaacccgggaagccaccctctcctccatccatggcgtccgccgccgccacctcgtcgtcggcgtcccttcgcctcctcaccaagccccccaagcccctcctctccaagccccacctcctcaccctctgcgccccggtctccttccagcgcctcgtcgccaggtccagcgcgtcgccgaccccgtccccctccgccgccgccgccgccgccgccgcctcgggntccggggtcgatccggcgcagnttcccccggggctgcgcgaaatcgtggcgnttttccagtccgtgccgganccggggaaaacggtacaancagctccttgcctaagccgcgcggctgccgc

SEQ ID NO: 1914 - DNA, 2000 bp, Oryza sativa
agcaactatctcataatagtgcgtcgtaaaaaacatgtaaaaaggacagcagtgactttaaacgaacattacaccttcatttcgactctgatttgggaaattttatatcgtcacctttcaaacacatcaaacttgattctagatcgacgagaatcgtcgaaataaggcttaggccttagaccttgtaatagataaggctcataccggaagtgcttctctccacctccatgaacttgaacacatatgtagccttagccttatgtttcctctataaatatacatcatctaaaacaattggattttgtctagttgaattttgtatgcgatacaccttatctctagtcctcggttgtttagttgaggagtaatttagaacccccaataattgttgtgtagatttatctggttggttagatgtatcacttcaatcacatctatttatttgtgctttattactattcacaatattcagattatatcttagctcactattgtaatgttctcttgtttgcactttagaaatcatcaaatgcatgtcatggttggtacaacgtcattttcggtgtagcgattgcatggtgtcttgcagtcttgtacttgttttagttaatagccactttccaaacatcacatttgatcaaagcgagatttatcctctcaccaaaagatcgtgccaaaagagaaagcttcatgacattaaaatgtgtgtgcctgcaccgatgtgtcaatccatgaggacggctgcctggcatcgttccacatataggtgggggtgtgcacttcctgtacgtgagcaagtgcgcaagtcacaacgccgttgatacttacgttgtgcccccttgcgatggcgtagcaaatcattgtgatttattacgtcttctcttctttgttgttatctttatttaaatgttttgtgcacaaagcacttgattaccatggaaattatggacaacaagagagtattacatgtgtatttttatcacaggggaagacaatttcagaggtggcaatcaagcagtgcctagtactactgagtgagttgacaaaagaatctttgctttgatttttcactctcctaccacaaagtacaaaccctccagacgggtggcatggcccccgatccctattccccggcggggaattcctctattagggtgagctaacggggtgaattcatcccccttggggccggaaacagccagaatcaaggtccatcgggtgggccggggtcggaagctttccactaatcccggccccatatccccatgggccccccgagatatgttgggtcatgagaaagtaccatgccatatactccgaaataatagcccaacagcaatatgtataccgaaggtccctcaacttgtcatcgagttacaaaatcatccccaaaccgcaaaactcagatatatgacaaccctcaacttacaaaaccgttcatttttttcattttaggtcctttagttttgaaaccgatttcaaccgacgtggcggctgagtcggcgtgggccccacatgttagtgtggccacaacatctctctttttcacctcttctctcccttcatcatctctctcccttctctgctctgcaaggcccgcagtgcttgggcggtgggcggcggtgatggcggctatgggcgacgcggcgctggggaaggggagggggaggagctggagcaggaggccgacgcagaggaagacgagtgcgcggcggccgatgacgcgaacggcggcggcacagaggagggtggcaacgtggatggggatgggggcggaaggttttcttcacaccggggacggggacgggatgccagccccgttgcctgtgatggatcttcctgcaaaaccgcacttccgaaggggtgactctgcaaggaaggtttttgcctccttttgttttgcgtctccttatcagagtggattggcctccacttcccttttggccgtccatctctcctctcctcgctctcgctcgctcgctctctcgctcgctgctccc

SEQ ID NO: 1915 - DNA, 2000 bp, Oryza sativa
aaagccggagactacaggagccaagtcgtcgggtgatctagtcgaatcaactcgactacgatctcgtcggtaccaccgagttctactattccccttgtaatatgtgggtctttccatataatcccataccaactggattaggggctattacctgctaagggggcctgaaaccagtataatctgtgtctcttgtttccttgatgtcatactacatagatcctcgtatcagcataccccaatacctctatatccggtctacgggtacccaccatcgacagcgcgtgagctgctggagttcttaaggagctcgccggcgtgctctcctgagctcttgctgttgctagtcactaccttattcaaacatgtgggtggctgtgtggctttggcttccaggaaaaagaagggtcaaagaaagatgtgtattcggttggatgatctcagccgtagaaacgaagggatggctgagattgaggcaaatccaccgggtggagttggcctcaactccagtggatctgtacccgttccaaccctgcttttcaagaaattactgaaataaattgatgaaaccgggggacgtgatgccactatacacggatacttttctgcagtgacaccgatacacaaatgcacgcactggttgctaattgtcgcccagttgctatcagtttttggcagtctcagccggcagcattgacccaagactgcattgggatatttcctccttcagaaattttaccattcttcgaaaagtacctcgagacatctaaattttacactaatttttttaaagatacttcatccgtttcataatataaaactttctagtattacccacattcatatatattttatgaaactagacaatatatgtgtttagattcattaacatttatatgaatgtgtgcaatgctaaaaagtcttatattatgaaacggagagagtactaaattttacactagaaaaatatagaaaaatatagtaccttcggatggtaaaattatccttcctgcttactacggtatatgtatgaatgtatgtgtggctctccgactctattgttgccttgttccctgaccttctctcctgcaggtttgcagctctagtttctgctcgccgtcgacgggccgtctcgccgaccgccggccgccgcagggttattctaagttacgttagcttcagtttcgccgatccaaggggcatcattcggaacatgcaagttttcccattttcagcagaaactgaacggtaatttcatgtgaagattgcgtgtgaaattcttgccacatctcttcctgcataggggttcaagaaaagttgatacatatagtactccctccttttctcatattgtaagtcgcaaaagttaaacttctttttaagcttgatcaaattaaaataagataatttttttatgattagtattttgattgttattagatgataaaacataaatattaccttatgtgtgactaacttttaaaatttttttacaaattttttaaataagatggacagtcaaacgttagacacgaattcctacgactacacttattttaagacggaagttgtaacaattagatttaatctctctactatgtaaaagcgctcttttggagggcttagggcgagataaaatttaggaccatttgtttcaacactatagccaagttctcaggatttttagaaaaacgtgtactactcctagcaatattctcttctccacacatactaatctgtcccaaaaagaatcaaacatagagtttgacttttttttttggtggagggggtactattcatcagaactcattccattcgagtaattcgttttgtgcccacacgatctgcaacaaatgtgacaatccctagggccaaattcaggtaagcccaaacataatgagaacaacccccttgttgatagcagactggcttaatttcaaatcagaactgtactgcgcggctgactgttagcaaccaagtcaccaaacaacaagaatttcacc

SEQ ID NO: 1916 - DNA, 2000 bp, Oryza sativa
  misc_feature (836)..(836): n = any nucleotide
  misc_feature (1395)..(1395): n = any nucleotide
tgtaaccatggcaaaaagaaaagcctgaagttttgcaattacaggtgaatggtatgtggatttttcttatatatgaagaaagtggacgttttctctaggagaagagggggtgcagtttactttcaaaaattaacacataagatctaaaaagtttaaatgcctcattttactgcacttttacaacatcaatgaagatactcaaaatgttataagatgatttgatcgaatttgcagaatgaagtaaagtgagtaataatactgcagtcaagttgagaaagttgcagttgaaacaaatattataggactaagcagcctaagccaaaggatgcaacacagatattcagtatattgattccaacgaccaatcctacaattgagaaagatcccaagctcaatgcagcggtaacagtgacaatggtattctgttaagaatcatcaagttctaccctaacaaataaaataagttaatggcactggctaaaggtaaatgaaacttataaggaacttgatcgaaagtgtcagtgatggataaaaatctaagttgataagctcaaaagaattggttgtaagctgctacatactccaaatgatcgatttctcttcctttttccaactgggcaagttgcaaggataaatgaagagatggttgtgaatgaagcccttgttctgttgtttcttagttcactgtcaaataagtaacccactacaatctattgatttgcagtataaccttagttatttttatgcagcaaaaatactatgtcaatgaataaccaagtacatgttcaggtaaaaaaacatacccaagtacatgcgacataaaagaagcatagacnaaactaatccaaacagcaggatagggtcaggaactctggagagcaaccacacttgatctagtaagatgcagcaactaaaggtcagtgctgctccaaaggttcacattgccacatgacaataaacatgttttagctgcagaaaatactaatgtgctgttcagtcgtttcctagcatcagttcctacttcagcaaatccttatcagacacaaactacatgatcgtggaattgtggtatcgattacaattgtgcgtccacagtccacataggctggattcagcaagatttgacgcgatggtaatatgctttcgattctaagcattcgactacaccactcaatatttccacaattccattccatcacaattttctttagcacagcaatatcacactgttgcatcacgcagacacatagaacgcacagtggaccaaaatgccacaggtaggatgcatcagcctaggccctagggcctaggatgaactcacctggtaagccggcgtctcgagcagcggcgacggggtcaagtagccacccgcgcccgtcggcggcgatgggggtngggtacagcgcggcggggtaacggacgaggttggcctgggggtcgtgcacgacgggggccctgaggacggaagccgaaggggacgggtggtggaagcggagcgagatccaggtgaggagcacgaagagggagagcaggaatgggaacgacgccggccgcttcaggaagtggaccagcgacgacggcagcgagggggacggcgcggcggcgggggcggcggcgaggggcgtcgtctgcgtgtggatttgcagcgcgatggctctcctcgggttcgccatggatgggtgggcggcgagctgctgctgcttgctgctggtggtggtggcgctgcccggactcggccgccgccgcggcgagctgttggtggcgagacgggcccgtcactaacccatcccgcatatggcccagcccaattaactctcagtctcgttgggccacacgcaaagcagatatttttccgtgtcgcaaagctcctccaatcgagaccgttgatcacgaaacggacggctcaaagttgttctccgcttatcctcttcctcttcttcttcctcaaacccgcaaaaccccaagccccgagctcacacaccaccaccaccgccatcgcc

SEQ ID NO: 1917 - DNA, 2000 bp, Oryza sativa
ttagaacagattttgggcagtacaagaagtcagaacttgattcctgctgatgatggagtgtttgatagtttgcaatactctgatgctccaatgtttctgcctggttcatttgacagaactggtgtggtggctgaaaaccattatgttgaatttggtgctagtggaattcagaaccagggatttcagcatacaactgaattattggcacataatcaagtcgctctaaatgtgcggaaccatatgaaggacaaccatgttgtcttctcacattcatcaggtgcttaacaacgccatttcatttacaagcttctcttattattacccaaaattatttcagaaactatactgtccaacttctgattattgttttctcaataaaaggcagccagcatgcctcctctttgtatgaagatgaagcataatgctgcagagggtcccaacttctaattgaaactactattacttctgaacattgcagatgctaccattattcatacagtgaatgagcaaccgcctaaccggagttcaaatgcttcacaatcatggttcaatggggctctatctgccttgctcgattctgttcctagcagtccagctatggctgctgaaaacataggtcttaacagaacactgcaacgcatttcgagctttaggtcacaacaacctgcaagagaagaagttagcagtactcttatcaacaccagaagaagaggcggtgggctaattttcatctcgttaatggttttacttgttgctatcatgtggacctttagcaatgggtctgcagtcaagcttagcaaggggttatggaagtttccctctacataataggatgcacccggttatcctggtggccagtgcttcttactacttcaagtactaattcttgttttgctatcctttcctctattcctttacattgaaaaaggcaacaatctaggaaaatattagaggattatgtggtgttagcacttactttcagaatattatgcgagagatgttaaaacaaaacaaaatgagaaaaagaaacatctgaggtgaacttctggatgtttttgtcctcatcattttgatgaaagtatatattgaatgtaattaaacgatgatggattgttgagaagtgcagttgctgtgcacgataaatgaaaaatccatttttgttgcaaacttgattttcctatgtggctgcccctataaatgtgtaaaaaaaatggactactgctagttgatttgcctcattagagttgtataaatataaatttagactccaatgatccaatcgtcaagtttgtgcccatcttttctgtcgaacatgtttctatgtttctactactatatgatgaaatgatttacctgtgctggatcagatattttccttatctgtgtttagatttgacacggaaattagataggtgtgagttttgtcctccttattttaatattattatagtttgagcttgttagccacaagtggcaaagacgatattgttcctttttttcattcctgaggccaataagatattttattaatcagatgaattaatataatttaaaaccgtgcattgcataggattgagattgatatcctctctaatcaaatccatggtgcctttctcactgtatgtgggtccagggataatcggaccatatgttagtaacaaagttacgtgacttcgatggcagagtatcctgatccagtagacagatgtacggctgttaaactgccagagtagacagcgtactgtttgcacgaatctcaatgcgccgaagcagcatttggaccgttaaaactaaaatggataggctgaggggaaaaaaaccaaaaaggaaaaaaaaagaaaaatctagcatagcatatcccccttgaacctcttcagtcaagtgcgcctcctgcttatctccttcacgtcttcacaccctcttgccgtttgtctcactacaacctcgtcttcttcgtcttcctccccgtcgagaatcccgcagccgcggcaaaggccacc

SEQ ID NO: 1918 - DNA, 1693 bp, Oryza sativa
  misc_feature (153)..(153): n = any nucleotide
  misc_feature (224)..(224): n = any nucleotide
  misc_feature (227)..(227): n = any nucleotide
  misc_feature (233)..(233): n = any nucleotide
  misc_feature (243)..(243): n = any nucleotide
  misc_feature (338)..(338): n = any nucleotide
  misc_feature (340)..(340): n = any nucleotide
  misc_feature (383)..(383): n = any nucleotide
ttgtattcttatttttctaattttagaatttagtttattttttatttgaaattttagttaatcttatattgtgttctatatgggactattttatcaatattcttatctggttttatgaatttaagttatttctaaattatattcttagtttgnaactcttatttttattttttttatttcagaatttattttattttttattctggaacattaattgaccatgntgnttctgntttaaaatgnatatcttatttcatattcctaattacttatttcgaattttagttatttctaaattatattcttacttaactcctatttggcctttttctaatttngnaaatgaacttctattctaaattttaattaatctcgtattgggnttctacatggcatcgttctttcactattctttatttttcattcagaatatcgggttattactaaactgtattcctaataaattgtcacgtgaagacggcgatagataaccgacacctatgcaatgttagaggtgttgattatcaataagaactaggagtatagtatgtgactgttcggttcaaaacctgacacatataacagcgtatagatatcggtgcttgttcacaaatcaacacctatatgtagttacatgtaccgattgtagaatcgacacctatatggcatcttatcggtgtcatctgacagtgctagtgacgaattcggtattgaagatcagtccaaccgatgttaaagtggattttatgtaccagtgattgtgaatttgggatctgcatctccaccaaaccgggataatcttggtcgttgtaacctgtcaagatgcacggtatgcatatatatgtagttttctcgattaaggagggcagcgaccggcgttatcatttccaaattgttagttttcattgcctccagcaaaacttgtctggacgacaatagcagccacagatcacgctcagacacaaatcccacaccaaccgcaaatccgcaattaggtgccaagttgtatacttgtatatgtatggaaaccaagactggacgacaagcatgtctattagccataataatgtattccctacgattataaacatggaaagtttactacgagatttaattaaactttgaagatattaaccatctcttctatacgcaataggtttatgatattatggtatagaaagtttcaagacaatttttttaaacacagtatgcacatacaggcgctcatatacatgttgtccactcatcttcacgaacttacaccctagctacccctatcagcacctccgaaaacgtacagggcaattttggattgatgaaaatcattagtgacgccacgctatcaagttctcactgccgatgagtactttgtctaccgctaaaaaaataaggcaacagtcgtaaatacgagtactcgtgctaagacaaggaatctaaccaatcgagccttcgcattttcaagacaactctatacacgccatttgtcttgttttaagttgatcatttcagaagttatatatcgacggcggaagtttaaaaattatgttcaaatcttactctaaacatcaaatatgtgtgtgtgtctgtgtgtgtaagcgtttaatatttttcataagagggactagactatgccacaccacgttatatatattttagcgaaactctaaccctcagaccttcagagccactccaa

SEQ ID NO: 1919 - DNA, 2000 bp, Oryza sativa
tgccaaaagcgaaagcatgagagagtaggtcaagcgaccacgacatatggagacaagcatatacactacacatacttcctttttttctggatcgatttaatttgttatgtacatatatatgggttgatgtagccttgatgtcttcagttcatgcagtgcaaagaaagaaagggaaaaaaagtttccttcagttttcagggttgatacattttcggttgttgcgtgtatataagcttctgctctagaagctttatcatctttttagtttttacaggttgaaatatgacatggcatcattctaatgttgctgttgcttgatgctgaattgatcgagttgcatatggataagagaagagataagatgagatgatatggtgtttattgtggttgcaaatgttgcatggtttgcttgcttcaagaactggtcgagcatgaagtgaaagacaattaagctccgagagtaatttgctactagtattgtattccaagttgtataattcttttcttgtctttgattaattaactagaggatctgacagtctcccacgggcgcaaacctattttggactatcgattttcgtaatctgggctcttggaagggcattgcttgcttgtctgttaccgtgatcacgagcagctcaagtatgatgacaaaagctcccaatttatccgagtaaactaatcgactatcgctgttaatgctgttctttttcttgtttttgcctctaaccaatgattacctcaagagcaccatgaacagcccgtgattagctactaataaacctgttgtttgtgatttttttttgccaagattaatcccattttcttttggtacgtggtgcatgagcagagctcagctacagcagcagaagagctgatatatgggtctcgctggtgatggcgacgccacaacctcgagtcccgacgaaaccaaacgcaaactgacgcagatcggctgttaggatgggtttcagattcagataaacccaccaccatcacattctgcaatcaaattcgaattgcaaatgcagatcaaaacgccagaatccgatgtctgctcatttacttactacgctgggagggagcagccgtgcgtgcttggtgatcggtgatggtcgacgcgccctcgtgatcaaccgacaaagccgtggcacgaggagagagagagagagagagagagagagagagagagagggagagggatttctagggttcttgctgctgctgtgcatactccgatcccatccaacccaccgatttcgcaacagtaaataaagtaatcagtgagaaagaacggggaccaggctgtcgatgcaggagaggagagtgaccccccacaacacagaccaagaatctacagcgagagggacagacagacaggcactctgatgcatgagagagaggacgagcttgcatctctgagggtgtttcttgggggtgaatagtttacttagccccaagcaaagattcctgctttgttctttctttcttcctgattagttggttaatccttcatctttcatcagcttatgatgatctgggtagtggtggagggaggagtgcaggggcagcaagcaaggaatgtttactgtgctggttcttgcatcttgacccaaagctctctccttcttcttaatctcctcttcttctgttgctaatttctcactaatttattccttagctaccactagtccactgccttgtggtgtactgtactgtactaaccagtaaccactagtggtactagtacaagctttgcttggctaacccctcttctgccgcctcctcattgccctcttcttctccctccccacatgggagtgtggctgctcatggcgtggtgccaaaatggcggtcaggccccgtcgccttcctgcgggaggaggagcggcgccgcgcgccacccgagatggttgtgatctgtgattctctcgcattttggcgcggctgttcttgagttggctgttcttggtgtgaggcgcaataggggaggaagggcg

SEQ ID NO: 1920 - DNA, 2000 bp, Oryza sativa
  misc_feature (489)..(489): n = any nucleotide
  misc_feature (501)..(501): n = any nucleotide
  misc_feature (549)..(549): n = any nucleotide
  misc_feature (552)..(552): n = any nucleotide
  misc_feature (554)..(554): n = any nucleotide
  misc_feature (559)..(559): n = any nucleotide
  misc_feature (1235)..(1238): n = any nucleotide
  misc_feature (1281)..(1281): n = any nucleotide
  misc_feature (1300)..(1300): n = any nucleotide
gattctcttagtatttagggatggagggagtagaagttttgtaaaggatcactaaaatatttatccaatcaaaggatcctacggcctagaccatctggatccgaaatcggacggcctatgtttattggatgacgtggcccaataagaggtattacttacttccttcactactttcaattcgtacaaaatccctcaaaaaaaaaaggaaagaaaaccccccttttcacactaacctctactctcccccgtctcagttcccgatctgcagcggcggaggagagagagacaccgccgccgccgccgccgccctccggcgaactcggccgggaggcccacggcttgggacggacaccagcaccaccctccctctcttcctctccttcctcaacccccaacccccgacccccgacccccgacccccgtctcggttcatccgcgcggcctccattccatctcggcggctcgaatccaaccgaaggtacgccgctngtttcccccccntagccctccctttcaaatcttccggcggcgccgccgcttcgtgagccnatncncggcntggattcccttttgagttgggttggttagataaacccttccggatttttttttttttggtttcgtgcgcgtggttgcggtgctaatatcagttcgtttatttcattgaggtttgggggttcagatgaactcacatgtaccgattaatggtgaagcttgttgtggagtggcagtggcggggatttatcattgtgggaaaatgtaggataatttcttagctttcccttgtccgtaatcactttatactactggagtagaacgtagaaatccgtgcacttcggatttcagagcgtttgccttgcttcagcgaacaattttacttgttcatacgtgttcgattgctcaagggatgataacgacccattgcaggtgttatcgttagttcagatgttagattgttagggggataaaaggtgttaggtgcaaggtcatgcatatctaagttatgttttcgtgcatttgaagtatatatatatttatgcaaggtcatgcatctctacattaagaatgcagtggtaatcttatagatatttatttatgataatggcttttgtatgaaattagactccttcactgtatctttgattccagtagagtatgtgttcacttatgctggaatgacaggataatatccactgagaggctcaactgcatgtatttcaccagtagagtaaacnnnncaatagttttttttttttttttagaaaaaggcagccccccagnttttgataaaaggcttaangagttcgtacaggcaatagttaagtctggcattgggtaacaccacatctggctcttcgcttatctctcttcataactttaaccagtccaatgttttgtgctccttaagtagtgtcatcaactatggtaatttttgttattcttagctcaggatccagatgttagttgcagaggtgttcagagcaggagcatacatctctagattttcgcgacatgcatgccaagtatatactgctaccgaaactctttatagggacagaaatttacttgtcaatgcttttccctgcattaaagtacagttacttgccttgagagaggggtactatgtataatttctggaacaaaattgtaggagaaaatcgcttcatagttctgtttttatgattttccttgacatgggatcctctctacttatttatttatttttatttctgtttagttctttattataaaacttaacgcctgttcatttataagttatagcactcactgcgattataagcctgcttaccctttttttataattaatttattttctaatatctgagcgaattttcatctaatatgttgctttctggaattcaggttgcaagattttcgggcattagctgtgcacccattctcaattcagaagacctcaatctctggagggcagcagaaaactaaggtcttgctgctttattcaaacccgactgatagcc

SEQ ID NO: 1921 - DNA, 2000 bp, Oryza sativa
cgtttgttattgcttcttttgactgtcggcactagtagcagttgatgcaacgtcatcctgacgccatcaccggttattatagcaaatcgttgcatcattaccgctgcctgtaatacccggttcctatcacatctacactgtaggaaaaatgaatactgagctagcagaaaaacccataaaccttgacagtcgtgcaatatgccacccttggctgcgcaagattaatgatagaaaacctattttttttctaaataattgaatgatttaatttaactattataaagttgaaaatagattaaaaatagtttttaaaaagttcttatatataatgttatagtaaaaatcacaccatctattgagtgctcgaaaaagtgttgcattgatccattatttctttcactaaaaactaataggaaaatcttgggagaatttctcgtaagttactggagtggtaattcttacctgcagcgtacgaccgtactttgtgctggacgacagataccatgtggagtacaaaataacaaatcgtaaaaatggccacatgccacacaatgcaacaaagattattcctccctctttttctttgtgtgtgtgaggttgagatagagacatacataaactacacaagagggtagagtagagtactactccgttatcacctgcctgccctacttttgtattattttgcatactccagtatatatttgaatgacctaaaacttaactgcatgctaatgtcatgcaatttattttagccactgtgcttggacaacataagttttgtcatgcaacctatagattttccaaagaagccagatcgggctcatatgttcatcatccaaaattttccgagcccaaggtagatttttaagaaaaccctatgttttctaatcaaagttttagaaaatcataagtattatgacttgtagtagcatataatcacatgttttgtggtctgagtgctttacaaaaccttactcttattcaaatctcgattaattttaacatacctgaaacaatgtcattcaatatatagcgaatagttgaatcaacaacttaatgaaaaaaaatcaataactgaaaattttcatatgcattatatatttttaaaattaagcaaatgcatcatatacaaagtgtaagaatgtgtcttatgaaactttataactataattcatgggattatgtgccagcagtcataatatcaagtgttttatacaactttgatcatgtagtatggagtttcctggaatttactcaatatatttttcaaatatcaagacaattagcatatcaacactcctcggattaccgttggtttaaggatatgttgttggtaggcgatggatgaaacggaattgaagacaattattgggagtgaattaatattataaaactgataaattgaactattcatttaaaaaaagaactaataaagaaaagttttttttaaaaaaaatttgaatatgaataatttataaaatatttgtgttaaaaacatgaagaacatatgtaaagattagtcttaaaaagtatatttcaataaaatcatatatttactaatatttatatatattataacggagaatagttatcgagttgtttttttttgagatcatatttttatctaagtattatcaacctgttactggaaaggagtatagtagaaacattgtttatttagtaaagaaaaaccctagtggattagtggaaattactgcaacagttacaggcttacagcggagtaagtagtgtagtactggtgattttacaaaagggccctcaacattccagcgaaatcgagggtaagccctgcgccgcaccaaataatctctcggcttccaatttttccacacaacacaacacccataccctctctctcctctcctcccgatctcgccgcgccgggaaccctcgccgccggccacccccgccgcctccgccgccctcgcgccaggcgaatccgcacggcccccgctccccgccgcctcctccggccg

SEQ ID NO: 1922 - DNA, 2000 bp, Oryza sativa
cgcgacgcgacgctgcgctagaattcgatcgactaaagctgagcggggtggtggttacgatgggggtgtcgacgagcgtggcggccgagatctcgcgctcggtggcccgccggcgaggtagaggcggcgagatttggcggtggtttcgtttgatcctgacggcttcggccggcggcggccggtgtattgcccttccccatgcatgctccagcgccgagcaaacccgggccccctaacgacgctacccaccattgatgccgcacgcgccttcgcctgcgcaggtcctccgcctgtcgccccgtgcggcctcggacctgccaatttctaagaatcgaaattgtcaatgcccaaaatatggctcaatttttcttgcatatttcttaagtgtataagaaatgagatcggtgagaagatggcatgcaaagctggggaaagttccaataaaatgttgctttctctctccctcaggagctgaggggaattttcttatttagagcggtaggtgaggaagttagtgggagttacctttcctcttttttcttgcgaaattggacgatacactagtgttttcttgagatcatttgtagcaagtgctgaggcatctcaagaggaggagctggtaaggggctggtcatcttcaatctcacgcagtcaagcctgaaatcatccacctgtctcacgagtcatgccaaggatccccgcaaaaaaagagtcacgccaaggatggcctctggctcagtgttctgctccctctgagtgcaaagaggtagatgctgccgctccagctcgtacggcattggcttgtcaaggtagtagtagcgtgcatgatggcagattaattggcgggaacgggtggtttaagaggtggcattatggcatggggaggcgcaggcaatcttgtgcctgttaggccagcgggttctgtcaatgctaaaggacaggggccacgcgagcagcgcgttaaaggcagcaagctcctcagtggccgcttcttgtgcataggtggcatcctcaaggagaggtgtagtgatggcagcagtcgggcaatgtggaggcacagagagggaggaggagcaggagaagatgggagggggagatggaggtggcattggctggggaagaagagggggaacaggtcggagaagagaagcagagatgtgatgggctggcacaggggggttggggtggggcacagatcacggcaattgtgtatttgagggaaaaactgatggatggcgaagcagctaattagtgttgggcaattcgctactgcagcatgaatgaagttggctctttgaagtaatagaggttgattattcttgcattgctattcaacagactgtattggagttggtggaatggttatatcttgtatttgaggtctttgttttctccattcactagtgtccatgaacatgaatatgcaaatattctttttgctagcagtggttatatgtatcttttattttgttgttgaagtaacaggagtatcttttgtcatggtaatcatatgatattaagtggtaactttcctctctctcttttggtaccatggcaaagttatgttaaataacttccctattatactgtaggtggtcatattaaaaaattgaggtggtaaaagttgcaactatttaatcatgtcgaattccaactcatcagagcgacgagagtaccgagaaccaacttcaccttcaccatccacgtcatcttctagatcaaggtataacattgactcgtttcttcttcttctttttttctcattaatacaatggaattatcaagaaaatcttgtaatttgcaaagttagattaccaggttggactttctacattaccatattgtaattccttgtgtttattttaagcattctccatctctttatttcatgcatttatttatgtactttgatggactggtatcgcaatcatcatttttacttcttctctgctatatagggatagaagtgatcttgcggaagtagatgatcctgaaagtgc

SEQ ID NO: 1923 - DNA, 2000 bp, Oryza sativa
tatgatataatagagtggactacagtaagtcctaggctagattcaccccattttcaaaaccggctataaccgtgtttttaccgggtacaataaaggcatgcacacaacaacccatcaattttaaataaacttataataatttaaattttggataaatttatatggtttctcacgttttgctgtgatattgtcgccgagatgtggttggctgcaaaagtttcaaacatccctatatcaccatggatcatatagtaaaaatacgtggtttagttttgttttgacacaatatactagacacgatataaaagtgagatataacttgaatgtatcaatgtgcttgtaactgatatgcacaggtgcatgagggaacctcaaattagccaacacgtacatttgcaatttgcaaaggacaaaggaccgctcaatgtgatagccaaattaacatgataaacagagatagcaggttcaccttcgcttctcttgagttgtccaggacaagatgttgtcataattgctactccctccgtattttaatgtataacgccgttgactttttaaccaacggttgaccattcgtcttattcaatttttttatgcaaatacaaaaatacttatgtcatgcttaaagaacatttgatgataaatcaagtcacaaaaaaataaatgataattacataaatttgtttgaataagatgaaaggtcaaacatttgttaaacagtcaatggcgtcatacattaaaatacggagggagtactaactcccgcgtcctttctagttaaaattgtttactgaaattctattggtacaatgaaaaacatatatacatacacatgtcacattggacttgagaattgaagccccagaaaagagtagcaatggagctcctaattattttcttacaaaagaaatacacaccacaaccacctctaatgcctccttggaacctaggaatttggttctatatgaatattgaaccaatttctatgaaaatcattacattttaatttaaaattaatgcatttagaagagacttacatttttgggacactactcaaatagatatattttatctcatatacaattaaaattataagttgacaaaatagttaatatgtttcaatggttggccataatactcgctcgcaattgtccaaataaataaagccctcatgaaatagaggattgatttagtagtacttctagcaaaactataagttctatcaacatcatgtgtatctctaaataaggcatgtccatgcaaagcttgcatgcaactattaaatctagccatttgtttctaagtcaagcaacctcctcaatatctcagagaccacatgagaaaatgacaagaagttctctccgtctatttgttttcctaacacaatatgcatggtcaattaggcaacgtagctcttatatcgtttttagcatgaaaacatgccaaattttctatacccataactatttcatgattttcttacattcataatcattatatatcgccagtacattaggcccagcaagatgaataatgccatctaattttccacggctcgatgactgccacgtgtccagttcctccgaagcagccatcctcagccgtttgattcgcgtataaatagccacgggcacccgagcccaccgcctatttcaccacccgcttcccctcccaccctcccccatttgttccaccaccagctggacggcgagacgaagcggaggcgagggcggaggcggagcacccctcgcggcctctcgctttaaggttcgtgctctctctctctctctcctccgccgaatcccccaggcgctaacgctggaccaaatgcaggaggaaaccctagaggaagcgagttggtggaggcggcgggggaggcgcgatgacggggccgcggggtggcggcggggaggacccgccgcggacgtcgtcgggcgcggcggcgtcggcctcggcgtcatccggcgtgccgaacgagccgctgaccccgacgtcgatgc

SEQ ID NO: 1924 - DNA, 2000 bp, Oryza sativa
tcataggggctacacacaaggatttaatgccaactagtatgacttaatggatgaattccatgtggctggttcagcaatgtgctgaactgaatatttgagtttgcatctaacactgcaatgctaatttgatgtctaggaaactgatacatgcgctaagaattacttcctctgtccctaaatataagggattttggttggacgtggcatatttagtacagcgaatccgaacaggcttctgtccagattcgttatactaggatatgtcacatccaaccaaaatcccttatatttagggacggagggagtatgtgattaaatgaacctcacttcactatgctgtgctggcctgctcaaatgaatattggtatgacacgtttggtaggttttagaaatagtggaagttttttttttcctttttccctttcccctgcattttgtaaaatagaatgcgcaaacatgctgaatccgataacactatctggctacctgcatgtgtgactgctttattattttcttttcgaactcggaaaacaaccatgttttgttttcactgcaccaatatcttctgttcaatccatcctcaaaattctcctttaaagtaggccgtattcagttggttttataatcatttattcaaaaagtgggtctatcgatgtttccctgttccttccaaacccagtttccagtttgttctccctcaggaaccagttttaaaactggattgttgaggctggtgatgttttgaaatcaggaccatgtacttgatggttactttgataaatgtcagtgacttcttttccaatattcagtttcaatacctcgaaactgtcgtgcaagtgtggtatgtttttatgcgatgcactatgttgttgctgaggtctgcaatgtgcatgtttatcccaagattttagtcactattctgctatgcctgtttctaaccaactgatatgcttctcaactcttcatttgcaaatttgacagagaatttgtagtttgtaagctcaaaacagtagttcctcacttgggaaccacttactcagaaacagtaacaataaataatgtttgaacagtccaagttcccaacaaattaccatattttttattgcgtttagcatggaactgattggaatcaggagatcttgaaacgaattggaggtcatagggataaacctagctccacgaagagaattagagatatccactacctcactggaagtataaaatagtagtttttctcatctcaccatagatttcctacccttatctgaagggacacacttgatgtgcacaaacagaacttgtgcatgatgaaatgttaaagtttctgacaaataccaaattatgttgtttcaactttatttaagtttgacacaagacctggtatccattattttattccataatctggttgggataattgctttctgctgttttctttttacttttttttaatccctagtcccaatggtgttttaatttatgaatgcagacatggtgatctaacaccataatcataagggccttgttatcaccagcacttctacaacctcaatgacacagccatgctcagcctaaatggttttgcttggacacttctggttaccttgcatcttttagctcacccgctgtatcttgcatgctgtgttgccaagtctttttgttgagcaaaacaaagtcgtaaaggtggccttttttagtgcctgtcaactgttttagtgaaaggccgtctagaaggttgtcaacattaaagatatgtagtgattaagagtacacagaaaaaccttcagcccaatcatgtgtttggatttatggtaaggtgaaaaatttggctacttttgtactactattaatgaatccatctcaagttatgtccaggtaaaataaaattttagtgctgaaagggtccataaaagtcttacaaaacacatttgtattaatttccctatcatgtttacaacatggcgcaggtttacctagtgctttttgtatgctacttgtgc

SEQ ID NO: 1925 - DNA, 1925 bp, Oryza sativa
  misc_feature (35)..(35): n = any nucleotide
  misc_feature (38)..(38): n = any nucleotide
  misc_feature (52)..(52): n = any nucleotide
  misc_feature (67)..(67): n = any nucleotide
  misc_feature (69)..(70): n = any nucleotide
  misc_feature (76)..(76): n = any nucleotide
  misc_feature (78)..(78): n = any nucleotide
tttttggggggttcccgccgaaggggaaaaggaanganggggggccgggggnaccccgaaggcgagncnnaacaancnaaacccaaccgcgcctgttgcgttgcaactccgttttgttttggcgcgcgcgcgagggaaaggaagagatttcgcgggaaaggggaggagaaaagattacgggaaaggaggggggacactgggagggagacggggggatttggccattttacgttttggcccctgacctgctagtgtatttcgctgttttgtacgaattgtaaaacagagtgtcgagtcaaactctgatccatgttgggactaattcgtactgtaggctcgtacagtgatgggtgggtgtattggtacgctgtagttagtaggtgagcagggtcaaggctcacacaattttatatcaaggttttgacagggttttcattgagaattgtaatatatatataatatagaggtaaaccagatagtagctcattaattagttaggtctgtgttttcgaaaaaagaaataatgtatttagatcgacgaaccccttatatctattttaaaatgttggtgaacgacgtaactatattttcatatcaataaagatagctaaatataattgccccctaaaaatcacacaattataaaaggtgtagggaaaagaacacgtttttttattcaaactaaaaaaatattctgtattgcctgccaaaatcgtatatactcatagaatgtgtacgcagcattatgatcccatttattaaaggagaaactaccatagtaataccattggtcaaagtgtttccgtattgtttagttgtcaccagtacaaccacagtaccactgcattgaacaactgaggggtcgatttcacacataatcataatcacaaggaccaaaacgcaaaaatgcacaataaaaaaccgcgaggagaaaacaaaacagagcacaagcagaggtaaaaaacaaaccaaaaaaaaaaaggtttcatctagccaacacccagagagagaaaggacccagtcccattccccattgccgccgctgctccctcctctcctttttaccttttcccctgcaggcttgcagccaccaccaccaccattcccctctcttctcctccttctccctagcagccaagccaccaagaacccaatcccccattgctagggttcctcgcttcgccgccgtcctcccttctctccacggcattgcctccaccacttcccctcctcccctgccgccgcaaccattcattcttttccttcattctccaaggtggtgtggttgcttgttcttaatgcgtcagagcaaccggcctcattgctgggtaaggaggatgcaagattgcaagtgtataaagattgtgtgtaggttttttgttttgtttgctggttgcatctggggtttgtttttcttttggtttcttggtggcttggatggatgagtaaaagtttctgctttttgagctgtgtttttgtgggttgaagctgtgataatacactagtggtagttgggctgttttagtgaggggggaaagatggtgcttttttttacctgcatgattgggtgttaaaagctggtgaggggtttaaccaactctttggatcccttactaaagttgccatttctttgtactagctggatttttacctgcttgcagggaggctcaaagattcggtccttaacttgccattccgtgcttatttcaggttggaaggagctgaaaagttgggggttttatggtgatgtgtggtactgtggagatcagctgaaagggacaagtgttgtgggtattagtggcagcttgttgtgagagccttctggtagatacactctacacttccagtccatttttgctgcaagaaatgcttcaggtgctgtgtctttgaggctcagtagcttccaatctttgtctggagagcag

SEQ ID NO: 1926 - DNA, 2000 bp, Oryza sativa
tactttctaatcttgcgaagatgtaagtcgagaagattatcagtttacaggtgacaacgtggttaaagtcatttacgtgtttgagaaaagtttttgggtggttcaaactccaaagtaaaacaagacataataactttcttagatcaaagtgaaaagatagtttaaaagatattacaaagtgaaactaataaaaggtagccctagacccaatttataccccccttcattttttttcagatttccaccgtttgggtagggtgggatgagtgctgagcgaaattactaaataaccctcgccattttgacgcctcctctgtcgtgcgtaccatgaaccccccacctcgtcagttggcctccgccgatccccatctatcccgcgagcgagcagggcggccgtcgttcgtcctgctgcttccgccgcatccatcaccctggtgagcacgtcctcccgccacccgcagcctacgccgatccccccatccattccgcagcgagcgagcagggtcgccgccgccgccgtttgtcctgctgctcccgccgcatctcgtcctcttccccatctctctctctctctctctctctctctctctctctctctctctctctacccacgcacttcttctcagaattcgccttcacccttagcttctgctctaggaatttgtctttaacgttaatactagtagcagtttgatggttcccaaaaaggtttggggggttcaacagctgaaccccatgccccatgctagatccgccactggggaggtgagaatttagattcggtttgtgagttttccatctgctgtgccttttttttttcgcggaagcgaaactttgatgcctttttggtgtcggttccattttctgattcgggttttcggagtacgccagatttgggttccagcagtttttgatttgccgtgcaaggtgactgtaggttgatgtgtgccggaactctgcgatcatgcgagtttccttgtgatatttttggtttttggatttagtgagctggatgtagaattttttgtcggatcctaggacgtcgggtttagtcaattggattctgtggcttgaagttgcacaaaaaacgacacatatattccgttttgtttttagctttttattaccgggaactgatcgaaaccagcgtctggtttttttggctgcagcataaagatacccaaaccgatgtttctcttttctggtactgtgttctgattggcgattgttttctcaaggatgtccattatagaatccttgtgcgacgttgccattaggggctatggagtatggtttgatccaggcagctccatagaatcctggaattgtgtcaagacacggtccttgtcacaaataccagagtcaattctctggactttggtgaatattagctgctcatttcagtgcttgtgcttgtagccatgtgctagactgtatgatcagtttttcatgagcaattcttggtgtattgttttagctgaataaaattggatttgattcgtccagggtgaccccagcttgttagcttttttgtgatatatgctcagaattctgggtattgagtgtctatcagggcatcagagcacgtcgtaggtccaccaactgttgaacatttcatcagtaaagaaaatgagttttacctatactatgtcgtagagaaaatgagttctataccatatgatggtatgatgttgctgccagagccaccaattagaatgcagtgagctgtttggactgggtctttttgtgtgtagagtttgagcgcagattttattggtctcatttggtggctacgtaagtaaaaacgaatatttatttgtatggatattcttgttcaagagtgttttgaattggtctgcctttgagctacaaagcttgcattgttgcaaatggagtcttcgctaagtttacttagagatttccttttttttttcagcacacattttcttctctcctgaagcaaaaatcacccaagaccagccctacaaaacctaggggtt

SEQ ID NO: 1927 - DNA, 2000 bp, Oryza sativa
taagatctcttttgaatgaaatatattaaatttgttggtttattctaatgagtaacgagtggtatcggagtattagtcgatacgcattagatttaccctatcagctatgctatgaatatgtataatctttactccaaagcacttttaagcgcaagtaatttatactgtctcggcacactgcccgatctatcccaatcgcttagcttaaatatattcttgaaatatagattatatatcattgatatctacagccgatcgagtggatctaactcttttctcgttacttacttcattgccgatctgacctgcgttacatcggcttggtgctaaatgatatgtcatcggcagtccagccgatcggctatcgtttatggatttaactttggattctttgtttcttgttggttgcaggatcaaactaactagcacgccctgaacctgaaggcaaatctttggacctgcactagagtaaagcaaacctcgccagtgtgtgtttttcacatcaacaccttccaatccttgtacacatgtatgattagcaggaggttcattttatcgcatgtcgggtgcatttttatccgtaaatggcctgcatacgtatatttaccaaaactagtggaaggggcagtgatgtcgacgcataatgggcgtagctgccaacatgaatttgccgcgttgaacgacggacttgacgcatgcattgcgaacggcacgggtgcagccgcaactacaagccatagctcctttcctttcttcttcttcttcttcttcttccttctttcttctttcttccttctttcttttcttctctctccctccatggctgatgccaaaaagtggctcggtcggccaatgacagcgtgacgaccgatggctcgatgcacgaaggtgcactcgaccatgatgggatgagctcgcacgggcttgtgtctcgcgaacgacgaggccacaagacgagcgtggaggccgactgctagtgcgtgatggcttgctcttttgcctgtccctgtctggaacgatacgacacatcttgtgtggagataccccaatcggcttgcgccggcgactccaagtcgacagttgcggtgttcaccaggaacggcaaaaacaaaacgggatggagagagtatttcattttcgtaattagatcagcgaatgcaaaacggatctacgagttgtcatccttctatgtgaattagaaaaatgtgacggtgatgtcatagatctaattttacaaaatttcagtggcacccagccaatatcacgaatagtagtggtatttttctaatatagaaaatttacgatgatatggatccaatctatactttttataaagttaaagttatagtccactaagttcaacatgctaccacgccacatcattacccactaccaaaaattacatattcaacctcatgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctgatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcgga

SEQ ID NO: 1928 - DNA, 2000 bp, Oryza sativa
gacggaaaaagtttcgtgtgtattgtatcaggaccaatgagacagagcccaccctgacaccttgctagggcggaggcgtactgacgttgccacgcagttgcaccaactcatggacccttgtcgaggattagagcattagcagttggccaccacattttgccgaacctaacgtgccatgtgagcaaagaataatgttagctacatgtttcacagcaagtcacttatagtgggtcccactaatatcaccttttttcacttttcatctcccctttttcctatcttcctctccccaatggcggataaagcgaggcgaggtcaaggcgacaacgccggcgaagcggcccacgcgtcgagggcgatgacgttaggtggagtggcaaggtcggtggcgcgggagcagttgacgagcgaccagatccatccctcgccttgtccccaaaagcagtggcaaggttggcggcacgggagcgagggatggcgaggtcggcggtgctcctcctctttgcattttccatggtggaggaagtgaggcggccgcggccggtttggcgacggcaccacctctcctcctccgactggcagggtacggcactgcaagagcttggtggcgtacaaaaagggggcgacggggcgggtctagcgctgactcatctacctcgtccatgactatggccggcgttggccttgagctcccctcctcagcaacgagcccggtgacggtgcagtgtggaagcaggggcgacgattttcttggctccctccttccctccccgttgacggtctccctccctagtcgtcgagacaagccgagctttctttcctccctctctcctttccctagcgacgagtgtgggctgccttaacgatgctgccaattttttatgaataacatgtgtcttagtttggtcacgcgttcttagtttggtcacagaaaatattgacgtggctgagaatctcctacttataagcttgagtaaggatgggaatggttagggtcgatccatttatgcactaaacctatccgtaaatttgtcataacggatttgtagggtcgctccaaaaatataaatggatcaaacggatcaatttgtcctaacggatttgtagggttgctccaaaaatataaatggatcaaacggatcaaaccattagaacctaaggttcaaggggttcgatctaaaatgacttcacatgtataaatgtttcaaaaatttgtacaaagttgcttcgctatataataattcattcctacaaaattcaactaaatttaacaagtttttaaagtgtgaacgcaagtttaaaaattttggatccgagttttacatgtaactagaatttttgggtcttagcaacacattatgggccccacatgtatgaagggctcaaaatttacacaaagttgcttctctgtgcaataaattattccaccaaaattcaactgaattcgacaagtttttatagtgtgaacgcgagtttaaaaattttgggtccgagttttacacatataactagaatttttgggtcctagtaatgcatcgtgggccccacttgtataaagggctcaaaatttatacaaagttgcttctctgtacaataaattatcccaccaaaattcaactgaattcgataagtttttatagtgtgaacgcgagtttaaaaattttgggtccgagttttacccatatgtaataagagtaaccgatccatttggatatctatgtataacctattgatataatagactcatggtggatcaaccctattaaaccatggataaacgaactcacttaaaacggtttaggttcaatccatatcctaaccattcccatcctgaccgcttgaggctgaatggcacataaacgtaccgtgaaagttcttagctgaggagagaagcgaataggccggcgatgggcgtggacgcatggtgcacgagcaacgaccggacgagtgaatgcagctgaggcgggaggaggcggtgtgggggaaggaggcgcacagca

SEQ ID NO: 1929 - DNA, 740 bp, Oryza sativa
accctaaaaattttcttttcaaattaaactaaacaggttcttagtttatttaactttttttataagtatattctcagcttcaatattattaacgttgtcatattggagtacgacgcgaataacactcatgccgagaaaatgatctattttttaaatatcttttaagaatctacaaattagtttttgaaaagatttaatcctgacgttttatattataagtcattttaagaaagtttacgatagaaaatttaagcaatatctaaagcacaaagttaatctaattaaaattaaaatttaatactacatcttaataatatgttaaagcgatttataatataaaactgaaggagtgaaatgtaaaaaaaaaaaaatcctgaaaggcaatgcacggcggccatcatttccatggtcacgaagaaggcgcaagaatccaaagcacacattcccatcacacacaccaccgctccgctccatgtcgcaccactacccatgcctccctccccagcttcttccacctcctgctcccctcgcctacccacagctgttcacatcactcccgctcctcgagaacaccactccctcctactagtagcttctctctctctctcttcttcttcctcgctttgcttgggttgggttggagcggtgagacgagagattgaggggaggagaggagaggacagcagctgcccctcgattcgattcttgagtgatcatcttgggcttgggcgttggcgcca

SEQ ID NO: 1930 - DNA, 2000 bp, Oryza sativa
gaccccgtattttttcttctcacttcacttacatgtgggactcacatattatttttatgagtgtatttcagaaaactgcaactatagtgataaaactatcagtttgctgtaacatgtaatatatttcggtttgctgcaacaatagcgtggggaaattatcacaagactgcaacttttactctatttttattttgctgactaggatatcacgtcagcgaaaccagctatccatactgctacacgaccccaaatacacggtattgtatatgttagggctgaagatttctggtattggagataagggacgtcaaacaactcaatataaaagttgaggtactaccggtgaacttaatcctggtaaaatttcggccccggaaggtggatatgccggcccattacaccccaaaccctagagaaatccatccactaacttaaccggtggaaatccaccactccgggccgcctcccgtcttctcttctcgagcggctcccgcgccgcctctccttgttgtctcgtcgcgcgccggcgcctcctctcgtcgcgcaccggcggcggcgccagcgcctcccaccgcatccgcctgcttcccctaaggcaccgcatccccttccttcccagtgccggcgccgcctcccttccatcctcggtgcaggcgcctcctcccttcatccccgctgtacagtgctgcacagagtcgaaacagtcttcttcaagcccagatccacggcaccaggtacaccttgatcctctcctcacccgcttctcgtgtgtggacagaagcatagcagttgatatgccatacatgccttctttggggttctttggtggaatggcttgatacattctgtttgagatgcttgatttctactgcattttaactgtatatacttttcaatcaatgtcttgtctagttccatatatgtacatggatatcttttctcctgctgttagaacttgtatggttaagttcgctgcaaagtgattttcttgattctttcactattcagagcgtatgttagttcatctgttgctaagttaagatcttaaaagtctgatcaaagaaaagaaaaactcagaaatggtatatatcatagaactctaagttgttagttcagtgtttaacttgcaatgagatgtttttataaatgaagagttaattttaatcatgcctggaatttttacaagtttataaataaagaaaccatccgaagttttattacccaagcgatgcatttcaagtatgaaaaataagtttggaaataggtttaaatttattgtccttactttttgtttttcatcatcttagactagatgtttttgttttcatgaaactagaaactcaaaaaagatttatagtgctgtgtggttatagcactcatgaacctattcctatcatatttggtcttgatttgtttcagtttattcatcaggttggttggggaatgcagttcattagtgagatatcattatcagtgctattcaactactgcaattcattatcagcagccactgtgttctgctaaacacatgtggtgctcaggttatgaacttgataggtgaagttaatggttgggtcaatatatctcaactgtggaaacaacgtagcacatgtatctgctcatgaagtttgcactttcggtggcaaataaaatttaatttaaattgtgtactttaagcatttttactgaggagtgagaagagatgtttcccagtctaagtttccatatattcctatgacatctatatttttgttgtttcatctgtgctccagttgctataacctggtttgctaatttgttatcaagaaatcgtgttgtctttcttttgtcttcctgttttgttaaataggccactgtagtgacactggtttgttattgaaacaaccgtgtataagtcaatttcgataatttttttttggccaaatgattgttatactgacttctgctgttaccatgttactatttaatagattttgtgagttctagctactagccaagaa

SEQ ID NO: 1931 - DNA, 2000 bp, Oryza sativa
cccggtgaggagccccacgctccgtcaaggaggtataaaccaaaaatgaggcaagcacaaatcaaaattgttgaacatgggccataactacctttacagatgcatatacattgcatcgatttgtatggttatgaatggaccaccatgtaccctcatgtcccaagtgtgcttgctgggggaagcatagcatttagaacggtttcgaaatcaagaggcagacaaatgaagtgagctctccaactcagcacaaggcaggttttttctttgttggtacgtacaggacaagagggacaacaagaaaggacccacaataatttatactctatgggttttcatgaccgatttcgcaactagattttctttgttattaataggtgtcctttcatacaaaagaagataaaaatgcaacattgatgacatagttgcttccatctttaaaactattattacttttaagggtgcacttgtctttatcttctggttaaacaaaaattgccataaattgcacatcctgcttaaaaaactatatcataatttttgctggctacttttttccaagtgtttttgaccaattatataaaaacatgtacacacaaaataatacgaatgcatgaaaaatatccttttaacatcagcttaatggctcctttggaacgcatcagcttaatggctcctttaaattcaagtgtcttgttatcttaaatcctacagatagaaaaaaacccaaagaaacggtagaaatgatcatttggattgagtagaaaaaaaaacataggaatcaaacgagactgacagacacagaaattttttttcccaagaggtggcacctcatgttgataatccttcataattcctatgacttgacacaatctaaaagaatttaaaggaatttgagcaattattcctttgttccaaatggttacataggatccaatctatcaaattttttctcaaattccctttgttctaaaggggacagagttgaaggaaaaaaaacaaatccatataatcgagtaaaaattgtaatgcatatacgtgtggtcgcataggtgaaagttattagcattctaagggctcgtttggaatatatgattttcaaaatacgtaaatgaaaaatacaagattggaaggtcctaacacttcaaaccatatgaattgaaaaagtttcaaaaaaaaactacaagaatgactgtttagatggagcacgggaaaagcgttggaatcaaaaagagagaagaataagcacaaatgattttttttttttccaagaggttagaccttatgttaaaattcccttcaaaatttctatgttttgggccaatccaaagaaattttgtaggatttttggatggctattcctttgatccaaagtaccacattggggattttttttaataggattgaagtcttccaaaaatccttaaaaccactttattccaaggagccttgctataacagtaaattgtttattgcaacacaaaccatacatatcttgcgttcgtacaaaaatatatgcatcttgttttgctacgccgacaatcccagcctgaaaataatttgattgtcattgctaccacatgagggtgatcagccagcccagccctcccctccaattgaataatcaccaactaaccaacgaccatatcaagaatcccaagctcctgtcagcgttataataatcacaaaaaaaggagaaatcccaggcatgtaaaatctcaggtaaaaacaccagtaaaaacccaaaaaatttatctcgactttttccatgatccatctcgtgcacatcgatcaaatctctccatctccatctctctctctgcccacaccacaccaccatgtgtgcccacatctcctcgaccaggcctctctctcctactacatcaatcctctcctcttcttctccctcctcagtccctatccactctccttcctagcagcagcagcagcagcacacagcgcggcaagaaacagggagcttcagggtgagaggagctagaatg

SEQ ID NO: 1932 - DNA, 2000 bp, Oryza sativa
  misc_feature (468)..(468): n = any nucleotide
catttgtgtcctagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatatttgtaaattgggtacagtatgatcaaacgtattgcatgacttgccttgctctcgaactgatgagacctcggcaacgtcttcgaggaactgcggatcgacgaaacggccgaaacctacgcgacaaacaaagcacacaagcaaaacatgctataagactgctgaaacaggaaacaaaactatttttaatggattttttgcatttttcttgatttactgagacttgaatggacttaaacggagctcggatgaattacttataaattttagaagataaactgtgtttttactaataaagnaaaagtccttaattaattattgcgcaataatacccagggctgacgtcagcgaaggggggggcgccggcacgtgggccccacgggtcagcggctccaaagggagggaggtggcgcctggcaggtgggccccaccaggcggtggctcaaaggggaggcgagggaggcgctggccgggctcggctcggcctcaaggccgaccggccgaccaaggcgaggcggcggcgaggcacgaccaccgacggcggtgaccggcggtgcgggaagcggcggcgacggccgaaaggaggcggcgcatggccggagcagcggcgtggccggcgctcgcgggaaggtgaggaaaggagggggagggaggactcaccggcgacacggcggccggagcggaaaacgaaggcggcgacgacgacccgacgagaggaggggcggacgagcggcggcgacacctagaggaggggaggagaggagttagggatgaagaaggcaaccgcgacgaccaaagtggctggccggagacggaggggaatggatagctcaccggctcgcgagggagatggggttccggtggggttccggcgacgcgaggcggtggccgagatggcccacacggcggcggagctagcggcggcggcggcttggcacggcggcggccctagtggcgacggcacgcggccggagatgggcgttggcggcggagctcggcgagcgcggcgcgacggcggtagagggcgtgggagaggacggtgaatggggaatgagagagagagctcgagtgagggttttatgggcgagggaggggcggaacgccgggatgccctatttggccggtgacgtggagaggtggaggagagagagagggtgtttggggatttcaaatcccccaacacttgcggggcgcgcgcgcgcgggagatgcgggggagagggcggcgacgtgggcgcgaggtgcgggcgcggagtggaggcgcgacgtggagtggagaaggcggcggcgcgggcgggtggagctccggctccaacgaccggaggtaggggacgaccgacaggtgggccccacctgtcggcgcccgaaagagaaagggagggagggaggacttcggggaggggaaaggaggagcgggccggcccaggaaaggggtgccgagcgcgatgagagagatgggccgacggcccatctagagaaaaaggaaggaaaagaaaagaaaaagaggagaaggattttcctgggattaaatattgcactttggtgatttttaattggttaaaattatttccaaggctctgaaaattccactaaaaatcttgttaatgcattggagcatggggaactcaagaaaaattccaccacgctatttccgattattaattgcatttattaattatggaattagctctaggttaattaagataatttcttcggacgatttatttaacaaatatttaaagcaaggaaaaagggggaaacttctgggcgtgacaggtcagcacctaggctcgtctatgcctactcccatgccgccacgggcttcgcggcat

SEQ ID NO: 1933 - DNA, 2000 bp, Oryza sativa
agggtttaaatctggacgaatactacattcatccacccatggtgtacgaacaaatgtacttcctggtgtcatcgtaattcttttgtgtcctacaacaaaaggtaattgatgtctcatacttttcctaggaccctgattacaagttgaaatactactagcatgttagttccatcgccgtacttgtacaacattaacacgcacatgcacgttgctccacggcattgaattttagggccacggttttgtgtgaagtcgatggatgtgtgttaggtacataatctgttccaaaaaatcacttgcccatgacattcattctgtccaaaatggaattactttcgtgtgctctgctctaagcaggacagtgtactggcacagctagtgcgctgctcaagttaggtggagaaggtggcattcatttcataatgtttcatccatcacctgcatggatgaaatctcacaaactccagagcatttcaaaacaattatacgaagttttcagagttcaaagattcagtgcaaacgattatctgaacttcccagagctcaaagattcagtgcaaacaattactccatctgaagtttccagagttcaaagactcagtgcaaacagttatctgaagttttcagagttcaaagattcagtgcaaacaattacttgcagtgtctcttgcaatttatgtgcatcttccaatgccaggattgctgggtgctttgatgcttcctctaccttggctttatgcaaagcaaggaggagaggcatcatcaggtgtaaaagtgctaaaaggaaaaaaaataaaagaatccaagaaaagaaggaaaagcactgaaagaaaaaagggcaatgttcaccacacttgctaacagtggtgctgaactaagggccatatgtgatatgtggtactcaccaagggaaaaaagttcatttggagagtaaagcatcatttaacactgccagattgttactgtgcaaaaatgtgcagcagtaccagcatatgtcctaacgtctaattactgcttcaggactggcttatcatcgaagtttcagttttgatcctaaagcaattggtggaacagtagatcagaagcaacattctgaagtaaaactaaggcctgtcaaactgatttcataactcctaattaatcagtagaattactaatcaaacttaaggcgtaaagcagcacattattctaagcctaacaagcaccaatcagagtgtgatcccaagaaagcagaggagcagggcactggtgtgtgtgtatatttcttttttctgaagactcaacagtgagaaaaagtgaacgctgggactgctagtccttggtcttttgcctgctccccgtttccagctgaatcgttggagacacacctgtccgttgatgcctgcagctacctcatgcttctgccagccacccgtgagtgatgtgcagcgcagggcaagccagcaattgtactagtacaagttacagtagaatcagaggatatatacttgcactaggcctcactggtcagtatactgtaataaggttctcttgttgtttattatccgttctgttcttgagttcgtcagtcatctgagcaagattttctttgctattccagtcggtgactgcctaagctaggtaaggtgcagttgattagatttgttgtttggttcttgtgaaatggtagtagtgatgtgcatgagtgttcttcagttaacatgattgtttttttttgtcttgttactgtcagttcaagaatggagcaagctggcaagaaatgtgatctttgatgatcacttcctcttcctgatgatgatttggttactttctggtactatcaacacacatcaaagccttgattcctctgttgcttgtacacactgtccttgatcgtagtagaaggagaaggtgaaggaatcatcagagtacagagattaatttcttgcagtacagattgatttgctctgcttctctgctggttcttgctgatcaagaagcatttgatgagagcttctcca

SEQ ID NO: 1934 - DNA, 433 bp, Oryza sativa
ttttttgatcggactcttttttttcatccggtttttttcgtctggttttttacggatgataaaagcacctcttgtttttttaaaagtaagcagagattacggccagttggaccttcccttctggaaccatccacggccttccaaacccctcccgccaacccccgtcttctctctcgaaccatccgtccccaaaatccgccttctccactctccaccctcgtcctcgagcttcgtcgaacactctagaacctccataaatacccacctccaccacactattataacaacctcgcctcccttccctcgctcttcccaagtcacagctacgcacgcacgcacgcgcaccacgaaccagcacgcgcaccacccaatggcggacgacgcgtacgacgacctcccaatggccggcgcggaggaggaggtggacgacgtg

SEQ ID NO: 1935 - DNA, 654 bp, Oryza sativa
  misc_feature (49)..(49): n = any nucleotide
  misc_feature (55)..(55): n = any nucleotide
  misc_feature (83)..(83): n = any nucleotide
  misc_feature (114)..(114): n = any nucleotide
  misc_feature (122)..(122): n = any nucleotide
tttttttttcccggaaaagcgggccgggccgccgttgcctttttgggcnaaggcnaaaagcgaggggtcctggttgccgccgncccttccccttgttcgcggggcccggaggtnaggtaggngccccccccccctccgccatccctctctcgcatacactctcactcctccctcctcttcatcatcctccaccacgttgccggcgcgaattggcccgagcgtttgggattggggacgtgggaattcctcccatcccgtcctgcttctcgtggagagagatttcgcctgcggatggattccgtacgggctctctctccgcgccgccagatccaggaggggagttcgtgcccgcgatacgctccagtgggcaatccggtttcgctttctgtaggttagctgggcaggcaattttcccatgaattgatttctgggattggggggcgagtttcagtcatctttttccgcgggataaattgatgtttgtttttgtgttcctaccgcagtaagttaaactatgcatcggtaactcgtcgagatccattgatgtgctgtaatatcgtacttaatactcctgatttgataatagctatgaagattttgtgtctcctaaagagcacaaaaatgttaatatgcttcgactgggacttaggtaga

SEQ ID NO: 1936 - DNA, 1484 bp, Oryza sativa
  misc_feature (2)..(2): n = any nucleotide
  misc_feature (4)..(5): n = any nucleotide
  misc_feature (7)..(7): n = any nucleotide
  misc_feature (146)..(146): n = any nucleotide
  misc_feature (162)..(162): n = any nucleotide
  misc_feature (222)..(222): n = any nucleotide
  misc_feature (261)..(261): n = any nucleotide
cnanngnaatgggcttgtttatatttttaccattccaattcatgtttattatttggtaaattaataattatagggctatatttagtttgttacaaattttgataatgtctatgaaattttaacaacattatattgagcacatcctnctaaaacttgaaaatnttgccaatttggctaattttggcatttaccaaaattaatgaaatgattcattttagcgtncggtcccgtcatgttattgtcttatatatctcggccgcnacaaaaattttaatttttaaacttcattttaattttatctgaatgtttttgtatcgtagtttactttgatgttgcattagcttttaaatcgttaagagcatggataaaaaaagttttattatgtttatttgatgttacttcgttcatctcatattatcattggatgcatcaattgcaacctcagccaactccaattttacctctcatcatatcaacggtgacacatgaatgggaaatatttttagggtcactcttaatatctacttgttgacttatcagccccaatcaaaatttgatcttagagtaacttctaatgaatcaacatcaagagtggtgttaattttatgagaatatagctggagtaaaaccgggcggttaacattctggatggcagactttctgctgccgagggaattgaagcagtatgagtatgtacgggagagctagcgagctgatgagtgggagagtgcaagctgcgacctgtagctagctagcattgatttcgatcgggggccaggatgcttcggcatccgttttccatggacactcccgcaggctacagctcatggagtcacgtgctcgtgtgcatgcattgcggttaaagtaacggggcagattcttttaatttactagtagcccccctctttgttttttgttggaccaaaacaaaactagtccatcgatggtttaattaagtagtaaattttttagatgcccccaactgatcttatgcttggtgaaaagaaaaaaaagattaagcagagtgctctgctggagtaatggatgagagagagagtgtgtgagtgaggtgcaagtggtggagcatcaatccatctgaatgtgggtgggcagaggatggatgcagtgcatggggcacgttgggggcctgcttctgtgctgggttgcagcttcctctcttctctctcgctaatcctataccctctcacgctaattaatcgcttcaccacccttaatgcacacagcttttgtcaaacattgtttttgtgcacacacatgtagtagtactgggctcgtaccactccactgctactgttagtgcttgctatgctacaccctacacacacatacaaacacactctctctcctcctcccccactctatattaattacttcacaacaacccttcctgttactggtgagcgacttggagctcttcaaagccccagcactatttctcctcccccttcctcctcctcctcctc

SEQ ID NO: 1937 - DNA, 1625 bp, Oryza sativa
  misc_feature (1)..(1): n = any nucleotide
  misc_feature (15)..(16): n = any nucleotide
  misc_feature (23)..(24): n = any nucleotide
  misc_feature (30)..(30): n = any nucleotide
  misc_feature (32)..(32): n = any nucleotide
  misc_feature (34)..(34): n = any nucleotide
  misc_feature (43)..(43): n = any nucleotide
  misc_feature (53)..(54): n = any nucleotide
  misc_feature (57)..(57): n = any nucleotide
  misc_feature (70)..(71): n = any nucleotide
  misc_feature (82)..(83): n = any nucleotide
  misc_feature (103)..(103): n = any nucleotide
  misc_feature (107)..(108): n = any nucleotide
  misc_feature (111)..(111): n = any nucleotide
  misc_feature (120)..(121): n = any nucleotide
  misc_feature (127)..(127): n = any nucleotide
  misc_feature (129)..(131): n = any nucleotide
  misc_feature (134)..(136): n = any nucleotide
  misc_feature (148)..(151): n = any nucleotide
  misc_feature (153)..(153): n = any nucleotide
  misc_feature (155)..(155): n = any nucleotide
  misc_feature (162)..(163): n = any nucleotide
  misc_feature (165)..(165): n = any nucleotide
  misc_feature (171)..(171): n = any nucleotide
  misc_feature (175)..(175): n = any nucleotide
  misc_feature (177)..(177): n = any nucleotide
  misc_feature (181)..(183): n = any nucleotide
  misc_feature (185)..(185): n = any nucleotide
  misc_feature (192)..(195): n = any nucleotide
  misc_feature (203)..(204): n = any nucleotide
  misc_feature (210)..(211): n = any nucleotide
  misc_feature (213)..(213): n = any nucleotide
  misc_feature (216)..(216): n = any nucleotide
  misc_feature (220)..(220): n = any nucleotide
  misc_feature (224)..(224): n = any nucleotide
  misc_feature (229)..(230): n = any nucleotide
  misc_feature (233)..(233): n = any nucleotide
  misc_feature (236)..(237): n = any nucleotide
  misc_feature (239)..(239): n = any nucleotide
  misc_feature (250)..(250): n = any nucleotide
  misc_feature (252)..(252): n = any nucleotide
  misc_feature (254)..(254): n = any nucleotide
  misc_feature (259)..(259): n = any nucleotide
  misc_feature (261)..(264): n = any nucleotide
  misc_feature (270)..(270): n = any nucleotide
  misc_feature (272)..(273): n = any nucleotide
  misc_feature (275)..(275): n = any nucleotide
  misc_feature (280)..(280): n = any nucleotide
  misc_feature (282)..(282): n = any nucleotide
  misc_feature (289)..(293): n = any nucleotide
  misc_feature (295)..(295): n = any nucleotide
  misc_feature (297)..(300): n = any nucleotide
  misc_feature (303)..(307): n = any nucleotide
  misc_feature (311)..(313): n = any nucleotide
  misc_feature (320)..(321): n = any nucleotide
  misc_feature (323)..(324): n = any nucleotide
  misc_feature (327)..(329): n = any nucleotide
  misc_feature (332)..(334): n = any nucleotide
  misc_feature (336)..(336): n = any nucleotide
  misc_feature (345)..(346): n = any nucleotide
  misc_feature (348)..(350): n = any nucleotide
  misc_feature (362)..(363): n = any nucleotide
  misc_feature (375)..(376): n = any nucleotide
  misc_feature (381)..(382): n = any nucleotide
  misc_feature (386)..(387): n = any nucleotide
  misc_feature (390)..(391): n = any nucleotide
  misc_feature (395)..(395): n = any nucleotide
  misc_feature (398)..(399): n = any nucleotide
  misc_feature (409)..(410): n = any nucleotide
  misc_feature (414)..(414): n = any nucleotide
  misc_feature (425)..(427): n = any nucleotide
  misc_feature (429)..(429): n = any nucleotide
  misc_feature (432)..(436): n = any nucleotide
  misc_feature (450)..(452): n = any nucleotide
  misc_feature (457)..(457): n = any nucleotide
  misc_feature (465)..(466): n = any nucleotide
  misc_feature (470)..(470): n = any nucleotide
  misc_feature (473)..(473): n = any nucleotide
  misc_feature (475)..(477): n = any nucleotide
  misc_feature (483)..(483): n = any nucleotide
  misc_feature (485)..(487): n = any nucleotide
  misc_feature (495)..(496): n = any nucleotide
  misc_feature (498)..(498): n = any nucleotide
  misc_feature (505)..(506): n = any nucleotide
  misc_feature (508)..(508): n = any nucleotide
  misc_feature (520)..(520): n = any nucleotide
  misc_feature (522)..(522): n = any nucleotide
  misc_feature (539)..(540): n = any nucleotide
  misc_feature (544)..(545): n = any nucleotide
  misc_feature (547)..(548): n = any nucleotide
  misc_feature (553)..(554): n = any nucleotide
  misc_feature (558)..(558): n = any nucleotide
  misc_feature (560)..(560): n = any nucleotide
  misc_feature (569)..(569): n = any nucleotide
  misc_feature (571)..(571): n = any nucleotide
  misc_feature (577)..(578): n = any nucleotide
  misc_feature (588)..(589): n = any nucleotide
  misc_feature (591)..(591): n = any nucleotide
  misc_feature (597)..(597): n = any nucleotide
  misc_feature (599)..(599): n = any nucleotide
  misc_feature (605)..(605): n = any nucleotide
  misc_feature (607)..(607): n = any nucleotide
  misc_feature (610)..(611): n = any nucleotide
  misc_feature (620)..(621): n = any nucleotide
  misc_feature (624)..(624): n = any nucleotide
  misc_feature (633)..(633): n = any nucleotide
  misc_feature (641)..(641): n = any nucleotide
  misc_feature (643)..(643): n = any nucleotide
  misc_feature (646)..(646): n = any nucleotide
  misc_feature (654)..(654): n = any nucleotide
  misc_feature (656)..(656): n = any nucleotide
  misc_feature (658)..(659): n = any nucleotide
  misc_feature (661)..(661): n = any nucleotide
  misc_feature (673)..(674): n = any nucleotide
  misc_feature (687)..(687): n = any nucleotide
  misc_feature (696)..(696): n = any nucleotide
  misc_feature (700)..(700): n = any nucleotide
  misc_feature (710)..(710): n = any nucleotide
  misc_feature (717)..(718): n = any nucleotide
  misc_feature (739)..(739): n = any nucleotide
ngggggggggccccnnggggggnnaattgntntnccctgtatncccccccctnnggncccccccctgggnnaaaaaaaaggnnccccccccccccccttgtgngggnntancccctctgnnggaatnannnaannntccccccctcgnnnntnanaaggggnngngggggnttcntntttnnntntgggggnnnncgggaaanncccggnntntantgcncctntggannttntcnnangggggggggcntngnggggntnnnncttttntnncnaggantnttggggnnnnncngnnnnatnnnnnggtnnngcccctnngnnaannnggnnntntaaaaaaanntnnnaaaaaacagggnngaaaaatggggnnattgnngccnnccnntttnaanncccccgaaannctcnaataaaaatgnnngngtnnnnntaaaaaaaggggcnnnccttnaaaaaatnngccnaanannncaaaancnnngggaaaanngnaaaaggnntntttttccccccnanaaaaaaaaaggggaaannattnnanntttanncccntnaaatttttncnggtttnnaaaaattttnnancccttngnaaaggnanttnnaaaaaaccnnaangggttgggnttaaaagncnaanggcccccnantnnanggggaaaagggnnattttttcccttnaaagggggncccnggggtaaaanctggggnncccccttaagggggttccccntaacccgggggggaatccggggttttttttccccccccccccctcgcggaagtggctcggcaggtggcgaggccacggcggcatagttggattcgccacgtcatgttaaaggaaaaactttagtcaaattatacataggtatcacatcactcaaataagatgataataatatggaagaatctcatttacacttgttttgtaagttagaagatccgttgtactcccttcgttctaaaaaaagaacctacgatgtgacatagttttgcggagagagtatctggttttcctgtttaagaatgaaaattggatttaagggctatttactttggtgctaaaataaaccatactaaattttgacaataccaagactttggtaaggttagcaatattgtcaaattttggcaagatggctattttggatgcgttcattttgttgccaacatacatgctactcacacatattgctgtgcagttgctaaattttagttattactgtgcagttgccaaatttctgatatatttatcaaaagttagtaagaaactaaacatatgcaacttaaaaaaaaatggtatgatttaaaatgacatcaaagtgaaagttaagggatctcaaatgagcttattcccgttccggtttggttggcgtagcgaatttgtcggccgttcgacgagcagctggctgggccggctcactcacaccagccgcatcgaggcccaactgagaggctaatgggcctcggccctcgggacggtttgcctccggctccggctgcggatggccaccaccaccaccaccatcatcatcggtgcccgccgcggaagaggaggagaaagggaaaaaccccgcgctgtgtagggttttaggcgggtcgaggtggagggggga

SEQ ID NO: 1938 - DNA, 2000 bp, Oryza sativa
  misc_feature (1656)..(1656): n = any nucleotide
  misc_feature (1735)..(1735): n = any nucleotide
cagtggaaattgtgtatgtttagaacatcgaaaacatttacaacgaatcatcaatggagcaatatatgtggcagcatcaaatctctgtaattcaagtgcaaactccaaagtccaacaaatacctgttcgactgcactccggacgatcagtagttgacgactcgtactcccagtagcaatcctgaattcctgattttctgatgctattgctgcaactccatccactgccttccatacgacatagccccagctgcatcctgcataacgtgaagcaaagtctacagcagcatagtactggagactataaaactcacaaaacacaatgcagtattgcagtgaaggataggaagagccatcggtcgtcatgtcgctgtttgctttttcatcaactcggctagctttcaattccttcgtccctccctccaccatcgccttccttgctttgctggctgctgctgctcgtcctatactcatcagtcttcagtaataaacgtctccatcactcactcacctgctctctccttctttctctgcctgtgtgtgtctcctctgtgtagtgtatctgtgtgtgcatgcacagctcactgcacacgcagtgatgaggccccaaggtgtgttggtgccgttgcaagaccgacatgtgggcccatgttagtgttccatttgtgtgaactatgctgctactgtttgatagattatctttggtgatatgataagcttggcagttttaggaaaggaacagggtggcaacacttctgctaaaagaatgtactttcatcagttcaagtgtttgttaattgccagaaaggaaaagtaaaggtgtttttacataaaaagttttggaatttataatcacttccagtttcccatgtgaccttgtgctctctatgttcaacaaacaatggcttgccttaaagtatggctgtatgctaactagaaatttgacatctctattgaactaaagtaaacaacttttaaggtattaccttacatccacagccaaagagagaataagtttgcattaaaaagaagagctaagtggcttattaagcagatctgaccaattagatttctaaaaacccagcaagcaagtaaataaatgccactccaaagaatcatagttgtaaccatcttcttatgaaccctacatgctcctttaaaacacatgaattttataaaaaataataatatataaatattaattaaaatttccataaaaattacacgaaacttctgctttccaaagtaggtttaaaattccagctagtcagcaccttctaagttatactccaagaactgataagtaatgacagggaaactgataaaatcctctctcatgatactacttcctccattctagaatataacaatttagtactggatgagacatattatagtactacgaatttagacatgcatatgtccaaatacataatattattatacgtctaatccgattatagattgttatattctcggagggagggagtagtaatattttttagtactgccaagtccaaacttcaaagctcccaacaggccttccccagtctctttagacaatgttctggagagactacaaaagtgatgttttacccacactattctaaccgagagagagaagagagagggtgctctgtatgtaccatgcaaaaanaaaaattttactacaccgatggaggtggtggggtcaggaagagaagaccctcacccatgtgggagggtcagtgagattntagaagagaggaggtagaattgtagtagtagaaaagaggaggagctagtagtagtagaagaagaagagagcagatagaaagaaccctttcttaaatgcagggaagtagtggcttcacttgcaacggtacaagaaccaccatcacttccctaccactccactactagccactggccattgctcctctcctcccactcttcttctccatctcctctcctctcttctctcattctcttccctgcaacttgcaaacagtgctctgcaga

SEQ ID NO: 1939 - DNA, 2000 bp, Oryza sativa
  misc_feature (344)..(344): n = any nucleotide
  misc_feature (349)..(349): n = any nucleotide
  misc_feature (369)..(370): n = any nucleotide
  misc_feature (374)..(374): n = any nucleotide
  misc_feature (376)..(376): n = any nucleotide
  misc_feature (387)..(387): n = any nucleotide
gtgtgtgtgtgtgtgtttattttttgcaaaaacttctataggaaagttactttaaaaatcatattaattcatttcaagttttttaactaatacttaattaatcatgagctaatccaccactccatttgcgtgccaagaggaagactcataagaacacaacctaatcacgttccttatgtccctagttgtttcaaagataatgaaagctttattgaactcaactaattaaattacacatgatataaacatggcatagttttgtaaagttagatctttggccaaaaaaaaaaggtcatttcacacctattgttttctaattggctttactgagccacttacaaaantttgnaatttttttaaacctaattnnagantnggttttggaantttttttcatcgtagttttcttttctatcattggcttttgaattgctaagaacataaatataaactttttaactataaattatttttggttgcttcgttcattttttcacggcttatcagctgcaaagtaaaacagtgggtctattgtcgaaagagcacacatatttcccccggtattctgcgtgttggtaaacagaaaattataagaatatattgaaaacctaagattcaagggctaaccaaattgtacaagttactaccatgatttgtattgtgcgatatattgagtggggccatgatatataattatctttgtaacagggaagatagtttttgcaaaatctgttgcattcgaatcaagcaatatttgttaataaaacctgacatgacagtagggggggtgcatttaaaggagaattgtgaagcaagtgactaaaaatagacccctaaaaggtgttggctggcgatgagatgaggaggggagaaggaaacaagtgagaccagcttctaatttgaaagcacatgtgggaatcgggccttgtggggtgcgggtagccgttaaggccgcggggtgactcctccgccgcaggatgcagatccgacggcccagatcccacgaccgttgcgtttaaacaggagaggccgggtgagcccttgccttttcggccaaattacgccttcctacctcccctattttatctctcctttgtctcccctctcctccgctcctccaaccaccgcagctcgcactcgcagctaggcctctcccctctgctgcttcttcttcttctggagcatcgagagagagagagagagagagggggagagaggtggcagggcagcaatcttcttcctcctctctcgtcttctagatcgtgtaaggctccttcttgcggtagattgatgcgttcttggtcggaaatttgggctagaggaggagattttcattttgaggggttttttttgatgtggttttgcgttcgatttggttccctgagctcgttttcccttggatctccgcttggatggagacgtggacgagtaattcagggaaaaagattagcagctagctgaaatcgaatcgtcggtactctagcctgtaggattggttcaagattagatctttgatgtttttgatgggttcttcctcctggttttttctaccaagaacggaggaaactcgacagggagatgattccgcttcttggaaggcatgttcagcaacttcttggacagccttcctttttttgtgggtgttttttcttttcttttattttctgctgtggaatttcttcgatctctccaccctgacgagagagttcaagcacagcaagtctctcgagttggaattacgagggttctaatctgtttcttctcttggtttctgccatatttgacttcttgggggtcgtttcgtggtcaaaactggaatttttaagacatctagcgaaatatcaggagcgaattcaaataataatgtcttgccttttgtagatccgcgtggctcgtaatgctacatgttcatatcgctgcctgtttcttcgatttctgacaaaaaaagcgttcgtgttctgacaaaatttcggtttggtttttctacagtagaacgtcag

SEQ ID NO: 1940 - DNA, 2000 bp, Oryza sativa
tagaaaaagtataatttgactccctcaactatcgcccgagtatgattcatatcctcccactacaaaacagatacatcgacccctacaattatcaaaaccaatgcaaacaatgtccctcggtggttttggctgaagtgtcgcctacgtggcggttttggctgagtctttgtcctacgtggcgcgtggcattagaataaaaaaatatgggacccatatgtcattcataaaaaaatatattatgggacccacatgtcatccttcctctccttcccttcttcctcccgtctttctctctcccttatctctctcccagcctttctgatcgaagcggcggtggcggcggtcgggagcagctgcggtggtggtggggagcggcgacgatggcggtcgggagcggcggctgtggcgatggggacgaggtggttgggagcagcggcggtagcagtggggacaaggcggtgggaaggggcggacgtgggccagtgctcgggcttgacggcggtgcagagtagggcgacctcggtgagcctcagcatgtcgccgtggcggtcccggtcggtgacgatctccacatcgaggatgtctgtcgaccactcatggctcagcgccagttgcgcccactccgccaggtcgtcgtcctcgtcgacggggaccttcccggtgaccacctcgagcagcacgagcccgaggcagaacacgtcggcatgggaggacagccgcctcccgcacgtgaactctgagcacttggccgccgcgagacgatgaccgtggtgcagaagcagcgggtagaacccgtggtcggtcaacttggccaccggcaccacgtcgccgccgctgccgggcgccgggaagacgacgagcacgttcgacgacttgaggttgccgtgcggcggccggtggacgaggtcgcctggctctggacacgcgcgtgcaccaccaccggacgccgccgtcgctccctaccgtcgtccccaccgccaccgccgccgctccagagagagagataagggagagagagggggaggaagaagggaaagagagggaagatgacatgtgggtcccacaatactttttattgtgtgaatgacatatgggtcctacatatttttttttgtttttattctaatgcaacgtaagcgctacgtaggactaagactgggtcaatactgccgcgtaggcgccacgtcagccaaaaccgcttccaaaaccacacaggaatatattttgcaccgattttaatagttagaggagtcaatatacctggttttgtggttggaggttatgaatcatactcgaggcatagttgagggaggccgtgtttagttgcaaattttctcttcaaacttcaaacttttccatcacatcaaaactttcgtacacacacaaacttccaactttttcgtcacattgttccaatttcaaccaaacttccaattttgaactaaacagcagccggagtcaaagtactttttccaatcagatttgagccgatcatgatttgaactcttcaaaactactagtaattttcagttcgaattcatgaaagttcacatcatgctatacctacacctagcatgtataggactggactgtattggtactagtactacagagtatcatagccgtacgggtatcatagacaagacaatacagaaagtacagtgtcctggaaacgtcaatgatcaaatcgaccatcaatccctcctcacctttcggctttccatcaaccggaatcaaatcggatagcgaagcaaagccaacggaagcaaagtaaacagggcattgccgtttctggagctcccctactgaaccgcctcgaaagcctcctcatcaccattcctcttcctcccatggcgaactcctttactcctcctccacccccaccgcctcgcccatccacaccgacgccaaggcagcgcttgttcttgttgttgttgttgttgttggcttcgctttgctgctaagctagctggaggaaggaggaggaggaggaggaggcg

SEQ ID NO: 1941 - DNA, 2000 bp, Oryza sativa
tactgttttgctcttgtcattttccacttaaaactgaagcagttctctgtttctctggtgtgattttatggcttgctgaaaaccgtccagattcatccaacgtctcaacctactccaattgcaagctactaaagcaaaataccgcatacacctatcgtccaataaaatacctaatcttaactgtgaatttggacatgtatatgtctattcataactaggattagactatgtttgagatgaaggaaatagattcaaaatccaagtgaataaaatgcaacattggttctaaatattaagaaattaggtgaattactgccgcaaattatcaacttgattataaaattaaatatattataagtaaatataacaaacagctaaatatattataaagtaaatataacaaacagctaaaacaaatgatcaaagtaaacagtaaaagaaaaccttttagaaaaacgtactcctcttgatggggtaaataatccgtttcaataatgtttcaataatatatccgttgtaggctgagttcgaagatgctgatggagataagatttccctcgtttttcacgtgtatacttttgaagctactaaaatatatgtttttttttaaaaaaatacagaaaaattggttcaaaaaccatattaacctatttttacaaatgtaaaataattaatacttgattaattatataataataactcaccttattttgtgtatctacttcctctgtttcacaatgtaaattattttagcattttctatatctaaatttattaatatcaatataaatatgaaaaatgttaggatgatttaccttctgaaacggatggagtagtaattttctttttacctctccaatcaaaggcagccgtattcttgagaatctaccacgtttatagcggtagtaacaattttggtaaaaatctcgtgcatttttctagatgctctggtgggatctgagaacgcctacccctacacgaaaccggaagcagcatcgtgtacaaaaatactctaccactgtttacttctgtagcatcacaggctgaagtgacatgccaagcaggcaacctacggcccacgcgtaggtccgtatatttactcctatacgcgtagagtacacggtgcagtgtatagtacatagtactaccgctcctcgtatcaggttataaaacgttttgactgcttttttatctaacgtttcaccattctttttcaaaaatatataaaatattaaaataaaataagtcatgcataaaatacaaatttatattttactatataacaaaataaaaattactaatcataataaaataaaataaaataaaggttaaactttggataaaaacccataataataattaaaaacggagggagtagagtagtacaggcagcacagccgcagggttgcagcagcagcagctgcctgcctccctttctctgacatccatgaatgggttcgagccgagctgaagctgaagcagaaggagaggagagaggaggtggtgtactggtgcgtgtgtgtacgagtatttcagaagccaaccccctcccctccctctcgctgctgcgtctctgattttgatgcatgcaaaggacgcgcacaagtgcacaagagcgtgagaggagaggagaggagaggagagagagatggtgctaccgatgagctcgcgtcagtagtagtacagtgtgtgatttcactgaaactttgttccccaccgtctccttccgcttctctcctctcgtgagatcgagagtgtgagaggccggtggaggaggaggaggaggaggaggaggaaaggtgaggtggtgttcttgctgttcttgttatttttttcttttcataaattgttgttgtttgttactagaagttgtttggaagaagcgaggggtgtgggggtgaaagtgtcgtgatctttttttttcttcatttttggtgagtttgttaagtttcgtggcgattttgcaggtgggatttggatttggatttggattggcggcg

SEQ ID NO: 1942 - DNA, 2000 bp, Oryza sativa
  misc_feature (304)..(304): n = any nucleotide
  misc_feature (374)..(374): n = any nucleotide
  misc_feature (1613)..(1613): n = any nucleotide
ccgtggtggaaatggagcaacatacgatccaaaaaaattcctaatcaaagttactccttaaaaaacaaaaaattcctaatcatttgttttttcctatgaaacaaatttaattctatgaaaaactaattaaacttactcctgaaaagctagtatcacttttttccctataataatccagatccctctcctgcaccgtgattgaaatgcattaaaaaaaaatccccaaccactcgtgatagattttaagaatggaaacatttcctcatatctccatagctaacatttccaatctaaccatcccaanggcaccgaacgaaacaatcggggaaaatcccagatcagatcaggggaggcaaggagacgggggaaccctnacctgacctcggatctagtggtgggcggcgccggcggcgccctgcctctcgagctcctcgaggtgggcgaggtggcggcgctccttggggaggttgatgaggtaggagaaggccatgaggcgtagatgacgtggaagagcggctccggcgagctggtctcgatgtacttgtcgatgtagcggtcgacggcctggtcgctgctcttcttcacgttctcccagctcagccgcggcttcaggtaccccggcacctcccgcaccttcatcccccggatctcgctgatcagggctcgcagcgccatggatggatctctccgatctcgatctctcctcttccccttcctcgcaacgtcagggctcgcggctagggtttggtggcttccgagacgggaggaggaggaggaagggtgggtgggtggtcaagggatggatttgttcgctacggggtggggatgggttgggctgggctaggctgggccgacctgggcttgtgtgacagacatgtgtagaggctcactgtttcggaaaaggaaaatgtataccgaaggtccctcaacttgtcattgagttataaaatcgtccctcgaccttaaaaccggatacaacgcatctctcaacttacaaatccagtgcaagttccctcggtggtttttgactccgattttattcgacgtgtcagctgactcagatggtcggtaggatgtcctccttccttcaggcgaggaatgcattgacctcaagcataggatggcgaggtcgggctcggcctcctcctcaggcagcattgaaaatattgctgaagaccgaatttcaacgcaaaaatatcataaccgacaaattcggtctcagtctcggtctcggtcctaaccgaaatttagcaacattttcattaatgaaatttttcggttctaatatttttgcgttgaaattcggggttcacctttcaaaaaccgaaatgaccgaaagaccgaagaccgagaccacaaatttcggtctaaccaaatgcccacccctacttgtcgaagctcttgctaccggcaaggagaggagtagggtgcggggactagggttacgacggctgtggggtggcttcactgatgaagataaaactagcatgtggagagagatgggaaagaaagaagatgggagaacggaggaagaagatggaactaaaatgtgggtcccacgtctagtcgtctaggggtattttggtctgtatgataaccgaaaatgtgaccgntaatggtatgattttaattttgtgcgaattcgaatgacatgaatacgactagatgaattaaataaaataaaatttacctgagtgggcatatttccaatcaacccaaaaataaaattgcaaacacgcggattgcgagcgcgcgcacgagctaggaaagggagggagttggggagcttagctcgcgcgcggcgcggtggatcgcatgcgcgggcgggctaaaattagcgggagagggaggagttgatcggaaaaagggaggccgcgtcgcattgcgtcgtcgtcgtcgtcgtcgtcgttgtcgtccgtagcgggagggagggagagagtacgtgcgggcgtccggaggtctcagcgcacgcccgcggccgggccgtcgcgccgatcgcg

SEQ ID NO: 1943 - DNA, 2000 bp, Oryza sativa
atggtttcgacaaacaggggaaggtttttaggggtggagaaatatagttgattgtacttggtaaactcgcatgtggggagggctagcgaatatgtatacgcatttcggtatacttcagctagggctgactggaatcatcgaccaatcgaaactgtcaagattttttttcaatgaatgaatgaatggatgggacatgttgcaactagcaacttgcgatcaagtctaatgcatgttttcttatatataaaaaacaatctagaatatggataaaagagttttggataaaaaaacgaagggaataggtgtccctagagccaatggtctttggagttggaatagtgggtaaacaaggattattggcacgagaaaattagtgttatgcacattttaaactaattttagaggatcgaaacactttattttagtatgcaaagttcgttttatattaaatttcaagagtataggtagttcacattacagtatcgtagctataggaatttgctattttagcacaatcagtatcgcttatcgttgtttttggaactattagagcaagtttaatagtatagctaaccacgggctaccaattataactaatctaatagccccattcatacaatagttaattataaaaatatagtacaccataatacccggtcccacctctcataaacacgtaacgtgttggagtccgtgttgcaactggctacaaatttgtagtccgttttcttctctatattctcttttcttctcgatatgtggttatagctggcttatagcttgctattgtacctgctcttacaaaactaattaaattcgtttcataatcaaggaaaaatggtttatatagcgcgttgagactaacacggcgaatcatactaccggacctgtacgaggctttcatattatttatagggttattaaaactgattatttactctataatttaaagaatacatttcctaaaaaaactttctcttctaatgtattatttagactgtatgtttaaagccgtttttttagtttatttcttaaaacaattgatttattcaatctaaatcaaagaaagcctaatgtacggcgccatggaatttcaattgcgtttgaccatatattttattattattatgtaaatatgaaaataataaatcacgcttaaaatattttaacaataaaatatatcataacaaaagaaaaacaatattaacatatttttttataaaaagacaaatgtctaaatgtacattaaaaatcaacaacgtcgtaccttgaaaatataacagtatttgtagtggtatatatgcaaatacaattgccaccaaaaaggagagaaaaatgactgggttgcaaagctgataatttggttgcgaccatttttctaaaacaacaatttaatttctcatctgctatcgtacaccatagcaatgccacgtgttagaatatgttcacactgaaataatgaaccaacgtattcctctctatcttttttttctcctcttaaaaaatatttttttagtataaatccctttcttacctgtgccggctttaaccaacgtattcctctctatcttttttttctcctcttaaaaaatatttttttagtataaatccctttcttacctgtgccggcttctccgcttgttgcattttactgtccccatgcagacaatgccaaagggataaacagagctaaaattggtgaaaattcactcgaatccaaatgtaaacaacccatttttctcctgttccaatcccatccattccattccattccttctccctgtgctcggattcctgttcttgcagctgatccctagatcttcctctttgcccgagaattttccgcccaattccccactccgattcctcttctttcgcccaaattttggctcaacatttcgcagcgcaatctcgagctgaatcttggggggtaaagctttgcttcttggaatcttggtgcggtttttgggggagatttgcgagcgtttggagccgagaag

SEQ ID NO: 1944 - DNA, 105 bp, Oryza sativa
  misc_feature (4)..(4): n = any nucleotide
  misc_feature (58)..(58): n = any nucleotide
aaanccccccccccccttggaccttggtttgtttccttcccacacgcgcacacacacngacagacaagaggagtgagggggaagaagtgcttgacttcaccacca

SEQ ID NO: 1945 - DNA, 2000 bp, Oryza sativa
  misc_feature (439)..(439): n = any nucleotide
  misc_feature (456)..(456): n = any nucleotide
  misc_feature (460)..(460): n = any nucleotide
  misc_feature (1236)..(1236): n = any nucleotide
taagaggtacagacataaggtaaaacaatgagaaaaattaagcagagtgcatgaacatggaagtcattacttgattgaaaagcccataaccagctagcaagcctagcaagcaattatgactgaaacctgtaatctgtgaagaagggcatcaaacattaaacacaccatgttcaagtttaaatatccataaaagaagccatgtttctgacgatacaacaccagcacatcctgaggaaattagaccatcatgcttgattacatatatcgaagcaaattgactagtgagatggtttaattaatcaacacatacatgatacgccacccaattctattcaataccagtatattgctgcatgatcttgaataatcatgtatgagagcttgcattatttgttcttactagtacatgacctacaacggcatggaaacatgaatcatnaaatagcttaccaaggnactnatcctcatcatcttcttcagagctcccgacgtcgctactgtactcatcactgctagaactattgttaatgtcaagatcaacatgccgaacctgtatcggttcttgtgccttcggcaccattgctggcaccacaaccggcatctgttgcacactggcccgtggctcctcacccttgacaccagccagaatgccatccggcggtagagtgatcgggtccccgggtttccatccaggcggcggcaacgggatttcgagaggcagcgccccgttccgccacccatgcggatgcggcacagtgattggtagcacagctgcctcctgggttggtgaaggctgaaaaagcggagtggcatctccctctgctgcagtcctctcctttgcttcctgggatttcggcactccaacatccaaatccgcaaattgatacagctgcgacatcctcatctcattttcctgaggagcaggcggcaacgccccacgcagaggcagcccagcaccatgctcaggcggcgcgaaggtcgtgtagcttatgcggtgggcgtacgtcaggacgtcgtccaggttgagcttggagtgcagcgacgcgccaaagtcgccgtctgacaccggctcggggtcgtccgccgccgcggcgccgcgcgggcgcttggggtcgcggcggtagtcggcgtagtcgtcgacgaggcggtcgagcacgtggtgcgcctcgcggagcttcttggcgaaggcgaggatcgaggcgtccttggcgcgcgcctcgcgggcgaagcgcgacncgcgcgtcctgcaggtcgagggtctcctgcagctcggcgacggcctcgaagagctgggtctggagcgtgttgagcagcgacagcgcctccttggtggaggagatcggggccgggagcggcggcggcggcgcggaggacggcgaggggaggaaagtggggagtgacccccggtacgccgagatccacgcggcgcggctcggcgagagctcgaagaggttggaggcgagcgcggagatcagctggaggagcgcctgcgcccgcgggagcggcggcaggagcggcagcagcgacggcgatgtagttagggttggtgcagcggcagcggcagcgcccacggccgccgccgcgctagggttgccctgcggcggcgaggaggtgggattccccgcagccgggttgggcgggagcgacggcgacgaggccgtcagccccagccgcgccggcgaggggtggtgcgactgcatcatcgcggcggcggcggcggcgactgcggatgcaggagacggacgcgaggcagaagctactagacaaaatttcctcttaatgggctaatgggcctccaaattgtattatatgggctttacggcccataaaagcccattaactcggccataaaacaccatctcttctgactccgccgcatcgtctccccaatctttttggcgggagagcaccacagcgccgcctccacttcccgcgcaattcgcaagagaagagccatggacggcgggtcctccacggcggcgaggtcgtcggcggcggag

SEQ ID NO: 1946 - DNA, 1156 bp, Oryza sativa
tcatactctagctataatctttatttttttctgctgtgagtgtgtttagtttatgccaaaattgaaagtttggttgaaattgaaacgatgtgacagaaaaattaaagtttgtatgtgtaggaaagttttgatatgatggaaaagttggaagttcgaagaaaaaaattgaaactaaactcggcctatatcaaatattaaaccttacaccatcaaatcaagtctggtgcaaacatatcactgttaaaccttgcatcatcttagcctagataaagaacaagtaaaatagtgggatccaaatccatctgaaacaaaaaaaggagttctttttcatgggatgcaattactccacttgagctaatcctccctttcaaacacaattacattttgaaggcaactactccactgttcactcctcgtcctcttgtttttttttggcttcgatccctgtaaccgtactgcacatcacgtcatccatttaagaaacagctcacaagaactcgacaacaattcatttttctcacagtaaaatccgtactacttggagcaagcaacgaatccaatccaaaacccaaaaacatttatttagaaatgcgtagacttttttcttttcttttttctgatggcacgcttaaatatagagagacatggagggagagcagcgcacgcgtgaacgggaagcgagagagaagcatggccatccaccatgtctgcatctgcatggccaaaaaggggaggaagaagaaatgagatgacaatgatgatgatgatggtttcatcacccaaccctcccttcaatccaacttcacctccacaaaaatcctatccattatccaccaaacactcgaaaatttccatcttttccagttaaaaatcaaaaatcccctatccttgtttgcttccatttcgtcgcggatttggaccacgctgcaaccaatccccatccagaacgatcccaatctccgatgggaagattctaaatttgcaatccacccaagaactccactacgagagcttccccccaatcataactccctcgctcgctgcatccccagttccccaccacgacgacccaagaaacgcctcctgaattcgtccctacccgcgccagatcggagctcgtagcaataatcatcgggagagagagataaagaggaag

SEQ ID NO: 1947 - DNA, 2000 bp, Oryza sativa
gaacccagctagccacctctaatgatagaatttctccgtggatgccgtctccagacatggcagcctcaggatttgaaaaataagttttgtattaccaacacgaaaaatacaattttacgccctcccacctcccaccctttttcaccagtacaatctcacggttccagccgttcggtactgcccactcaacgtcctagaattggtaccaggatacacatgcttgacggtaaaaatttattgggattttatcatccttaagaattttctgttataaaatttggtacattaaaatataaagtatctcaagatatcaaaaattttagtgtaaaattgaggtactttcctaaggaggcaacgactacaaaattcctcatatatgtatgctagctagccagtacttttttttttttgaaagcaagctagccagtacttcgtgcaggtaaaaaaccggccggtgcagctgccgccgtcgatcgacagacgaagctccggcgccggcgagcacgccgtcgtacgtcgcatcctgaaagcccccgccggttatcaattctgctgatatatatggtggacgttacttgtgcgttgcaccggcgaccgctactacgtatatatactacgtccgggccggcgatcgatcagcttccgccaccaacggctcgaccgccgccgccgccgcggtctccttttcacgacgaaccccggcataatattgttggtggcgcaatgggcagcgagtggtgatgtcctcgttggccggcatcagcagccgcggcagggagaacgacgacgggtcgacctccgactccgacgtggtggcacttgtgctctccgtggttaccggcggccgcctcttgcgcttgtcactgtcacgccgccgtggttccccgcagcagcagcagcagcagaagaggcggctgaagaaggacgccacggcgtcgcagagcgagctgcagcactcgtcgatgctgcagtcgcagtcgcagcagcagcagcaacagtcgcagtcaccgcagtcgcagcagtcgcagtcgcagtcgccgcagtcgatgctgatgtcgtcggacatgtcggctatgggcggcggcggccggcggcgagagcagctcgatcgcagtagcgatggatggatgcagatcgatgagcaggtgaagagcaaatcaattgatatatgaatcagcaggaggcagcgatcgatcacatatatagcaccgtatgtatacaagaaccgagtcggggtcggatttggacgaccgattatgatggaccaacccaccatgaacaatgtgtatgcatgcatggaagcaagccaattatttataacttccatatatatactctggaggtagagaaaaggaaaggagcagtgcttctatggaaattgcaagctatactccagcttgcaaacatatatggaatcatggatttccttattatttcctcatcgattaaggtgcatatatggaatcgtggatttgagatggcggtcaaatggatcaatttttcttttaaaaattactagctactccctccgtcccaaaatataagtatttatatccagattcatagtcaaaagttattacattttgggataatacttaattaatcacgctataattaactgtttcgttttccgtgccgagggaatggtaaagcaaagccaaccccggttagagcaagtttaatagtatagcccactactagctccaattcatctataatcaatgtaatagtcaattcatacaatagttgcttactatactattaatatatggtctcacctgccatacacatattgtatcttgaaatccgtgctacagctagctacagatatgtagtccgtcattcttttctatcatcttttatcttattaaaatatatttatagctagttattccgctattgtacctgctcttacctctccctaaaaccctcccctctccatctctcctctgcttcgtctctcctctcctctccgccgctgcatcccctccaaaaataaa

SEQ ID NO: 1948 - DNA, 425 bp, Oryza sativa
cccccccaagtccaacaggctcgtccaggccaatcgattttgttttcctttctgaattgggccctgtcgcgaagcctgccacctgaattgggccgtaagcccgtaacctaagctctacgccgaaggaaagcccaaactctaaaaactcctccaccaccgcgcggcgggaaacccgctcctcccccctcctccgttcccgcgcacattttttcggcatcccacccgccgatttttttccggcatccaacgtcgcacatccatccacgtcatcgatccgcgccgcgtgccttccaccaatcagggcgcacgtcccctcctctacaaaaccatctccccacgtctcctcctttccccacgccgcaatctcgcgaatcccaccgcttccgtttcctctcctctccccgagaagaagagagcagcggcag

SEQ ID NO: 1949 - DNA, 2000 bp, Oryza sativa
  misc_feature (304)..(304): n = any nucleotide
  misc_feature (881)..(881): n = any nucleotide
  misc_feature (1043)..(1043): n = any nucleotide
gtatctgttgcatgtacttgtatgtatctcgtcatcctcactgtgtaaattttgccgtttctttccttcttcacatgacggcactatagtacgtgcgtagaagtgtaatttgtttgtttgtttttttggaagacgtactgcgttgtttaccgtacaggcgtacacaaccatcctggatttctctggtggacaagtacgtgtacgcccatgatacggggaaacacttttaactacctaggtggagtccatccatttattacatgtcaaccaaataggtatgaaaaaaatttagaaaatttaacangataccttcatatgtaaatgtcacatcacaaacatacaagtttaaatttaacttctacaagactctagcaaaaatatcaaatcaagtttgatttgatatttttgttacaacttataaaagttaaattttaatatatatgtttgtatattgatatattatatatcaatatatcttgttaattttttataaccatttaatcgacatgcactaaatgagtgattaaaatccatcgccatgatacccccaggttgttcttgtatgtgtgccctacaggcttttaggagtacattctaaccccatgcccgctgcacagtaattgacgcggcccatctgcgtggccgtcgacgtatccagtatatgggtcaatttggatcacagattatgcagtggtcctaaatgggacgggctagaggcccacaatattttttcacgttacatccaaatttgtgtggcccgattaggatcgctgccaactattcccttcgtctcaggattttgagtttttgttttgcactatttggccactcatattattcaaaaaattttagaattattatttatttatttttgacttacnttattatccaaagtactttaagcacaaattttcgttttttaaatttgtacaattttttaataagacgagtgatcaaacagtgcaagcaaaaaactcaaaatcccttaaattatgggatggagggagtagtcagtttggcaggccgaaaaaaccgggttcccnaaaaattttagcaactttataggggtcttaaattgatttcgagttcgaattatatccttaaactgtaaaactgatgttgagctcgcattttccaaaaaaggttaaataatatcttaacatagtatgtatgtttattttagctgacgtggcaatatagtcagaaaaaatacatgggggccacatgtaatttaacttcaaccttttcccatatatgggctccacattttttttactaggaagccacgtcaaaaaaaaaaaacatccatctatattgtcttagaaccttattttcctgggttttaaaagatggaggttcaacatttatagtattacgattccaggatgtaattcaaactcgacgtctagattagaaaccttaatgaacttattcctactagaggctctaatcttttggcccaatcaacgtatgccaaagccaaaatttaaatttttgaacttaattttgaagtagtttttgagttttttcaatcatagtttcttatacaatatggtcatttaagtcgctaagaacataattgtaaaagttttaatcacaagttatattttttcgctactacgccaaatagcgtatattccgcatatagccatccgatgaggctgccgtttatagggttctaaagaaaaaggctggtttgggccgagcaccagataagtcgggccgatctcaaacagaggcggtggcatggcccagtccagaagaaatttcgcatctccaaaaatttccacccgcgaaaactccgtgcgacagtgcgccgcccaccaaattcaaattttgaacgcgaaaacttcccccgcgcgtcttcctctcatgcttaaatctgcgcaaatcacgcgctcctcgcaagcaacagtgagtttgaacagaacaacgcgacgacccttgcagcgcacgaccccgcggactcgatccagatctagggcttctcgtcggcggcg

SEQ ID NO: 1950 - DNA, 2000 bp, Oryza sativa
gcaaaatgatgtgatattaacgtatgattgattgtgttttaattattataaacttgaaaaatatagcaactttcatatagaaagttttcccacgaaacgcaccgcttagcggtttgaaaagcgtgccacgaaaatcttaatctttatccaactcttgttggagaaaagaacgagacaatattatgattttctaacattaacttttatatcgcgaaaaatacatacatagaaggttttacctgtaacttatttttagcgcatatttacgaaaaaaaaagtaataaagtcgttttgggggtcgagataattgtacgaattttgggccttggaagattgtgggccaagatttataatttttcagcccaataaatcctttctggtttaaagcgggctgcctaaatataatgggctggtccgtatacgtgggccatgattcgataagggacataaagtgaacttattccaaccctgaatacacggcccgctgttagcgttcatcggatcagcatgcctacgacttcgattaaatctgagctgatggtgaaagccacgaggcatcagaaattcagaatggtcccttgaaagttcaggatcaggaacaacgtgcaatcgtcatgtctgcccgcgaagtgagctgagaactcatcatatttcagatcatgggaacgagatccccagcagaggatctgcatcccaagatcatgagctgcacaattatcttagttagtatttctaaaatgtgttttaaattatattgattagccgcacgtaaaacgtaatacgtgaatagcatatgattgattaagtattaattattaaaaactaaaaaattaattaatttgatttttttaaagcaacttctatacgaaagttttcatacgaaatacactatttaatagtttaaaaaatgtgctaatgaaaatcgaagaaataaccaagtcgagacagtgtttagaatgtgtgccttagataacacaatgttcttctttgcagagcattttactttggcttcaggtttccactgtgctttcgtcttgcctgacgctgaatcggacggacatttttttagagaagaaatcggacggacataaattctatatggactcacatgtcagctacacaatgcagaattaagagtaaaacaaccaaaggaacgcccgcacatgtaaaaactcaaaagaaattccacttgtcagccataaccaatttaaattttaatttgtgttgattttcatgtttttacatcatggtctattttttagcattggcttttaaatcactaggcaagtatatataaaaaatttaccgagaaattattttatcattaataagtgttccggtctataataagctataggcgaaacaatgccactgtaacggtcctagcgactattctgttccctacctagatactccaatatttagtagtagtgccagatgcataataagatgataacattgacaagtgctcataacttaattttgaattattttcctcaatgccccatcaagtgtatcacaacagtttggtgatctctcttttttttcatagataacggtgatctatgtgacaacagtattgatcaatgctatatcaatttcttaatggtctatgaattcaaagaaacaaagtattggcagatcatggagtcgttgggtacctacatagcttaaatgcaaagcttcaactaccctataaaagcacttcttctatgattgaacggcaaaaatacatggaatttcatcctatcgtcactgccatagccgttttctccatcccattttgccattttctattgccacttttgtcagtggttgtactagattagctaactgaagaagaagaagaagaaggagaaggagaagacagtgtcggcggcgaccctcctcgccggcgacggaaaacgaccggttttgacgtaaatccacaaggcgttatgagctcgaagatgactgtgcatctgctgctgaattattgagctctctcttgtcgacaagag

SEQ ID NO: 1951 - DNA, 159 bp, Oryza sativa
  misc_feature (10)..(10): n = any nucleotide
  misc_feature (14)..(14): n = any nucleotide
  misc_feature (16)..(16): n = any nucleotide
  misc_feature (29)..(29): n = any nucleotide
  misc_feature (32)..(32): n = any nucleotide
  misc_feature (37)..(37): n = any nucleotide
  misc_feature (41)..(41): n = any nucleotide
  misc_feature (51)..(51): n = any nucleotide
  misc_feature (64)..(68): n = any nucleotide
  misc_feature (70)..(70): n = any nucleotide
  misc_feature (130)..(130): n = any nucleotide
taatgcggancaangntgcgtcctctctnccntctancttnacccttgatnctcgatccggatnnnnncnggagaagcggatgggagtggcagttacgggatggcgtgaggagagagaaccggatggggncgggagaagcggatggaaccgcagccagt

SEQ ID NO: 1952 - DNA, 2000 bp, Oryza sativa
  misc_feature (161)..(161): n = any nucleotide
  misc_feature (280)..(280): n = any nucleotide
  misc_feature (318)..(318): n = any nucleotide
  misc_feature (629)..(629): n = any nucleotide
cggctcggcgacggtgctcctcctcgggtgaacgacgacggctcgaacgggacgatgagctgctacaagcaagcatgcacgaggtttgtgaggtcaaggagatggtgtatgcgcgagaaatcaaacaatggctcaccgaggcagcggtaatcgacgatganggcgaaggcgattctagatcggcgccggtgaagaaaagatgcgttctccgagtccttcacatctccggctggggttcttgaggcgtattgaagaggaggttgaggcgatgacgatggcncaacggcttgctccgaggtggtcaagaatggccggacnacgacgatggttgaagcggcggcgctccggtgcgtgctccagggcgtcgtcggcgtggtcgcgttccggtggctgtgatgcacaaaactgggacgtggtcaaaagagaaatggttcggcattgtgtggagagaagggaacgcgaaaaacctggagatgaactttacccaatcagcgatggcgatggtcgtcgtttccacggccggcggcaaggtttggggcgatggagaggcagagaacctcctccctcggtttcttcgggctctgagtggtgaatggagaatggcaacgcgtctgggaggagtagagagngagaaaaggggaaaccgagatcgacgacacgttgcggccacgcgtcggctcgctcaatctctccctctctcggctggagcagtggaggaagtgatggacagagtcaaggcaagcttaagaggctgtcaggtgggtctaggtcgtggcaaactaggctaggtgagagggttgggtaagattctgggtaaacttgatttttagatcatttttcggaattattttctcctctaactttgtagcttcataacttgatgtgtggaccaaattatctagtgttgaatttactggaggtaatgagcatacaaaaataatgggtagattaatcacagaaattaaacaaagatgggctgttagaaagctagattgaatttttaggaggcctaaacagaggaggaaaattctagaaaaattatatttaggcatgataaataatctagtatttgaataaattattttacatgttcacttatgagcagttaaatgtacttttggatgaagtatggctttagccaattaaaatttaatttgattccttttagttttctgctttgactgattaatttgtggtattaaacttagttattaacttgtaccaatattatagtgaattgcttgtgctaaacattatctatctaattttttccatgattttaacttgcacataatattttagagaattaggattactttactttgtatatgtgttcccacttcataattgcacctaatattgttacagggattacattaaacttcttttgggctgagaagacgatatttgagtttaatattaagtccacatgttatcacccaagattaactatagttttgtttagtaattttaacccttttagtttatgctcatgagacatattatgaaaagcaagaccaaaatccaaatgcacatgagactcgagcctaggcatgcattatgcacatgtatgctcatatacttggtgacatttctagtctaatgttgggaatgaaaaggttttattttgttctcaaattttaatcatgcaatgatttaagttggtcatcacctaaattaaaacggaaatttttgactctaaaaattggagaagttaacctctaactattttgacaagaaattttaagtcctgaaattttgggtttgttacacctgataactccgattattaaatatattgttaattggggttttctccgggttaaccaaggcaaattctagaagccattttttaatgatttgaaacctaagggaagggaaaactctaggtgtgacaatacttttagtcggaaaagttattgcaatgcaacatgtttcgaaaaaggagtaagtagtcagttgattcaagacctagagcgtctgaatttggggatagtgga

SEQ ID NO: 1953 - DNA, 2000 bp, Oryza sativa
tcgtcagtttatgttgtttagaaaatattaatgataagcgtagaaatttcttttaagttgccttattgttcaaatttttttttaattgcttgcactatgccagatcaacccatctttgatgcctacctatgacggatcaaaatgtatcatcatggatgatatcatctctgatgggttaaagtaaatcctggcgtagatgaggctcaagaaaatgccctgttacagtaaataactcatctatgacggatctatataaggacccgatacataacgtttctaacgagctcacatatagggccgtcatatatgacctattactcgtggtgggtgttgagttttcacccgtcacgagtgggatacttcaccttaaacgtgttcaaatcttataccgttgatggtgattaaaaaaaacccacccccaccctaggggcccgctagcctgctcgccccttctcctcccctcatcttctctctcttatatcttcctccgccagcgcacccatccctcccgcctgatcgccacccgccaccctccctcccgacccctggctgtcgcggccttcttcccatgattgccgtccaccggatctagcctccacgaacgttgtcatctccttcgcccactgttggtggtttgctcgtctcgtcagccccgagctccttggcgccaggtccggtctccatgtggttggggaccaacggatctagacgcctccatgcatgctccgcttgtcgccttcttcgccctctgtcccaaatcgtcggccaccacctcatccagatctgctcaagcgccgacaacccgccttagcacctttgacaacccgcatcagcaccttataacttataagtagtgggagaaggtgctaaggcgggtcgtcggtgctcgagcggatccgtatgaggcagcggttgacgatcttgggacagatcaacgagaatagaacacgaataaaaaactttatcgagtagtggtttctcatcattgtcaagctcgacgccagaaactgtcattctcttataaggtgcgctaaaatttaaattttaaaactatttttcataaaattttattttaaggattggtttttaaatcattaagaacacatatataaaaagtttacctataaattattatttctactaataaatggtacgacttataagagcaagtttaatagtatagtcaactattagctccaaatcatctatagtcaatttaatatccaattcatacaatagttacctataacatatactccctccatttctaaatatttgacgtcgttgacttttttaaacatgtttgatcattcattttattaaaaaaaatcaagtaattattaattattttcctatcatttgattcattgttaaatatacttttatgtacatatatagttttatatatttcacaaaagtttttgaataatacgactggttaaagatgtgctaaaaattcaacgatgtcaaatatttagaaacggaacgagtagtatacaattaatacctgatcctacttgtcatacacatatttatcttatagctcgttactcttctctctcatattttatcttctcgaaatatatttatagctaatttatagtccgctattgtacccgctctaattagcgtcaggcgaagcttctcaacagaaaagccaagcaaacgtttcgggctacgttcacctgtgatcagaccggcccaaacaatgatgggccgagccaggccggggccgggccgggttcccataaatatttaatgctacggttgaaaatggctgtgccacagacaggtaggtcccacgggcacggccacatccccctccccccttcttccatcctcgcatcataaaaatccatattcttctccttcttctccctccgcgtcgcattcgcatcacccccccgaaaccctagacccaccaccaccaccaccatccccgagctcgcggagaggcagcgagagcgagaggtagctgctagtaggcgtcgggcgaggag

SEQ ID NO: 1954 - DNA, 197 bp, Oryza sativa
  misc_feature (5)..(5): n = any nucleotide
  misc_feature (16)..(16): n = any nucleotide
  misc_feature (19)..(19): n = any nucleotide
ttgancccagttcctnaanccttgtcttcacaagctgagggttgtcacctgttaagttgcatgcatcacaatttcacatcatcttagcagacaaaaacagtgacataaattaacacaaatagaatcaatattccaagagaaaggggataaatattgttcttttttttctttacctggactgcaaatcttccacgagt

SEQ ID NO: 1955 - DNA, 2000 bp, Oryza sativa
aaaaaaaaaacgcttcatgggcccatcagaaggctaaatgggcccatcagaggcttcgtggacagaggcctagatgggcctagataggtaggggtggcaacttggcccatcagaaggccaccggccgactctaactcccactcccaccggcggcgacggcggcgagccgagttccccatcggtggtggcggcggagcttgcggggaaggaggaggaggaggatggactggtcgaaccttggtggggaggggccgccgggttgatcgccgagcgcgtcctcgccaacgacgtcgccgactacatccgcttccgcgccgtgtgccggccgtggcggctgtgctcggtggatccccgctgctcgcagagcggcgccatggacggccgcttcctcccccggcggtggatgatgcttgacaaggcggcgccccaagccgtcggctgcttccgcttccatcaccagaatatgacactcctcaacctgttcgtctgttttgctgatgaatgatgatacattgcagcgagcggcttggtaccttggcatagttattgtttcctcagctcagcgtggctggggcaccaagcaaccatgacgcggtggcttgtgccagcaatcatcacacgttaaggaagcaaaggatgcagggctggcgagggaattttcgagcataatccaccgccagggagatagtggaccttacaccgatagtagcagtggcggtttccgcttatacaacttggcaggtaatggtgttgtttccttctagtttcaactagggagtgcatcaactagaaacacaaaccaagaaccaaagctacaaatgaaatgcctttctaagcttgaccctacatttgcccacttggtgttggtgatccatgcatgtagcatgctggaaagtagtactagttaagctttcaatttatcccttccctgtggtttgctcttatcttgttttgcctaaccattcaaacatgtcattaatcagttccaatcttttcttctggtatcaggataattctccagccatgtaaattttatttgttcatgctagtggacgaattgccatctatcatatgatcacatacacctttttctttttccgtacatgcaaattgcagcatatattccggttgaggtgtggcaatcataaaagccacctccttgaccttgaatgcaacaacatatacctatttggcttgttttaagatgagtcatctcctaaagcattttggatttacaggacttgatgaacacatgacctgaaaggggaaaaactggtccaaactccaaaaagagttacctgactgctaatgcatcgtgtggaggcaagttctggcaatattgtaccgaacactcatgcaagtgtgacaagatcagtgcatcaaggttacctgtcaagcaagatcctccttgaaatgcttattgtgcacttttatttttgtagagagagaggcttcatatacagatatacttactgctgcagtacttcctttctttgtctgcatcttctccttcttctttatgtgtagaattagtatagacattcttactcttttgtcagcagaatatagtgttctgtacttattatagaagtctcagtgatcagtcaccatgcaacaaaagaaatagaaatactgcatatagtttcagttttacttcccactcgattttaacatgaggaagcattgtcttgcctgaaacaaagttttctaattacttaatcactctgtatgtacagtcagttgggccttagttttgattcaataattgatattgttctctagtggttgttttctactgaattgtccatagtaagaaatgcgaatcgctaaacagaaaaaggtattatactataggtagtcttatgataccacatctggtggacgacaacaacttgactttgcatataaataggcagtcccaggatgatctttccgcagcactccattcatttatctggttctgttatatatctctcaacgtaacctgattaagttggtgg

SEQ ID NO: 1956 - DNA, 2000 bp, Oryza sativa
ccgccctggcaaggcctccgagaacctaaggaaattcgcggctggggacgcccagagcggataaggccttgtcaggtaatgcagacacgaacgaccatgtaagatctggtcatgtaagagttctcaccatgcgtattaatcaagccgtgtaatcggaaattgggttttccaacttcacggctaggggctagggtaagtgttttttcaaccaaggcaggtcaagggtccaagagccttatcctccgaaaatgattctccgacaacaaggatgggggctagggagagtgtatgactcaacaaactgactgatcgaagtcggtaaaagagaagacgctcgtacacaaaacattggtctgtaaatttaattcattttcagttttccatacatattataacatgtcaccctttgaacagttttccaccacacatcctatgtcttatacggatacaaccttaggatataggaggagtttcgcataaggaaggatgaatagagttctacatggaaacgacaaggactactcggattgtatcaatattggttttcctagttctacttggataaggggacacctatataggtataaatacaagaccccctaggaggaaaggggacacgcaacaatagatcaacatacaagccaacatacgccaagacaagccgccgaatatcaacatcggagataagcttagtagtccccatacggtacctacgactaccgtcaggagggatctagcactatctttgatctcgccggacatggattcgaggaggaagactaccctgttgtcgattacgtgtctgcacttcagaccgccatattgataacagatagataggctaccccaaatattgttctggtgtgattatgatgaataagagcaacgaccggcttcggccaacaggagtagggttattacctgacaatttaagggcccgaacctgtataagaatcctcgtccctatctcttttacctcagtctcgcatataccctggtgccaatgatccccgtactatgcaaataccggcaaataccatagtcatgacatcagacatcgacaaggctaacaactatccatgtcaattcgtacaaggaagtacatacagtacaagaactaaaaaaaatgcaaaactagaatacaatttctaaatatgcaccgaagtactgtaaaagtgtagaaaaagtacaagactagactaaaattttattagaatacctaatgcgatatgtcttcataattttcactcttcatcaacagaaggtagagaacctgaagctaaatctgaaaaatgatattatataatgtaagtgatacaaattatgagaacttaattatttgtaggttacaaagcaatgcatgacatacctctaggtaatttgtgcttgcgcgtcctcaaagcatgataatgttctataatctgatgatcttcaatgctagtaaaaacatcccgctcaatatagcaaatcatgcagtgattcatccattcatcattcatcttgttccgcagctcagttttaataacattcatagctgagaaggctctttccactgttgccgttgcaacgggcaaaatcaaggctaattcaattaagcgatataccaatggaaaaactgtgtgtctatcagtttggaccatcttagcagcaagtttaccaaggtcagagcagcttgagaaatccaaatcagatctcacattagagataaatgtgtcaagttggtctctaaggactaaacaatcatattcagaaaagtcatctgcataaatcttagcaagttcaatgagcttatcttcatcatagttggcaaaagaattccttggatcaaggcaagcaatacatctcaatagctgagtagacctttcagcaaaacgattgtttaactcaacaataatttgatcaagtaccacattaaatatgcatgtccggccggccgctcgccgccctgcgcagtcgccactctccaatcggcaatcggtgatgtgagagacagggaggag

SEQ ID NO: 1957 - DNA, 2000 bp, Oryza sativa
  misc_feature (815)..(815): n = any nucleotide
  misc_feature (819)..(819): n = any nucleotide
cccggcgcggcggcgcggctggaccgccgcctcctggaggcgtgcgtggaggccagcgacgcggtgcggtggtgccccagcgcgccgcactgcgggcgcgccatccgggtggacggcgggggcggcggcgaggagcggtacgccgaggtgtcgtgcccctgcggcgccgtcttctgcttccgctgcggcggcggcgcgcactcgccgtgcccgtgccccatgtgggacaagtggggcgccatgcgcggcggcggcgaggtcgacaacctcaagtggatcgtcgccaacaccaagagctgccccaagtgctccaagcccatcgagaagaacggcggctgcaaccatgtcacttgcacctgcggccagcatctctggtgagctcgacacgacatctatcgattctccatgagattgatgtcacgccattgttggatggatgcagctacgcgtgcggcgcggcgacggggacgttgtacatgcacatctgcaaccgctacaaggaggagggcggcggcggcggcgtgaaggtggagatgaccgccggtgggcggcagcggctgcggttcatgcactactacgagcggttcgagatccacaccgagtcgtacaaggaggagcaggggaagctgggtccggccatcgacgctctggcgcggcggctggaggcggacgccacgctgccgtggtcgggcaccagggacgcccggtggccgtcggcggcgcaccggcggctgctgcggtgccggcaggtgctcccgcggtcgtacgtgctcgcctactacatgttcggcggcggcgcggcgacgcggcgcaancggnaggaggcggcggcgcagaaccggttcgaggatttgcaggggcagctggagcaccacgtggaggtgctgtccaggacgctggcggcggcggcgcggccggccgacgcggcggaggtcgtgaaggcgaagcgcgacgccgacaacctcgcccgcgtcgtcgaggggctgtgcgccgggatgtaccggtgcgtccaggacgagctgctgccgctgctcgtcgagcccatgaacatcgccgcgtaccatccggacggcccggccatggccaaggagttcccgccggcgaccagcgtgaccggcggagcaccgccggcgacacgccactaagccacaacgtgtcgagttcattattactatacgaagcaaggttgtaaacggtcgatgggtgaagggaagcaggtggttttgggaaaaattctattgtccaaacatgtttgtggtttggcatggtggatttttggattaattactagctaagtagtataggaaatatcctatattgatacagaggaaatgatggattattttgtgctgattaattagtctaattgttcgacgttgtgcaacgtttctggataacttttcagtatacgaacacttcaaatgatcagacctctcaataatttgcagccaaccaaacgggtccaacttcatcttaaagaccctatcctatgttgtttgtggtctgtttataggaagtcggagctgctcttgagagcttggtttgtttataggaagtcggagctgctcttggtagcttggcaacgatgacctttgttttatcctccagttgtaccgtcgcaagtttttagttttttctccgtgtgggttttgctcggtttcccccttcaaaccgtgcttaagtgagttttttgggtccggtttcccttaaaaaactgggccaagtctcttattcttaattgaaaacaggctctccctatcctcttttgaggtttttccaaaaaaaaacaattgtcggtgacacataaatttggagatatgaaaacaaagtgcacgaatggtaattaacacacgtagattttgagatatcaatgtaaacttttttttaagaaaaaaagaggaacaactacagatgacacaaatacatttggggatgtgaacgtaaactgaaaaaagaaatagcacaaacatggtgagaaaagttaggaaaattgacaacca

SEQ ID NO: 1958 - DNA, 2000 bp, Oryza sativa
  misc_feature (1781)..(1781): n = any nucleotide
actcagtgtcggccaactgatcactgaagctctcctatggcgatccttgccacctcctgacatgcatggatgtagtttcttcctccagcttcgaacatcactgaggggatatcttcactattactgttcaaggtgactttgactcggcacttctcttcatgaagatcatgaggaatctgagcataaaaaggggcagtccccaaatccaatgacaaaggacatcgtacgtaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaaggtaagtagatcaagtaaaccaagcttgcaagataaattgaaaacagttggaaacaaggttacaaattttatacttttgaataacaggttccaaaagaaataaaagaaagttataaaatcaacttgctaaatttattttattgcagccacgtaggcgccacgtcggcgccagctcggccaagaccaggtcgagtcgaccccggtcggcccctccccgtgcgcgcgttccaccgcgagccgtgagactgcgcgtgggcccgccgcatccgttccaccgcgaaccgcgcgcgtgcaccgcgtccctcccccgcccgcgcgcgtgcgcggcgtgctcgctccgcacggtgacccatgtcaccgacaagcgggtcccacccgggaccacgcgtggttagcccggtccaccggccctctctctcctcccctcccgcgcgcgcgcttgggccaccttgggccggccggcccatttagctcggccggaccacttcgttcctctcgggccgcgtcctagccgcccaaggaaaagtctaatttccctccctgttttcttttcttttcttttctttttcaaaaaggatttaattaaatccttttcctttagaccaaaaatccaataatcttataaattcaatattttcccaaccgtaaatccgtttgactccgttcaaatcccaaaattcctcaaatcttgagatctatctaatggcacacttagaggtcattaatagggctttattttcgctgtttgttgagttgtcccgtttcgcgtgtagtttcggagcccgaagacccgcagtgcgaggatttcgaggatcaagctccagatctcgagcaaggcaagccacctttgaacatcttgagcctatatttgaatttaattatgttgcttgaaaaatattatgcattgatagggtcgcacttaatctgttgtcccgtctgcaaggcagattggcggacctacctaatttgttgcatttgatccttccttggttaattgatatatcatgtccccttgtaaccatctagttgcgtctcgataaatcgtgcactctgcacgagtatcgacggccgccttcaaacataaaatctgagtaacttcttgggtaaaacttgggttttacaaaagacttggaaaacccgacacctgggtcggtgcttgcgaactaaatgaatttctaaaaccgcggaccggggaacgtaccgggtgtacggtttcccgctcttgcacttaaggaccgtttccttggaatttcatccaaacataagacaagtacgaccacatgggtggaatgggacacccctggcagagtaactagattatcaggggagccttgatgccgagagacatgtggattcgccggggtggtgtcggggaggacccctgggcttcctggcacantatggtctaggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcaaacagtcgtgcccacggtc

SEQ ID NO: 1959 - DNA, 2000 bp, Oryza sativa
  misc_feature (451)..(451): n = any nucleotide
  misc_feature (465)..(465): n = any nucleotide
  misc_feature (583)..(583): n = any nucleotide
  misc_feature (622)..(622): n = any nucleotide
  misc_feature (634)..(634): n = any nucleotide
  misc_feature (1303)..(1303): n = any nucleotide
aaatatgaatccgcattacgtttaataacatttggatgattaattgactacattttaaataaaataaaaaattttaaaccatcataaaaattcaaatgcattgtcaatgtatgtcggtgacatgggaccgggggtatcgtgactagaggcttgggtagccgcgatcacccacgttacccgaccccctcgggggggtcgggcccgagggtgacgtggccgcccctccctctgtctccccgagggttcggccgctcccgtttcggccccgagggctggggcgccccgaccccctgtggtgttggcgccacgtgtgtgggttaggtgagcacagcggcgctcacctaaccgcatttatagcgggttagacaagcgcgccacgccgtattcaatgcggtgcagcgcatgcttatccggtccgtgaccagtcgcggtatgtgaccggtcatagacnggtcagatcgcggnttaggtggcaacaggcggcctgtcgcacgcctcgccccgtcccgtcggaatgatgagagcttcctggctctcgtctctagccggagctggcgtgctgactcctggagttggtatgtcngtcccggtcagatccattctaggcttcagcgcaagcatngcaagaaagtcnctggccattgaatgaaggttgaaacgggcgtccaccgggagagctgacgagcggagcagaaggcgtgtgctgtgcttgtcagaggtcacttccggctgtagactagccctcattgtaaaaagaatgtttcttttcttaggcagcttaaggcccatgtggtgacccctgaccagataaaaaggaggcccaggcctaggagaggagggagagagaaaaaggaggaaggggggagtgatttctagagcctgaaccctctctggctctccggctctctgtatttcttcacgcacagatccaccagaacacaggagtagggtattacgcttctcagcggcccgaacctgtctacgtcgcccgtgtcttgtgcgcttcctctctcactgacgttcctcagatcgagggcgaagaacctcacttagcgcccccggccgaaccggcaaaggggggcctgcgcggtctcccggtaaggagccccacgctccgtcaatgtatgttctggagctaacatagctcaatcattgacacacacacaaaaaaagctcttattaggttaatttaaaattataataaatgttattttctttaagaaactagtcaattctacacacaagcagataaacacagagctgcagagcacacaaaatacgagcgagtggaagctttatttcntttggatttgattacaagctacaaaaggaggtgcgaggtgctcgagggagctctatctcactttggaccttcagggtcctatttatagacggaggaagcttctggcttctactgcaagataacttacgtcgtaagccggcttctctcctaagctggctttcgacgcaagttttcttttgtagtaagctttccattcatattttaattcgtcttataataaaaataggtttcataacacttttctaatttattgacaccgtattctttctgttgttgaatgttacttgtataagacagcggtggtatttgcggtcttgcggaggcatacgagagaagggcggttagttttgcgggcaaaaactaaccgcagtccctatccacgacaagcgcagaaagcaaaactcaccccccggcccccaccctgagccttgagacgcgagcccacgggccgacgaccgcgcgcaaccacagccaccgcccacaaactccagtacacaccgcccgcatccccccccattcccctcatacccacacccgcgacgcgattcccccgcacaccgtcttcgcaatctcctttggtcggctgcccaatcctcccttcccttcctctcctcaaacccccccaacccaaatgctcccctccgctccccgtccccgcctcccaaaaccctagccctctcgccgcgcgctccccccc

SEQ ID NO: 1960 - DNA, 2000 bp, Oryza sativa
  misc_feature (1008)..(1008): n = any nucleotide
  misc_feature (1730)..(1730): n = any nucleotide
  misc_feature (1732)..(1732): n = any nucleotide
  misc_feature (1736)..(1736): n = any nucleotide
tttgcttttacttagctgctggaatcaacctgataaatttgaatacagtccatcttgtggtagtactattatagggatgataagataagaaccagacaacaaaataactctaaatgctgcattcttcatatcctactgaaacaataactctataataccagtatccgaattaattaggagtcctggtcatcttctttgctacttcccccgtttcacaatgtaagactttctagcatttcccacattcatatagatgttaatgaatctaggtatgtatatgtgtctggattcattaacatctatatgagtatagacaatgctagaaagtcttacaatatgaaacggaaactattctttaaagctgaacaatatttgtagttattctagctgctctagccgcaacagggagaaagaaaagaaatgtaatgccaaaaccacctctaattgcacgatctaaatcatcgatgccactgccactgaatagtacactatggcaagcgagattcactgattgaatagatttaaattgcacaaaatccttccgcaactcattacagttctgggttaaactgaacttacaagattaagatcgacctaagcgctactagtcacccaatttccatttcgaatcatttgatttaccatcttccatccgaatttgagtaatcttacactacagttgagcagcataaccaatcgagggccaatcaaacagaagatggggatcatgacctggtactcccactcggcggcgatggccatggcgagcgtccgcgactgcagcttgagcggccgcttcgccggcgacttgagggtgcggtagtcgagcatcaccgaccacccgttgccgtcgtcggcgcgccgcacggtggcctcccggtagaaccgcttccccaccaccgaccccgtcatgaacgacatcggcatcgccaccgacgtctcgtcccgcgtcgttaccgccgccgccgccgccggcttcttcaggtagatctcatctccccttccccngcccgcctcttccctccctcccggagaggaggacgcctccgccgccgtccccagcagccgccacctcccccccgccgccgccgcggatcgctgcaggaggaggcggcggcctgcgagtgtcgccgccatgactggtctcgctccgctgtttgggcctaagctgctgttctagtagaggcaaataagtctgtttcgtctccctcatctcttgctcctgtaaatcgtctccctcaactgcaaaaccggatatagcgccgctcccggaaggctttttttgtcttcggaaagtagtgaaaatcaactccttcgatcgttttggaagtggtttctactgacatgacagtttgaccacggtttaacttgctaagtcagtagatgggatccacgtgtcagcgactttcatgtcacctcatcttcttcatcatctctctctctttcaggctcattcggtttaaaggatttttataggattattgtaggaattcaaacattaggatttttttcctatatgcctcattcctttcattcctataaaatcctatcaaatacctaaggattatagccttacaagcttattccatatgattcttattatcatgagataagacctcttagaaaaattcctaagaaataagatgcatctaacatcctaattctttaccttccctgtacctttgatttgggaatcctataaaccgaattagccttccatctgtcccccncnctcnctctctcatcaggctcaataactaggcccatccgcaaaatcggcccgatgtttgaggcccaactaggcccagagaaggttcgagacgcgtggagcagcttcgtctccgcggcgacctaaaatcgcgaggactacgaccaaatcacgcaccttcgctctcttttccattgcagagccctcacgcttccgcaaccaccaccgcgtccgtgatcccatccacctccatcgccgccgccgccgcgtatgcgccgccggtgaccgggat

SEQ ID NO: 1961 - DNA, 823 bp, Oryza sativa
  misc_feature (1)..(1): n = any nucleotide
  misc_feature (26)..(26): n = any nucleotide
  misc_feature (30)..(31): n = any nucleotide
  misc_feature (35)..(35): n = any nucleotide
  misc_feature (50)..(50): n = any nucleotide
  misc_feature (62)..(62): n = any nucleotide
  misc_feature (68)..(68): n = any nucleotide
  misc_feature (71)..(71): n = any nucleotide
  misc_feature (73)..(73): n = any nucleotide
  misc_feature (84)..(84): n = any nucleotide
  misc_feature (103)..(103): n = any nucleotide
  misc_feature (106)..(106): n = any nucleotide
  misc_feature (111)..(111): n = any nucleotide
  misc_feature (119)..(119): n = any nucleotide
  misc_feature (122)..(122): n = any nucleotide
  misc_feature (124)..(125): n = any nucleotide
  misc_feature (127)..(127): n = any nucleotide
  misc_feature (134)..(134): n = any nucleotide
  misc_feature (154)..(154): n = any nucleotide
  misc_feature (166)..(166): n = any nucleotide
  misc_feature (172)..(172): n = any nucleotide
ntgactttgaaagtttgccaaggagntggnngacnatatatattttcaantgcaatgttcanaaaggnttngnaaaatttgggnaattttgggggccccccgntangacantatttttnccncnnantttttcncgaaaatttgggaaaaattngtttaaattcanctaaantttgtttaaaatttcagacccaaaggtttaatcttgtgtataatacatgcccacgcattcgcgcgggctaccctcctagttagtatataatgaggaatactcgacctgatgagatgcatatgctgtgcatagtttggtccaaggtggacgaccacctttggagcaaagagagagcacaacaacacgatgccttcgtacggccgacctagctacccaagaaaaacaagcccggataccataaaagcagagtgtggttgagctgcctgaacaagtaccgtgtggttgatcctcctcctctcccccccataataaactaaccatctctattcttcttctgcaccaccatcgccagcagcaatttccctttctttttcctttccttcctttgctcttttctttgcttgcgagttgcgacagtgacggagagagagagagagagtactgtagcaaagagaatcggtgagagagtgagagcggcaaagacaaaaggcggcgagggcgaaacccccaagaatcaaggcaagaggggaagctttgcatttgcccggccgactctcttcttggttcttggttgtggcgtcggcgtctccgtgttgtttgggctggccaccgttgctcgccgttcttgggggcaggcaaacggcaccggcg

SEQ ID NO: 1962 - DNA, 1764 bp, Oryza sativa
  misc_feature (7)..(7): n = any nucleotide
cctacanttattcccattttcctgttgaattggggtatgccattgtatctttggctacaaatagaagttactgataaggccagattcaatagtgcgttcttttaaattgatactgacagatacacacttgatataataatgcttatttgtgatgcataagaacatatatgcctgcacttgaccttattcgataaggtcaggcaaccaaacatgccctttctaagtttgtctttctgtgatctttctcagtattttatagttgaaattatctttagcagaactgaggccacctctacacttgaactgagcagaatttataagagtacatgaacagatttttctacacttgttcttttttcttgctgttaggctgggaaagatggccaatgatgatatatgctgctgtttgtgattcatgtgaatagatttttgctctacacttgttctcattttcttgcggtttcttttttcctacacttggtcttattttccttttccttataccttttcttttgctacatttgatagatactactggtaagaacagataccaatgatagtagctaattcacattcttcatatatctgaggccattgttctgcatttatttacctgttggaaatgaggctcaatgatgtcaaatttctgcacatatttgctacattttcgagttattgatgtcaggcaaatactatcaagttccttgttcatcttttgatatcaacagatgtactcactttttttaggtaaccacacttgattttgacatgatcaagtttttatatgaaaccgatacactctgcacttgctcttttggtaaagatcatactactattaagtgttgatgctcttgcaacctggatctctgcaactcagatcctgtactatttcaaaggtacatgttatcctgtttacttttactatgtttcaggaaaatgtgataatggaaaaacttgtgagatcaagtgtagatatactaaggttgatgagtttgaagaacatagctgaaacagatggtttagttttgtatgcggttactaatttgtttatcaaattggttactgtaaaaaatttgccatgagcacgtatatttgtatgtttgtttttgaattgtcaaatgtaccagtgtcgtcaataaaattatgtacatgatttttgctagaataatcactcttgcgtgttcatccaggccatttcgttacatttgataaaaaaaatgatcatcagtgctgctcattggttttaaaaaatgacaacatcagtaaagcatacatacccagtacatcgattctctaagagaaaaatgagcttaggaatattagtaggtgggcacagacccagagtaacataatttaatctatatatctacgatggattaaacttatcacacataaatagattagggactaggaaaaaatctcgtttcacaaactttatggggtaacctaaccacccacaagaataggtatttacacataagatgtatccatccaaccaaacaacatctcctgcatgctaccattccatccgccccttgctgcaaccaaccaaacagcatctcatcatatccaggttcatctcatccaagcaaccaaacacctacatgtgtatcctctaaaccaggctaaacttagcctggatgagggagatgggccaggctagagggatacgagcaaccaaacagacccttactgcataatcttcaccttctgtaaaccctctcactgagcaattggatatagggagtaagtggaaatggatgc

SEQ ID NO: 1963 - DNA, 2000 bp, Oryza sativa
  misc_feature (840)..(840): n = any nucleotide
ttgccccagaccgagctcaaggatggggatatagttgaagtgaggatgtagctgatgcgccatatctcctctgcccagggttattgataaaattggtttgaggttcaatcaactatgtagggtacattacctgaaaatcaacgaccctagggtcgtaacagactgaagattaagaaaacgtagaaaaccaacagcccaatacctcaattgtacagtccatttgtcgataagaatccaaggatgcgggatttatgtacaggaagtgctatatctgtacataaagctaccaactgtatgtatccttgtttatggttaaaatgtaaatttctgtaagtaaagttgtagtaatattagtcagtagttgacagttttctaggagctgcaattgttctgtacataatggtgaaccgttctatggcttgatcaccttggtactgagctagtgattgatgaacatggagtgagatatgcgcttggtctgtaaattacaaatcagtatgaatatttggacttccgatgataatatttttgcatattaaaaaactaaatttttagcactatgggagatgatgtctaaaactgactttttttccccaaacactagcctagagcccgtgcgttgcaacggaaaaaaacaaattgagtttctaccttattaaatcaattaataaacatttatattagtttaaccagtgttatgatttttcttattaaataaataggtgattttgaaatttggaaaaaccaatagttaaataggggaagacttgtcaaaagttggtgtaatagtatagattgtgaggtctaagtaaggtggaaatagataccaccattactaanattttaaatagtactttttttttcttaaaatataagtatttttagctataaatctggacaacagtatgtccaggtttatagtttaaagttactatatttttggaacggaggtggtagcagtatttagtatagataagtactattggtggtagtagggaaaaaaaagaaaacaaaatgttaccgctagtagttttttttgttgcccgccaatcaattctcagttcacagatggaccaatttcacaactgctaagatcgatgtggtccaaataattatccaatttaccaaatcatcaactactagtactccatccgttttacactatactccctccgtcccataatataaggggattttgagttttttttacgtttgaccactcgttttattcaattttttttaaattattatttattttatttgtgacttactttattatctatattactttaagcacaactttccgtttttaaaattgcaaaaaaaatttaaataagatgagcggtcaaacgttaaaagcaaaaacctaaaatcccttatattgtaggacggagagagtaagtcattttagcatttttcacattcatactcatgttatgtctagattcattaacatgagtataaatgtggaaaatacttatgaaacggaggaagtaataacaaacatggaagcgattattcacgatgttctaggaggaaaaacttcaaaacatgcatccgctcgcctctccaaaaattaatcgcctttccaaatttccatgggagagccgagaccgtcgtattcaactcctttgctaagcgtctccgggccccacatgcagtgacaccgcgagcgccgcaagtagtaacaaaacacaagcacagctaatccagattggcgaattgaacggcttgcatgacacgccccgcgtttccttccactcctgcgacgccgccacgtctcccccctttcacaggcagcgttcaaactttcgaaaatgagaaaaaaccctaggcgagccccgctcccaacggtcacatctctcgaatcccctcctatataaacccctccgccgcccaccccacctccgcatctcagctcagtacttgatccaccacccacaaatccgccgcgcccaaatcaggaggaggaggtaagaggagaggtaggtgccgagaag

SEQ ID NO: 1964 - DNA, 2000 bp, Oryza sativa
  misc_feature (474)..(474): n = any nucleotide
gtggcgtgtacagtgaaggcctcaaatcatggagcataatgtctaatgtatggtccagtttatgtcgattggagtcattgtcgtgcaccgtagatgatagtagattcatagtatggagagtaatgtatttcttagattaatatttagatgaagcattgtacttctagtcttaaaatataacaatttaaacaaagagtttatctaaatttgtagtactcgattcgattgtgttcagttcagtactatattaatatattttagaatggaagaagtagtactgtactctctccatcttaaaatataaaaacataggactaaacgagacatttctgtttaggttcatagtattaaaaaatgtatgtttcatccccgtcatatgttcttatattttgggacggatggagtattttgcttgagtaccggtatgatgatgatatcattgtatctgtacgggtaggagccaatagtctgganccccacccattctctgtcctccacggtagttgcatgagatcaggatggctagcgacttcagattaaggggttgtttggaagataatctagttctaaaaaaagggagagagaagacaattaatctcacttttctacaaaagtttatataattatatgtgatttgttggtcacacttgtaataagttgtggtaaaatgagctttttacgagtgtacttgatatatcttaaaacgtatagcatacgataattatggcacgaactaaacaccagggctaagctggtcaaatcttaaacaccagtgttgcactcaaccaaacataacaatggcctacacaatatcctagtggccctgccaaatgttacacaaaccaacaacaatactgcacttttctagttactgttagcgcgacaatgaaattgagcttaattagatgagatttttatgatgaaattatgcggcatatggctaccggcaattaataaaccggactttctttcaggcagcagcccatgaagaacatgagagtttgaagtcctgtggaactagtcctgtagaccactgtgaactgtggctgataccatgtggccttcacggccgcaaccagtattgattctgactggaataagttcacttaccatccctgaattttacatcgagtttgcatgacatcctaatctctaatatcagaaatctttactcctcatgtaattaaaaccatgcaaacctacttctctcctgcctcgccccatcggctggcctgcgagacgagaaaaagtgagagagagaaagggagagagagggggtgatgatggcatcctgattcctgatatatgggctccacgtgggtcccatgctgactcagccgccacgtcggataaaaccggggtcaaaaccatcaaaggacctaaagtggacggttttttaagttgagggatatcatatatttggttttgtggttgggagactgtcgacgggtggtaccgcgactaagttatttagatggtatggggattgtcgatactagggtatatgtgagattgaggtaaaagagatggagacatagatttttatacaggttagggccccttatttgacaggtaatagccctatatcctgttagccgaagccggtgttctcttatccatccatctagatcacacaagtataataagagatcagagattgtgctagatctctcttgccggcttttcataggcacgggatggggtatgtctaggctaatctctatcatctatcgatatttggcggcgtgggtcttgttggtcttgtggcttatcccatattaagacttggtaaatggtggattccgccgagcttaaccgattactgctgggtatgacagtgacgattttgtaactcgatgataagttgagggactttcggtgtactttttcctatatatatcgagcctcggagaactcccataaccctaccgtgcgccgccggtcgttgtactttgccaaccgaaagtcgtccgtcggcgctgctccacctcatcacacga

SEQ ID NO: 1965 - DNA, 2000 bp, Oryza sativa
  misc_feature (511)..(511): n = any nucleotide
  misc_feature (518)..(519): n = any nucleotide
  misc_feature (526)..(526): n = any nucleotide
  misc_feature (623)..(623): n = any nucleotide
  misc_feature (740)..(742): n = any nucleotide
  misc_feature (763)..(763): n = any nucleotide
  misc_feature (1454)..(1454): n = any nucleotide
gagctgcaacacttggaggtagagagcttctgctagtgctctgttgggtgcccacatcaccctacaagatgaaggtgtctttgatacctggttcagcagtcgagggatatgaataaagatcgatataagtctactttgactcccttaaaaagtgacccgaatctaatccatgaccctaaactgcaaaaccagatatctcgaccccaaactattgaaaccggtgcaatttaactcccttggtggttttggagggcggtttcgctgacgtgtcgctgacgtggcggtgttgacctagtctatggggttgacatggcgcttaggtggcatttaaattaaaaacatatatgtgggacctgtttgtcattcacacacatacaaaattgtggggcccactgacatgtggccccacatgtcatcctctctctctttcttcttcctcccctcctcctcccttctctatttctttctctctctccccttcggccggctgcggggagcacggctgcatcgncgccggnnggcgggngggggctagagtggtggcggccggcggaaagctgaagcggcggcggcgggctggaggttccagatggcaacaggcagctcatgccggcaagagcggnagaggcggcagtgccgacgtcgacgcgacgagatcgagcggggaaatgcggtcgacggcacgacactaagcgcccgaaccccagtctcactccacggcacggcactcacggggaacnnncttcctgctccctccgccgcntcccgccgtccgtgataacaagatccggcgctctggcctctccgccgattgcaacaacaagatccgggcatctggcgtatgcgacaggctcacgacatggccaacatcgagcctgtcaagctggttaggggcgagggccaccatcgagctacaccatttagcattgcaacgacgacatcgtcaagtcattgctcgagctcgctgcgtggccgtcaactcccgtgccagccccatcatcaccaccaactcatcccccgttgcgtctccttcaactagtgctgctaaggccacaagcatcacaaaatccagaaataaaattgattcatttagcaactaaccagagataaaattgattgttagtaggtcgttcactatccactgaagaataggatgagtaggcagaggggagtacaccctcccggggatactcgtgcttgcgtcgagcggcactgacccggacatcacgtcggcgatgagctggctcaggtcgctggtgaagcaatcggtctgcagggcgagcgccatccgtcggcgctcccaccgccgccgccgcttcaacttccgccgctctggcccccacccgccgccgctccagcccgtgctcctccggtggcccggccagctaaaggggagagaaagagagaggagaggaagaggggaggaagaagaaagagagaggatgacaaggggntcccacatgtcagtgggccccacattttttaatgtgtgaatgacaaacggttcccacatatacatttttaattcaaatgtcacctaagtgacacgtcaacccacagactaggtcaataccgccacgtcaccgaaaccaccctccaaaactgccaagggagtcaaattgcaccggtttcgataattcgggggtcgagatatccggttttagggtttagggtcatggattagattcggctcactattaagggagtcaaagtggacttattccataaagatcctacaactagtaaagggagcgaaagtgaacttatttcctagacacggatgatgggtatcggtgacaagatgggccggaatgcaattctccgccgatgagccgcgactagctgggccggcccaccgcgttcttgcgcgggcgaggcacgcgtccgaatgctcgcccaatccaccactcgtcgccctccgcttcgcttctgctccccccccaaaaccctatgcagaggaggacgaagtgagccccggccaccgcccgccgccgccgccg

SEQ ID NO: 1966 - DNA, 2000 bp, Oryza sativa
ggaagccctgggccgaaagcaaatttaactaaatcctgtcaattttaatgcttataatgttaagaaatttgtttataagccttcttagccaaataaagttgatgaaaaattattttagcctctaaatgaaattatttcaaaaccagatatcggctttaatggcttcatctcaagtcagagaattaattttcgtaattgaaaggtgattatttatatgctaaaagaataagatcttgaattagaactccaacattgtggtattagagcttaactttagcctactcaattccttattcacatcatccatgtgattagaagccatcggtgccatcttggttcgacatgaacaatttcgagtcaaataagcctaatctaatctgtttagcttcttatctttattgcttagtgaagattagctcatattcatgttcaattaaagttaataagattgaattagggttcatgatgcactgcattgaatataagacagtttagctgagtattaagttgtggatgagaagtactcaggaaactaacccaaatggctttgctactatacattccagtgaaaaaagatgagctgtgtacatatgtgtgaagataccttttgtggtttggtgaaaagggtggcatttgtggtgaattgctgtagtggtagtagtactactccctttgtcctattttaactgcaaccataagtttccgcgcctaactttgatcgtctatcttatttatttatttttataattatgagttgataaaacatgaataatactttatacgtaacttatgtttttaatttttttcaaataagacaggcaattaaagttgtgcacggaaaattatggctataattaaaatgagacggagggaatagttgcttgagtttggatcgttggatgaagaaatgaaattgacagcagctggtgttgaattgggatttgtatcatgtgcagttagtactatcactgcaacttagggcatcctcaatgtatgttgcaaaagtaggtagtaaggtgggcccatgtaagatggtaatagtagattgaagatgcaccacaatgtatatatgtgtagagtgggtaataaggtgggacctatctgaaaaagaaccccaaacatgagccatgtcacaattaaaaattaggtaggacccaccacaaagtgctataacctgtagcaagcttatggcttggtagtagttatttactacttccacgatgtatcttacctagtagtaagaatattttaattcctaatacccacttctcccctacattgtggatgcccttatgcagtccactgccacatgttagatccgaatctaacggttcaaatgcatccggatactgtagaacactgtaacaagaaatattcaatattcttgcgtcagtactgtagcggaagatctggtccattcatcaccaaaatgaacggctgtaatcgcatgcagtagtttaacttgcggtcgctattcctactgcaggtgatcccaatccgttgaattgatgttttgtggctgtgtggtgtcgagaaatgaaattggtatagcttaagatgtgcacttgagaatataatattagcaagccttgaaagggaaccaaactaaactgaagaggagggatggagggaaagccgacctgaaaatgaaaatgctttcagtttggctccaaaccaaaacgaagcggggatttggaaatttggatggatttgggaatttgggtgggcgcggagctcctgattcccagcgagcactgtggaccgtcggatccagcgagatggaaggctcaacggacgagatgagtggctggagtggcgccaagtaatgaatgttgtttcgcggcatccaagagaagagattgcgcgcgagcggggagcgggcaaataaaattggatttgggtcccccaattcgattcgattatataagcgcgtggcggtcgccgagtcggcggcaaaacctcaatctcctccaaatccatagccctcctcctctcctctg

SEQ ID NO: 1967 - DNA, 2000 bp, Oryza sativa
  misc_feature (1306)..(1306): n = any nucleotide
  misc_feature (1381)..(1381): n = any nucleotide
atactgcatatagtttcagttttacttcccactcgattttaacatgaggaagcattgtcttgcctgaaacaaagttttctaattacttaatcactctgtatgtacagtcagttgggccttagttttgattcaataattgatattgttctctagtggttgttttctactgaattgtccatagtaagaaatgcgaatcgctaaacagaaaaaggtattatactataggtagtcttatgataccacatctggtggacgacaacaacttgactttgcatataaataggcagtcccaggatgatctttccgcagcactccattcatttatctggttctgttatatatctctcaacgtaacctgattaagttggtggttatggagcatttcacaagaggagtggtgctcgggatgccttccatccaaagatgccattcactgtcatgtcaaatggtgatgcttctgcatattcatactcctctttgatttatagaacagaagcaggaaacgaggcatagttttggctaaggctactataaccatattcaactgaagtttttgtattacttattgtgtttagcatggttagagattctgacaaattctgagaaaggtttgattttgtcgttatcagggccaggtgcctataaatttctgcatcatgacgttgcatctctcttttaacatggttttacgccccttctgtgttgaatacttaattttgtgctgtgaccgtgataaattacttaattttcaaacaggcagagcgcccacagattgatgtgcggaaggcagtgatccagtgtaaagaggaatcacggtgctcaaaatgctgccatcctgcagatatgccgatcattcctgagcaggcaatggagttcctctctcgaacatggagcccctcatcatcagatttcttccaagtattctcactcagtttcagttccgtttaccaacgcggtgtcagcatttactaaattgtagagttactctattattatctccatatctttctatgtatcgttggttagtttgaaaatcgagattgaattagccaacgtcatttttttaaaaaaaaatggagggagtattttagagctcacatgcacaaaagtgctttcgtaagcttaatcattaagcatggagatattttaaggtttggtttttatgcacacagacccttagaacatcatctgaacaccgtcagccggagaaggcaatcaaaagacgaagagggaaatgaagaaaaagatgaagagagacatctggtcccggtcaatttcagggaggcaaaagccaattcttcaaccngacatgggtatgccagtgaatggtctcagactctcttaactcttaactctcggccaacacaggagttgccttccnatatatgttcaattcttgcttgtctaacagcgtgttctagctagtgagatgcctagccccataagcgcaagcataagctaaaagcaaccaacttgggtaaggacacgacacaagcagtataacaacaataacatggcacatccacaggatagtacaaattacacagtaactgcagtatagtatactccctctgtttcacaatgtaagactttctagcattgcccacatacatatagatgttaaagaatctaaacacatacatatgtctagatttattaacatctaaataaatgtgggcaatgctagaaagtcttgcattgtgaaacggaggaagtagttggtatcttgtcagatttgctaatgaatgctttgttttccttggatattagcaactcaacgctggctacatgaaagcaattcttcgaggtcatttcttgagtgctgtttcggtcactggacgccagcgaaagaagaggaaagaagagctcaggctgcacgcagcacaggcccgcgcggctgtctcggttgctcagctcgccgcagcaatcgcaggcattcgtgtcggtgtgcgaactgaggccggacaacctgaagtatgtcgaggctgctgacagcaaga

SEQ ID NO: 1968 - DNA, 1114 bp, Oryza sativa
  misc_feature (952)..(952): n = any nucleotide
atataccattagttccaactatatatgtaaagaactaataaattcttaaggcctaaaaacatgtagtggtggtttatggtccctcgtcaatcgtaagcccatcctcactcccacgccctctcgagcgagttctacacgcatgatgtcccttccgctgcatgaatggaagcacgcccccgacccccaccacccgatcaaaatcaatcaaccatcattccgcggcgcttgcctatggacctcctttcacgtctagctctcaacttgcatggatgtaacagcatgtgcacttgccaataaaaaaaatatcaattaaatttatagtgtactcttttttattgtacaatctacaccaagacctagaattgttggattattttcataaggccacgtgttcctccccacatacgcctcgtcgagttgtcatcttgtattcctatcaaatgtattgcatcaactgccgccaccgctcgatatccagctagctgcctaggtgtgctctaccaatttacttagcaccagccccatctcaccataaatgctaacctatgtcccctatcgagcagagccgcaaggggccagcacatgacccatctgtcaccgccatgattccatcaacatctagctgttgatggcctctctgtgacatatactatggatgctacacggtgcccctctatgtgcctggccatcactcccgaccgttagctctaccacccctctgttttccgttagcatcttcacccctaatattttcgtgtcttggtccatatcctccataaacgaaacatcacaaatttttattattcgcaatttaaaaataagtagagaaaacatgggaatgcatagctaccttttgagaggtctgcatgtcctgcaccagtgaaacaatcggaactaccaagtttgcactatttataggaattgtattgagttgctcgacgaaaagccggcnaacgatctctatgcgcaccggtgcatccatgcctggttttctttgccccctgccaccataaatacacacccagctgcaatatggatcaccaaacacctcgatccatccctctacccttcaagaaacaagaaagacaacaccaacaaactagctagctcacca

SEQ ID NO: 1969 - DNA, 1354 bp, Oryza sativa
  misc_feature (698)..(698): n = any nucleotide
  misc_feature (705)..(705): n = any nucleotide
ggaggagaggaggaaggggaggagttggagaagagagttagagaggatagatttgaggagaggtgtgagattcgatctgtctaagttgtaactgtggaggagagaataaggtatagggattatatactacgtgtttaattttagtcccgattggtagttggtgatctttagtccggttatgacatcaaccgggactaaagatcctcggccctctgacatacatctgacagtggatgaaccggaactaaagatcatcttttgtccctaaagatcaaaatttttataaccgggactaaaaataatctttagtcccggttcttcttggatgtggaactatcgtggattttgccggaccgaccaaagatgatttctctaccagtgagtagctcagaattactatatataccttaatttatatgatgttcacaccttttcttttacaaaataggataattaaacctaacctctacgtccaaccgatgtacacagccaatgcgatgttcacataactactagtagtaattatttatgctggcgtgcagttgtcttcttctgttctttggtcatatagtagtttatgctgtgtattccatagttaattactgtacgtatatatatatctgaccagcaacctcctgccgcaagccctggcctgtcaattgacgcaacgacatgtatcattctccacgtacgcatgnctctctngcgtgttatcgaaaaagggctaggtttagtgaagaaacattgcgtgctttcgcgcacctgggtgttatttattcatatcactgtagatcattccatgggtcttaaacatatgatgctacacatggcgaatactaattttccgtggccacgaagcgctcaatattcgccatgtgagccatccatgtcaaccattgcaaaagtttgcagctgaactggacctggttctactggtcccaatttatgatggcccattagtcacccaacttaggtacagcccaaagaccatagcccatgaaagcctccgcattgactcctcggcccctattgcgtcactgggcgtcgcctcccctttctcgatcacccgcgtattattatccccttattaatagccgcaacccccagtaatctcccactgacattacgggcccacaagtacgcgtccccaccagccatagactgctcctagacccgtcgcaccgaagctcccctgccaaatctacgcacgcgacgcggccatctctctcccttctcccccaacctccattagccgatccaaaccacctcaaagccccggaccgcatcactctccttctccccccccacgcccagatccagatccacccggcgcggcggcggatccgtcgaggaa

SEQ ID NO: 1970 - DNA, 104 bp, Oryza sativa
  misc_feature (11)..(11): n = any nucleotide
  misc_feature (79)..(79): n = any nucleotide
attcttccccntcacctcgccgcctcctccccttctcccggccgccgacgaggtccagaccgtggagcctgccgcggcngccgcggcggcggcggcggcggtcg

SEQ ID NO: 1971 - DNA, 2000 bp, Oryza sativa
  misc_feature (1817)..(1817): n = any nucleotide
  misc_feature (1940)..(1940): n = any nucleotide
gtcccatacaaaactaccaaccgaaatccatttcattctcgcccctcgtgagatcgcggcgttatgctcgcttccacgccctgcgatcgcagtatcacactcaccactcagcgatgttgctcctctccgatcgacaggtcttgcagctccaaacatgggatttagcaaacaacatcagctccagtcagtagtaaaaaaatgtttatgagaatcctaaacagaaattgagatgtgaaaataataatctctccaagagattaggtaaatttgacttcctaaaaataaaaggtggggcccatacaaaactaccaaccgaaatccgtttcattctcgcctctcgcaagatcgcggcgtcacactcgcttgcacgacctgcgatcgcagtatcacgctcaccactcggcgttgtcgctcctctccgatcgacaggtcttgcagctccagacatgtgatttagcaacaataatcaactctagttagtagcaatcaacaccaaccagcaagcagcaatacattagtagctccagaaatttgttagcaactctacagtcagcagcataagcaccaacagcagatccggtacaacatatgggcacctatcaatacttgagcaacaatacaatgtcaaaaaataaaacatacaatttgcatgtcaagcactatctatttattcctagcattcttgttagacaaaaatggtgcgattttagcagcaactttagcagcagcaaggccatttaacaattttagcatcagtagcaacacatctagcacatagcagaggacatcagttttcagtctgcatcagtttttagcaagcatcagtttttagtttgcaaatgcattagcaagcataagagaatcgtcacgccgcgcgtgtgcaccgtgacagcgtgctccgccgttgacgttggcatttttttactcagaacagaactagaaacagtagcaacagcaggatgaagtactattttccctcaacacatagcaacagcaaaaacaacaacatattggtcatgcgttgttgcatcgacgcagaccgacgggagtggatgtgtgaatcaggcgccggtcaaatgtgtgaatgggagagccacaaaagactctgccgattatgggagagatgcgtccggtggcagggtagctagaggcgatgatgacggacaacctcgcgacgaagttgcaggctggaaaatttcaacgagggcgcgggaactgccacaagcgctcgcgagaggtggattgggagtgagagcgcttctttattcgtggagaacgagaaacctggagatgggaatctgattttgggttttctgcttagggtcactgttggattgatttttttcaacaaaacctcaaaaattattggatatggatttgttttgggtgctcttcgcatgctctaagagaggagagagagaaatgagctaacatgaaaagagatgacacttttgtcattttctcacataagacgttggtgttaaaaaaatcttgatgataataacatcatggtttgaattttagagtaattcaatagccaaatatcaggtttcatgaatatttttcataggaccgatccaatttacctaaaataatcatctaacaatgcacatttacgaaaatctctctctttccatcctgcgtcgcctcctatcttctattgagagaagtagtagcagaaaccgcctatccgacgccaaaaacacgagcacagatccaacgggccaaggtttttttgcgcttgcgaaagctaaaaacgaagcggaaggcctccactctgctcctctccctccgcacccccaaacaaaccaaaaagnaaaaaaaatgaagggttccggctaaaccctccctttcaaatctcccccacgactcccatttccaccccccctcgccgccgccgccatcgccgccgccgcggcttcctccaccaccattccaantcccattccccggggcccccaaaccaaaaccctaaaacccccccgggggggcggcgccag

SEQ ID NO: 1972 - DNA, 2000 bp, Oryza sativa
gaattagtgacgaagagcaccttgagacagtaataagcacagattccaactggtgggcaaagcagtggacatagaaagcatacggattttcattatgtatcagtagctgcatgtcgttaaattcacatctcatgtttgaagctccatcatacccctgtcctcgtagtttagaaatagataagccatgctgagcaagcagaccaaccaatgtttccttgaatgcagcaggtgtatcctctgtgagatattcaagaccaagaaatctttctataaccttccctttcttattcacaaacctgcaaaccacaaattagaatatgttaaggtggctcaacaatgaaatggtagttgctttcaagtagagaacatataaacaacttaccttacaaaaactgccatttgatatttctctgccatatcgtgagaatcatcaataagtatggtgaaattaccatctccaatctctccaattatcacttctgtgacctcttgtgcacaagcttttgcaagacccttttgaatcaatggagaagttatgtcaatatttccaacgacgttcatatcaaaagccctttcaacctctttatccctcttcttgtacaaatctattaactctagaagattgcccttgtttatggaggttggtgattgaccaggaccactgaaggccatgccttgcattaggagaaatcttgcacaatctaaagaagcaatgaaacaaattctatatgcacttccaatgtctggatggttagaagagagctcatgagacttgctttgatagccaaaatcctcaagacctttccttcccttactgtgatcactggtacctccaccaaccttgtctttggtttccccatgatacccatcaattgatctgtgtcgattcaaatcagaagttgtggcatctggattaaacttcttggtaacattagcccttttcttcagccctgtaggtgtgcccgcaccacattcaagagtcctctttggcacaggctgataatacctcctcattacttaaaggttaaaactaacctgagaaacatatacattatcaaaaattaatatatcaaacacagtaacacagatccacctaagatttacccccacaacaatatcataatttcgcacataacatgctcaaatgttaattcagaattgccacaactcacaggtcctccaatgcttacaatccagaagtgacaactaacgagatttgaacaggagtataatacctcctcatttcttaaaagttaaaccctgagaaacatgttacattatcaacaattaataaataaaaaaattccacctaagattaagccacaataataccataatctctctcataacaagttcaaatgctaatccataattcctagttgctacaatgctacaacaaacaggtccccgaatgcttacaatctgaaaactacaattcacgagagctgaatgggagtacaagtagaggactcagtaccaaaatccctcgccccactccgccggcgcaccggcactcgctgctgcccctccagctccagcctccgcaacccaccgacgtcccgacgcctccgccggggaatcgagcctccgggagacttctcagggcggaggcggagcagtcgccccacgccgccgcttcccctcccccaaaatgcgtaatcaccgaattgccactgccggctagggttttcccgccgaaatggagaaaaccccattgccgaatggaccacgcggccttttaactcctcgaaggccttcttgggccgctttccgggccgcgggcctccaccacccgtattcccgtggggtctagatccatcccggcattccgaacaacggttgcgaatcctttccgggcggaaagaaaaacagagcttgtcagacagatccgacccgaacaccatccgcttcgccgccgcatcaattcggcgagaggcgcattcgaatctggaaagcaccaaaccctagcttcaccaccaccacgaccaccaccatctccc

SEQ ID NO: 1973 - DNA, 2000 bp, Oryza sativa
  misc_feature (85)..(85): n = any nucleotide
  misc_feature (1648)..(1648): n = any nucleotide
ttctcctcctctttttgcctcaatctcgcctctgccatggccgccttcccctcaagctcctcaaccaacgttgttgttttgtccnttgcttcttcttcctcctgggaatccaagccatactgataacttgatttgcacttattattatgattaattcatcatataattcaaatgatggaaccttgagatgtgatgatgaccacggttgcagtgtccatggccctgagaattcgacaatgacatgcctttgtggccgcgatgaatgtcgtcggcatcgtggggtcggccgcatgggaagaggtggcaatggcaatgagtcgaggacattgtcatcgattaacacattgtcgcctcctcctcctcctccttctcctgatgatctccccatcatcggattcaacatcacctgcaaggagcttagagccaatgtcgctatgattgacgggctctctaaaggatcccaaggccggcgacccctatgacatggagtatgaacgattgatagattattgtattagcatcaagaatcagagacatgcgatcaagcattgcatgatcgttggataaagaaagctagaaaaaaatgtagatgcatgcatgtattgatgaattctatgaggcgaatggggaatggcatgtgggatgatagcaccatggatgtaggatcttcggagagattagaaaaagtataaaactctaaattaaccatatggcccctaaagatagtgctattagtttgttaattttagagttttttttcttcttcttcttcacttctctttccattacctttttaaaataggcagttaaagtaagattaagaatccactagaaacaatactgaccagaaaaacatcatactctatttagcatcacagtaatagattttatgtctcgtgatttggatatttagtccaaatataaagcagaggtgagactttgatggcaaaaggtgctactccacgagcaaaggtggaaaaagattgatgctccatgagtatggtattttgacaagattacaaatttttgttgatgtcggtgagcggtaaaatacacaccaatacaatcacttgataatattcaacatggaaaatggtttaccttatctagtgggttgtttttttttaaaaaataatggattacattgttgcacggattattgtgaaatttcgtcaaaaagggtatttctattggcaaatcgtgacaaaaagtatattttttaaaaaaacattttcctcccagtgaaactcaaaataggtggagtatgtattgtttcgagaaattggacattccaccaccgccaaaagagggttttgctcaaatgccactccgcggattggattcgttaaaaagtcacttccaaccaatgccaaaccattgtttttccatattcgtcattttacaggatttctacctttttcggacttgacttgcccaaaataccccttcgttcagttaaacaagatgagatggacgcgcccagcgggccattggtaacgaccacagggaggaggaaggagggcgggttggatgcggcagatgcgacgggttgtgcaccagttgttgtcatagaacggtctctccgagctcgtcttcggcaagagcggcgcgtcatcggcggggacgacatcggccgccgcgacggggncggggagagctcaggtcttcagccgtctccttcaacaacaataaacggacgacaagtttagttcatgtaggcaggagatggagatggcaaaggagtaaccgacgataatcaaagggatattttgatcaggtcaactgcagaaaataatagaaatattgtgaaatgacgaatatgacaaaagaaacggtttgatatcaatttggagtgacactttaacaaatccaatccaaacagtgatcgaacgtccaatttcttctattgtttctgcgggtaaagctgaaactccccaaagcaccagttcgtcttccgtcgaaaagggaaacggaccgcctcctcaccggcggcggcctcc

SEQ ID NO: 1974 - DNA, 2000 bp, Oryza sativa
  misc_feature (625)..(625): n = any nucleotide
  misc_feature (1588)..(1588): n = any nucleotide
  misc_feature (1698)..(1698): n = any nucleotide
  misc_feature (1731)..(1731): n = any nucleotide
  misc_feature (1734)..(1734): n = any nucleotide
  misc_feature (1794)..(1794): n = any nucleotide
  misc_feature (1862)..(1862): n = any nucleotide
  misc_feature (1997)..(1997): n = any nucleotide
gggtagtaagttctagggagttattatgagtagctgcactcgtaaattatacaatatggagtagtagtaaactagtaatgtagtatggctcagctagcatttggcttacatgttctattgtttcaactaataaaattatgtcatcagctagcccctgctcattgctttatcttgtcagctgacacattcttaattcacttgacatgcagcttggcctgcaccacattataaggagggacatattgatatatccaggctatgttcctgtacctgaagtacattacaaggttttccattacgggctgagatttggtgttggtaattggagctttgacaaggctgactggagaaatgttgatgtggtaaacacgtgctgggccaagttccctgaaccacctgacccaactactgtcatgaaagaagatcaagctgcacgggagagggatcttctcagcatcgcgtgtgggagggctttgaacaaagctctatattggcaccacaagagcagagattgccctcgaccaagcccagttgatggtgcctctaagaaattccagaaagtcacagcctccaacgatttaggaggaggaaacacggagcagtcattcatacataacattaagcnaaaatcccacattgatgtggctaagctgaagcctatcgaaagagttgcagccactatatcatctgtacatagagcaaggaggctagctagatcttcaaggatctggataattgctgtctgggcagcatcagttgcagtgttcttattggtgatctccatgtttttcactgatcgaaggagaagtgtttcgagatcgaggatttccagaagccagaaggcccacgtctgactacaaaataaacaacattgcgatcatgaaatgtattcctctgccaatacagtacataaaggggtagagtttgggagctctagaggctgacaacacatctgtaattgaagccatcagaattagctttggagacatgtagagttgcatgttcacttttttttttgacaagtttgtgttcgtagatagcaaattttgctaccattggtgttgtatttgatttatttagtgttcttaacatgatgtaaacaattatatgttgcagttctctttgatagaaacaatcatatgctgtttttatggagagattcagtgatatatgtgattgaccaaacatacaggtacagtaatttgattttttacggaatagaattttattacttaggtcttgtttggtacaactctagatccatgatggattcaaaagtttgtatgttaaattatactacatccgtttcaggttataagatgttttgactttagtcaaagtcaaactactctaactttgactaactctatagaaaaatgtagtaatatttacaacaccaacatagtttcattaaatctataattgaataagttttcataatatattagtcttgaattaaaaatattactactttcttttacaaaattagtcagatttagaataatttgactttgacaaaagtcaaaacgtcttacaacctgaaacggagggagtagcagtttaaaatttatattttatttaaaacagnaataaatgatttatctaaatgttattaatgaaatcgtagattcatatctttggatttgtggagttagaagtactcagttaaatcttggatctggagctgtgctaaataangccatgtcaagatatgctgattttttttttgcntgnaaaaaaaaaaattccggtttgcgtaaagggtatcacctagtaacaggctaaatggctaanacgcggcccatgggaaaaaagtcccctaagataatcatacagcccactagtatattagacaccacctnactcgactcgaccgcggccgcggcatttcgaattcccaaccccgaaaatccccaggccccgaaaatttttcgcgcccaaacccaccaaaccctagacccaacttccggccggcgaaagccgccgccggcggccgncga

SEQ ID NO: 1975 - DNA, 2000 bp, Oryza sativa
  misc_feature (1850)..(1850): n = any nucleotide
tgaaattgctgtgatacataattcagtagcaaaactgatattccaattacaagatagagttgaagtcagtagatgccaggtattatctggcttatttgatctattaattagttttctgtgatgtttctgtatacgacagatctttccatctggtagctataactttttcagaatggacacgaggacttgaggagcattttttctgttctgttttatgacgtgttcatgccttacttccatctcccatgcagatagcgaagaacattacaacaaacgagatggcaaattccatgagatacagttatctaagaggtccaggtggaagattcagaaacccatttgaccatggagcgcgcaagaactgctcagaattcttgttaaatggatacaatgaggacattgaacgtcttgatcatacgtcacacactgatgaggaaatgggaatgatacagatgacaaacgcagtcttctcagaatggcgagggcccttcccaccatggtaacggcactggccattcttgtgctgaatcacatgctcactcaaaatctcacagtcaagtaagttcatctcagtgttgtgaccacagtaagaagaccgatagaacaccattgggcctagggctgggccttggacgaaacagtgcttcccggcagtatgtccggtctcttctcccattgtgatttgttatatgcagatcatgtgtgtgctctctgtagattgtatgtgttcatgctgaggctccattatttatttagctgcttgtgacataccacataggtttcgctagcttacgttaatattgttggggtgctagctgtgtgaaaattcagatctattagatccagtattttttgtggtgaatacataggagatgaaggtagcaaggtgctcatgaatatccgctgatccgcagttcagaaatgtcttgtcgctcctgaaaagagggcaacaattttgtgcagatgcagcagcatgaaacatcttcattgctgtgtcccttggtgtcaatataactccagcattttagcttctggatcttacatctgtgggaaaatgtagttgtaaactaagataattgtaaatttattagcaaattctgaatttagatactcttgttgtgatctatagctgtactgacagtccagaaagttgtaataacaaaacaaatatctgaactcttgacgtgttatgaactctcgtaggacctacgaatggatgatgcatccgttcgaaaatataggtacttgtgcatggtttttaaatgtatacggacgatatgcatatttttggaacagagagagtaatagttttttttttccagttattccccatttaacgtatctggcactggcagtacgacattgcttgcagcttgtatctgagtatctcgagttaatcactttttagcccatgaacattcagttcaggagtgaggagtatggtacctcatgatttttaagagaaggatggccttgtcggcttgtccccaccagtggatggctggctgtggccggagaggaccaaagaagtttgcaactcttccctgcttccatgttaccgacacttataaataaattcttaaatttaaaatacacaagaatttcaagttcatgcagaattttccctgtattgaaaactgaaatatctctgcctatctaatctaaaactgaaaaacaaataaaaagaaagaaactttagaactcgcaacttgggctcggtccagctccagcctccaggacccagatgccctcgtggtccagatcacccggcccggcccatcctacctcatcatcacgcaacgcaacaacactgacctacccagacagcgtccacccttccttctcccgcngccgctccaaaacccccacctctaaaaccctcgccggcggcgcacccccacccaagctgagcggccaaaccctcgacaagcatcgtcagcagcagcagccgccggagaagtaaccgccgccgccgcggtgggagagagagagagagggag

SEQ ID NO: 1976 - DNA, 2000 bp, Oryza sativa
  misc_feature (252)..(252): n = any nucleotide
  misc_feature (1722)..(1722): n = any nucleotide
tctattgccgttgagctcattcctatcggctggagctttccagtgctactgctaaagctcgttcttgatccaacgactaaggcggaggcaacgaggattggaacaagcagtaatggcgggaacaagcctcgatttccttgatcacttgatgctaccacctcgactatcatggcctagcttatgttctccttgtcatctgaggtcaccgttgaggtgttctccttgtcatctgaggtcaccaatggggaaaanagggggaagatgcaaaaacccctctttactccttaaaaagatggtttaacttcttttgaaattaaactttttattgttgtgagtcttatgactgataagctaacaagtagacgatgagagtgtaagctataatgtttgtcttgtggtcttgtacgtgatatgtttgtacacattgggtaacagaagaataattaagttcaacttggagtacttcagacctcaaatgccacattgctagatcattacttcatgcccatcgaattcatgaacaatttgatggctcgatttggttgccgggatcgatttagatgttaggacttggtacccctagtgtaaatttgaacttagggccggagggagtacttgggtatcgtagcaaagcactataacagattagacctttctattctgaaacagacatgtagagtagagtagatgaggtagcacgtttctttccttcatttccgccaagtttgatcgtgccgtttctgttcatttcaatttttcaaggatctggtactatttgaggtaattaaggacccggtgatggcatcgttttcatccatggcaatgcttttgtggaggttggtaaccaaatcttgacagagaccttgcagttcaggctttgagagtcgaaagccatggcactggaacgcatcatcggggtaattagcaagcacgtcggtccatgatgatacgttccgacgaatcattgccgacagaaaggcacgctgaactccaaaccccaacaaactttctccatgcgaccatgcctactgcatcttatgttggtccatcaatggcatggcatggcagatggcacatctagctagtagttaaatcgtccgctcgcgcagttgcgccggcggatgatacaagaagcccacgcagcaatatgctgatctgtttgccactcacgcttgaatgaatactagtagtagcagtactagtagctttgctattactgtagatctgtgcgtacagccgcagcacggtggtagcaccatagtagtagcaccgtaccggcacgacggacgagcagtgaataagctcatttatgcatccgtggtgtacccatggtttccctgtaggccacagtactacgacctatacggacgcaacgcgaaacgggcaacgacaccacgtccgcggccgtcggttgacgtgaacagcggcacgatgcgtgagcggttgacgtgaacagcggctgcggctgcgcagccagcgaattgaagagaaaaaattcctccccaaccgcgcgtcccatgccgtaccccacccttcgctgcgcctgcgccgcgcacttcctgcccacctcaacatgccggcagattggcagtgtggcaccaaaccacgtcgcgcgcgcgcgcgctgctgctcccgatcgcgttcgcgttcgcgtttcggtttgaccgcgcgtctcgcctagatttccacgggtaaggtgaaggtaaacgccgcgcgcgccangcaccaaacacccagaagaacgtggtttctggccaaccgacgtcaaggaagaaagggctcatggccgcgcggcagcaccacccgcacattaacgcacgccacccaccgccacctactcgccactcttttactcggcgcgccttgtctctctctctcagtacgaggggagtagtagtcagtagtcacagcagtagaagtagagcgccggtgccgtcgccaccgcggcgggggtaatgcatgcgctcgcactcgcactgcgcctgctcctccagctgtcg

SEQ ID NO: 1977 - DNA, 2000 bp, Oryza sativa
aggagatgatggagtcacgtgccatcccatccgtttgggatgccacggccacttaggctgactcgtgcaacaagaacaccaccaataactaaataactactccatccgtttcgaaatgtttgacgccgttgactttttatcacatatttaaccattcgtcttattaaaaaaatttaaataattattagttcttttcctatcatttgattcattgttaaatatatttttatgtaggcatataattttacatatctcataaaaaaatttgaataagacgaacggttaaacatgtgctaaaaaagtcaatggtatcaaacatttcgaaacggagggagtataataagagcaagtttaatagtatagccaactattgatccaaattatctatagctaatctaatagtcaattcatacaatagttaactataaaaatatactacaccattaatactctgtcccacctctcatacacacataacatcttggagtccgtgttgcagctggctacaaatctgcagcccactttcttctctctcttctcttttcttctcgatacgtggttatagctgatttatagcttgctattgtacctgctctaactatagtattatatataccaatatcttcatcttaaaatataataactagtaaatgtttattttacgaatataatggctatatatcgcctctactctacgggcttgttcactttgttaccatttggaaccttaccaagttttggcattgccaaaatttagtaaggttgtcaaaattttgccaagatttcatatgtacttattaaaatttagcaacaaactaaatatagctaaaattttgacaactttatcaagaaaaaatggtatagttgaaaatgacatcaaaataaacaggcactactaatagagtactagaagaagtaagtgctaccgttttccttttttttcctcttcccttgtccgcgatttcttttgtctcccagtcaaccctcttcttttcataaaaaacaatttattccgattttcacattatcattaaaaaaagcaagttttaaattgggttagtggttataacctatatcttttcactcagccaaataaacttttgcatagaatatgtatgttcaatatatcatgggaagttttaattctagtattcaaacaacgaaaagaatataagtgggtaatcttttttgccgtatataaaagtttattttttaattgatttataaaatttggaaagaaaacattgaataagttagaaaaaaatctacttatttgtccactatattattattttatgaaaaatttactcgtaaatttacacagtacacgagttgtacttgaatcggagtaaagaagttgtagcattttcttggaagcatgtcgttgaagagcatgagcgctgctcaaccaaatctccattttctaaatcaaccaagccttgacctagcttgctaccaccattcgtgcacacacattctctctttctctctcagcaatggcaagggtggcaacctcaaaaccctagggcccaaaccctccagaagatctggaacatccagccagaaatccgacggcccaaatcactccggccgttgtacttaactgagccgcagcccagcttcctcctctcttcttcttcttctcgcctcttctcttctcttctcttcccccacactctctcactagcttagcttagctaaaaaaaagaagaataaataaactaaaatgggagcttgaatccctcccaaatccgcaccattacgcgcaatccgtacacctgctcgacccgcacatggacctttcttctccgattcgcccgctctgagcaaccgggatccgtttctgctgcccattttttgttctgtttttgtttttggtttcttgggggtggaaatcttggccatctttcttgcgactgtaatggcgggggttttagcttggtgagacactgtagatctcgtcgtcttttttgatttgggtttttcggatggtgacggag

SEQ ID NO: 1978 - DNA, 2000 bp, Oryza sativa
gaagtttggcgcagaccaggagggaaaggagatccacctggtgctcgaattctcaagttggttcggcattgccgtctggatggcagatcatggagcaattctgccttccaaaggtccaggttttttttcgcggaccgctttccacgtcctttttcgtttggtttcattatatgaggggattgggggggggttccaaacttttactcaagaacaagaggggttggtgagctgccccctccatgagttgtgttttgtggcaaaaaccatggcttgtgaaaaagccttggaattcattaacacgaaacatatgcctctgccagctttgatgccaggtagagtgagtataaaaaaaaggctaaagaaaaagggcctcagtgcctttcttagttgttctgtttttttccccctgtaaattttctaagttgtatgtaatgcttttggaatgtgggttgctcttgagtgcattgtgcatagcatcattgtctgatgagcattggctgtaacacgtacggttatggttttgcttatctgttccctttcttctctctcgtttcttcatatacaaaatgcaaaatacaaacacgaagtgctaattaattatggttatggaaagcaacaggtcttgcatgatttggtttagctgtcaaagaaatcatgagatggatggaccatttggtcaccaaaaaaatctgttgttgggtggacctgccagctctgcttctgccctaccatgttagtatcatccatcgttctttgcaattcctctgctagcttgacaagatcagctgctgctgcctcttgcattgaaagctagtagctgcttgattcttgacaagccactaagctagcctggacagtgtcgttgtaggctagatgtgtcggcacgctcgtacaggtttttttttctcgttgtggggcccacatgtaattgagagggttcgttctgatagataaggggcggacaggtttgcgagctgcgtcgcatctacccaactgatccgacagtgattgtttgctttggcgttaagcatgggttgattagagcaagccctgttagactgatacatgggccccgctgcttctccctgttcactgtgtagagtgtaggcgcaagcaacaaaggttccctagactgttttgggtgtcactggtttggcggttacagcacaaccgtgcgattaccgtgaagtataccgtaattttaaaaactgagaaggttactgtatgtaataaccgcgatagcaacatggttttgtaaaccttgcaagcagcacacgctatgctgtttaattagttaagcatctctagttaagttagatcaaatttcatcgtgaaagtgacaatttgaaatttaggcttttagctgccctatattggagtgcagtaatttacgttgtgttagttccacgctaaaattggaagtttgaagaaattagaacgatgtgatggaaaagttgaaagtttgtgtgtatgaaagttcgatgtgacgaaaaagttgaaagtttgaagaaaaaagttaaaatctaaactgggccttagagggaaatcattctttaggaccccttagcaacaaatgaaaactggagaaatattgtaggattggatacctatagataaaaaaaactatttggtcctttggaacaaaggaacgattcttccaaattcttttcaaattcctaatcaacgcaccatttcatatggatcttgaaggaaaacaagtataaggttcatcctcatcatcactgggagcacttcccttcctgtacatttggggcaaattttcaagcccaaacccccaaatccacgaatccactccgaattccgggattccgacgcatctgggctcatttcacggcccaaattcactaggtcggtgcggcctgcacggcccaagtagacaagtagtagcgcccatctgttcgcccattcccgaacccgtcgtctcgtcctccacacaaaccctccccaactccacgaatcccgccgccgccgccgccgcc

SEQ ID NO: 1979 - DNA, 2000 bp, Oryza sativa
  misc_feature (814)..(814): n = any nucleotide
  misc_feature (1622)..(1622): n = any nucleotide
  misc_feature (1706)..(1706): n = any nucleotide
agaaaggtgaaaggtggtggcgtggtgcgttctgagaaaggtggtgtgtgttctgtgcataaagcggatgcgcaaaagcgataaataaaatttggggcaattgcttatttgaccccgttttgaactctagctaccaatttgaccctactttttagggtttgcttatttgaccctccttttcaaaattgaagacacggtatgacgctattccgttaagggcgtctaatggtgttaactgaagcccaaaatgtctcgcccaaaatatctcttctgcccttacttatttgaccctattacatctgggaccctgccgtcagttctatcttctccaatcctttcttctctcttctcctctcctccaaggatccatcacagggagagacggacgacgagccggcgccggccctagtgatgacgatgaggagtggcggctgcgagttcttctcctctcctccacggatccaccacagggagaggcggcgaaagtcgagacggcgagccggcgccggccctggtgacgacgacaaggaggaggagtggcggcggcgagtccgggcggtggatctcgagctgcagtcggcggatccggcgctgccgctgccacctcctccctccatacgagcgcctgtgccggcgtcagccatgccatcggcccgctctgcctggcctggacaacgagctccccctcgctggcgggctggaagcggcaggggtggacttcctatgggtcgaaactccaccggcaccgccgcagatctgcgctcggcgcagccgccctccctctacaagttgacggcggcgcggatccccttcntccacggccggccgccgcggccggtgctccctccctccaccagcggcaccgccgtggatccgtgcttggcgtagccgccctctcgccgcgagttgacgccggcgtggatcccgtccctccacggccccctgccgccgccggtgctccccccctccatcagccggcgccgccgccgatccacaccggcgcagccgccctccctccgcgagttggcgccggcgcggatcccctccctccatggcccgccgccgccgccggtggtccctccctccaccagccggctctgccgcttaccttccccgccatagctccctcgccggagagaaaagggatatgatagagagagagagaccgggagagaaaagggttagatgaggatacagttggagggtattttagtcattatgaaatgtgattttattttttctctttttttaaatgaactcttaacggtgttgtagaaacagggtcagacggagtgttcattttcaaaaagtagggtcaaattggtagttaggcttcaaaacagggtcaaataagcaattgtcccataaaattttgatcagaaattgactgtacgtctacgtgccctcacacgaggtgaccactcgcaggatatgatagagagaccgggagagaaaagggttagatgaggatacagttggagggtattttagtcattatgaaatgtgattttattttttctctttttttaaatgaactcttaacggtgttgtagaaacagggtcagacggagtgttcattttcaaaaagtagggtcaaattggtagttaggcttcaaaacagngtcaaataagcaattgtcccataaaattttgatcagaaattgactgtacgtctacgtgccctcacacgaggtgaccactcgcangccagccccagcccacctgcaggttgctgcgtagcccaagccccgactcgtggcatcgcactacacacaccacccgtgaggactgaggagtctcggagaagattcctccgttccggttggccgcgcgccgtgcggccgtgcccaagccaaaccgccgcgtcaataatgcagctacggtcaagtctcctcctcttcctcatcccccctcgacaactagcccaccgccaccgccaccgccgccgagggcgatccgatatgcatttgctgctcccgtagaaggcgcgcgtcgcagca

SEQ ID NO: 1980 - DNA, 391 bp, Oryza sativa
  misc_feature (3)..(3): n = any nucleotide
  misc_feature (5)..(5): n = any nucleotide
  misc_feature (15)..(15): n = any nucleotide
  misc_feature (19)..(19): n = any nucleotide
  misc_feature (31)..(31): n = any nucleotide
  misc_feature (33)..(33): n = any nucleotide
  misc_feature (35)..(35): n = any nucleotide
  misc_feature (47)..(47): n = any nucleotide
  misc_feature (50)..(50): n = any nucleotide
  misc_feature (53)..(53): n = any nucleotide
  misc_feature (69)..(69): n = any nucleotide
  misc_feature (76)..(76): n = any nucleotide
  misc_feature (100)..(100): n = any nucleotide
aancntggggaaaanccgntaggcccaaatntntntcgggttggccntgntgngcccaatagcctggtnacctggngatattgcccccaaccccaagaangccaaaatccgcgcgggaaacagttcggcgcccgcgcgccaaacttgctccaaatcgaagtattattttctctcgcgatttctccgatttttttttctagcgataaattaattaatgctcctctcgccgcgccgggaaagcatttaaatctccccctcctccgcgcggttctcccaacccaaaccctaccacgattcctccccactcccaatccaatcgccgcggcggaggcggcgggcgcgcgtgcacaccaggtgttcgacggaaggcctcgccgggtggggggcgaag

SEQ ID NO: 1981 - DNA, 2000 bp, Oryza sativa
  misc_feature (759)..(759): n = any nucleotide
aagccttgcaacatgaaaaatataactatgaattacttttattttacgaattcctgtttgtatcctatgagtgtatgccaataaatagcaatactagctagagaatttgaaataatttatatgtactttcacaagaagtaattgcaaatgaaatatttattcacgggaaagagaaaaataccatgggtgaaatgtgactattgttggccataacatgataacaacgtgtatggaacatttattgccaccaataatttcaaattttcttcaaacgtaagaaacagtgaaaaccaaatctcaattgtttctacattttcaccacacacgcaaacaattattctgttccagttgcatcacacacaaaacaaatgctttccccatcctttcaaaacgaattttgttttaccccattcccaaattaaaaaccatcgaaacaaaagggaaagaaaaaaaaggtaacaaaacaacaaccaacgactagccgcaatccagccgttggcattcaaaaattgccgaagcgggacacaaaggcggccgacgtggaaacggacggcccagatcgcgcggatcccacgcgggccatctccccgccgtccatttcacacccccgcgccccctcgcgtccccgtcctttttgcagaaaccaccctggaaaaatcgccaaatagccatccactcctcttctcatcttcccctctcttccgaaattccgccgcgcgccgccgatgcgcgtcgcggccgccgccggcgaagcccccntcctcctatgcgcgccgccgccgccttcttccatcgacctccccgcaggcgcctccctccgttctcccacctccgcaaatcgcgccgtcatcgctcgggccgggcggcgtccgcagcagcagccgccgcggtggttgagttgagggcgtctggtaaggatttcgggccacccagatccaggcaggcagcggcagcagcagaagccgcggaagggacgcgctcccggcggacgaggcggcggcacggcagaggcgtctcgcgtccaggctcgcccgtcagcaaggcgattggtgatctggtatatatctctccatctctctgcttgattaattgttgctttgggatgttgcttcgttggtgattgggttgaagtgttgtgctgatttgagtttgaatatggaggaggtgctatgctatacgatataaaccgacttacgagcccagataattcgtatcactaagatctgtgttatatattttttgtctggtaaattccacagcgaaagtcagacgcttttagcaccaaataaacctgaaacccagacagaggaggtccatatttttagattatggataaaccaggagataattcacattttgcagaaaatacaatcctcaaatctaaaaggagaaaaaacattttactaccctaaaactattttatatattgcagaaagcttaaggtttactccccctaaatgtgaaattagctacttcagtagttcggacttcggagggtagaatgagctaataagtagatttgcagaatagtttacggaagcaaagaggagtttttccccatttgcaagttatccacttgactgcatatcaatcaaccatctacatatacatcagggtgaatgatgcattttttagttttcataaagatgtacaacgagggggtgtagacacattatcaccccaactctttttttagataaaatattatacaatccatctctataataaaacgaaaatgacatgaattctaccccaactcctttgaaatgagaattcatgttcttatgagggtagtcaatgtcctgtcctctatgcatccctgaatgcttctattgttacatcttgtgacaatatcttcattcgtccaattcttttgcagcttatgattgcttctcccttggagcaactccctgaaggcctcactgaggcttgacagtataatgatttttatatcccttggaggtttctactgcaaagtgaggattgattgtcttcactca

SEQ ID NO: 1982 - DNA, 2000 bp, Oryza sativa
  misc_feature (1121)..(1121): n = any nucleotide
gaattgctcatgttttaaatattgtttatcattacaccaatagaaattatacaccaataaaaattaattacatgcaacacattcaatcatcatattactgtttacacaaacaaacgaaattcttatagataataattattttgagaagacctacaaatcttatgagacgatcaaaatggatggggaagagtagtttgcgactcgggagcagtagtattttccatttataaagaagacttgaccggcagctgggagaggaaggaagaagacaatgcagatagagttggcacgaactccaacccccacaatgttccatcaacactcctgtctccactctccaccaccctcaaatccccaaaaccccatagtagggtccaaaacgcaaaaaaaccccatccaccccttaccacctgccctaaactgccaaatccccaaaacccagggtgcaacacgcaaaaccgcaacccccttcgcatttcgaaaaaagaaggccaccggccaccccaccaccacctccaccacgacgcacgcttcgagcgccgcttcgcctctccccgctccactctctctctctctccacagcgtttgtttttgctcgcgagaaaaaccctgcggaaaatcgaaaaatctcgcctcccctcttcgtcccctcccctcccctccccactcgccgccgaagcttccggtttttgttcctcctcctcgaaccctcgggagagatcgcgtggtgagcccgctcgaatcttttggtatatctttgttcccgttctttccatccatccctgcttttttcttggccgctttccgtgtaatgccggtgccatttccgcctctttggttttccccgatctgtggtttcggtcttgcccggtagagattcgggaacgggaagcgcggcggcggttgcgtgacggtttcttgagggttcttgagaggtcttggttcggttcgtgcttttatctttggtggggtgtgagtccgtgcgtgcgtggatgtttttcttttgcttttgcgaaagtgaaagtgtgcttgcgaaaagggggtaaagcgacgagcttgctgtgtgcgcgcatatgtagctgctggtttcttgcgaatggttggggtggggggattttttngctcgattcctggttttcttgccgggttcagatctgatcttttttctgctctctcttgtgtgttttttcgagttgtttgtggttgctcacctcttgtgcaccggcaatggcaggcttgagcagcgtttcttgctcggcggcggcggcggcggcggcggttgctagatctccggcgtgacaccggtcggaatgggctggatgtcgacggggacgacgttcgggcgttgatggcaggtgaatccctggacgaatgtttttgcatttggtttggtctccctctccagatgtagatggggggtatatatgttgtcttgagttttctattactatattggagcatggtcaatagggagaacatgcttgttcttgccgcctgcgctggaaatgttaatgcttctctgtcctttcgagattattattattctttaaagtcgcctactttgcagtgcaagaactcatttttcacctcttggtttagtgatttacttccctcagtggggaacggcaaccgtcctttgttactttgagctagtaaatgcgcgagatttacctggtttgtccatgattgctccaggtgtggtgttcccatgattgatgatgtggagatactgggatggttcgagatgaagaaaatgcttgtgaggtgctctgttgagagaaaccttattacctgatgacttgttaattcgaaggtgccaggttcttcctgttcattttgatatcgttcatcatttttgtttccgacaaccagccattttaaaacttgttcttatttatgatgttgcagttattctagcacaccagttgctgctggttggatctttttctttcattgctgagtaggagcgtaggagttggttggttcaagaatttcgttca

SEQ ID NO: 1983 - DNA, 2000 bp, Oryza sativa
  misc_feature (1238)..(1238): n = any nucleotide
aggcaacaaagcaggttgctgacaacttgaagttacagttagagaaggcggcatctgagagtgcagcttctgcaagaggtcacagtgatgcagggaaggtgtatccactccctgacaccgaacggaaatgcagttaccatactgggcagccggtcgagagcgcaaaaggaaatcagtccgcgctaaccacattgatcaagctgaatcaggcaaaggcattcctaaacatggatactgtcatgacgattaagaggcagatagaggaggagaaaggatcacttgaaaaaactcgtgagaggttacagttgaacagagcgaaggcttcatcacttgaagcagacttaaacaaaattgtttcacagttacaagcagcaagaggccccaaacctactcttgaaccttctgatatctggttgcagatgaaacagttaaattcagagaaagagaaacacaggaagattgctgatgactcgaagaatgagattggcgaattaaccgccacgattgagcacacaaagtccaggacgaagaccctacaattcaggattgtcatggctgaaaaattgaaggaagcctcaaggcgcggagaagctcttgctcttgcagagagaaagaacctgagcaatggggagcacgaggccagtaccgcatccgatgtcacactttctgtcgaagaacactcagtgctggtgcaaaaagcagaagaagcagatgccgcgtgtaggaagaaaatcgacgcggcaatgcaagagctggatcaagcaaaccggggcaaactggaactcttggaaagagtagaggaggcaatggctgcagttgagaccagcaggaaggctttggaggaagccctaaagagggaggaatccacgaacaaagcgaagctcgtagccgaagaatcactcagaaagctgaggtccgagcaaatcatccagaattggcggcccaccggcaacagctccgtcaaattcaagacctcagcagcgacgacggcggcggtggtggctcaccggagagccggctccgggatctacgacgtgaacgggctgagcctggtgacggcgacgcccaagagcacgaaggcgatgtccatcgggcagatcctgagcatgaagctggaccaccgggagctcgaggtcgccggcaagggcggcggcgccaagaagaaggtgtcgctggggcagatcctgagccagaagtacgacgccctgtcgccgctgaggatcgatcacggcggcgcntcgcgcaggcagttccaccccaggaggaggaagctggggttcgtcgtgtacgcgctgctcctcgccaagcacaggcacaggaagaagaggcagcccgccgccgccgccgccgccgactcctcctcttgcacccatggcagcttcagcaccaaggctgtgtattaattagcaacatttttttttcttctggatcaatgagtagtagctatgcagtgtaatagtacagacttatgaataatcagcatgtgtattagttagttctatgcacaaagttgaaattcagcagctactccaggttgtaagtatgtacaaacatctactgttcttgcggtttcgagagaaatttcaaccgcggcgatgaatgctctgttaaatttactggatttgggccgtagctttaatgtgggccgtgagacccagaaagcccatgcatgaaaatgtggagtccttttaggccctgtttgaattcctgaattgggccttaaattaggaattcaattggaggcccagtacaattcaatactcctttactacacggatcgcggtcacgtcacgtggtccatagtccagagtcccgagcgcgggaaagggcacctcttcccgccacaccgcgcgcctcttcccgccaagacgtgccctgttcctccccaaattctacccccaaatccgaacccgccgccacaatcccccgcccattcccggcttcccgctcctctctctctccctcccctccggtcgcgcgtcccgtctccggagcagcag

SEQ ID NO: 1984 - DNA, 2000 bp, Oryza sativa
  misc_feature (1382)..(1382): n = any nucleotide
ccgatctgttctgcgtccgctgacggcgtgaacgcgggcgagtttggtctacggctaggctgcagaattaaggtctgagcccaatccccggcctgctccactcatttcattggtgtatttgtttgataaattattagaaatgtctatataaaaatgatggactgaagttgaatgggacgtgtgtgtatatacattatatagcagtgcatgaaatttgattatgtcgagatacttgctgccggcggatgaagttcgatggttattatacttcatatttggttccttacagttattttgaaattagaacatttgtctcatttatttgcttgatcccatcttcttgcaggctacagccatccctgggtttttttaagtgctgcacttctatatatatatctaggtaaatttcaacccctcatgttcactttctcgagagaatccattttctttgctttaatttcaggtagtatataacctgttctgatgcttcttgtgagatttcatgtttgattgattttttttgaacatattagcaaatatacgtgtgtcactgccgtgttttgatatttgatttagtaaatatctcctataatttttcactgccatcactccaggaatattcaacttatgcttgtcatattaaaaaatatgaggaaaaacagtatattaggatcttgtaaaatagcatgttggaccctagtagaacctgggccctagtagaacctgggcgccgtgaaggccatggtcgcaaagctgatgatacgcaggagatgtaaaagttagcctattaagttgaacaaatcatattgttttacattgtttcagacaaacctgatctgaagttagcctattaatattttatctgaatttaactttaacattggttatccagcgactatcaagcatcacccttaaaagtgtcattgataagaatgaattatacctaaatctgaccaatttgtcacatagctgataatacacatgtgaagcgtactgcaccgataatagttacatggaatatgtagattctcattgcccctggttgctgacagtctaactccttaacattcatattcattctcatcttgaggttggtcatttctaactccttaacattcatattcattctcatcttgaggttggtcattttgtttgctctgtacctatgagatttccccttgcgctgtgaaacatatgccatgtcacttcacggcagcaagctgaggctttgttctaattgtaggttcaatatatcaagagggtggaacctaattgataagtgtgcaccagatcgtggtcagactaattcacggtaaggctgtgtctgtttctcaacccttgatatatagtgtatgattgtgttgtgttgggtgtatcctggnagaaaaacaaatgcatgtctgagattgtttcttcgagattattaaaatttagctgtcaattgagattgtaactatggtctatattacattaacgcatatatatgcttatattttttttcctttttaatttttttagatggttcgtccatacaacttaaatgaatatatttaattcattcattgtataatagaaatatagggcgtatagaccgtataaaataccaaccatgtgcaggaattataatgccgatatgtatacgcatacgcacgccactcaaagttttattgtgcctacgcaatatcatagtctcgtaaaattttattgtgcctacgcaatatcctagtgttgtactttacgttacatatatttgatgtgcgacatgaattgaataaaagttcaaatacacagatcatataaaaatattttttgctaacatgaaattttataaattatttaggacaaaaataaaattgcagcgtagcgtttagcacaggcatattactagtctccttaaatccatctcctttggctttcccctctaacaccgtctccctaatcccagagtctacctaccccacccctcttgttgccgccgcctctccatcctctcacgggcc

SEQ ID NO: 1985 - DNA, 2000 bp, Oryza sativa
  misc_feature (278)..(278): n = any nucleotide
  misc_feature (280)..(280): n = any nucleotide
  misc_feature (450)..(450): n = any nucleotide
  misc_feature (589)..(589): n = any nucleotide
  misc_feature (616)..(616): n = any nucleotide
  misc_feature (626)..(626): n = any nucleotide
  misc_feature (635)..(636): n = any nucleotide
  misc_feature (665)..(665): n = any nucleotide
  misc_feature (676)..(676): n = any nucleotide
  misc_feature (731)..(732): n = any nucleotide
  misc_feature (737)..(737): n = any nucleotide
tggtcggcgtgggcgcggtgtccctcgccgtcttcgccgacttcgcggtagcacttgacgtcgtagctcatacgcatatacgctgggtacagacggccgcatgtacatgcgtcttcgtacgagcatatatatgcatgcatggagacgaccagctatagcctagctagcttcttgttggtttgccgcccgataacatgcagacgtatatattagccaagcatgtgtatatggctgagcacactcacatgtatatatgccattacgtgcagcggaggagngnggatgcggggggtgcagcggaaggcgagcgcggcggaagagcggcggcgggcgagcgcggcggtgggcaaagcagcggaaggcgagctaggcgaagcggaagacagtggatgggacgaggagctcccccgtgctcggccgccaccaccgctgtgcccccgcgggtggccnacgatgctaggagaggcatcaccggcgggagaaggggaagaggcagaggaagagattgtttattggtcgccggccgcttccccttccctcccaaaatcgctggccgccgttccgcgcaaccgggttagcgctccgctanactgtccgcggcctgctcgcgctccantgctcggccngccgccgtnntcgaaccttccgttgcttcgttgccacgntcgccctccgntacgccgcgtagcctcgcccacggtgacgacgatgacggccacggcgcgtggtgnnaagantacagcctgaaggagaagaggagagagaaaagaaaagagaagaggagagaaggagaagaaaagaggaaaaaaaagatgtgcaactgacatgtgggctctacggtgtttttttaaaaaatttttgctgactaggatgccacatcagcaaaaccggacgaaaatactgccgagggacctccggtgaacgttttgagtgattttaggggtacacatttctgattttgtggttaagggacctcaaaaaatctcgctgttaagttgagggatctccggtgaacttattcccccaatttgtacagttttttttctccctaattatttgggcctgaagctgtgggcctttccgatcgagctgtaggcccggaaccttggcgagtggtgatgtgataacgtgtggtgggcacagtagccccccgaagaaacacagcgaagctcccatcaaccgacaaaagaacactgtaacttttactccaccgtgggagggggaggaggagcaggacaggcacgtgggtcccacgggctgattgaatttcgtggccccaggtatcaactgcgatcgggccctcacacccatgcagcagcagcaggaggcagcagcagcacagtcaaattaacaatggaccgctacgtcgacttcggtatagtactggatggctgctcgctatcaacggctctttttcaaacattctcccgagtatttttattttccggcgaatcctacattcctaccattagcacattagaatgtttttcaggtgaggaggtaggtactcaaactttgtttagatccagagatggataaccaaaatgctcctgaatattagcactactggagtatggagtactaactttctgtagagcctgatatgttacctgcaatggatttgttttttttttctttcctagaatttgaatgtttgaactttgagcatgagtgcgtgcaattggttgccgtgatctgagtttaaactcgaaagtgtgcctctttatccacccgttgcagcgttgcaggctctccaaacgatcaaccgatcaagtgccaaaagaagcacgggaaactaagctgcagtgaccacccacgtgccgtggcgaccgctctctgacccctcctctcccttcccgagcctcacacacacacacacccaccacaccaccccggccgcttccgccacttcactccactccacatcacgcggccgcactccactgaaacccaccgctcacccaacccccccgaaaaccccccaacccaagcgcccacca

SEQ ID NO: 1986 - DNA, 1068 bp, Oryza sativa
  misc_feature (47)..(47): n = any nucleotide
  misc_feature (50)..(50): n = any nucleotide
  misc_feature (52)..(52): n = any nucleotide
  misc_feature (68)..(68): n = any nucleotide
aaacccccgggggggggggggggctcggggcatgacgtcacccctcnggntnttccgcggcttcgccncggggcccttaacccggtcaccaacgtggcagagggagagagccaagaggggagcacaggctgaacagccataaatgtgcgatgccccaactgtccctcaccgcatttaatgcggtaagggcagacgtgcggcgtgccttacgaacccttgtccatcggatgtgaccggtctgtgaccggcccgtctccgtcacatccgatggatagggcaatcatgtcctcacgtcgcccttgtccccagtggagtgggggtgggtatgacccgtcacatccgagcgccgctcgaggaagggctgttgcgtgtcattgttcatttatgagggaatgacagggctatcccccgcgtcaggcaggggacggcgccgggttccactcgagaatcggttattgcttagcttcgggagaaggcccggtttaaagcccaaaaagtggagtggggttcccccccggtggagggtaggtagaggcggcacatgtggtatccccttaagctataaaaggaggaccctgcccattgagatagggggacgactcccagaaaacctgagctcgagaggagaaggagcaggtgcgctctctggggggaagaaacccttgtaaaactcatcaataatcccaaacacaggagtagggtgttacgctctatagcggcccaaacctgtataatcccactacgtgcaagcttgccggtaatcttagggacgagcgagtgatttccgagagtttccgagaggcgggcctccgcccccggccgaactcacgaaagggggggtctcacgacctcccgctatcggggggccatccctcgacagctggcgcaccaggtagggggcggttgcgcgttccgagaggaagttgttttcttccgtcccaagtttctccaggccttagccgaccatggtcaaggtcctggaagtagaggaggaggcggtggcatttacccccaccccgtccaggagtggggattccggcgagagccgaggtcctcgtcaccgtcgcc

SEQ ID NO: 1987 - DNA, 2000 bp, Oryza sativa
  misc_feature (1469)..(1469): n = any nucleotide
  misc_feature (1475)..(1475): n = any nucleotide
  misc_feature (1477)..(1477): n = any nucleotide
  misc_feature (1481)..(1483): n = any nucleotide
  misc_feature (1486)..(1486): n = any nucleotide
  misc_feature (1494)..(1494): n = any nucleotide
  misc_feature (1506)..(1506): n = any nucleotide
  misc_feature (1508)..(1510): n = any nucleotide
  misc_feature (1516)..(1516): n = any nucleotide
  misc_feature (1520)..(1520): n = any nucleotide
  misc_feature (1537)..(1537): n = any nucleotide
  misc_feature (1549)..(1549): n = any nucleotide
  misc_feature (1558)..(1558): n = any nucleotide
  misc_feature (1570)..(1571): n = any nucleotide
  misc_feature (1575)..(1575): n = any nucleotide
  misc_feature (1588)..(1588): n = any nucleotide
  misc_feature (1596)..(1596): n = any nucleotide
  misc_feature (1613)..(1613): n = any nucleotide
  misc_feature (1624)..(1624): n = any nucleotide
  misc_feature (1626)..(1626): n = any nucleotide
  misc_feature (1647)..(1647): n = any nucleotide
  misc_feature (1665)..(1665): n = any nucleotide
  misc_feature (1908)..(1908): n = any nucleotide
ggtacggtagttgaaaactataattacgtaattaagagttcgctaaaataaatcccatgttgtagaggtcaggataattatattgtattagaccattcccaacccaaaacactagacatagtttccataaactccacatcatcaagaaactagtactagacattactcttccaatgcaaacaccactattccatacttaaatttaatgctatttatatcacatgatgtcttggatgttgtgtagaaactatatctcatgcaagacatgatttccttctctttcctcatttatttacttgccacatcatttttcatcctaggtgacaacttatttaatgctatggacactatcctagtcattgggttgggaatggccttactccctccattccaaaatagcacaactactcttaacccaaaaaacaaaaaataattattatcatattatagtttgaatgatcctaataaatataatgcatatatccaatatgattagataacatgagagtgaaggatttaaaaataataataatttaatggagaagatgccatagttaattgtatacttgcatgcatgccttatattatggaacatctaagaaaattggttgtgctttatattatgcaatggagggagtgtcttaaaaaatatactccagtttgtaattctaacatattaccatgttaattggataaaaattatatatgttagatggtggtggattgaaattataatggttgatataattatattcgaaacacaaatagcatatgtggagattgaagctataagatgtatttcaaatagaatcctacttaaatctactgtatgcaaatgtatctttggaaaaagctacgaattacattaagaaaatgtattttctaatatacactttctctatcgtaaaatatagctatctatagcatttaaaaattatcataaaatataacaacttctataccaatcacaaccttcgacattcaaattctccacctagtccttcttaacccaaacatttcttttctcatttaattttatctacttttttaatcccttatatccaaacttaaaactttctatttagaatggaggtaattctgtatatagattaccaaaggtacaagagctaagaatcgtgcatcaaattcacttcggaaaattacataagaaaaacatttgctagtttgttctacataaatctcgagaattttcacaacggaacacgaagctaggagaatttcacattttataaaacttttataaaatgattaaaaaatattgaaaaataaattaaaaaaatctaaagtcaacttcaaattaaaaaattaaaattaaaattttggctaataaacatagcaaaagccgaaagatgagactgaaagctacccagatcaaacagttctatcgctatagaggatccgagcaaaaaacagggccggccggccggcagaagaacacaccacaccantaccantncccnnnccnaccccacncccccccccctngnnnctcttncccnacccagtgtactatacngccctgcccttnaccactttnacctccctcctnnagtnttctcctctggtntccccctntccctctcctttcggcnaccaggccacngngcttccctccccttggttccngtagcgttccgaataaangcccacctgcctttccttgaccattaccataaaaagagcttgctcccaccgcctctctctctatctccccgtcgctagctaccagcagcaacaagtacactccccccactcctcccccacacgccgcgtacaactagctaagcagaggagagggagagagagagaggtggggttttgatggaagtacaattctagctatgttcttgatcggggccatgatcgcggatctctagaaagttctanatcttccgtgcgtggtgggcgggtgggggtgttcttggtagggtaggtaagtgctgctgcaatggaggaaggaggtgggagtggcgtgggtg

SEQ ID NO: 1988 - DNA, 2000 bp, Oryza sativa
tgcacatgtgctgctgcgcaatgcagagttggccgtagagcaatgttgtgctgtactactagtctactggagtactactgcagactggactggccgtcgccattctactagcaaatatcacatttgtaacaacgatacactggagtatgcacagtggtgtaccgtgaaccagcatggacgtgcgaatgcacagtgtaacagcaagtgtgccccaggcagaggtagcaagcccgaaagtccaacactacactgcataaagttataggattctcccacacatgatgagtcgcacgcagctactactcctacagtagcagctagggacaatttcttcttcagctcaggctcagctgctgagccggtcgcgcctcccaacgcataggcatgctcccgccggccccgtctttcttgtccgccattacgccaaccggccgcagtaactcagcgtactactcgtactctactctactccctccattccaaaataaataaataaataaatagataaatctagggtgtgtttagttcacatcaaaattaaaagtttagcccttgtttagttccaaactttttcttcaaactttcaacttttctatcacatcaaaacttttctacacacacaaactttcaaattttctgtcacgtcgttccaatttcaaccaaacttctaattttgacgtgagctaaacatagcctagccctgtttagttctaaagtttttttttccaaactttcaactttccatgacatcagacctttcatacacacacaacttttcagtcacatcgttccaatttcaaccaaacttccaaacttcagcgtgaactaaacatagcccaaggcaaagttggaagtttgtatgtgtacggaagttttgatgtgatgaaaaagtggatgtttgaagaaaaattttgaaactaaactcgggcctagcactgaatgtgacagattctaatacaataaatctggacagagctatatctaaatatatcacatctagtactaaattgattttttatgagaaggagagagtactccttttctttccctgcttttacgcgctgcagcattgctccctactgcatgctccctaccctcttcgttaaaaaaaaaaaaatcaaattctggccgtaaacctgaaccacgctatacgtatttaccatgttttggctccctatgagttaacggttagcatgtaatatatattggttttaaaaagtaagaaagttatcttacgtgatgttgcgataaacgcacggttttataaatcttgtatatgattttgtagtataactcatgtataactagatatatataattatagataatcgaaaaataacatgttcatatgtttataatcgttaaaagtcataacgtgagtcagactcaaacagttagtagaccgtatgcataatatttttctttttggaccgagggttactcccaaccggaaaacagatccctgactttgcagtttgtagttgtaccatgtgggggccacatatcagtgacacaactatatgtcggtggtctaactacaaactgcacaaaggctaagtttagatccaaacttcagtctttttccatcacatcaaattgtcatacacatataacttttcagtcacatcatctctaatttcaaccaaaatttaagctttacgctgagctgaacaaagccaaagtcaggaccatcattctcccaacccagacgagccaccatgctagctgctgctgctgctagtgttgcccagtgaccttgcagctcgccatgctagctccgctgctcgctgctgctgcttttgcccaaagctgcacaacctgcattgcctctcgcctgaccctcttgcctcatctgtgtctccccccttctctttttcttcaacccctctttatgctcgtttctccattgcagctcacctccatctcctattctcctcctccttgttgaaggagttcgtgtgcctctaccaagaacaagaagaagcctcttgcatcggcag

SEQ ID NO: 1989 - DNA, 2000 bp, Oryza sativa
tcccatgcatatctggatcattcttctgagcctcgcggatttgatcgagcaaggtaggcttggcttctagagtagccaagaatccatggctaacgatgcttaggttcagggcttccatctgttgattaagttccggtggaatgccacggacgccaagagtgttgcaacagctttttcgactcagcacgtctgcgaccacgttggccttaccagggtgatagtggattcccacatcataatccttgatgagctctaaccatcttctctgccgaagattcagatccgactgagtgaagatgtatttcaaactcttatgatcagtatatatttcacagcgattctcaatgagatagtgccgccagatctttagagcatgaaccacagcggctaactccaaatcatgggtagggtagttgccttcatgaggccgaagctggcgggaggcataggctaccacgtggccttcctgcgtgagcacgcaccccaatccttggcgcgaagcgtcacagtacactaggaagtccttgcgagtatccggtaagattaacactggcgaggaaaccagcttttctttgagagtttggaatgtcttctcgcattgcggtgtccacacaaatttttcctccttcttcagcaactgtgtcatgggttgagcgattttggagaagttctcgatgaatcttcggtagtatcctgccaaacccaaaaatctgcggacttgagtgactgtcttgggttgcttccagtcagtgacggcggtcactatttcagggtccacagcaactcctttagcggatatcacgtgccctaagaatttgacttcggacaaccagaactcacacttgctaagcttggcatacaattgatgttcccgcaactttcccaacaccagacggagatgctgctgatggtctttctctgattgtgagtataccaggatgtcgtcaatgaaaaccacaacaaacttatccaagtattccatgaacacttggctgatcccctcctcctgagatagatttcagtggttggttctggctctcccagagctccaattgaacaaggaggcatttgcttgcacacacatgcacccagttgcatcagactcgcatgaccaggaggcagaggaagccagaacaaggctcatgctcatcatgcacgcagaagccatttctctcatgctttcagctgccaagcttcacccagcacggcttgcggttcgctcctcccgtgcgtgcacagctcaagtgaaaccgcctcatcacttccatgtgatcatcctcctcctcagctcccagaatcctaggggcataaataatctagccgtggcatctccattcgatcaccctcatcgatcgatccgcccgatttggtctggccagctttcgtcttctgatagatggttgcttttatacacctgaaactaaggcaattaaagcttaagtgtaagtacaatgcccctctttgttttcctacattttagcatctgtttatgaccatgatgatgatgcattgctgcttttaaggttaaggtgcacatcgaaaagatttgctacttgcttgtagacaagaatcgcataaaatgtaacaatggtttcagaaaggaaatgctcatactaacgaaagtttcatgacacaatatttcagatctttcaaggaggaataagaatcaacctgtcaagtaaaaagttttaatatttgtatgatcagaaagggcatacaccaacctaaatttgctgtgtaagaaagtagctagctgtgccaaatcattgtcacctcagtcagatctgccacaagcacgtacacatatatgtgaaaccgactagctttcttgcagctggaaaaactccaacgtacaacagtaaatgatataatctcaatatctagatataaaatatcctttttggaaacttctacaacgataatatatatcggtttgtcctaaaaactctttttttgttccaacaggtaagacttacaagtagcagaatagtttctacaat

SEQ ID NO: 1990 - DNA, 2000 bp, Oryza sativa
aaaattcgcgaggaaggggcgcgttcatatatagttgtggaggcggggagttgcacgtcgcgtgtgggatgtttgtgtcactgacaggtggggttcatgtaatgtgggggcagggtgtcagtggctgggttgggtgaggaggtggggggattgaggagacgtggggtttggacggcggtgaagggctaatccaacggctgggatggggtcgggttggctggctctgactgagtctgtgggccctttgccagaggcgtgatgagttgggaagtgtttgaaagggtgactttttggggaagaataaaatgaggaggaattcgaatggaaaaatggggaaaggagaaatgtagggacaacttcttcaatatacagttttacacgcctgttgatatataagttaattgtttcattacttgttcagaaggattgatggttttacacgcgtccatataattgaactcctgacttatgacttaaaaaatattttcaaaattttaaatgtatagaaatccaacatatatttattcacgtttaatatttatatttctcttctataatatactcctggagtatgtgttttggtttctggactgtttttttagttaaattatgttttgtggttgataaaaacgattgcaatatgtcccgtgtgatttaatgaagtattaccaacaaaattgttgagaatgaaacgagagggagagagatgagtaattctcattgatcaaatgtttagtttatacatagggaaatggtttcaatcagaggacgtgatggttgggtgtgaggagtgtctgagagaccgaggatgtgcgactaaggccttgatcccaaaaattttggcaaaaaacatcacatcaaatatttagatatatgtatagggcattaaatatggggaaaaaaatcaattgcacagtttacatataaaatgcgagacgaatcttttgaacctaattacgccatgatttgacaatgtgatgttacagtaaacatttactaatgacggattaattcaggggtggatctcaaaaaaatagtagtgggggctgaataaactacatcaacataaattgaaccttcagtccacacatcctatgaatatatggaaaaaaattagtgggggctttggggggtctctgtcccggggcggtactagggtctcaagacccccattgtgaatacgcccctgagttaattaggtttaataaatttgtctcgtagtttacatgcggaatctataatttattttgttactagtctacgttaaatattttaaatgtgcgtatgtatattttaaaaattttacactcaaacacaccctaaaccgctgtggttccttgcggtagagtagaagggtgaggtgcctattcactgggtcaatcccatctaatgatatggatgaaaccatccaaaaaatcgtaacacttcctttgactgaatccaacatttgatcattactcacttattattcacttattattgttctacatacatgttaagagaatcttagaaataatatttaatatttatatttttcttatatacaagtcatgatatactttcggagtatgtgttatggcttccggaccaattttaagttcaattttaaggtaggagtattagcaacaaaacaactccattcctttagcgacagacaattcaaaagccaagttctcaaaaaaaaaaatcaaaagcgtgtaaaccgtttttaccatgaaaatatctccgatgatgcaagactcgcaggcgggcccgatggcgagccgaatgcctctccaaaagggttacgtgggacccattcgtcggtcgaaaaattcagacggcctaacattactatgggcccgtacgtcatccaccgagcgctacccgccaaatgttagccataaaccctgagccgttcacgtttcccatcccattctcatcatcctcaccctcccccgcgccgaccccccgccgctgccgccgccgccgctaaaaccctaaaacctccaaccttaccc

SEQ ID NO: 1991 - DNA, 2000 bp, Oryza sativa
aaacatcatatcgaatctttggacacatgcatggagcattaaatatagattaaaaaactaattgtacagttaaggggaaatcacgagagggatcttttgagcctaattagtccatgattagccataagtgctatagtaaccccacatatgctaatgacggattaattagtcttaaaagattcatctcgcgattttcaggcgagttataaaaatatttttttcattcatgtctgaaaaccctttccaatagccagtcaaacatccgatgtgacacccaaaaatttttcttttcgcgaagtaaacaggccttaggcaaggcctggtttagttcccaactttttctttaaacttccaacttttccatcacatcaaaactttcctacacacataaacttctaacttttccgtcacatcgggtttgtttggtttagtgccctaccaaagtattgatagcgccaaaatttaggcatgttttggcactaccaatattttggtagggtagtatttaaagtgaatgagtttggattatactaattgaaagccaaattttatattatagttaagaaagttttagaattatgccaaattaactatgggcattaccatttacttgcctccaaaccaaaccattaaattcactatttaagctaccaaaaaattggtagggcacattttagcatcaatccaaaatgacccatcgttttaatttcaattaaacttccaattttagcgtgaactaaacatacccttaagagcaagtttaatagtatagcccactactagctccaattcatctatagccagtctaatagccaattcatacaatagatgcttactatactattaatatatggtcttacctgtcatacacacactgtgtcttggagtctgtgctgcagctggctacagatctgtagcccgctgctcttctctctcatcttttatctcattaaaatatgtttgtagctggctaatagtctgctattgtacttgctctaagcacaattgaaaaatcttggaagtagggaacggcttcttctccctcaccacaaaatgaacattgaacaaaccaagaaaaaaaataatgaaatgacccatttgccctgcattccaaagcactcacattcattgccttttgagcttgacccacaccactctgagggccctttgaatagcagggtagaaaaaacggagaaatagcaaaaacataggattctgacagggattgaagtgtaaaacagaggattgcaaaacacaggaaaaacataggaattgtcgtttgattggagcgcaggaaaaacgcaggaatcggatgaaagagatagacttaaaggaaattttccaagaggttggagctcttgctaaatttcctccaaaatccacatgtaatgtgccattccataggaatttcataggatttaaaagctttaatcctttgaatcaaagggctaaataggaaaatttcctatagaatttgaatcctataaaatttctgcattaaggccccctttgaatcacaggaatgaaaaaacgggagaatgggaaaaacataggattctgataggaatacaagtgtaaaacagaggattgcaaaacacaggaaaaacataggaatgaccgtttgattgagccgcaggaaaaacacaggaatttgaggagaaacacaggaatttgaggagagagaaagactcgaaggattcttaacatgaggtagaacctcatgttaaatttccttcaaaatttgtatgggaagaggtattccataggaattttataggatttcataggattcattcctttgattcaaagggctatataggaaaaattcctataggaattaaatcctttaaaatttctatgaatttcctttaaatcaaatggggcctaaaagggggccatgaatctttcactccactctgctcaaatatagcactccactccctggtcagtgctacttcactctcccacttcgaggctacaagcttttcttgcttgctgca

SEQ ID NO: 1992 - DNA, 2000 bp, Oryza sativa
  misc_feature (736)..(736): n = any nucleotide
gagacctgcgattgggggtcgtacagagattgatgctatgttgtgcgtataaatccagtaaaaagttactagttgactcttttcaaccatttttctgtataatttatatgatttgaatggcatcgattcattcatctgttgttcttattacgcatgtcacctagtaatgaatgtgatctcagtttcttgaattcaatgtttattttttcggcttgtttagagcagatagatttatttgttcttggattaaaaaatggaaaagaaaagagcaagcaattcagtattcgtatcacgtatatgggtttatatgtatgttgagacttaggaatctctgaacctgaagtgcaaatgagcaatatatgtttgatcaagattttctcttccgccgtagaccatttaatcaattgttgtcccaataaagttggcagataatagggtggtgacacttttcatcactcgtcacctcgtgatgcgtctatctaggtgtaagcactgatcaatgcatgtgttgtggatccccggccttcaataatatagaactggccggtcctgtttatcacttctttggtggatagacatcgacaagaacatttttttggttgcaagcttgtgacatcttgcttgaagcacagagttttgatcgatgtggggcagaatttgtgttgcccattcttcttgtctggagggagttatcctgttgcctgacctacatatcagcaacaggcctgtagttgcngtgtcttttgcagttggacgtgtgatatgtgatagataaccaagtgccagccaattttattgtgcaaataagtttttgacgattttgtagttgcaagatttgaccaactttgactcctccagtttttggagtatgcaaatacaaaccttatattttcttatctatattgacttgagaagactgggttatagaagcacatgatttgtttgttacggatgctgtgttatttttacactccttatgtaaaatgtatttttttttcagaaaatagtcgtacagtacactggcaatttactttactataaatctattattggtcagtttgaaagacgtttcttatatattattcaatttctaatatagtgatattctcgaagtagtatgttctttctatttctaaaagaagaaacatcactatcgttcgctagtacatgttattatgggctttccgacagtgaaactgataagatcatggatgatatgatacttttgcctcctccatagctgtcaatggtctggtccctgcgtttctgcatctgatttgtctaattttgcatattggacatcttcattagtaagttatatgttggccttctttgatagaatttagcattctattttacaaagtgtgcaagacctactcttctgttgtcttagaccattggataattttgttttcccctttgtatgagcaagtcgcttaatgggagctgaatataagaacattgttttattagcagtttacatttctggctttcaagtttcaagatcatttactactgactattgccctttctgtactctctttgttttttaatatatgacaccgtttattttttttagatacgtttgttcattcgtcttatttaaataatttatttaattatcatttattttaatgtgacttgatttatcatcaaatgttatttaagtatgactcaaatatttttatatttgcacaacacttttgaataacacgaatagtcaaatgtttgtcaaaaaaatcaacgacgtcatatattaaaaaaggaggtagtactagattacattttccatgaatgttgagatgaatcaatgattaacttgaaattttgggtcactgaagtctgctttaagtttgtactacagataatgttcctgctgtttctttcttattctcaagtgtattactagtgtatgtgcatttttctcattttctcacttgttcttggaaatgcagtcaggtcttcacccttgagggaattgttttcattatcttatcaaa

SEQ ID NO: 1993 - DNA, 2000 bp, Oryza sativa
  misc_feature (1775)..(1775): n = any nucleotide
  misc_feature (1778)..(1778): n = any nucleotide
  misc_feature (1911)..(1911): n = any nucleotide
gatgactggtccaactttattggtaaagttaattgtgtcaaaataattatgagatggagggagtattatgcatcaaaatttatttaaattcgtggagcatcaagtattggtgaccaaactatataagattcgatatgtatggttaacaatttaatattgtactcgcttcgttttaagttacaggatgtattttgttttttaaagtcttgaccaacagttacttcattaaatgtatccttttgaaaaaaaatgataccactcgattcgtattcaaaaatacttttttataattatatttttcgtgttatataaatattacttgttggccaaagtcctacatcctatattttaaaaccaagggagcagtaaacatcgttggtgaaatctagaataatgatccatagttacaacgccagcaacaaacacggtataaaacagtaatcatcgatcctgcaggttttgtttgatcctttgcacgttataaatttcacataaccatggtttgaacttggaaatgttttagaatttcgagtgtaacatttggagctaaaaatgagttcacaattaatagacgtatattaagggtttaaatgagttcacaataaaggagggtaactcatctgggtttaaaattcgttgtccacgtatattaagtacacaataaggacgttttcagtgggatttattgatggtattgggagttgctgctggtctctactccctccttccaaaaatataaggcctattcctttttcatcaaaacatcaaaaccaaaaagcaattaactcactcaccatatagcaaaaccaatgaacatgtaaccaataagtattagaatggcttcttggttttcaatcaacaatttaatttagcacacaggactcatattttttgagaaatcgaagaatgaaatatgtctcatatttttttttgaaggagggagtatttattttcttctttttttttttgagaaactgcgtacttcatccatcccataaaaaaccaatctaatactagatatgacacatcctaatacaatgaatctggacatacatctgtccagattcgttgtactaggatatgtcacatccagtcccagatttatttatttttggacggagggagtaagtagtaactctatttaagtcacatttgtacaatcgtcctcttgagaagatagaataaaacccttaggaacaaataccctgtaaaacagctagagaaacaacttcttttacgagcctatgtgctaccatattcgtcgagcaatgaactctgaaagacgtttaatctggacttaaactaacttcatgattctataaatagaacggtttagttctgactaaaataccgtcctagtcatttccatagcatcattattcaattagaacggtctccatttcttttaatgtgggttagaaacgtattagtgtgcgtatgttcacaaatgcttcattcattataaaaacttctgctagtagaagcaccagtgatgcgtggtagagttgtgggtgtataattttacccaccataatttaaattctggtgcccacgaatattacgtatatgcaaatgaactttcgaacatgattttagtgagatcagtgatgtgtcgctagtttccgtctcttagagcatgtgttaggggacatattagtggggtgttacgtgtgtagtggtgtgtgcgtgtgtgtaaaaagaaaacttccgctatataagtaggagtatgaaacatgtggagtagattcggatgaaactgactttttttttttttngcngtgatgataatttgactgtcactgtcagtcgttggctagacgttaatactcctacttccgatagattataaaaccaaacccctgcagcttcgcctttgctcgccgcgtcttcccttcttctctctctctcggncttaactaaacccgaatcttttctcttaatcccgggcgcagtgcacgaatctcaaagcggccccggctccttccccttcaccggcggcg

SEQ ID NO: 1994 - DNA, 2000 bp, Oryza sativa
cgctgagcccctccgtttcatactatactgctcacgatgagatacagtaaccgcgcgctttgctatagctgcatgttctgctttcgaattcgctgtgcacgacggcgatctctcatctcccgcggctcatcccgcgaggagaaaaaaaagaaggcgaggataaccctgtgacgcatgcgggcaaacatggccacacgtagaaacagtctcgttacttcgttcaccggtgatttttcatttttcatgctttggctgcctcacaggtcgtattctgctcactgttgcatggttaatgtcgaagcaaacggggaggtttgcttttttgtcgagcagtcgttgtcgccccttgccgtcggaagcatggctaattaagccaagatgacagccgtagctagctccgctttgtccctgagtgtttcggaagcattcgctgtccggccacagatacacacacttgaatttgctcatattggttaaaagctggaacgctttttgcaagggtttcaaaaatggaagggaagaagacctccgttgttaccgatccaaataccgtctactagtttattgccggctagaagctagaaacgtgtaacaagtccatctcacagctgtgtaagtgtaggttaggctttggcttttgatccattgatggcgttgaaggttggcaagagaacgttgaaattttaacgagaggcttctaacggtagttgcaacggcccacgtattgttgacattttcgcatttcaacgtctcgagctacaggaacgatagcgtaaactacacttattgagtggtatagacataatcgcacagtgacacacaaacatcacgcacgcaaaatcacggcatattgttccgcagctaggcgctgcaaagacagcaacaatactatactacacagcttcgttaacacgatctttgacggtctctgaaacagtgacagggacagttcagaaggttgaatcctaaacacatcggttttcggagctcaggcaagtctctagcaaaaaaggaaccaaacagaagatgcctagagggaaagcgtatgtgccgcagtgattttcttgttaaatcacactgctaatatggcttgatgttcttaaccgtttaagattagagcctcattatttggcttatgatttatatgccaatattaatatttgaattctaaaacttgattttaaagttgatttaatattatttaaaatgtaatttttatattaacttttaagtcgataaaaacacatatacaaaattttaattataattattttttaactattaatgtgccattatggcttataataagaagtaagcaacaaataagaacatagattattaacccaattattagcacgattatataataaaataaattaacaaatagcctggaataataataatcttaaaaatacagtagaaaaaatgtagtaatgttttgtgagagaacttatttttagatacttgaccaaaataatccagcaaaaaaaccgggcagactgtgagagattagagataagacggcgccacggcggacgccctttccgtcctttttctctcgcgcacacgccgttagacaaccggagcggcgaccagcgcagtcaaacccccccctagccgtccttccccacaccggctcaccgcaccgccgcgaaagcccaaaaacgcaccggagaacccacccaaaaaaaccgtaagggccccaccggtcagcgacaaatctcgcacacgccacggcgccacgtgggaatgttcccccaccctcgtcctcgtcggcccaaggctaaaagctaccgccggctacgcgtccccagcgcctccctcccgtccctttaccgttaccattaccaaactcgtcacagttttaccgctcctctactcatctcctctctctcttctacctcacttcaccaattccttctcctcccatctcccaatcccccaccgcggcgcccaatgcagcacaaaccctagccctccctccccttgatctcgcgcga

SEQ ID NO: 1995 - DNA, 2000 bp, Oryza sativa
gagatgatgtatttattagtggcccactttaagataccatgggttgtagagtgtagtttatattatgatgtcttattgagatgacatcatagacactacttatagacactataggttgggactgctcttaaagctgcgtttcttggagttttggtttagatttttagcagcacggggaactagaaggttattagtaccatattgttgtttgactattaattattattataaaattaaaaatggattatttagctaaattattttacaattctgtatcgatttttttctttacaaaatatactttgcgcagttcaagaagcttactaacacaaaatgagaaaatagcctagctagccaagaagtcgttttgggggtgtttgattttagccacactttatcataccacacttttggctaccgtagacatatgtttagttcaccaccacaaatgactcgccacacttttcaatagcatgttctttatgtcatagactcaactttcttatcaactttatacacttttatgactagcaatttattcaccacaattttatgtcagtcacaacttacaacttacgtaattgtggcaaaaaaatatggttggtagtcaaacgtacccttagaacgataagacaatcatcctaatataacgggaatataaactataaattgattgcttgtactatgagaaaccacaacaaaaaatacatatatgttacctttttaggcatgttaaatttgtagtccagaattaactttactaaaatattgacatttttttaagtactccacgtgttcgatttgtagcataatcaattttttgtagggcttttacgagagaaaacattggaaagtcccaaatcctgctaggatagcaatgataagtgtatttttggttcattactttactgaaaattgataatactataattaaattttggtaaagttgaaaatagcaaccaattgctatttacacatgtaattacatgctatttacattgcaattatactctaactatatcattgttacatttgaaatatttttgagggaaatttctatcggatgttggataggtagtagtcccattaaacaagcccattggatcttttaccgcattcccagatccacgaacccggaaggaagctatcccagatctagtattccgaaagcgaccaccgaatttgttttccctttaaaaccccccaatgaatttcctaatcccccttttcgctttatttattctcttccaaccaacaaaaatactcggcgaaatattttccgcggcgccgcgcgtaccgttcgtccgtcgtcggtggagtggaggctgccgaactgtaaagctcacgggttgggcgaatctccactcctcactcgccccccactgaaatcgccaaaaacccaactgaaaaacccccccaccggaatcctcacgcacacacctcgccgcggaagctgtggcgtccgcgtaggagcagctgtttcttttttggatccaatccaatcggtgagagcaattctctctctctctcttgcttgcttatagcgtcctggttaaaaggatgggggggttcttgatgttctttggcaagatccggtgaggccgctgctttgcttctgtgaggcattcgtggtggcattttctgtccgggctttgggttgatctgtttcgctggtgagaagcgcttttaactttgccttaggattttgctgggagagcttttcttctgcttgattctttgctgccagcagttaaatccaaatctttctttcttttgctgcgttatatagatagagtatatagtatgctggtaaatatggcagttcatgctcaaagttttccccattgtccactttggggtcagctactaggtctaaatcgccttggatttagctgaattgtttgtatagatttgcattgcattcaccctcatggttagtaaaaagagtgaaaagaaaaaaactgatttcttgactgtacaattcctcaggataagcagcc

SEQ ID NO: 1996 - DNA, 2000 bp, Oryza sativa
  misc_feature (1071)..(1071): n = any nucleotide
ttgaagatcgccatctatctacaattgttggcaaagacagatcctcttgtgctgcaacgtggagttaccaaggcagttgcattgaattttgatttgccagttagagctgtgcagcaagtatgacgcagtggacaggattatggtgggatagaaggtgtgataaacaagttgctcacaagttgtggttgcaaaagagtacaaatagatatggaatctatcagagacgtgcctttgagagatcgcacaaccattcaggatcttgccaatgcgctcggtgtgaagtagtccacacttcataggcattttaaggaaggccagtttcgttgcctacacgcattaattccatacatgcatgcatgcgttacgaggaggcgtcagcgagattaccaatggcactagctctatgtgatgattaatatggcatttttggtttttgctagtgggatgatcaatttgggaaggagggagtatttctttagttagcaattattaatcattaattcaggattaggcagcaagctcgctgcgcaaccccacgagctcgtgcgttgccacgagtttgcttctttgatatgcggcagtagtatattttttccagtatattttcaaatatcactttgtgtcttttgtccacggcaaaacgaggttactagagcacacataaaaatggaagataggtgaattttaatactcttatctggtacattagtgagcacacttggtttatgagcttaatggttatgaactcaccagattcaaatgtcgccttctttagcgtgttaggggaaatgcatcttgcccctctctaataatgtattttgtattatctagttataataaaacctcacagggcatattcttttaaatatgttatttctttcacaatggctcgtacaatgtaagttattgcataatgcaaatattccattttaaaaatagttttggttgcctttggtgattggagtagctagttttatttctttctaaagtttcgaaagtacttacaattagcatctccatgaaatgccacaaagcactcaaatacttccttcaatcataaatatttgatanttatgacaagatttggttttaaaactcttttaatcaatcttatattagaataagtttacaatatcatgggatggtattttccaaggcaagactagtatttgtgcatacattttcatttgagaaataattgattatcaaagttttaaaagtctgaacaaatcttaccccaaaacatcaaatatctaggacaagattttgtcggacctctaacacttcaaccatcaataatatcttgaatgtgtgggttagagaaaaaatacggtatacccatatttaccttgaaaagcactattaaaatatcatagattttataaacttaatataatataaaaatgttgatcaaagttttaaattttaaccaaatgttgtcataacatttataaccaaagtgagtagtttattacaaatctaccaaaacgattggtcgaatatattcgaagtactgaaatcactacaataaatactaaaaagatttatacaagataactaagtaatggatagaagcaacttttttattttgcttaacttgcaagggaaacactgaaacatccataattacaacaattgcaaatttgccacttgtttaaatcgttattgtaaaactaccactagaaatatgtaaaattaccactagaacgatcattcgatggtatccttacaaaattaaaaaaaacagtagcaaatttacaaatgtcaataaataattctccacttgaatatttgaataggaaacataaataattttgcttgaataatatttgaagggagagagaggctgaagccctaaattcccctcctccgccgaccaaaagccctaaaccctaaccccagccaacgcgtcttcctgcccatccccggcggcggcggcggcgtcagcggcggaggtcggcgactagtaccagcgaggaggaggagaagaaggcaaccgg

SEQ ID NO: 1997 - DNA, 2000 bp, Oryza sativa
  misc_feature (7)..(7): n = any nucleotide
  misc_feature (1411)..(1411): n = any nucleotide
  misc_feature (1431)..(1431): n = any nucleotide
tgtagantgaggagagatcgagagtgtctcggctttcatcaagcggtatattcatcatcatttcgtccatcttctagctgacttatactccatccgttttgaaatatttgacaccattgacttgttagcacatgtttgtccgttcgtcttattcaaaaacttttgtgaaatatgaaaaattatatgcctacatagaaatatatttaacaataaatcaaatgataggaaaagaattaataattacttaaattttttaataagacgaacggtcaaatatgtgctaaaaaatcaacggtgtcaaatatttcgaaacggagggagtatacgctaatagaagcactagagtgtataagtggaggcattagtagctcaagtggtatcgtcttaataatagaaaaacagagtagtcgtttgtttttaagttgtttttttttcttaaattcctcctgatctcgttcggaacttggaaatatcacttcacaagtgacagtttgatttcctcttgtgtttatgcattattttgtgaccgactaagggcgttttcaatattctcattttctaacttatactttctaatttttcaacttatactttctctttttttcacgtgtatattttctaaaccactaaacagattttctttaaagtttatgcagaaaagtttcttaaaaaattatattaatctaatttttggctaataactaaataatcttcgctaattaatcactttgttttacgagtgataaaatggttttcaaccctcgacaccaaacacagcctaacatgtgctactagtacgtgaaaaaaatatgaattttcagaattcccagaacacacgtttgttgtctcgagaaatgaataattaataaatacatgggacaaaaatataatcatgctagcaactaaataaaaaagaggaaataaaaacaaattcaaccccagagagagagagggagaggaaaaatggggtgcccatgcggccctgcccaatagcgttgctgtacctttcagctttataatctcgcccctcgcgagagagactccccccatcctgcagactcgccccactctcttgctcagctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagcccccggctgcggggttcggccaggttagctcctgttcttgcggaattctggctctttttttttttggggttgaaaggggatgatctgggtggggtngggaatggtggaattctggnttttttttttttgttctttctttggctggttttgttccgtggggattgaattctcggttctcgtcacctcaggagtggtgttcgcgctgcttgttttggttgatctgtgaattatgggggaagacaccaccttttctctcgtttcttgcacttaaaaatcgtctttggtgagctgttgtgcttggggagctcttgagctgagcaggttcggtttaatctttgattgggttctatacttcactgtttcggtgttcccctctgccgaatttgggaatcaagaggttctgatccatcagtatcactcggctttctcgtcattgcatatgtacaaaacctgcttttttcaatcactcatgtagtcatgtctaattggtttgtcttttatcatcttttggtgtaacttgtctgtgtcactaaccatgccataatttttttttcatgggtactatgtgatcgatttcttcttcttcttcttcttcttcttttttaaatttttacctgtcataattcaagtagtagcagtagtaatctaatctaaagcttccaaattttccggtgtagttgagacg

SEQ ID NO: 1998 - DNA, 2000 bp, Oryza sativa
  misc_feature (509)..(509): n = any nucleotide
  misc_feature (619)..(619): n = any nucleotide
aggtcctcgaaggtatgtaaacgcaaccacctcaaaatgatcgttcatcacacagcccttcagcagcatgacatctgacggcacaaagcgagatctgaatcaagcaaacgcatgctgttgctttaaccactgttttccatttctgacgaacattgcaggagtgaacctgtcgttgctttcacgagtaatgtcgtcgaggctcgcgcgaggaacctacaacggcggcctcctgtcgacagaggccgggacgctggcccgtgtagttgcagacgcgacgattaccgcggcgggttatctaggcccggacctcctgctcaacatcactctgctgccacctcttgtcatctgcatagcctccctcgttgcaacattctgcacatacaacaccctgtactaaggaagttgcctctctctgcacactgtagagccggttaaactttattcatgctcacattgggttgtattttacatgtatctgcatgcggtagcattctttgtttgtacaagtncttaaacagttcaataaaatgttcttctgtaaatcctacagatgttttctcgatgcatgtttacagtccttatgcattttacatatgtattcatttttcctatatctgtnaaaaaaatttcttgatctgtaccaatattatgagttatgaggttgaaaagacacatgcaccatggacaacattttgcgtgaaggattgccgttcttttctattgaatttgatgcatcgattgtgaccgcccaataactctagtgccaactgcgggggcatgaccgtgtccgggttcaacaaagggcatgtgtagttggtgaaataaaattttttgggtgtcacatcggacgtttaatcggatgtcgaaaggtgttttcggacacaaataaaaaaaataatttcattactcgcctggaaaccgcgagacgaatcttttaagtctaattaatccatcattagtacatgtaggttaccgtagcacttatggctaatcatagcttaattagactcaaaagatttgtctcgcgatttacatgcaaactgtacaattagtttttctttttatttatatttaatacttcatatatgtggccatagatttgatgtgatattttttggaaactaaacatggccaaactctgcagaaccgagctgtttcaaggattgggacaatcgtttttatatgggccgtgcccctgaatctgcacctgcagactcgcgcctgactaggtcgcaatgcaaccagaaaagggacgctagatctgaagcaaagcgtcggccacgttcgttcgacgcaacggaggtgatctcggtggtggttgtggcggttaactccttcttacccgttctttctcacgcttgtggcgtgcattgtcaatcagacgatcaccgtggctgccctgtgctagcgtgctgtactgtggcatgtaagatgtcacgcgtgagcctacctggttgcgaggcgatttgctcgagcatgtcttcagtgcagacgatgctgaaaccgctgtgtcgccgaagctgaaagagagtgacgcttatcggtcaaacgtcctccggcagacgttgaccacatttctggctgaaaatccagtgttctttttgcttcgcctaatttcggcaattaatatatgtgttctatgattaaacaaagtgtgcaaggcgtgtctagtcagtagtcactggtgtgcagtaagcacgatcaacttactaactgatgctgcgaaagagagcgtttcaaacgtgaactagcatcagctgcagctgtcaagcccaacccatgcaacaaccactgccctctctcgtactctgcagcagcgtgactatgcgcgctatataaaggatcacattatctcatacttggtcacacagaaaattaaaccgtactctgatacttcccgtgttacgcctgtcacagcttacttacattggtcgccaatggcgtccgacatggacaccacacgagcgctggccatcttagcggccacaagctttgttgca

SEQ ID NO: 1999 - DNA, 2000 bp, Oryza sativa
agataatcgtagagctcactatctactattagcctatcttaaagtcaacatatataatagattagctataagattggttacacttttcttccctatctctatctctcacttatatatttattgtttttttatcttggagtttgtgttaaactagcttttgtatgagagccaacacatttaattttttattacctctctcatccacataagcttacagcaagcttatagctctagctcacattatactcgctctaacactcaacaccgacaaccacattgtttagggagaagctgtctagtgaaagggtggggtggtccggtaccagagccatccgagggtggaggtggtagtgctgctataagtctaaaaataataagtctatctactctttcggaattgtaaatattgaatgagatgagcatatttttattaattttttcccccacttctcgattttcatgcggttgttcttctaaatattagactttcaaaaggtttttctaatgaaccctttttttgttttttcaaaggtcagaaatcatcaatcatgatagtaatatattatggtcaataagtaacttttttggttgaagtttgattacttatgctgttaaggagaaacacaagagaaaagtatgatagaaataggatgttgtgcctgttttttttcttgtggctatttatttggtatgaataatttgctgagatttatcctaaaatttaacaaccaacaaaatggctcgaaaaggagccagcttattattgccgaccgttcgtcttattttaaaaaattatgaaaaagttttaaaaaaatagtcacacataaagtgctatttatgttttattatatgactagaaaaaatgcccgtgcgttgcaacaggtaaagacgtttttttatatataacaactattagaagccgaaccaataaattaaaataccgggatcactatatattataattaaaaaagttaatgaaaatcatttctttgttttgggccgaaacgttattccttcctttcttttaaagaaagtcctagcccagtttcagtacctccccatgcttggcctataacaggcccaagccacaagcacaagtagagtcgttacattcgtaggcccaactcacatagtctactgtgatcttcaacctccggaagatattctatgcatgcacgatgacaaagccgatccttgtcatcaaatccaaccgaatctttcttgatctcctaaaattggttgagggcttttgatccactcgatctcttcttcctgtttccctaaaatcagagagaattcacaaaaatcaggataaaaaggcgaagctcgctggtcggccatcttcgatggaaattaaatccaacaaatgaaaaccttgaaagagcaaatcatggagaaaataatgagttaggagtggggaatcgatttttgtaatcaataataggaggaaacttacgggggaggcaaatcgcggcggtgctagggtttggcccgggccctaagagcggtaaaaaagggagatcagattgcactgagtagaaaaatacggagaaacctaatcggactaaaaaaccggcgagaaaaatagacgaaaaaaagaaacatattcaattaaaactgaaaaccgattcaaaaaccggatgacgtaccaaaatctcgataaaacattttcaatttttataatagtagagaaaaaatagacataaaaaacatatttaattaaaactgattcctcaataaaatctgaaaaccgattcagacacggatgacgtaccaaaatctcggcaaaaatatctctaatttttataatagtagagatataataataaaaattttaattataaaattttttttaaataagatgaatggttaaacgttggatacgaacgacttattttgagatgaatgagatggagggagcagcagatgtctgtttatgtttgtgttaggtagggcccagaagagaagaggaagaggaaggggccatggcgccgccacaa

SEQ ID NO: 2000 - DNA, 2000 bp, Oryza sativa
  misc_feature (41)..(41): n = any nucleotide
  misc_feature (1970)..(1970): n = any nucleotide
attttgttagtaatgcgctgtatgtgttaattgattgcgcnttttttttttgcattacatttgaatttgaccgtattgttccctggtagctatatttatggactttattgttttgagtattattgtagctagcaagtcactttcatccatgtagtttgagatggacaagcggctcgctaaaaggcgaaagctgatgtttttttcttttgggccattgctttcttcgctgctgctattgtgactttgtatgccaggtctagattaatgaaaagaagacaggaaatatttgactgcctaaatactagaatttattacaagaatgattcaacctgccaaaaaaaatgttagagctcctttacttccatttgtgtgaagttttgaggggatgtgaatcatgtgacttgctttgtgataccatacatgtagccactgtttgtttgaggggtaggttgatttttgtaattgctagattttacaaaactgcaattatttggtcaaaactatcactttgctgcaacttaactaggtatttcacaaaactttaactagttgcaacattctgataaatcatgtactgttgttaccgttctctgaaatgcttagttaaagttgcagcaaactgaaatttactcaacgttatttgaacaactagtattgtattggagccattgatggtacacatatatgggcaactgttaggaagtctatggaggcttcttttcatgataggaaagaacatgagaacactctctctcacttttggtacagcacaacataagcattgtaaatacccaatgaaaatgttatggaatttagaaccagacattaaagaaaggaatgagactgaggctctgttcgttccctagggttcccaactccccaacccttgttttccgcgcgcacgcttttcaaactactaaacggtgtgttttttgccaaaagttgcttaaaaaaatcatattaatccatttttgaaaaaaatagctaatacttaattaatcacgtgttaatgcgaacatcgttttacgtgccggggaggaacccctcctcccgaacagagcctgactactgaagccacatctcaacaagaactggatacagaatggtagatttgccacctatctcctgtcttcgtgataacttaacgcatagcggagcggggataggggcctgcctcggtgtcggtgggaaggctcacactcagccctgtgaattgattttggacgtcctttttgaaatatgagggcggattttggatttttcatggaggcagtttctgaagttccctttgattcttttttcctaggaaaaaaggttcgttcagtctgaaccaggggcatgttcttgaatgagaggctgaaagacctgttaatgtgtcatttagtctcagctgggcctgttatcaggagtaaatcacccactgagtccaaatgtttagagtattgtatgctcatcatgatgctgtaatttaactgttatctgcctgttctgtgtaatgtttcatcttccattttcatattcctgtaaccattgaaccaattcaatggaataagtctctgttaacattgattcaggttttagaaatgcattcactggtaatttcaagctggttcgaaattcttgaactttaacactagttcatatgtttggagcatgtagccatggtcagcaactgcaggaaattcttgaacttgaactagtgcagtgcaaacaagacagtctctagtaaatcacctatatcatacatgcatataacttacacatatttccatattatcatcttttgtaatagatgcaatagttctgttcacctttttctgacaagtaattctctcaaaactatcatgatcgttccatacagaagaatttcctttagtttgtccaatgaatgaatggagaaagggctgtgctcaatttactcatagttctgttttgacacagattggagtatgattttgaggatctgaatnaaagaagtcagtaaaatcatttgtctctca

SEQ ID NO: 2001 - DNA, 2000 bp, Oryza sativa
  misc_feature (194)..(194): n = any nucleotide
  misc_feature (199)..(199): n = any nucleotide
  misc_feature (257)..(257): n = any nucleotide
  misc_feature (259)..(259): n = any nucleotide
  misc_feature (261)..(261): n = any nucleotide
  misc_feature (263)..(263): n = any nucleotide
  misc_feature (268)..(268): n = any nucleotide
  misc_feature (349)..(349): n = any nucleotide
  misc_feature (540)..(540): n = any nucleotide
  misc_feature (623)..(623): n = any nucleotide
  misc_feature (633)..(633): n = any nucleotide
gctcacgtttacggctaattataatttcagtggtaagcgacatacccatcgtcagtgagacgtccgtggtaacttcgacattcttaaattataccaaccaagtcatttggatgtgcttatatgggtagagtggttaatctatatcgtcacagttttctaaagatactcatggagtagagtatgcgttacggttnacttnatcattttttaaagtaaaaactactctatattggtttactgaaaactggtaaaaaccnangngntctcngtccacgcggtacggaaacaagctaataatgaccagcttccacaaatcgataagacgataaccagccgaaaaattaatggncttggtaaagtttggtgtacgtgtgtttatagcgatgagtaacaaattctggagtatatgggtttatagcgatgagtacgggtgtactgtggtaaataaataaaggaaaaggcaaacccgcaagctggtccagtccgtaaataaaccaaccgcacggccaatgctgacgagaaacgcggtacgtacgggcnccgagccgcgcagcgagcgaagccgaataaataaggcgcaaatgggaagcgaaaggaggcaggcagagaaagttaaaaaaaanggaaaaaaancggtggcgcgctgtagcggcgtgcgggtgcgggatgcatcatgcatggtgggattggtggtggtgtcgtactactgctgtttcgtttcgtaccggaggagggagaggggagggagccgggcgtccagaggaaggaatcccaaaggacagcaaataattgaggcgagacgcgagcgtgtgggccccacccgacgtcgtcctctcatctccccgttttacccttcacacagatcccattacctgcctgagcctggcccaatccggtcaaaccttttgcctcacgtagtataaaaaaaataatactgacccgttcatctcatttcacgttaaaattaaaagtttggttgaaattaaaacgatatgatgaaaaagttgaaagtttatatataaaaaaattttaatgtaatgtaaaaattaaaagtttaaagaaaaattttaaaactaaactcggcctcggttaaactcgaggtgtacgagcagtagcagcgggttgcgtcgtggtgggggtggtattatagcagtagggctgtaggagtacgcacaataatgcatgtgccgtgagtcaccgtgcaccatctccccggtgaggtgcaccgggacgaacgaacgaacgaacgaacgctggtgcacgccgcggtacgagtacgagtacgtgtggtggtggccgcagcagcggcagcgcccccactcgtggtgctgctgggtcctacagtgattcgcaccaccaccaccacgcccctgcctcctcccgctaattacccgccgctgccacccccgactcccgtacgttgccgccccaggacgccactactgcgtacgcgaacccaacctcctccctcccgtgcgtgcgtgcgtgcgcgtgcgcgagattgcttggcttccccttcccacgcgtcgcgtctcctctcgcgccgtctcggcctcgactcgatagtcgataccccctctcctcctctcctcttcacctcggtctccgtctcctcttcaaaccttcctccaccttcgtttccccctctccccttccctccccttctctcttccccagctcacgccgaccgcgcgatccccctggttggttggttgcttccttcatccacttttggccgccgattcttccatttctcgattccgatgaggtttacgtgaagaggagttgaagagaggctgcgtgaggtgccgtgcgtgaaaaggtaaacgggggggttgtgatcgatcgattgctgtggatgttgtgtggagtttttttttgggttgctgatgcggtttgatttgatcggggtggtgtggtggtggggtttgcagatccggagaggggtggatcgggttttggccggcggcgagtggcggcggcggcggcggtgttgagag

SEQ ID NO: 2002 - DNA, 2000 bp, Oryza sativa
ctcttgtgcagcaatcactggccgtctcccgctgaatagaacatgcttgggtacacccacaaggcctgcagctggcggtaccagtttcttttgaacacgaggttgtcatcagtgttaggatcccacacagcatctgcatcatcacccaacccatgcaggctcaatggctgagagtagtgagcatagtacaagcagttgctcctccctccccagcgctccgggttcttgaaagaaaatggaggggctcctgcatcacccccaatgaagagtgcccagttctccagcttcttacctccacccattttgcaggcttggtcgacatgtccagacggtatggcctgtagaggaccggtgctccaaatgaaaaacttatgtagtggtcaacaatgagaagcatgtcaccacaaaccacaaaccatggtctcatatacggacattcattcatgttatcccaccagagagtttttatcttttccaagcgaagaatgggggccaactgcaaagtgtacagactgtattcaatcacagcgatgagctgaccattgaattccacaatctgatcgacccgattaacgggcagcttgagctcagaccaagagtcacttccaactggccaatcaaacagggaggactgagtgctgataatgagatgtgagttaggtgacgtgataggagccgtcagaatgccacagtagtagaactcatcacagttctcactgaatggaaggcgtggaggtgaaacctcagcaccggtgaacacatcaacaacaagacaataaccacggcggcagcagatgagctgaccatgggaagaacctgcaaaatgcatcctctgcagagtttcttgaggaatctggcagcggagtggggtgtttcggttggctagatcaatgacctcacacgagcgtagcttgcgatgaccattgctgctataaggggctttgacgcggacattgggtcggacgaggaggggtgggagtatggtgcgaaagttagattttgatgggtaggatgagaaggcagcacgccaagaatggcaggtgccagtgaaggcaaggaggtcaaggaaagagcccaatagagcaacaatggagtgaagcaggccctctgggagttctgcccaaccttcgatcacagacgtggcagggggtgctgagccagaggcttcagaaaccttgctggggctttgcatgatggagtattgctggactccctgcaacacataatgaattcaaaaaccaattagaatggtgaaagcctgctagaatttcagctaccaaatatatgcggaagatacctcaatcgtcattatacactgaaaataaaaggcaaagatcttgattccagcaggtacattttttatgttcagggagaaacaatagcatacaggaaaaacagtagctcgtttttcttgaaaatgcatgcatgcctgcttaaagtttaaaactttctatgtgaagcccatcattgtattcaaataatgtaaaaaaaaaggcctgaaatattttctgttttgatgcctatctctatttgagggtcaaattatgacaaaaacaaatattttctgttttgaggccttcctcaatttggggatccattcatgcatggcatcaaaatttctgttcaggaatcaccacattgcatccaatttcgcgcattttgttttcacactagtagaggcacgcgcacctatacgctctcataaacctacgttttttttttcacgaatgcgcaaaaggattgcgcgtcaatatattagaagaagatagtagagtttggttaaacattgcaaacgatcaggccgttctcataaacctacgtgatcaaccatgtcaatctagggttcttcgctagcacatccaacaacaaaatccagtgcaagatccacccctaccaacgcggggtagatctcaccaccacaggacgggacgcgcttctcggttaggatcggattcggagacacgagtgacacagacacacacacgaggagaaactgagaa

SEQ ID NO: 2003 - DNA, 1672 bp, Oryza sativa
  misc_feature (5)..(6): n = any nucleotide
  misc_feature (9)..(9): n = any nucleotide
  misc_feature (21)..(21): n = any nucleotide
  misc_feature (23)..(23): n = any nucleotide
  misc_feature (30)..(30): n = any nucleotide
  misc_feature (40)..(40): n = any nucleotide
  misc_feature (55)..(55): n = any nucleotide
  misc_feature (57)..(57): n = any nucleotide
  misc_feature (62)..(63): n = any nucleotide
  misc_feature (65)..(65): n = any nucleotide
  misc_feature (68)..(68): n = any nucleotide
  misc_feature (72)..(72): n = any nucleotide
  misc_feature (74)..(75): n = any nucleotide
  misc_feature (77)..(78): n = any nucleotide
  misc_feature (80)..(86): n = any nucleotide
  misc_feature (88)..(88): n = any nucleotide
  misc_feature (93)..(93): n = any nucleotide
  misc_feature (97)..(97): n = any nucleotide
  misc_feature (101)..(101): n = any nucleotide
  misc_feature (106)..(106): n = any nucleotide
  misc_feature (108)..(108): n = any nucleotide
  misc_feature (110)..(111): n = any nucleotide
  misc_feature (113)..(113): n = any nucleotide
  misc_feature (116)..(117): n = any nucleotide
  misc_feature (119)..(119): n = any nucleotide
  misc_feature (139)..(139): n = any nucleotide
  misc_feature (143)..(143): n = any nucleotide
  misc_feature (147)..(147): n = any nucleotide
  misc_feature (149)..(152): n = any nucleotide
  misc_feature (154)..(154): n = any nucleotide
  misc_feature (162)..(162): n = any nucleotide
  misc_feature (170)..(170): n = any nucleotide
  misc_feature (172)..(172): n = any nucleotide
  misc_feature (178)..(178): n = any nucleotide
  misc_feature (191)..(191): n = any nucleotide
  misc_feature (194)..(194): n = any nucleotide
  misc_feature (201)..(203): n = any nucleotide
  misc_feature (206)..(206): n = any nucleotide
  misc_feature (212)..(212): n = any nucleotide
  misc_feature (222)..(222): n = any nucleotide
  misc_feature (226)..(226): n = any nucleotide
  misc_feature (234)..(234): n = any nucleotide
  misc_feature (238)..(239): n = any nucleotide
  misc_feature (241)..(241): n = any nucleotide
  misc_feature (262)..(262): n = any nucleotide
  misc_feature (265)..(265): n = any nucleotide
  misc_feature (271)..(271): n = any nucleotide
  misc_feature (279)..(281): n = any nucleotide
  misc_feature (287)..(287): n = any nucleotide
  misc_feature (294)..(294): n = any nucleotide
  misc_feature (299)..(299): n = any nucleotide
  misc_feature (302)..(302): n = any nucleotide
  misc_feature (304)..(305): n = any nucleotide
  misc_feature (307)..(307): n = any nucleotide
  misc_feature (315)..(315): n = any nucleotide
  misc_feature (318)..(319): n = any nucleotide
  misc_feature (321)..(322): n = any nucleotide
  misc_feature (338)..(338): n = any nucleotide
  misc_feature (345)..(345): n = any nucleotide
  misc_feature (353)..(353): n = any nucleotide
  misc_feature (355)..(355): n = any nucleotide
  misc_feature (370)..(370): n = any nucleotide
  misc_feature (373)..(373): n = any nucleotide
  misc_feature (376)..(377): n = any nucleotide
  misc_feature (387)..(389): n = any nucleotide
  misc_feature (392)..(393): n = any nucleotide
  misc_feature (400)..(401): n = any nucleotide
  misc_feature (412)..(412): n = any nucleotide
  misc_feature (420)..(420): n = any nucleotide
  misc_feature (425)..(426): n = any nucleotide
  misc_feature (429)..(429): n = any nucleotide
  misc_feature (432)..(432): n = any nucleotide
  misc_feature (435)..(435): n = any nucleotide
  misc_feature (439)..(439): n = any nucleotide
  misc_feature (442)..(442): n = any nucleotide
  misc_feature (448)..(448): n = any nucleotide
  misc_feature (466)..(467): n = any nucleotide
  misc_feature (476)..(476): n = any nucleotide
  misc_feature (480)..(484): n = any nucleotide
  misc_feature (492)..(492): n = any nucleotide
  misc_feature (494)..(494): n = any nucleotide
  misc_feature (498)..(502): n = any nucleotide
  misc_feature (504)..(506): n = any nucleotide
  misc_feature (509)..(510): n = any nucleotide
  misc_feature (512)..(512): n = any nucleotide
  misc_feature (514)..(514): n = any nucleotide
  misc_feature (517)..(520): n = any nucleotide
  misc_feature (522)..(522): n = any nucleotide
  misc_feature (528)..(528): n = any nucleotide
  misc_feature (537)..(537): n = any nucleotide
  misc_feature (539)..(541): n = any nucleotide
  misc_feature (544)..(545): n = any nucleotide
  misc_feature (547)..(550): n = any nucleotide
  misc_feature (552)..(553): n = any nucleotide
  misc_feature (557)..(558): n = any nucleotide
  misc_feature (565)..(566): n = any nucleotide
  misc_feature (571)..(571): n = any nucleotide
  misc_feature (574)..(574): n = any nucleotide
  misc_feature (576)..(576): n = any nucleotide
  misc_feature (578)..(578): n = any nucleotide
  misc_feature (585)..(585): n = any nucleotide
  misc_feature (587)..(587): n = any nucleotide
  misc_feature (593)..(595): n = any nucleotide
  misc_feature (600)..(601): n = any nucleotide
  misc_feature (603)..(608): n = any nucleotide
  misc_feature (616)..(616): n = any nucleotide
  misc_feature (620)..(620): n = any nucleotide
  misc_feature (626)..(627): n = any nucleotide
  misc_feature (632)..(632): n = any nucleotide
  misc_feature (634)..(634): n = any nucleotide
  misc_feature (636)..(636): n = any nucleotide
  misc_feature (638)..(638): n = any nucleotide
  misc_feature (640)..(640): n = any nucleotide
  misc_feature (645)..(645): n = any nucleotide
  misc_feature (655)..(655): n = any nucleotide
  misc_feature (657)..(657): n = any nucleotide
  misc_feature (664)..(664): n = any nucleotide
  misc_feature (667)..(667): n = any nucleotide
  misc_feature (673)..(673): n = any nucleotide
  misc_feature (677)..(677): n = any nucleotide
  misc_feature (685)..(685): n = any nucleotide
  misc_feature (689)..(689): n = any nucleotide
atacnngcngtggggggagananataaaancccccccccngagcggggaagtatntntacannangcncggngnncnncnnnnnnngngcccnaccnccanctccnangnngnaannangggggggggggggggggggngggngtgncnnnncnacaaaaanaacacagngnggaggngtatatggtggtnganaaaaaannnaangaaganatttaatttntttntatacccncccnncngtggaaagagaaaaggcgtgnttnaaatantaaaaatnnnaggagnggggganttttngananncnaaccaggngcnnannggggggaaaagtaganaaaaggngcatgagnanacagggataaaaagnaanccnnggggagtggnnnagnnaaaaaannaaaaaaagggngagaaganaagannggnganacnatanagncacganaggtgagagagagagagnngtgagaganaagnnnnnatgtagancnaacnnnnnannnacnngngngannnngncactcngaggagagngnnntanngnnnnanngagnncgagaanngaganatncntnagagagngngggtannnagagnnannnnnngagcacanggangagagnncgtcntnanangngagantgagagtgancntacatanacncatctncacngactcacngtanctgaccagccgtgtgtctctctctctctctctctctctctctctctctctctctctctctctctctctctctctctctctctctctctctctctctctctctcttttttcaactgtgggggagaaagaaatgatgtgaggttcttgtcatgcctggctagatgctgcagctggctcatgattaatactggctgctgcggagctgtggtggggaagaggtattttgttctcttcttggcaatttgttcagtctgtgccattgtgtgacagcttgaacttttgaggagaattcgtcctggtttgccctatggtaggtgattttttggtgaactggtgatgttgcagttcatgaatttactcaaggattggggcttggtgcgtgcccggaactgaagagtggaggaggattgtgctcagtgcctcttcagtcagaggtatgttattgttagctcctttggtcattttcctgtttgcacttcagtgttcttgcctttgttagtttattaagaaaagttaggactgtttgcttgtgagttgtgaattatgttgaatttggccgctctataaggtgtgattttcattggtcgccgttccaattcgctgaagatagagcgtcctgttttcaggctctgcaaattttggtatttgtggtcgttcatgttaggttccaagcttatgaatttcctaatatttggatttaacttagaaactgcagtatctgagatgcaggttaggaaaaggtggcttaactgaaaattatgtatgttctatatggtttgcttcctgctcatacagtagatactctaaattgtcagctcttcttgtttaattacatacattcactatcatgaccattttagctagttgcttaaaacttgagttcactaattttgctcttatggattgctgctcaggtatatgaacaagtgctagttctacagttaatatcagacaagtcattggccgtaagcttcctaaggcaac

SEQ ID NO: 2004 - DNA, 2000 bp, Oryza sativa
  misc_feature (1118)..(1118): n = any nucleotide
  misc_feature (1598)..(1598): n = any nucleotide
  misc_feature (1609)..(1609): n = any nucleotide
  misc_feature (1612)..(1612): n = any nucleotide
tgcatctggtgatacaaaaccaaattcatggaccttgctggacttcggttagtcttctatactctacagtcatacgtaaaatggttagatttttcgatgcgcaaatctgcggctgacctattacccttttcactcttaacaggcgatgttgttgtccatatatttcttccgcaacagcgagcattctacaacttggaagagttctatggcaacgcaacctccattgaactcccttttgagaagcagttgcagtgactgctgttttcatcttctcctggagaaattgcaggtttccacaaaaaccgagcagcattgcgccatggattctccacgtcttcctgctcatatgtgacgaactgctcggagctatagatttgcatggtctaactcgccaatgtcacctggtgactgctcgccaagttcagaagtgaggcaccatgatgccaacattctccttatctgttgttagactacgtgaatcattgtattaactatcacattagagacgataattattggtgccaagaggagtagaggccaagatgtaacacattgtgccagttcagatttcagacgcgaggatgcagtgtgcaagttcaacttaggcatcctttggaatgaaggaatttcaagggatctttgtagtatttggactaaattctatcaaaatccagtaaaattactccgcggtaaaattacttggtcgaatcctgaaaaaatctacgcgttagatacgtgccatttgccggtgtaatgttgttatctgttgctatctgaaatctgataagagttctgacgggttgcaaaacttgcaatgttcagagtgttctctgaattcttatatctgaatttctgaagactcaactgccacgggagggatggcgcagccggagaccttgtcgctggccgggcggcgggtggcgttcacgacgccgcagaccgacgccggcggcggcggctacggcggccggctccacgccatcctgcggcagcgcggcgcgcggccggtcccggtgcccaccatcgccatccgcgcgcacgacccggacatcctccgccccttcgtcgcgccgggcggcctcgacgccttcgcggcgctcgccttcacctcgcgctcnggcatctccgccttctcccgcgccctcctcccgtcctcctcctcccccgcgcggcggccgcggcaccccgtctccgacgccgccaccgcgctacccttcaccgtcgccgccctcggcagcgacgccgacctcctcgacgcggcgttcctctccaggctctgcggcgacgcgggcgggagggtgtcggtcctcgtccccgacgtccccaccccggccggcctcgtggaggcgctggggagcgggtccggcaggcgcgtgctctgccccgtgcccgacgtcgtcggcctacgcgagccgccggtcgtgccgggcttcctcgccgggctggaggcggccgggtgggtcgccgtgcgcgcgccggcgtacgtcacgtgctgggcggggccgcgctgcgcggaggctctggtggacgccgcggcgcccgacgccgtcgtgttcacctccaccgccgaggtggagggcctgctcaaggggctggangccgcggggtnganctggccgcggctgcgcgcgcgctggccccgcatggtcgtcgccgcgcatggccccgttaccgccgacggcgtcaggaggctgggcatcgaggtcgacgtcgtcggcgccaggttcagcagcttccatggtgttctcgacgccctcgccgcgaaactcgaatcagattgaagcactaccattgttcgtcccaaatccgaatcaattttagatttctaaaccgaatcttgttgcgagttcttctcctacccatccgcgtctcggggcttggaatcgaatcctcgccaagttcggatcaacgaactgccctcataagcccgcgtcccctccttcctcgcgtcgacgccgcaccgcaccgcatctccgctcgccgccgccgacgacgacgag

SEQ ID NO: 2005 - DNA, 2000 bp, Oryza sativa
  misc_feature (344)..(344): n = any nucleotide
actagcgactagcgagcacgtcaaatttgcacaggcaactcttggaagacggttgatctcgcaaggtaacaacgactaatgtgtacagcgtactacagataatcatgagtttgtattgaacattttgacattattgtaaagtatggtttgtcaacggtttgtttaacttttgacctagttaacgtgaaaacggttatctgtcgcgattgtcaggatttacgtgggccgcattgggggcgggctaacgagcaggccagcttcgctatctccggccggccgggccacccgaagccgactcgaggggcataggcccaccacaattcgcacctagctttttttttttncgttgcagcaaaaggttttctgaatctactgaatttatctagtcacatatttcctcccttttttaatatgtaatgttgttgttgttttagatacgtataatcatttgtcatattaaaaagtttatgtaattattattcattttattgcgacttgatttatgctaaaatgttttttaagtgtggcatatttttttatatttacataaaaaatttaactaagacaaatggtcaaacatttgtcagaaagttaatggtatcaagtatttaaaaaactaaggtagtaactgaaatatagagagtgtgatctgtagcaaaagtgatcagtactacaactgtttggaaatgtaatcaaacagcgttgatgaaatactgaagctggctttgatcattgcaaacgctaacagaatgctatagcagaacgcaacccttctcatgttgttggtaagagccaagaaatgcgttaggcatgtcctgctgcttaacaacttaaattaattgattacataaaaacgttaactcatccaggtatagcaaagtattattgaaagggattaccaatgtaaatattaaaattgtaatataattatagtgtaacttacacataactataatataatttgtttaacacattatttccactaaaggagtacacgtgaccaaattgcatcacccgtggttgcgctatgattttttcctttcccgcttgcagagtcttaaagtaaatataacagattaaaaatacataaaaagttacatacatattatattataattacatacaagttataatattttttgaacgactcgcataagacggtgcgaagttctattgatagagcagaagaaaaattataagattacaaccctggaagttgtaactaggaaaaagggaaaaatataccaccacccacacaccgacaacgccaaaacactgaacaaggagaaggctagcaccggaccggccaccactaaccgtggccgacctccgctaggccaacaaagaaaacacggtcgggatcgcccaaaacccaactcttacaatcaacacaaagccccgctctatccaagtattcaggagttaaggagagagggtgagagagaagaatggaactcctctccccttaggccctccgacatggccagcttgtagagactagttaggatgccgccacaagaggatgtaatctagagtgagtttgtactaattggttgggtggttttagctaggggatgcctaaacgatggatcatagcaaaaccgttacttgaatactgaagctacctttgaatctttgatcatggcaaaagcttaacagaaggctagagcaggatacaaccctttcgtgctgttacctgtcggtacgagccaacttagccaagaaatgccataagcatgtcatgttgtttaacgaattcactagcttagtagtagcttaattaactgcctaaaagataaaaaggctaataaaacggttaactcattcggagacaaactcgtactgcaaagcctacgtgaaaatcgcgtttcccgcgctctcgtggcgcaccttctttgtctgtacaagaagtctattatataccccccatcctggccaagaccacacctcgccgtcgccaccacctccctcgccgccggcagccgagcgggtcggtgccg

SEQ ID NO: 2006 - DNA, 2000 bp, Oryza sativa
  misc_feature (525)..(525): n = any nucleotide
  misc_feature (585)..(585): n = any nucleotide
  misc_feature (592)..(592): n = any nucleotide
  misc_feature (756)..(756): n = any nucleotide
gtccattgctttaattaagattcctgcttcataccaatcatgcaatctcacttaaaatactaacctccggataaataacaagaaccattattcaaactaagaaattttctcaatccaaatcatgctttgccaaccaatctctgttgaagcctcagacataaactatcacccggaagaattattgttaatcatgaggggcagcctccagcttagctgtcctggaacagtggttatgcatccaatccgaaacattatggagaccagcggtgtcagtctacacactgacaccacggatcaggattaaacaaaacctgttcaaacgcatcaaaaatacacatcgaaaagcatcgaaaacgagacgaaaaaaaaaagccctactggctccaacattatgaacagaatacggcgatacactaaaccatacagtacgtgatacgccacgggagcaggggggaaatgggggcccaacgcgtgaatcacaccacgctggatgcggggcccgctcctctggggtagccggggtangcgcatgttgtaccgagcgatgctggagccctggcccgcgccgtatctccagtggagccntgtggancggggctggccgagttggccggccatggcaagaaggaagagcagtggatcgatcgccgagacacgagcagcggacggccgcgatcgcgtcgcgtgcagcgtgctctgctttgccgcgatcggcatcggcttgcgtggccccccgtcccgtgctgccgcgttaangcggcgaaccgtgcgggccggcggggcactacgctgttgctgccgcgctgcggttgccggccggccggggtccgtgtaagtggtggcagcatcggatgaccataggcacagtaggcgataggaccgcctccttttgccgcacaaaggcgggaaatcctctatcttcttctgataagttcggtaaaaaaaaaacttctggccagtttactaccacttcgctagccctggaaactcgctggaaaagagggaggaggagtttcaccggaagaggaaatagtagtgggcacgtgggaaaatctcgatagacaacggtggaaatgccactaggattagatttggaacttgggaattaaaacagagggaatgttgtgcattaatatgatatgaaatcatttacttcccgtgtatttttgtcaataatggtatctgtagagttcatttttttatctggtatttccttgcacaaaatggagtttataaattataaggggagccaggccaaggtatgccttctagacatagtatttccttgtttcattgtttgtattttaccaaagtacaagtatagtagtacgaatattatgtacaactctgaaggctgaacttgttgcaagcagggcttttctgcctacagagctactacgtgtatttttcttgttaaatctacacacatgacacacctacaaagcaacattctgttgtaactgaaaacccctatctgtccaaatgcaaaagcctgagcctgctgctgtgaatgacagcaggatggacagaaaaaaaaaaggaacccaagcaacaacacaaggaggaaaccagaacatgcagacaacacaagcaactggctcctctcctctcctcctaccgttcagttagcagagttaacaatgtgattagctgcgtactggaggactactactagcggacacaaagccccactaaagtattcattcgttcacaattcacaagccgtcaagcactgtgccattatccccaataagtagtactccaccacgccttctctcttcttcctctcctctcctctcctccgcttcacctccgtttctttcatcgtctatctctttctccccaacacagcgggcgaaccaaatccgtcgtctcgccggggtccgggaccacctcgtcgcatgcgcgctgggtcgtagacttggccgccggcgatcgccggagttggggagcgcggcggcggcggttccgctctcgccggagcgaggggtgggtggagg

SEQ ID NO: 2007 - DNA, 2000 bp, Oryza sativa
tttgaaacagatggaattttgtggctcgcccctgcaggatagattatggacagcttgaacgttcaccgaccgtgtggattagccattgattagctacggacacgggactataaaaacacagaggtagaaaaaagcatgaataaaacgtaatgctcaatggattcctataaaatttcaaaacacatgaaagtttcataaaactagcgggaatacataaaaaacgtaggaacgcaaagacatcagaagaagaaaatatgaggtaagacctcatgcttatttaccctcaaaattgcactacaatagctcatcccataagaatttcaaaggaattggtaaaagcaaatactcccaccgtttcataatataagactttctagcattgctcacatttatatagatattaatgaatctagacacacatatatatttagattcattaatatttatatgaatgtgaacaatgctagaaagacttacattctgaaacggaggaaatactttgttttaaaggacttcgtataattattttctataagatacaaattctatggatttcctatgttattcctttcccaaatattcttatggcaagcacaaagcaaccgtagcagctatttagaaatcagaagtggtttcagagttttatgtagtactttgcagcatgctaagcatctctagcaaccttttcatcccactgtttaaatcaaaatttagtaattatggataaaaatcgcacaccaacagtccatccatcccactctccaagtcatccgctaacaaactccttctctcacttgccaaacttaactagcctactcaacttggctattcgtgtcccactacattctattctctttcttccttcatttgggagcggttggcgttgacgggagcgcctctccctcgactccgcctcaacgcgcctcctcgctaccgtggcctcccgctcgccgtcgcctctgacctcgcacgacctccaccgcctcctcccccgtatggattcgactcaggattcgtcgccgtctcctccatctactttactggagacggtgtggggatgcctacagcgacaatggggttgggagtggatggcgagctcgagctccgttgtagcatgggcaccgccacaatgtgcagtctctagagccacctcgccctgttcaccgtgcccgccaacaacctccctttctcccgcgttggttacctcgctccacgcactcatggatcttccatcgttgtccgctgtcaccgtcgctgttcgcctttgcacggacgtcaccaccacagagatggagagggccaaggaggagcttagggatgcccccagtaggagaagagggaaaggggaataaagagaaggaagaagaagaggtagtagatgataacatatggataccagtagtatagacttagagtagaaatgatagatggagagattattgaagttagcaacgagtttagcttgccaaaccaattaaagatatgcttatataggtatttggagagtctgatttggagtctgttggagatgctctaacaatctaactaatttggccatgcttttttagccttttagcagccattcagaagtattgagttcagtatttctactttattatttagaacatttgttgcaagctatgtgttaaagtctttcttcaaatattttattgaaacacttccacatttttttttggcatagtttgtgttcactgcaaaaatcactatgatggtcatgacttcatgctctctactttattgatgcacaatactagtacaattaattaaaagaactagtaataaataagacagatatagtagtattagcattcaggaaaacatttttctacattttctgcagcagcagaccaccgttcgacagtcgccatcgtccaccctccaatctccatcgcttcttccctctaaccacactccgcactctccccctcccctcccgcctccccactccgtccaccccgccgcaccgacactctcctccg

SEQ ID NO: 2008 - DNA, 2000 bp, Oryza sativa
  misc_feature (98)..(98): n = any nucleotide
  misc_feature (185)..(185): n = any nucleotide
  misc_feature (241)..(241): n = any nucleotide
  misc_feature (293)..(293): n = any nucleotide
  misc_feature (713)..(713): n = any nucleotide
  misc_feature (716)..(716): n = any nucleotide
aaatgcacgaaaaaattcgggattggaagagaagaactcaaagaagacggattcaacaaaacaaatcgagacgtatgtacaccacatgatgaaaaagnaaaaaaaatccgccagatccgccgccgaccaccgcatcagagtcatcttgctgccaaggggagctcggggagaaggagggaggcgtngagcggcgacgtcccccatggcggcgctggaggaggcagggcctcgcgccgacgancgccgcgtccgccagatccgccaccttggccgggtcgtcgccgagcccgtcnacctccttcctggccgcggcccttcgccgccgcctcgaatcgctcgccgctccagggccttgcgccgacgaccgccgcgtctgccagatccgccgccaacaccgccttgcccgggtcatcgccaaggcaacctgtcgtccacccccccgccacggaggatgccgaggtgctgtcggccacggccgcctcatccggcgccgcatccacagacggagccgaggccgcggacgaggaggacgagcggcgagtgcggcggagtgggaagagaagcggagctggcgccggacggggaggacaagcggcgggtacggcggtgcgatgagaggagccggaggggatggaatggataggatcgaatgggcggagtgggaggggaagggtaggtggaggaaattatttcttccactcgcccatgctaancgnacccaggtcacgcgcactgtaggagtagttgccttgtatagcgtctccatccaattaaggccctgtttgtttcagcttttgattcttataatttagattattaagccagattactataagttggattataataagctggcatagaataagttgtgagttgtttgtttgtctggattattgaaggcatagattattgggtctgaaaggctaaagtctataatgccctcagctatctgttcagttaatgatataggtgggtaatttttctcaagtatgtagaggtagtgggtctttagccactcaataatctgaaaaaagctcctctagagcagcttatcagattataataatctgacttatagattataataatctgctataataatctacttgtttgtttaagcttactcctaataagttagattataataatcctaaactgaatcaaacagggcttaagccacacatatatgggtgcttacactctggggtgagtgtttttgggccaactttttaggctaagggtacgggacccatagcttgcaatgtgagaggcctcagtgaacttgattattccaagtctgcgggacagaccatctctgatagcttccttgttagctctgtccacaaggagcacactgcacacgtctcttgaaggtttcgaagcgctgaaccatctcggcatggtcacgctcctggttgaaagccttgcaccactgcttatacaaggcccacagggcatcatctgaaacaaggtccttctcttctgccacaaagatcaccctaccttcgccgtcgacgtggcaggaaacgcccctaggctaaacgcataggcctaggcaaaattaggcccaaaatccctacagaatgtagactgatcatccggcccattataccaaacgtagccataatccacatggatcatacagaaactacgatccgttttggcccaacacgtttagattagcctgaaattttcatcagaggcctaatccgaaggagatccgacgaaaatatccccccctccggttcgcgtgacctcggttggtggtctccccttctaaaatctcgccgagtccacaagcgcatttaccagcagctccactcccatccatccccgcgaccctcgctgatctcaccaccaccccgacccacccgcaccgccccaccatcacatcgcccgcgtgagattgctacccaaaaatcctcacctccgacgacgaattgaggaggaggggagagagagctcaaaaaccctaggaggaggtttgaggggccagatcg

SEQ ID NO: 2009 - DNA, 2000 bp, Oryza sativa
  misc_feature (112)..(112): n = any nucleotide
cgacggacgatttatggcgcactcgacaaaagatgcacaaactaaactagaactagaagcaatataaaaaaaacgattcgattgattgattgtaggatattttttacaattnaacgggccttgtcccttatataggggttggtcttgccctctacgggccctcctccacgtccaacttgggatagaaactaaaggaaacccgaaacatgtcttcccaagcaaagaaaactcgagacccgataaaactgattcgggctcggactctgtcggtcagaccggccacatgccagcggtctgaccggcctatacacggcagtcagccggcctccaaaaggaaacatcggtagatttttaaactttggcaattttccctatttcgactttacgtgccaaattcaggtgtacacacaatctctcaagcaggataggcttaggctgtcctgtccccgtaagccatcactgaacgctgaaaacaatagaacacgacatttgtgaaatgattgctttaacatcttttctttggataacatgtcgcacattgtgtttgggatgcgtccttttgctttcaacaccccctccttgaaatgctaaaaataattttggtaataggctaagggaggtgtctagatttatttaaaaactgattttatttagaagtagtgtcttatattgatcaatttggtgttgttgccataatatagttgtcaacaataaaaaattgtttaacctcatataggttatcttcgtatatttcagttagctgcattcttgatccttgatgatttcataggagtagtaggatactatgtatagtagaactacagttttgaatttggtagccacgggtcttttgttaccgtttagatgacgtagttcatatagaatattattttagattctatgtttttttattagatattcagttggatatcatcatgaggaagctgagagttgtcccataacatggagttttttttaaatttatcttgtttttaccgtgtgtctattaacagataatttcttcgtcccaaaatataaacacatcctctactaaatatctactccctctattctataaaaaactaacttctagatataaacttggatatacatatgttcagattcatccctaaaagttatcattttagacatagggtgtatattttaggacgaaagcaataccaagatgaatcattttcattattaaaaaaatgaactgattgttttttttcagcagcgagcaatagcagggaaggagacatttttcacctgcctagtgcccttagagcaggtacatagcaggtctaatagcctgcttacctaatattttaacatatactgatagagagagaaaaatcagagagagcaaatgggacgacaatctagtcgccggctcaagcacgagcgcctaggcactctggccccctgcagttcgggacaaccaatagagaatcagaacttgaacatgcagaaattaccaatacctgacaggatatcttagttaaagcatgagtgtagtcaattgttatatctaccatcgtggtttagttatctcttaaatgattatactgaattttggagccagcagttaactctactattgaatttgctcttaccgcattcctcgattctccaacccaacggctctcgcattcatacactactgttgcagctgtcagcctcagtccgatgacaaagcagcgacaacctttttttaccaaattatctcctctccactgctacactccactccactagctcgccatttgagaagcttcgagctcacacagatcccagttactagtggtactggagtacctcactctcaccacactcccttcgtccctttctcctctctcaccaactcaaagctctcgccgaatcccacccaaagatccaaacccttttccatccaagaacgcgagaatccacccacccaccccgccgacgcccggcgatgggcgccttcgcggcggcgctgctggccctcctgctggccg

SEQ ID NO: 2010 - DNA, 2000 bp, Oryza sativa
  misc_feature (830)..(830): n = any nucleotide
agtacacgagtgctatagtgaatctgtggtattgtgtgctagtagttctcgggccaaccgttcttgtattgttttccttcaattctcaaggaagttggcgtgcaagaaaagagaaagaaacatatttcgttgttaatttatgttttgatgcaccattctgtctattttggattgatctcgccagttcctttaaaatcaaaacggtactaacttttaagcgaagctatgtatattctttccaaattaacaaatctaagatgacaggattcttcacatgaaagcttccgttttgaaaaggcagaacttaatcaaggaaaaaaagcagcacttttgttgtctataactcctttttagacaatgtgtctaccatgaatcgtgttatttgaacatactaaattttgagagaaatggattgatttgctcggccctatgcatttaatactccatctatcttacactattatgtcatttttacactggtgcagataatgaaaaagaaacgccaacgatcgatcagatattttttttttggtattgacgcaagctgagatcactctcctcctatcatagaaattaaattactaatccatcgatctcttccgtctagtcagcaagaacataataattttaaccatagcaattagctagtcaaaacgatcaataagacgataacaaattcgaccacatgatccccactatataacaccctttttatcagcctcaaatccaggtcaagtcaggatcaagtgattctaatcctatcaagggaccccgcttgagatgacggctcaaacaacatcaattgacaattgtagcaaatcccttttctngattttgatccaatcaatctagtactccctccgtttctaaatatttgacaccgttgactttttagcacatgtttgactgttcgtcttattcaaaaacttttatgaaatatgtaaaactatatgtatacatataagtatagttaacaatgaatcaaatgatagaaaaataattaataattacttaaattttttgaataagacgaacggtcaaacatatttaaaaaagtcaacggcgtcaaatatttaaaaacggagggagtactatttaacaactaacaagctagttttcaaaaacttaagaaggtgtgtgcctgcatgtgggtccaggccaaagaaagtagcagcccatgcattgcactgttgcagtgcaggctccagaggcagcagctgcagtagcttacctttgcagtgggagagggaggaaggctgagatttgatgagaaggggggatatgcagatgcaggaagcatcacattatgggctaatcatgccaaatgcaaaggcaccaagccacagctttttaccaccccctccttccccctttccctatctttctcctcatcatatgtgtcatgatgcattgcacacccacacacactagctacactagctaacccttgctatgcttgcacaaacacctaaagacacacctttcaactttcacctttttaccacttcaaatattttattctcacacatacacacacaaacaatctctctccatcgatctcactctcactagcaaagctctatatttatcctgccttgatggttttgttgttgccactagctagcaaagcttatttatgcttgggggtaatgacccatacctaagaacaaaagttgcccttttgtctccaaagggaactagtcaagcagaagaggagatcgatcagcaactagcatagtttgatcccaagagagatcgatcgattaattagcaacaagccaacgacaagcttagcaatttgataacaatggcgactagtgaagccgcagccatctccaaccctttcgctcctctcaccaaccatcagcaagaacaccctcctcctcctcctcctcccgccaagaagaagcgcaatctccccggcacaccaggcaagtgcacaacacaattaacctcaaaatcttccccattttgctgtgtttgactcgactgatcaacgg

SEQ ID NO: 2011 - DNA, 2000 bp, Oryza sativa
ataccttgtccttatgtatatttatttcctagacacttgtaggctagcaatcaatattttttatttttctccttatcacttatatgtgggcctcaagtctattttttaaaacttttttttatactgggttgtcatatggacatcatgtaattaagccaaaaccaccctaaaacagccatggatttgttttgtatatagttttttaatacttgggaaagcgagctacggggtatctagttttgcggaattgctcaatcccgggcgaccggcgcagggggagccggatcgggcgctcccccacgttcgctctccccccacgtgaccctgttgggccccacccacttctccctcccctttctccacaaaaagatgtttcacctagtgtcctcacaatgtttcactatgtatagatttaatgttgcagtgaacgaaacattccattgcaacaaaaacccaaatattttggaaactctctattaagggaatttggcttattttttgttccaccaaaaatgtttcacctaatgtactcacaatgtttcgctatgtataaatctaatgttacagtgaattgaaatattccattgcaacaaaaaacccacatattttgttattttctgttccaccgaaaaatgtttcacctagtgtactcacattgtttcactatgtatagatctaatgttgcagttaactgaaacattctttcgctatttgctgaaacattgtttttatataaggtgaaacaacacccgatttaaacgagtgaaacattttcgatctactttgtgaaacaatttcgatatacctggtggaacatcgtgcaacatttaaaaataattcaataataagcttattttttttcgtcaggatatatccatgcgtggtcttgttttaaagatttaattgcaatgaatttaatggtgcaatcggatcatgatttggataagtaatttaagagaaaaatcagtttaaagtagttttacacgtaaatcgggcgctgacgtcaattttaacccgtttgcatcgggcgcccgagccgagggaattttttttatttatacttttttttattaaaatatttacaaaaataatttgttgtttcgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatctaaatattcgttacaaaatatataacacattttaaaaaatctcagatctacatttcaaacgacattggatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaaaatcgcccttcttaagggcggcaggcaattagatttgtaaattttcgaaacaaaaaattatttttgtaaatattttaataaaaaaagtataaataaaaaaaattcgagccgaggcgtcaccctagttttgcggtggaggggtacgaattagactgggtcaatagttgagggagttgcaatgacttcattctaacgggcctgcacgtatgctacagttgtgcgtaaggaagctacagtccagttctggcccagcccagcccatgtagaagaatagaaggtgacatctttccttcctccctcgcgggcggaggcgctcacacgcaaaaaccctaaaaccccagtctacccttccttccccgccgccggcagccgggacatca

SEQ ID NO: 2012 - DNA, 1760 bp, Oryza sativa
  misc_feature (8)..(8): n = any nucleotide
  misc_feature (103)..(103): n = any nucleotide
  misc_feature (154)..(154): n = any nucleotide
  misc_feature (188)..(188): n = any nucleotide
  misc_feature (190)..(190): n = any nucleotide
  misc_feature (1538)..(1538): n = any nucleotide
  misc_feature (1549)..(1549): n = any nucleotide
  misc_feature (1561)..(1561): n = any nucleotide
tgttgccncgtcggggcctgcttcgcccgccagcctgatctccgtcgtccagcggcatcgtcgtcggtgagcgaaggtgagagcatcggcctcttcttcttcntgctcgccgctctcgtctaccacgcacctaccattcctctccttgggttcngttgttctgctgttctagatctggaagctcttcncncctttttttttcttggattaacattagtactagtgataacagtttcaccaaaaaaaagagagaaaaatttggggctcaactggacccgcaatgtcatgttgctggatctgctgctagtttctggatctgcagtagtggcattgttgccatctgtgttggagctgatttcttttcttttcttttctttttcttttcttgggtgcagcatattctgctctgttcatgcttcactagatttatttattatcaagttcaaggttagaactcgctatatagcatgggcaaatcaaatctctggagtagtaagaattcttttcacaggtgagttggagggtggttgggggacccgctttggagtgtgttgcaggttatgtagtagtacatgtgtttgcaacattgcttcttgttgaaactaatgctgtgccatgtactacctgccggccttctttgctgatgctttaagctaaatttagaggagtaattatgtcggtggggggaaaattgttgtttattccacagcttgcgcgagctgaaattggtttggaacaatgttgtgcggggacgcatttcttgctaccgtagtcactgtcgatcttttccgcgggatgtttttaatacttgactgtggttttggttgctagggaggcatctccatcagttctgcatgttttgtggtgcttgtctgtactcggattctttttggagggaactaaagattactttttcgtgataatacgtgatatcggaaacatgctgctcaaactagtattggtgctgctaaagcaaaactctttcctcaatgtgggctgctagattgagtatttttttaaccattaataaagactttgggccatctttaattgtccactatggctcatatatttcctagaagtttactgttgttcattctaagaaaagaataactgcaccttttttttagactatgaagctttataatcagcatttgtagggactagcttcagttcgaagtgtttttttttagttaggacattggtgcttataaattagaagacaaatttattgtaggatctgatgattacgtggtgtaaacatagaatgcccttaatagattactgctccttttgataaggtaaattatgtcattaatgcacaatgttagctgttctactgctagtttcccgccattagctaatgtattttcttcgaaaggaaggccattatgtactgttcaaacctcacagaacacaccacaaaaggttcttctatccacgatctctttcatctctagcagtacgtgcatgtaggacaatttttgtctcatgtcaggcttgcatttttcatgatattcgtagtgcgattgtttccnctgggtgacanaatgttgtatcngatttgcgcgtttcttttttttttttttacttcagctatgtgattttgtttgactctctgtttttaggtgctgatacaaggtgttgtctgagtctgcaaatattgatgatgtgcctaaaagtttgacagtcttgcttgaatacacagcagcattacttggttacactctgaaaggtgtagttgcctttgttggtttaga

SEQ ID NO: 2013 - DNA, 1037 bp, Oryza sativa
  misc_feature (7)..(7): n = any nucleotide
  misc_feature (44)..(45): n = any nucleotide
  misc_feature (56)..(56): n = any nucleotide
  misc_feature (58)..(58): n = any nucleotide
  misc_feature (106)..(106): n = any nucleotide
gacgacntacaaaacgaattacataaatgagagcgaaagggccnngtagcctaggngnttacaagagcctcagtagcacctgagggcctggggttcgactccccgngggagcgaattttccaggatttaacggcgttgtgctttcagtggtaggcgacgtacccatcgaattagaggcgcctgtggtgacttcgtcaatctctccaggatttgccggcccagtcttcgaagatgctcgtaggggtaaggtttgcgttgcgcgtgcattgtgagtgtctgcattgtactgtgcctaattaatctataattagaggcacatgtgttgactgtagcaatcactataggtttttttaagccagtaatctaatctgataattagagtaatgtttactgtagcatgcatcatgagtgtctgaattgcactgtgattaattaggctataatagagacacatgattaattacgctcaatagagacaatttttttaagcctaattaatctataattagataatgtttactgtagcatcacataggctaatcatggattaattaggctcaatagattcgtctcgtgaattagtccaagattatggatgagttttattaatagtatacgtttaatatttataattagtgtccaaagatctgatgtgatagggaaatttagtcccatctaaatatgttctcaatattatgagtttctgacaatcgggtccgagaacccagagagacatacctgggacccaccgtacagtgggacaggagagaaaacctccccggatcctgcccctcctcaccgtctccactcccgatctccccgctccccgcgtcccgtctccgatccacccaaacacccgcaccgccgcgctacgcgagcacggcaccgcggcgcggcgcgactccgcaggcgacaagccgaggagaatcccgcgcccgcccgcccgcatcaccgccggatggccgccggccgtcgccggtagggcgataggcgggtagatccagatccggcggggcgggatcatatacaccccgcgc

SEQ ID NO: 2014 - DNA, 1622 bp, Oryza sativa
atttattttgaaacggaaagctttcattgtttttttttccgttgcgtcggttcgtcggtcataggatcagcaaaattgccgactagccatatatttgatgtttcaaactatatttgcaaacatacctttttctttcttacaacggatcgtacaatacgctatcgtaatccgagcggctggcagtgcttgtggctatggcggccgatggcaccgattttgaattttttttattctaaaattgttttcactggcagttctctttagcttgccgcttggttatctagcatatccgtttgcgaaactcgattttcgctggtcaacgaaaacccaatttaactaccagcgaaaactatttttgtagtagtgatttatgatgagatatatgagtgacgataacaatattacaccaccaacaacttaaagactggaaggtaaacgaaaagggagttactgaaaaagaagagttatttttaattacataatggtactgaccagtacactacacgtatgtatatgtgtgtggtgatgatgaagaaagcactcccttctgtgtaaaaaaaattaacttagaaagaaatttgaccctcctagaaggtataatgaatttggactaccttttatgattcgttattttaaaagggatcacatctacatcccctactaggttaagtaggttgccaacgtgacagagaccaaagtgctgctgtgacatttgggttgaggtaacagacaacggcatcacactatagtactatatacaacagtacgcaaataatatccataaatattatacatacagtgtggtcgagatttaccgcttcccgcgtacgttaaaacaacacacatgatgctaatttatgcgtgtatgaatagtaatataactagcaatatatgttcgcgtgtagaaacaaacattgaatttattggtataacaaatgaatgaatttgatgtatatttggtttggaacagacgaatgctccgcttttaagcagtagaggtaagaatttaaagggaaaaaattcattagtgtctattcgttttgaagaaattttaatacatagaaatataaaaaatggagaaataggaatacatgcaaacttgaatccataggattttcccaaaaggttagagtggacgggaacaaaatatatgttttccctctacatcttgtaggagaaattttttctttggttttcctatatctacattcctaataatcaaatagctttcgtaggaattaatcctaaaagaaattaaaatcctttaaaattcatccaaaatgaataggcgtaaatgagttagggaaaaaaaagaaaagaaggaaatggtgaaaaaggaagagaggcccatgcaggcccaccaaccaccggatctcgatgggaggagtgggccacctcttgtccatcccctcaatcctttcccttccttcttcaaagtcgagactcgagagagacaagaggagaagagagagtgtgggcgctcttaaataggagagaaaaagaaaaccaccgccaccgacatcgcctcgcctcgtaacccccaaatccagcgcctcccttcctccccaataatcgaatccaatccatcttccacgcgcattccggatccgcggaccaaggga

SEQ ID NO: 2015 - DNA, 2000 bp, Oryza sativa
  misc_feature (761)..(761): n = any nucleotide
  misc_feature (793)..(793): n = any nucleotide
  misc_feature (1507)..(1507): n = any nucleotide
  misc_feature (1968)..(1968): n = any nucleotide
aggctgcaggcttctaatttactactacctccatattttaatttatgacgccgttgactttttgtccaacttttgaccattcgtcttattcaacaaatttatgtaactactacatccgtcccaaaatgtagctatttctagcacagtactttgtctcaaaatgaagctatttttctacctaccttcttctctcaaccaatcacaaccattctttttcacctactttctcttttcaaccaatcacacaccttcttcaatcattctcacctactttcttaatacctgtgtcaacctcaaaaatgcttacatttagggacggaggaagtatcatttattttattgtgacttgattcatcatcaaatattttttaagcatgacataaatattttcatatttgcacaaaaaattttgaataagacgaatggtcaaaagtagcatttttggtagagcgctgaatctactgcaagagagatcaatataccttcccgggctcgggctcgtggccgttccagaaaacgtacgtctcgatggtgttgaggccgcccatcttggccgtcttgacgagcttatcccacatctcgggcgggctccgtgggtagtggatggcgccggagaagaagaggtccctcttgccgtcgatcatgagggagcgctcgtcgtaggagacgacggtgcccttcttcgtgagggtccactccgccgcggcgcccgggaggagcagcgcggcggcgaggagcgccgccgcaaccgcggccgcgangcgggcggccatccgaacctgcggcgcgcgcncgggggggctctactacgaggggggaacggccagcggcggcggcgggtagggtggggtggggcggggtggggttggcggcgacgcgggcgaggccgaggaggaggaggcggaggccgccgctttgaagggcgggaggggcgttgcgcgggagtggccgcgcggcaatggcgcgtcgcgggtggccatgcgcggctggcaccggagctcgcggcaattttgcctacgacttgttccgtttggccacgagcccacgaggttgatgacgacgaagccgaagagttgttgatttttttttcaatttttaatttttaatttttaatatttacagaaatattataacggcgaaaatatttacagaaatagaccatattgtccaagtaaagagcggcaaggtgacttgtgtgggaggccactcagcgggcatgcgaaaattatatttaccccttgccacccttgcacgcacatggcgttgtgtgccacgtcaccttgccgccatctacttgggtggtagggtttatacctgtaaatattttcttcggtataatatttctgtaaatattaaaaaataaaaacttaaaaatgaaaaaaaaaatcaagagttgttcatgcgcttcatgggtcgacggcccaattgaagttgtgtcatatgggccgaagcccagaaaaaagcacacacgagatgacagatttgaccgggcccatttgtcagcganaccctaagcagccattcccaagcccaacctctccgccaaccatcccgccacgtcaaccacctttccatcccaccatggccgcgccaccacacccaccaaccccgggtccatctcggccgtcgatctccccaaccgacggtccagatacaccgcacggttcctcctctcggcttccttctcccaccaacctccacactccgcccgcctcaaatccccccgcttcgccagccaccacccgccgccgtcgccgttgccgtcgtcttcgtttcgcagctccaccacctccatggcggccgccgcctcctcctctctgctcgccgccgcctcgtcgtcctcccgcgcggcggccgtgtccgcccgccgcgcccccagcgcgagtccggccgcggcggcctccctcccctcgccgtctcgcgcctcctgcgctcctcccctccgcgcttccgcagcgaggaccctcngcagccgtgtcgtcgcgagcgcggcccccgct

SEQ ID NO: 2016 - DNA, 519 bp, Oryza sativa
  misc_feature (5)..(5): n = any nucleotide
  misc_feature (9)..(9): n = any nucleotide
  misc_feature (11)..(11): n = any nucleotide
  misc_feature (18)..(18): n = any nucleotide
cttgngttntngattctncaatcctttggtcttacgagctttgatgtcttttgcaaccagttacttttttccatatgtcaaattgtgtgctcatggaatttctctagagaattgatgtacatgctccattgattattctcctgtctttcctcgtgtggctggtgtcaaaccctaatttgcttgaggtggttgtgacaattcgcatcatcaatacctggttaattggaggtggttatgacatccttgctcacctgtaatgcgtgattaaatattatatgggaaagtattattctagttttttttgcaaatcaagatgtttttcccttttattatcgaaaaagatgttccccctacccgtgttcaatttttaaaattctattctgaagaaaacaagatattggtttggtacttgcatttaactctcaagaacatgtcagttatagtagcccaccgttaagacgtatgatttatgtcttaaaacataatatgtttttgtttcttatagttttgataaatttg

SEQ ID NO: 2017 - DNA, 2000 bp, Oryza sativa
  misc_feature (1351)..(1351): n = any nucleotide
  misc_feature (1353)..(1353): n = any nucleotide
aagctagctactagagctgtagttaagctcaatggcccaatgtcattagtgctactgacagtgtgagctgcaacatctgtaattagcaggaccagcttatcccaaacagtagcaatgcagtgtcatacagtattgattcctgtgagcactgtgtaccattcatagggcttgtggtacacttgtgctagctagtatgcactgacaaatcctgatgatttccatgcgagttgaacccagcacatggagctttttgttcaggttaccgattgatcgagcagctaagacctcgagcattatgagatcgataagcatagcaatcgatcccgtgatcatacatgcagatgatgcagtggcgtgcgtgacactataggtacgttgttgctgaagccgaacatgcgatgctgcgtgcccgtggcgcaatgatccaaaagattacaggcttgcacgatcgaccaactgtttttcatgcaagatgttcagagagacagatagtgatatgtgtgttgttgtgtagatgcatgggcctcggctagaaatgctatttcataccgctacctcgtagctaccacggagagctatcgatcgaatgctagtttgtagtaggggtttgagaaatgatttgtcaattgcaatttggtaggggacaggtgccagatcagtgatggttgttgatcagtagtgtccgtcagaaaagatatgtgggtttcgatcttcagtttttttaatgaattaacgactaatagaacttttctacgagactacaaattaaatatgttcttatagttcttctggataccaaagcaaacaatattatcagggatagggaagaaattagcacgttctgttcgtttttttatctgaacctgaatgcatggcgacgaactgaacaattaagctcaaagtgaccgaccgatcatgttaactgttaagcagtcaaggtccagtgctgataaaccacatgagagagagagattctcagatcccatgtcaacacatccattcacagcagatcgaagctagattctttgcaagcgtgctgctcgtcaagcatgcagcgaatcaggggagagattaaacaagttgggtgcagataaccttcactgcagaacgacaaaaaggcccggattgaccatacaatgtaccatatcaagttatgcgattctgtcggtaattagcatgcatcaaagattcttcagataagccaattcgggttaatcaatccgaccgatggtcggtatatacaaacattgctcctcactactaggtgcagtccaggaattgctgtaaacacatgggcacttaacacacccagcgaagcagaatgcataaaaccaagtgttgttgttttttnantttgaaaaaggccaacggcccggcttatattgaaagcccaggggtataaccaagtgttgtaactgagaaaatgcacattttctcaacaatgcaggttattaagtcttttgtttcatggtcacattttaccacgccacattttaattagacgtgtattagtttactatcacaattgtgcattgctacactttttcaacaacatattctgcatgtcataggcttaattttttttgtcaacttttgtcacgctttgtggctaccaatttattcattattttctttttgtctatcaaaatttgctaaaccttagttgtagtaaagtgtggctgacaacctaatacatcgtaagatgctagccaaaaagttcaaagatgcaaatgataaagatgaagtactgaactgggctaaacacaagttcagataaggcccgatttgtggtacttaccaagtgggccaactacacaagaaattgggccgtcctccccggcccaatcgacccaataggtaggtactgcttccatgtattgggggaagcagagagatccccgaaatcaaacccctcctcttctcttccccttcctcctgcgttctagggttttgcctcccagcggcgactcggcgagcgagaccaccggcaagctcgtcgg

SEQ ID NO: 2018 - DNA, 2000 bp, Oryza sativa
  misc_feature (1471)..(1471): n = any nucleotide
  misc_feature (1719)..(1719): n = any nucleotide
  misc_feature (1721)..(1721): n = any nucleotide
  misc_feature (1730)..(1730): n = any nucleotide
  misc_feature (1741)..(1741): n = any nucleotide
  misc_feature (1743)..(1743): n = any nucleotide
  misc_feature (1761)..(1761): n = any nucleotide
  misc_feature (1769)..(1769): n = any nucleotide
agcgtgattaaatttggcatggttttcctaactaattttttactttgattttttcattactacgatgttcctagcaacaaaaccacaattatatgaaaataaattcaaatgtcaatataatgatattatttttgtaaaataaaacataatttataataaaatagtatttgttaaatatttagatagttgaattttaatacgtgcataccttattcagtgacacgggtggagtaatgtgttatgtatgatttatgaaaaatctcatttgtactctagataaactcgatactataagctatcgaccaagttttaacgatttttagccggcttgaaatgtgcatctccaactgtttgtttgaaattcgtcgattttcattcaaaatcaacgataaatcgatgacttgggtggagttcaaaatttgatttataaggaatcgagattatgtgcttgtttactttgtagccgctctcaaccttacctgtttttttttttcacatttttgtattactaggttttggtatactggatgtgtttaatttaaagccttatcaaaatttggtagaattttttaagtagaaactaatagaattactaaagtttaataaggtaatgttggtaagcatacgtttggtttatcttatcaaaatttaatactccatccgttaaaaaaaaatcaacttctagagtttgaattttgtcccaaaaaaccaacttctaccctcctacctactttcagcacgtaaaacgataagttttatcccttcaataccctttatctacctatcatttttactgtttttttcaatgattaagagcattttagtcattcaccatctccactaattccaccttgggatgctagtaatgcaatttttttggacggagggagtataagattcgaagtgagaatacaatgaaggagcctaacaagcatgatggcttgatatataagatccatccaacgcatgcgcgttttatccgataatatagggtctgttcactttgatgctattttcaaccatactattttttttaagctgtcaaaaaaatatctacgtttactttattgccaaatttggtaaatacataagaaatcctggtaaaattttggcaattttaccattttgcaaaaattttggcaatggcaaaattcgataaggtttattttagctacaatctgaacatgtccattgtactataatggtatgttagcttttatgttagcttttataacatgcatgtaaattgacacgataactgatagatagtactcttttttaagtattagagtggtcttatttctcagtctcttggtcaacacaacatccacctgtttctatcccaaccattcttaccaacaactaatggaacgtttacctcgcgataaacgtatccaaaatggtcaggaagctcaatttttttttacacggcatgaaattcacttgactgaccggactagagagagatccnaagagtagatcggggcgtggagaaaaagaagtccgatagacccggaccccacgagtccagtcattgcaaaacagcgcccacccacgaccacgacgaacacaaacagtaagaaccaccaacgaaaccgatctaacccaagcgaactccccactccacccgcaagcaagggtagtagactagtagtaggcgaaagaaaaaaaaaatccccccaaacgagagaagcggcagcgacgacgacgacgacggcnanagcagcagngggggcaaaancngcagaagcaaccccctcntcggccgntccgccccatgggatcgaggccgccctagggttttcccccaggttcggcccttcggtttcccccttttcggccgcgcgcgcgcggggagccaccaaaccctaggacggcaaacccggcgcgatcgcccacggtggaggcctcgtcggcggccgagaggagccgctccgggctcgggtcggggttccggtacctcaccggcgccgcctccgggtggtgggaccggtggatgg

SEQ ID NO: 2019 - DNA, 2000 bp, Oryza sativa
  misc_feature (1909)..(1909): n = any nucleotide
aaactaagctaaatcgtcgcattctgagtgttgatcgcatgcggacatgagctttccatgccgccagtgcccggaggctacaatagcatagacgaggagctcgaagtcgctaaagagaagcgcaacactaccccagaaccatgactcgacgcgcacacgatgcttcatccatggtcgaccacccgtgtgttagctaatgtacatcttaggtggaccgtctcccatgctcgatttttctccatcttccgctcctcctatgcatattattttattttttaaatttaaaataattaatacttaattagttatgcattaatgactcacctcgttttacatatcttcttaattttcttcttttccctcttctcaaacatggtctaaacttagggaatctagatacggtgacagtaggatgagaaagaggcacccatcataatcgaccttattcggtggcaccaaactcactgatcacgtctccttggttgatttgagcacatgccgagaggaaaaagaagaccaacgacgatggaatggggtcagtagttgatttggcctgtgacaacggataggagcagtggtgagaagaagcgagggagagagaaaaacgagagagctagaggataagtgtcatcttactattattttaattcgctaagataaaaatcttatgctcttcaatttaaatatttatcgagataaaaagcatcgaatgcgaaaaaaatataaaactttcataaaagaaaatataatacaagataataaatgacctcaacctataaagagagtgtgtaataccccttacaaagtgttgtggttccaatttacactcgttaggcttacaaatatcagtttatttgtttgtcacgcaaattttcgtctgtcgccttatgtgcaaaggcaacagtatttttcgcccatccattattcccatgctacaatcatcgggcccacatgttataagcatcatttacatgccacacatgtagagtagactaattgtccaagaacaaatttgcttttgtggtcatagaacacatcattgatgcttatgatcaggcttagttgcttcgatattttttttaagatcaaacagtactcatcccactactacccggtgcaacgcacgggcattttgctagtattagttaatatacttaacactaatgatagtaattaggaaagattctggagatttttttactaatagattgaaaatattttatgttagatttgaaaacttttgatttaagttttaaattttaaagtcaaattttaaaaacttcaactcagattcgaaaactttcaacttgagaatcgagattagaaaactttcaactcgagaatcgagattcgaaaactttcaagttcagattgaaaattttgaaaactttcaatttgagatttgaaaacttttaactcgagattcaaaaaatttcaaatcaagatttgaaaattttcaaatcgagattcaaaaactttcaagttgagatttaaaagctttcaagttcagattttaaaattttcaaatcaaaatttataaactttcaaactcaaaacatgctaaagataaaaaaaatcagaaaaaagtgggaaagaaaaggaaaaaaatggtaaaaaaaggaaaaaagagcaaggaggcgcgcgcgctggcacagcggcgctgggtcttctaggcccgaaacgcgcgcgcgtattagcgtttccgctttagacccgcaaccaaaatacccagcccactaagcctgacccgccccggcccggcctggaaggtccccgagcactgacgcgggcacggggcccactgccgacgtgccaatcctggatcccacacgctcacgcgagcagagcacgaccgatctcgtctcgtctcatacaaaccccgcccgcatccgcacccggatctgccacngccgcggcttccctccccccctcctcccgatccacccctcccgccgccgccaccgccaccgccgccgccgccggccggcgagagagacagg

SEQ ID NO: 2020 - DNA, 2000 bp, Oryza sativa
aaatcatatataaactttacatgtgaaaagtttacctgtgtaaagtttacatataaaatgttactgaaaattactatgtaaataaagttagtatatgtaaactttatacgaataaagttacatgtataaaatagaattgtttatggtagattttagtctaaatgagaaaagaaaaggccaggatatgcttcagctagctagtgggcccaggatgattttgcatatacataacataaggctatagagagacttgtgagtaagagcaggacacgcacgaaagaaataggcagcgtcttccccttccctttgtggcgtaaaagaaaagaaaatctcccgtctcttcgtctcctccgctccttgcgccgccaagaagacgagtcgggggcggcgatctccatctggcgagcagagcaggggaggggaggggatcctggtgagcctctttctgattcatctctctctctctcccatcgggactggaatttgcttgcgttcgttcgttcgttaaccctagcttctattctagatctggaagaagctcttcccttaatttcagagccttaaccttaatacaagtaacagtttgtttgttccccgaaatgtttgtgaacccccatgtcccaagttggatccgccccctggtttggaacaccttgcacttttcaatttccggtgatttgtctgtaactgtgtactaggatagtctcttagtaatctatccatgtcaaaaatccttggttgttacgaagaaagaaccattctggaagatgctatgcaattcatttcctaattcttattgcttttgtatctgtactacctgaccttatttcttagtttctttatacctagcttatattctctatctgaaaaatgtaactagtattgtgggtacaccaactgtaatttaccctcttccttatttatcgagaaatcttccttcttatcaatcttttattgccctatcttggattcttttcggtttagtttgtttctaatttcatgttagtaacggatatgaaatgtgggagaatgccaaattttagtgggccttttagattacacgctttctgtttcgtttatgcatatatttattctatttattgtaatttgatatgttcagtgaaaagttgaaaactttgacgcaaaatgaccttattctgattctttaatgcactgttttccttcatagtataacttagtggccactgaaagaaatactgtggatgaatgcctattgatagtgtaacctatatgctatctgcttttcctcgtcaaatggagatgaccgaacaccaatttgtcttagaggatatatatggaacatgagtgaaaatccattgagttttaaagaagtacaatgccacttcatcaacttttgtacataatcaattggctaatcttttcccctgatgccatgttgttgtttgtcatcatatattgcattcacagtcagaaatttgaagaacatattagatgcatattaagtgtcatggttgatattggctttcatgtttactggaataaaatcccttctatccttaggcattataacttacttccaaataaaataaactacttttggtaaaaatatattttggaagagacctcccacatatatattgctacctctactgtgggctaggtagacaatcatgagactggatgcatcatgttcagttctttgtggcaaaatccgtaatatagaagatatacaatgtgatgaaccttcacgctcaccttcagccacttttagggtggttgccttaattgtttgttatgtgttggtttcaagtttgagtgctgcttttgtttgcatcatatcatttttcattgagtatcagtttgaatgatatctttaagatgaaactctgatcatttatttgaaaatcctggcagtttttcatgtacggtaatcataacttcatatattgattatttttcaggctcagtcttgcgactttcttgctgtataatgagatcatatctttgagtgctcaatg

SEQ ID NO: 2021 - DNA, 2000 bp, Oryza sativa
  misc_feature (21)..(21): n = any nucleotide
  misc_feature (95)..(95): n = any nucleotide
  misc_feature (548)..(548): n = any nucleotide
  misc_feature (563)..(563): n = any nucleotide
  misc_feature (590)..(590): n = any nucleotide
  misc_feature (629)..(629): n = any nucleotide
attctactctcaattttattntttcctggagtttgtaggcacaacaaattaagattttatgccaagagaatatttttgataaaaatactaataanaaccaaggctgcatatatgtgtttttttactactactagatttttttgtgcttgaaaaaggtgaggaaatgttgccaaggtcattgccttatcttccaggggaatagcttaaaaccgtgtgaacgcctatatctttatggttgagaagttctcaaagaatctgcccgcgtatatagaaataaaagtacaagactcgtcattttcacgctattttgttccaaatctatttgatgttgaaccactccttgggttctatatcttgtgagctagcgatggatactttttcttcatttcctttttataaaattgtattcattatctagtactataagatatatgtatcttttaagtaagtacacatttgcatgcatttattaatttgaactacttctatttttaaagataaatccaagtctaaaacattaaaatatgatggatattacctacatcccntaagactctcctttnccctttaatatgagatgtaatagctangatgagacttaagtcatatcctctaaacctgctaccgantcttgattgtagagtagggcagccaggaatataatggcaactatccacaatagtgttgctgatggtgatggagattgtaaaatcttaccttacctacagagatcatgatttttttagacttggaaagaagaagagaaaaagttaatggtgtataaaaacaagctatacaaattgaaagaaaaaagtgcatatatctatatctaactggtctaatttactcgagaaagatgtgaggattcgaatgaacatctttacaaagagaatgctccaattgtgatcacatcaaatgcaatgtgaaataactttagtttcggcataaatgagaaaaggggttcgataacgaagaatgatatatgtattcagagcgcatttacactctcatggaaacaccaatgtggcaacctatgatgaatattataatcatgtgaataagcttaacatagttttaaaaaattaaattataagagaaaaaaatgccacattggtgtttactgttactattgttaccatggatccaccaccataggatgcgtgggctcgtcagtggatcatcaaaatgagaccctcactttacattttttttctcttataatttatttttttcaaactatgttaagcttatttacataattattctaatgaattatacacatttttttttcatattttggaaaatacatatttctaaaaaatatattactagagcaacttgttttaagatagtactccaagttgttaagcttattccaaaaccatgtaaataatccgcgacaataataatccgtttggcaatctaaatcaaacggcgcatataggggttgtttggttgatggctaagtttactatacctcactttgccacaagtgtgttatgccacacaaagtgaggctagcaatttgttagccacaagtgtggctaagtttggtaagaatttgagtctataacgcataggcccaatgactagtaaagtgaggcatgacacaagtgtgacaaccaaccaaacaatatactaacaaattgtgacatgtctaaggtttggcatggcaacctttgagagccaaccaaacagccccataatacatcgcagcaaatcaaatgaaaatacaactcactttttgcagcaaaccccctcacgatcacctaaatttcgaaaagatcctcaaagccccaacccttcttctccatcgcgtcgcctataaatacccccctcgccttcctctcacttcttccgccattcccctctcctcctcttcttcttctccaccgaataaacccccgcaaaaaggtggtgagttcgagagagagagagagagagagtggaaggctagggttagggttagggtttcctcctcgccgccgtcgcgtggcgcg

SEQ ID NO: 2022 - DNA, 2000 bp, Oryza sativa
  misc_feature (417)..(417): n = any nucleotide
ctacagacagtctttagctaatatttttgtatatcgcaatgggcccatacgatgtgggatgagctacacctgtccatacaaactaaggataggctaagagtgtgaattgagcataaaacattagatctaaccggttttccgttaactaactatttatttatttatttttttaggaaggaggtggctacgcttcgtgcggcattggagtggggagaagatgatggatgactcaaattctaaggagtaaacacattttgaaagtacatctacataattatgataagcagtaagttattcctgctaatccaaatactccctccaactcaaaataagatgcgcaaccactttttcaacgtttcataatataaacatgcacatgcatgcatgcatgtaattaactaacaccatcattctttnatttttgttaaattagagatctttagggtgatctagtgaaattaacccttttttttaaaattagagatgtttaatttcattggatattaacccccattggatttctccaccctcaagttaactaacacctccaagatcttgaggggtggagtatgcaatggattgttttattgaagtaatccaaacaaacaattgataataattatttcttggcctttatattagtgaagattgcgccttatattttgaaaatagagagagtaataatagctaaactaaatgagtaataccccgcaatttaatcaatggctaggggataataacctatgattatggtctagggaaggtacgagcattaatgcaattagttgtaacgtacacctggattagcatggacaaacttaatggagaatcttggcgatttgatgaatactcttgatatggagttcagccttcttcgtgcttcatcttgtttaacgcgaacgaccttccttccaaaacagagtcagagtctgagttcttattccaccgagatagtactactagtattattttagtgttcgaaatggaagaaaataattagtattgagcattgccctacattacgtttttacagggattccactattgtgtagaaaccaaaatcgtgtactttacatataagtaatatcttaattagatagtaaatcctttttctttgcgaggcatattagtacacttcctttcttggcgaggcatattactaattcctttacatacttttcttattaggaaaatctgtttcacaatgtcttccattagaaaacgacaaatatattgctattgcagttttcccacattttgcctttgctgctttaaagggctgatatagtttgacatgtagtgatatcaacaccttggaattagaaaaataactactctgtggctccctaattactctttactttttttttctaaataggcttagaaaaaaaagtactacaaagggatgaatgtgtatttactattcaaccttagcctccttgaaaaccaaaaaaaatgcatagaaaatagtttaattttccacatggaaattttggtaggctttaatccatcaaatcaaccacactaattactccatcatttaatacggcctcatggctatggaccgatggacatggaccatgctggtacagtatacgtgcacagtagcgcacgtgcttcacacctgccggtgcatagaccgcgtccacgcagactctataccctctccttcctcactgtcctttcctttccaaaataccatttcttccaattcgcagctgttgcgatgaattaaaaaaaaatggccaaaaccttgtaaaaagcaaaacccactcgccactaatcgacgccattggcgagagctcgagcgcgcaacaccaccacgcggtagcctcccccaacctccacctcctcctcctccgcccgccccagagccaccggatggcctcgcttctgtaggagtagaggcgtagagcccagcgcgagggaaggcggcgattgatttgatttgaccaagattggtcggccgtgccgtctggtctgaggagcccggctctggg

SEQ ID NO: 2023 - DNA, 2000 bp, Oryza sativa
gagagtgacactctcagcataatgggctggctctcagcataatgacgctcgtcggaataggcttgcgtggcggcgtggacaacccattcaataggggaccaagcataatagtcgagcagtcgtgggctcacctatcgagggtagaccatggaggaagaggactatgatagagcttgatggtgtcgtgatgaggaaaaggaacacattgacaggaagcgaaggacctcgccagaacttatggaggaagtggaggaccatgatagagcttgagaaggaagaggaacacattgatgatgagcttgtccatgcaagaaacaactatgacatatagctattgctgggaaagaaggggtcatggtaggctgagggtcaaggatggatgtttttcttatggtgaatcacaccttattttcatcactatacacgcacacatttgcagtactagttacggtcacttgacatagtgctacattatttctgtcctcaacaataaacaatgcacattttctcgttcggaagtgtcgggatcgaggtccaatctcacccacccaaaatgcttgaagtcagcagtccatactttgccgtttatatgacatatgctcaatctaaagacggataaatcattgaatacctgagcatcatgccagcccacctaaaatacttaaaatcgaccattttctccatgatgctagttgatgatttagcacttctaaatggagaatatgtcatcctaacccatacattacgaattcagagaagaatctcacatatcactatgaattcatgataaatgagaatctaaaaatgacaaatcatcatttttctcatgcagttcaggaaggaaaccacaaaagcggcatagacgttccccttgcgagccatatactatgcatgcgaaagattttattattttttaaagatttcataaaaccccatatttattgtcaaatttgtgcaaaaccgctgatattttgtcttgtgtctcataaccatatattttatggtctaaatgtttcataaaacaccatctttatttaaatttcagttgaattcaatatatctaaaacaatatattttaaaatggtaaatagttaaaccgacaacctcaatcaagcaatcaacaactaaatgtttcatatacacgttatatattttatgtttaaaatttttagtaaatacttgacaacaactccctccgaaaaaaaaggagataaactctaactatctgatacagcagctagagtttactttttttttctttaagaacggatggagtatatatatatatatataagggtggggggttttcaaaactttaaagtgttaggtgccgctggttataatacctgtggttttatatgcaacttgcatcataattcataatgagtggggtttatcgaaatttcgctctattttgaacgaaccgagcaaataattcgtgattcgagcaaatataaatagacagaaacacccgcctttcctttccttgcgcgcactccctcctcccacccaccttccccccttctcctctttccccttcacaccttttcgccttcacctacacacaccggaatccgagatcccggtgaccgcgtctcgcacgcgtccccctcccttccccgccgccggatccagcccccgcgcgctcgccggagtcgccgccgagctaaaccgcgcacccgtcccccgcccccgcccaggccgagcccccgggtctccgcgcgcacgtgggggggacggcgccgacgccgacgccgcgccagatctgagagatccgcaccgacgccccccatcctcgccttccccgaggcgtcacgccagatcccccagatctggaatggtggtggtgttgttgctgctgctgctgccgtaggtatgcttaggtgagtccgtgatcctcgggactcggtcgccgcggcccgcgggtattggaaggaggcaaacctcgtcgtcggcggcggcggcgtgaggtgctgcggagaggtggtcggggaaggaag

SEQ ID NO: 2024 - DNA, 2000 bp, Oryza sativa
  misc_feature (1939)..(1939): n = any nucleotide
  misc_feature (1974)..(1974): n = any nucleotide
tccatggtcttggccaaagctccctactcacccttgcccgtgaggggcttgttgaaggtatgtcatgaggaccttcggccaacccgctgaaaccacctgggctatcaagaatcgtctaagtccatcaggcgaagaccttgggcgaagccagaagggtgaagactaaggggtttgtcatggggccgcgggcgaagcctagcgacgaaggtcaacgggttcaccaccaagctcgatgatcgaccgaaagcttaccaagggcgaaggccttcaagcaaagcatgaagccgtcgccctaagtagagaatgccttcggctgagggccagggaggcctggcggaccgtggaggcccttcgccacctaatgggccggcccagaaaggccgccctagggtccatgggtacaaaagacaatgtatacccactgtaatatccctataataaagataaccatgtaaattcccatataacaacctaaccctagaggtatgagcctatactagcattataaatagccccctagggccatataatgggggatccaaaattttttaccagttaatatactactttactgtccaaatacacctaaccaatatccacgttcttcgatgtgacgtggttgctgttcgacaacagtaatagctaagaccctcggaatcccggagccatattttttttacataatagattgaaaaaacggcctctacattctcttggatgtgcacagacaaggagccatgttatagttcctcttgtggctataaactctgttcttagcaacatatatcatgaaaataattgagtcagtggacaaacgcatttagctaaaaccaaaagtcaatgtgaaatgaacgagatatcaaccaaagacatctacatgtagtgtgtatcccaaaggaaaaggatatcgtcactgatcgacccggccggctagctcgcacgccaacctagctctttatttgtttatttattttgcaaaacaccaagctagctttttatctaccttataagagcaattataatagtatattataagctagctaaatgctgaggtagaggagaaaagagaggagagggggataagctgtgtgtaaacttatagccggcttgaacgcaagaaccaagaaactctgtgagagagataaatgggccctatattaattataaagagctaactattactccctccattctaaattgatctacatatttcatagggacaccaagaccaaaaaaaactaatgactctctcatactatatttaatctagtaacaaactcgatgcatgcaccatccccactattccctagctaatagtaaataaagatattgcatgtgagttataaatacttgtgtgcattgatgcatgcatcaacgcccatttactccaatgcacagataacgaatagacttaataaatgaacacaaatatatagatcatttagaaataacctaaaaaaactatatgtagattaatttggaatggagggagtatatgagtaagctaagagaagactacaaagaactttatagccaacatgttggctgtattattaaccttgctttaattcaccaatctatctatctaccctataattcacaacacatcttagactgtgttcttttccatgggttccaacccacccctcgttttccatgtgcacgtttttcaaactactaaacagtacacgttttgcaaatagtttatatagaaaagttgctttaaaaaatcatattaatctatttttaaaattttttatagtaaatacttaattaatcacgtgttaacctatcgctccattttccgaatggaggggagggaccactccaaaaagaacacagccttgctcatcatcatcattggacaaatccaacgtgcctcatcactctgcccttatccaacggtcctgattcgccattctctcaaaaaaaaaaaccntcgccagttgccgcccgcgcggagcatccatcctntctacctctagtgcgcccaatcccgg

SEQ ID NO: 2025 - DNA, 2000 bp, Oryza sativa
ttactaatacttaattaattatgcactaatccatcgctctatttcacatgcgtgtagaagggtttacgacttgcaccgcccaatacagcctaagagagtatttaagaggaaaggaaaaaaagaagattgagaatacgtaaaccgaggtgagccattagtgtattattaattaaatattaattatttcaaacttaaaaaatgaattactataattattttaaagtaaattttctataatttttctaagaaacgcacagtttagacatgagcatgaaaaacgaggtaaatcttctctcaatctcgttgcaaacttacaaaattagaacaagtatgcaatcccacgtcatacttgtcatctgcagttcttcactccccccaaattatattactcaaacggatatgcttgcgtctttgcttaacaactaattaattaattcgccgtagtggcacatacatttcaggctaatgttcatggactgatacgatactatatagtttgctggtcagactgatattttttttattggacaccggccgggcgggcacctcccatctcctttgttacaggttcaggaagcagtgggcaatatgcagacagggacttgtcccctttactcggaagtggattccattgcgtagatgtgcacgttctctttctttttctctacaatattttaacttgtggaatccgatactccgacgttattggtgcacgaggaacgtctgatcatcgtttccatcagttgcaggcggtgtgcacgagcgacgtttgatcaatccatggcgtacctgatcacctctttttttctaaaaaaaagaaaacacggcacaaacgtaaaccctcacgaatgacattcttatctatacacatgcacgccctacacttattaacatatccgaattcttgaactttaccccctccgtttcacaacgtaaatcattctagcatttttcatattcatattgatgctaatgaatctaaattcattagcatcattatgaatgtgggaaatgctagaataatctagattcattagtatcaatatgaatatgggaaatgctagaatgatttacattgtgaaacggagaaagtatatttataattgacgaaaacattgtatatgtctcgtcgtcgatggataggtttcagtaggaatttctactgaaacctatccaatgatgatgagacatatgctaataagtatagcccgtgcatgtgtatagatggtgaaaactgagaagagaaagccttcgtttttcatgcacatcccaaatactagatgtagtatatttttaaaaaaaaatctataaaaatgttgctttaaaaaaatcatactaattaattattcaagtttaaaataattaatgctgaattaatcatatgccaacagtaacagtgcatctcgtctatgtatcttcttattttctctcctctcagacacatcgtaaatatgatatgcgtgtaatgaaaagaagattcgaccctgatgcgcggtccggatatgtctctccaaaacacaagcagatggagtatatctttagctaattaagctatagctatatagctcgcagttggtcgcacgtcagcaaaactagcgtagctatagctaaggctcggttgctgcacggatggatggtccaacctgacgacgatcggtcgacacaccggtgcggggcccaccacgccacgccaccgtgtccactctcctcctacactgcatgctgctgctgacgtggctcccgcatctgccgcgcgctataaattcgcggctccccgagctctcaacctcgtcgtcgccgcagcagcttgcgatcgatcgagagctagaagaagcagcagcagcagctacttcttagctcgccgtcgccggagctagctcgcgtgtgaccaccgccgccgccgccgccgccgcacgcagcctcagctcgatctctgcactttgttcgatcgccggccatggggttggggcgagcgctgagcgacgcgaagccgtacgtgg

SEQ ID NO: 2026 - DNA, 2000 bp, Oryza sativa
tcaaacaactgtaattgggcaaccaggcgaaccaatctggaatcaagtaaagctctgagacagttatactttaagctcatgggcattttgatggaacctttttcttgtatactatcatgctcataagcacttgacatcaaacaggactttcatatgctagttgcaaaccctcgcaaacagaagttgtgcattcaagtaaaggattcagttggtctaaccgatgtcactattggcactggagaggtagggtttcatcttttgcaaagtttgtttcaattgaaagttttccttagtatcctctctaagctgatgtatgtgatattacttggaaatttgtagtttagtgtactgttttacagcagtttgctaggtcaagcaaacatactatatcagtgatgagtgaagtgtattttgtttgtatttttgggtgtcctttgttgaagtggaacgtgtttctgagtatattctatttgccaggttgagttaggatcacttaaagacacagtacctacagacaaaattgtaactttatatggaggatggggcttactgggaaacggtcaaaggggaagtactccttcgcctcacatacaaagcatatgtcgaggacgaggaagatgaaggggtaaaaaatgagtttgctgcgggctatgtttcagacgaggatgtgctagattatgtccaagacagtacaagtaagcaaagtgacatggatggtaaagagagagagaccttcatggatctgctggccgcgctgcttgtcagcgaggaatttcaaggcattgtgtcgtcgtctgaacccggaagcttgagagatagtgagcaggctgctaaatccagagatggtgaaaatgctgcagcagctgctgatacagggactgtatccaatagctccacaggtaaccaactgttgaattcactatgctggttacctgcatagtattgttggttggcttgtgtttagatttccattactacatcaccttgattgattttctgattttgtttgtgattcagatactgctctagtgtggcttgctgccataacaagtgtgatggtgctggtctcatccaaccttggtggttcaggctatttcaacccttgaagagttgatgcatgaagaatctgatctgactggagtatttggacgatccatctgtctgaatctgatcatccgcagctagtagcagaggtcgttttgttttgattttttttaactttatttttgccgacaagtgtatattccattcccatgtatctaatgttgcagaggaatcaaagaatggcttggcttttggcggctgtctctcctccctttttctatttcatacgattgacatgatgtagcatatcctttttgtgcaaccatccacgcacatgatttaatttgtgtgaatgggaaatttggagttgcgttcatctctcctcttggaattggatcaaagattgcaccattcattcatcaatagatagcagattagcagaagacatgatttcgtttgttttttttcctaaacaaaattaagggagcaagtgcaggcatgctgaatttcgtttctttttgtaaaactgatcggttaccgacaaaattcaaagaaattccatcaaaacctatcgaattccatcgaatcatcgctcgactttggttatcagtctttttttgagaactggttatcacttatcagtctgtgcccgtcgagaagaaggtcccagatgaaacgggtttgggcacactgactgactggcgggccccacgtgtcagcaacgcgaaaggtcaggagagaaatggcgggaatgaatggagccatttcccgcgcgttccacaacctcccgcctcttggtttccccaatctcccgcgcgcttgctcttcctgggctttttagtctactcgatctaactccaaatcccatcaaccccgccgccgccgccgccgccgccaccaccgcgagacgcgagaggagagtgaaagaaagattcagagagagagagagagtaagc

SEQ ID NO: 2027 - DNA, 1057 bp, Oryza sativa
  misc_feature (3)..(3): n = any nucleotide
  misc_feature (5)..(5): n = any nucleotide
  misc_feature (9)..(9): n = any nucleotide
  misc_feature (20)..(20): n = any nucleotide
  misc_feature (34)..(35): n = any nucleotide
  misc_feature (40)..(40): n = any nucleotide
  misc_feature (116)..(117): n = any nucleotide
  misc_feature (624)..(624): n = any nucleotide
  misc_feature (667)..(667): n = any nucleotide
  misc_feature (956)..(956): n = any nucleotide
agnanggcncgttatcccgngccgtttttgggcnnacgcntaagcccgtaggccggcacggcacggcacgtttgctctagcgtgccggcacggcacggcccaggcatggcacggcnnatcggcccatttatttttcctacgattttctaattttttccatatatttctcatattttttattttttgccacattttatctatttgtacccatatattttatgatatatttcctaaattttcctcacatttatcctatatttataatgttttcctttatattatgttttttctgccttttttcttttttcccctcaaatttcaatttttatgggccacatgtaccagtgggcccgctaccagcacacggtccgctacagtagccgtgccggcccggcacggcccagcacctccttgggccgaggccttggcacgtgggccggcacggcacggcccgctacaggagccgtgccctagtgagccgtgccgtcagtgtgtcgtgctgtgctggggcgggccgcctgtttggcctgctataccttctcctcaccatgtagatgagagagagagggggatagatagaggagggaggctgacatgtgggaccacatgggtcccacctttttnctattatttttgtgtagctgacatgtgggtcccacgatttttnattatttttccgggatccaattcttacgtaagcgccacgtcaatgtcacatgggacgaggacctagtcaaagggagccacgtaggcgccacgtcatcaaaaaccgggtacaatactgctgagggaccttttctgcacggtttcgtaagttgagggatgagttgtatccggttttgcgaccaagggacgaaaatcggactgggcgacaaataaagggacccaaagtgaacttattcctactgcacgtgctcgtctcgcccgagcagaagagtcaagagaaaaaaaaaagnaaaaaaaaaggagaggtgaggtggcacgcgtgagagtgaggagctcgcgaactccaaaaccctaaccctctcggagcttcacatcggcggcggcggcggcg

SEQ ID NO: 2028 - DNA, 2000 bp, Oryza sativa
agatacatgtcagcatattttcctacttgaaagagattaaatgaagagagagagcaaagctatctattaacctggagataatctatagagaaaaacgaggcaatggattagagagctatagatacccatgtagacataccattgaagtggtttactattaatctagtctattgctgagatgtacatgttttatagatagcaccttactttaccattgcgggtgctctagtagctccgcaaatcccactttaatatccttcaatgatttcacctttcctcctcttcccctattacatctttcaccagcaccaaaccctagcagacgttctctagtacttcctccgtttcacaatgtaagtcattctagcatttcccacgttcatattcattaatatcaatatgaacgtgggaaatgctagaatgatttatattgtgaaacggaggggtactatttcctcaaatcttgttccacagccctaccgagctaggtcacatgcaaacatcgtcatgtgcataatgtcttcagtcttcacatcatcatggcctcatggggcattaggacagccttattgccaacatgtctattggcaagaatgccactgaaaatatcagattaagcttccatagtttgtcccaaaaatgcttgtgtcttttgcattttttcaaaagccgggtaatataatgaaaattggcaaatattgctactgtggacgaagcagacagtctgacccctccccttcacgtcgcaccactcaaatatgaatatcatgctgcagtgagctgaagatcactctggattattctcacatgtggatgcatgtaaagcatgcaaaaccttcagatttcagactagacagcgcatcagatttcaatcagagcatgtgtttcgctatgcaacctgtacgttcagaacttcagactcttgagtgacagcattcagatttcattagaggcagcaagcgtttcactaatcactatccgagttttgcgttccgtgatgaagttaggcgtaggtctcatcagattatttactactgagtttttttttatttttgaaactttttaatttttaaatttaaaaataaatcttttcaaaatttatttataagatctaaactttttgtcactctaattgaattggcatagcaaaacaacactatcacgagtgttattttaccatgccggtatgactggcgtgacaccgttatctcgctttgtttggtgtgttagtattgttttaccatgtcaaatgggctggcgtgatttaaatgttcagattctgaaaataagttttagaacggtatattttttaattaaaaatttcaaaaagaaaagatctactactgaattgttgaaacgtattatacgctccatacttcaggaagtatataaacttttttaaaattcagtagtatacttgtatttatggccatacgtatgtgtttttcatgtcacaactttaataacttctatttaataaatttatatgtttacgaagtgacatatcacatatttatccatttaattaattaatttttaaaaaagaattaacagctatttagatgaacgagggtttagaatacttttccacgcagatggtgatactatatatattgagttgactgttcaatttaactcaaaagctaacatgatgagtgaagaggagcagttcaatttatattcctagcactactaatgcacacggccgcacgtcggcgccggcgacagataccatcaaaccacaccgcgttccaacgaggagagatcagaccagatatatatctgatatttatctgcatgactagtattctctcccttttatattataaatcatttgattttttttaagtaaaattttgttaagctcaattaagtttatattaaaatttagcaacatcaaaaatattaaattagttttatcaaacgtaagattgaatttattttgataatatgtttatttttttacttaggaaaaaaaaccaaacaacttataatataaa

SEQ ID NO: 2029 - DNA, 105 bp, Oryza sativa
  misc_feature (54)..(54): n = any nucleotide
  misc_feature (58)..(59): n = any nucleotide
  misc_feature (72)..(72): n = any nucleotide
  misc_feature (76)..(76): n = any nucleotide
  misc_feature (82)..(82): n = any nucleotide
gggagagagagggaagcttgcaggctgcagctaactagctaggcaaggagagtnaggnnatagatcaagagngatnttgagnccgagagagagctagagagagat

SEQ ID NO: 2030 - DNA, 2000 bp, Oryza sativa
  misc_feature (65)..(65): n = any nucleotide
  misc_feature (511)..(511): n = any nucleotide
  misc_feature (1233)..(1233): n = any nucleotide
tataaacttaaaaattggaacggtgcaggtctaaatggttcaaactccagtacagctagttctgnttttgaatctcttccattggcaatcaaatggctaagggaaactgctcaacaaaaccaatctacttcatatcaggtgaaaacttcttatataccttcatttttgttctcccaattgtttgtatcatgtaggactaatttttcttccaaccatacctagctactgtaccatagtcaggacacagggatatcacataattcattgtcagcttagcacatgtatatgtagttgtgtagtgaccatcactgattcatcattcttgtctcttgtgtacccttccatcccttcgatgtgcttgcgtgtgtgcaactgctagtgaatgcacagttcttttttcttttttggttctgcttttccatgatctggaatacctagtaattgtttatgtgcatgtgtttattttatgtccctttaattatgttatacctgttgttttttatgttttttngtctctagcaggcagcagctactttcaaaattgatgctgatacatttgcatttgtacactttgaccaggtcttagttactggctccctgcatcttgttggtgatgtattgagattgctcaaggagtaacttcatccagagtgatgcatagttcagattgaaatggctgcttgcagtagcacaagctggccactacaacaatttatgattgggatacaaagcgaaaccacctgattggaacttggaagaattaaagaatgaaagtcgtcttgattcagatactaaccaactgaaaacttgtatttctccaattttcgtgtttctgcctttccaggcagtgtgtgccttgtagtctactgttgttcagaagagtgccacccaattgtggaatgtacaaacattgaataattatatgatgtcactgatgccattttttagacttacctggattggattcttcccccaaattcccattctataaagcaaaatgctaatagcttatacatttatatcccctgttggaagatagaaactgaaggtggcatattgacatcgttagcattttcctgcaaatacatgttattgtatttttgggcaaaagcagactgatacgggtactctgtctttttcagaatacatttttggggctgaagccagatcaaaaataatttgcttgtagcttgcctgtggccctgagcaaaggaagatttcacactttgggtnagacatacatcttcccccctgttattccagttcgtatacaatagttactctgggaaactgtctgttcggatcataccatgagctagtttttgttcttgtgccttttgttcttatgtagcttatgtgtcatctttctttgtttgtgaagaaccattctttttaaggtcacatttctctaaaaggccaatgacatgcatgctgtttaattttatcatgtgtgcaaatggttatacatttgtttgtttgtgttattctcggtgcactaagaatagcttggtcaacttcttcctcaaaagagaaaaatgaccggctgataacaatggcatttaaataactcttctgtaaatgtcttgggctattgttagtcactaactattattgcaccctaaatatagtcaaacactttctgtaggagaataaccacaaattataaccatgtgaggagtctccaaagttagcattgtgatgtggcacatctaatctcatctctctgaccatttcctctggcttagaggtggagttagacccaagcctcttatatttcttccctagcttcagcctctcccaaatcaggtttccagaattgcatattaaagcctcccatcaacttcttgcacacaccctccctttggctttcatctgcatctattcagttgcagattgagagccaaagacattatcttgattctatcaggagggttgtgctagcgaattcttgttagcaacaaattgacatattgctcggcacatccccaccgagaatacca

SEQ ID NO: 2031 - DNA, 2000 bp, Oryza sativa
  misc_feature (273)..(273): n = any nucleotide
ggtcagcagggagagccactgtgttggttgcaatagatccacttggagttgagaaagctcaagagtggtttatacagagacccctactacaactgcagcactttagagatatgtcaattgatcccaaagtcagacctacaggagatagaaaagcagacgaatcaattccatttaatttcagttcatcctatgtgtaaagatacttcttaattttcaaatagatttcagtaaaaaaaatgactgtctatactaccaaatgcaggggaatatttngttttaccgaggattggaatcagctcttcacaacttcgccgcccttttcaacccttcaatccaattttcatcaaatcagtcaaaattatgaatccaaccaaataaaaaaattgaatactatatattgaccgaaagcacctaacctaacctattgtgcattcaaatatagaggcaaagtaaaaggatatacatttcattagagaatctgataatctatcaataccaacataaacattcagaataacatttatgtttatacctctaatttactcgcacatcccgacatcaggcatgatccgcctctgccccacctctcacctggaaggaaggtctatggcaatcagggtggagagcagctgaaaacggcagccatcgtgaggaagacagacgaattgatccgtggcatttaacatctaaaataatacagattgcatcaacggggaattttacccctttccctctacctcttgcgcctaattagcttcattagtactacatgattcggtgctaaccaccacagagcaagttgcgcatcagcctgcttgtctggaggctccaaatctgtcatacactggaatatatataaatagaaatttaaaaacataaaaaatgttccaccttatgtagcaaaagaacaaaagtgaatcacttggtaacaaaatcaattgtctactgcttcttcaggctccatttctcggagagaccactcaaaactcaacatgatgttttcggttatctggcgtttaaagattaatagtatgattatgtgaaccatgttaacgaattatgtttgagtgaatggatgcaaattaacagacaaattaacagagagagaaccacacctgagaggagaggtcggtgccggtgatgatggcggcggcggccacgacgccgttagtcagcatgggagaaggtgcaagcaacctgaggccacgacggctgtgcgcggcgaaggagaatcggcgacgacgactgaacggcggcggcgcggaggagatccctgaggcagcggggagaggggaggtgggcgatgcgagggagaggggagtgcggcgaggggaggtgggcgacgcgagggagaggggagaggggagtgcggcgggtgaggcgggcggcggaggtacgacgtggggagggcggcgcggcgcgacgtggggatggcggaggttagcggcgcgcttttttttctatttttcttggtgcgtggttactttcttagggatgacaggtgggtcccacgcaacaacggatctgaaaggggattgcaggattaagaatgaactcgtactttatatatatatatacacacacgttaagctacttgttttatgtggggataaaatccagaatcaagagctaaaagaaattaaactgatcctaataaatggagcagaagagaaattaattctttccgtaaaatggacaacctctataatactagtactcacacctgtctgtagccatcaacgcggactcccctgacagagtggccccacccaggcgcgtacctccctagtaaaaacgccgcgccggaacccgtgagaaaataccggcgaaactcgaagaccaattaaattcgaccgttgccgttcccccgtttaaaaatcacttgcccaccgcgatcccttccatcgcctccccatccatccgaattccagtcaaaccaacaaaccaatcgaagacatcacgcgaggagagaaaaaactagccgttgcgctactcctccg

SEQ ID NO: 2032 - DNA, 2000 bp, Oryza sativa
taaagtttcaattggtcagcaccattttgaaaaacttggtgattagctatgcatactctggttttggggaaagaccgcttgagtaataactttgatcagtgatatttgtagtacaaagtacaaacgagtttggtagaaacaaactcaaaactaactactcctctagctagtagaagtatatcgatctctaactctacgtacgttcagttagtcgtttaaatatctgtaacacgtacgttcaacacaagatccagagcatgaagggtatcgatcggctgatttctcggaacttcgtttctgcatgtttatttggtacatcgggtgtgtcatgaaatttgcatattttctcctctggctatgatctctattagtgtggcatcaccattgtgaactgatctcctccagattccaatttaggtgtgtaataataatctgctctgctacacgcctacacagtgtgatcgaggttaactaatggtaaaaatgagtgtataaacatctagatctagttcatccctacgttatagattaaagtaattaatttctaaccgtgtggtttgcagtcgcaagagaacggtcaaatgcatatagcgtcatagcgagtcacaccttaatttcaggtccagttctttcagtcgcaagatatgcgggtaatgcaggtcaccagtgctgcgttccactgtcattcttggcagcttccttcgttttctcttatgcgttttctcctgtacaactgtaattttttttttcattgttacttgtaccgccggtcactcaaaagacaaaactgatatttgtaacaatcagacaacacagcagtcagtccatggctatcagctagtagatgcacgtgttctttgtctaagacttaatcttctctttctttacaaattatccgttgctcgaccactctcccaatccaattctgaatttgtttcctgggaggcatgtaacgcaatttgtcagacgatgtaacatgcagtttgtctggcggcttgacgactgctattactgatctctttgtttctaaatatttgacatcgttgactttttttaaacatgtttgatcgttcgtcttattaaaaaaataagtaattgttaattatttttctatcatttgatttattgttaaatatacttttatgtatacatatagttttacatatttcacaaatttttttaaaaaagacgaatggttaaagatgtgttaaaaagtcaacggtgttaaatatttagaaacgaaggaagtacttagtaatgtgaccgtctctacttaatatattgtaccttgctagtgtacttattatccgtgttggttatttatgattgatgatccatccaagcatttctcttattcttctaatggaaaacattgtagttgaaattaagtaacaaaattagaacttcttcagttttagtttacaaatttacagaggcatcatatacctgtttcagttcattatcaaggcgattagtactctgtatcaatttgcgcaatgacactaagtgcgaggccagttaatcatgttgccagtgtgaagctaataactgaatcgagtgactaatgatcatcagctgactagctagctgggtgtgaatgtgtgtatggtagtgtatggcatccactgagatacactgatcatacaccaattatttggttccagaaaagcaagaaaaaaaaaggaaagaaagcataaagcaaaccaaacccaacacaagtaacatcacacaccgccctctaaaacgtcaagaaaggcgataaccactagcactacaacacactactggtcctcatttcacaccaaacgcgtccaaactcttgtgtgctatctacgtgctgcattgttgtggtctttagctctggaccattcagtgagctactggtggatcaagccatgcaaaaagcactagagcaagccctataagtaccaatggccatctcctcactctcatcacacagctgcactacttgcactgaagtagctagagcttgcaagtaa

SEQ ID NO: 2033 - DNA, 2000 bp, Oryza sativa
  misc_feature (1108)..(1108): n = any nucleotide
aggattcatctctgtactggagtatataactatacctgcattgcagaagtaagcttgctttcttagctcaataatgacattcttgcatgcatgatcctgaagaactagctagctggagtatcaggcaatattactataatcccaagttttgcacagaattaacccatgcagtctgaacattggaaaggccgtgtttacagctgctaaatatatatatatatgttctggatcacatgttttcagatgtttgccactgtctagtatgctgtgcagaataattccactctgatgctggttggtcgctgccttccatcgactgtatcctgtttgcacatactagccagcgatcgagcagacagtgcgtttcagacgacataaacttttggcattctgaattgttccgattccgtcttgtattaatcagcttcactagccgtcacaagacagcatcttgcaaatctctgttaggtacacacaaccgccattaacaagtctgctagactctgaagaaaagctgctagtgcgtgtataaacaaagtctgaactgaactgaacttaagcttaaacttaactgaactagtgggtatcatctttgagaatgtggggatcatgccaaatatttttcagacgagagtgcttctgctgctgctggccgttgctacgtctaattaatattaaggaaagggataaagctaagccatcgatgagggccatgacctgattgatcggtgtggttcgggccatacgtcgccatccaacgtgtacaaattaaactccactaatcagcatcaggggaaggccaagcccgtgctattcagacactggcccatcccggtacaagcgtgagatagaaagggagacgaggacgtcttaacgaaatgagatgaccaagttttaattgcagccgtttcgtccactctaatacacaaatcaataaactttttttttcaagaaaatgatactatccaaagtgaagggaatatcacgatttctagtttgcaatcgcgtcacgtatccactctgaattcatgtcggtttccaatcacgagagcgagcggctgcttgaccattgattagcatgcagattaattaattaattaaagaaacnaaaggagaggggtgatcaggtttagttgttagtccactactttattataacgaaagcacgatctgacaaaaatgttaggaggcctggcaattgcaagtggatagcgctaggaaaaatggagcatccagtgggatttggaaatgtgacccgatccattgcacatttgcactcaactgtttcgccctctccttcttcttttcgaagagtatcgtacgatccatttgaattttgaaatgcagaaatttaatagggctcacagaattttcccaggaaacaaaaaaaaaaagttcatttttccgggctgagctgtcttgggctgtaggaagctgacctttgatgggccggccaatgggaaaggctacacatctcacgacggaaaacacggaggcccatcagaagcccaatcgagaggcccaactcgcaacctggaagaaatcgccgccccgtccagtccagtctcctctcctctcttctcctctcccgccgccgccgccgccgaacccgccgatctccatcctgcgagcagcggcggcgctccacctttccctccccaaatttcaaaactcgattcgaaatctgccacgctttattcccgccatctcattctcacctacccaattgtctcctcctcctcaaatttaggttgaaaaagatattcccggcgcctccccacaatcagctagctctacaaatacctcccgcatgagctccatttgcgccatgagatccctcctcgccgcctccaccttcctccgctccggcgcttcccctctgctgcggcccctttcccgtcctctcccttcccgcctgaatctttcccgattcggtccggtgaggccggtctctgcggcggcggcggcggcggacaagtctcgaggcggaggcggctccg

SEQ ID NO: 2034 - DNA, 2000 bp, Oryza sativa
  misc_feature (1979)..(1979): n = any nucleotide
ggttgggcgaaagttgcctatgttattaagcaagctgatatgttgcccgctccaccatcaaaggataatgacgaatatgcattgcagacttgtgtcggctgaacataccgcgttaagctgcagaatctgttaatttcttttctttttcgttgttgagtaaggttgctgaattgtacctactcatgacatgtgtacattccctaccgtctgaatgggcaagcccggcctattcttgtacagaaatgttcttcagctcatctcattttgctttttctgttgaaatcttttgtaccctatataggttggaactgcaacatgcagtattgcaggcttgcgctgcgctcctgtgtgttctacaaaagaattgtgtagcttgtcaatgcaattttgtgctgacaaattatattcgatttggatttgttacaagacaatttaccgatggctctgtgattttgttctctttcgtcgaatgttgtcacgggaaattgtttcgatgtgtaaggcgtgctttggctgcatttggtaccgaactgaaccgaatggcccataaatcccatgtacgttttggaagcatgcaacaggagggatttgcatcctttcacttgaaaatagcaggtgaatctgaatcaaaatcagaacgttcctgtgtactccctccatccctgaacctggtttttatattttttttaaggatggagggagttaaattaggtttttatatgttgggagaagagaaattcttaaaaatcctatacatttatggttttttcctatactatcttaaaagcggagttgttttttttccatccccttatgctaacatgctcagtgcattagtacataatcaccgtcacttcttaaatatatgggcctggtccattgaagttaatttgatctatttctaattatatgtgtagtatctgttataggccgtttcccccgttcctaactttccatcacataaaaatttttctacacatataaacttccaacttttttcaggaactaaacacatccatagtgtacgtagtaagggtgtgtttagttcatgtcaaaattgaaagtttggttgaaattggaacgatgtgatggaaaagttggaagtttatggggctgtttggttcacatactaacgttgcctaggttcaccatacttctcttagctaaacttgccaaaggtgaggccttcaaaatctaagccacactctagccaacaaaataaaaccatgctacacttttcagagtcagttacatgtgagacctagattacaaaagaggaatcttgccacacttatgggagccaaccaaacactcacctaacatggtcaaacttgcctaacctcaagtgtggcaacttatgaccatcaaccaaacagcccctatgtgtgtaggaaagttttgatgtgatgaaaaagttggaagtttgaaaaaaagtttggaactaaactcagcctaagtactccttaggagcgaagaaaaaacgtttccaattttgctccaagcaaggccaagtttttcttcaaactttcaacttttccatcgtattaaaactttcctacacacatgaattttcaacttttccatcacatcattctaattttatccaaacttctaattttggtgtgaactaaacacacccaagtactactattttagagggggtttgcttggaaacaaggcgggtcgtttcaaacaattgctactttgggcgcgcgcccactcaacaacagaaacgaggccaacgcggccgccctctcccccaaaaacaatttcaaacctcgcttcggccgccgagccgctctgcactgtcccccccaaccccatccgcctctccctctccccccatttcaaatccgaaaatctccaagcgctccgcggcgtcgcgtggtcccttctccgcgctctcctctcctctcccctccccttcttccgaaggcggcgaaacccaagcagagagcgggcgagatctcgcgcgggcncggcggcggcggcggcggcgg

SEQ ID NO: 2035 - DNA, 1363 bp, Oryza sativa
aaaaggggtaaaaccccccccccccccccttctcctgtgttcatgcatgcatgctcgcccgccgagggcccggttgtcagcatgccggccgtaataatcaactgatctctacacgtacggccacgaacggcacgacatagcaagccgagagctctcttgatcattgcgcccaggaacacgacccagtacaggtacgggctgtttggttggtggcctcggtttgccacaccaaaccttaggcgcgccataatttttcaggctagtgtttatttgcgtgtcgcagttaagtcaagccatactttactagcacattggcccacgcgtcatactcttatttgctacccaaagtctgtcatagttatggctaacaaattattggccacactttgtgtggcttgccacagttatggcaaatcgagttatacatatagcctccatccaaacagcagtagctccgtgtaacactctcgagcgggtgcgggcgtggcgatcgatcgaacggcaaaccaggcgtgtcccgtgtccgtccgtggagaggggaggggagggagagggagaccgggcgcatcgcgccacagtttggccggggcgcgtgggcgatccccaccactcattccccttttcagtcacgaacagtgtccgcgagatgcggcccacgctggctactgttgcgcggggacatgcagagcccggccggtagagcaatacatactatactttgcctgcatatgcccccatctcgctaatacacactagccacccagggctctctcacacagtctctctctctctctctctctctctctctctctctctctctctttctatctttctctagctagctatctagtggatctctttcccatctcgcgcgcccccatagcccttttgtccagggccaatatatcctccggccacgctcatgctgcctcctcgccacctctgcctttccctctttgctcgcggcaaaatccacatgcagttgtagacttgtagtagtagttagttgtggttgtttgttgttttggctttcaaatcaggaacaacgacagatccgaggctttctcgaatcgggcaggtccatcaaatcggaagccagccagccatctaatcacctcatcacatcaaaggggaccaaaaggatatctctggtggctaccccctctcctccggccactcgtgtaaaatttcccttctgatcctgcgctgtgccagattataaggccattgcgtagctcgatcgaagaaagaagcaggccagccacagtactgcctctcttgtcgatcgatcgacagccacagcctgcaggtgtggggattcggctggccgtcgccttcgtcttcgtcttcgtcgtcgtcctca

SEQ ID NO: 2036 - DNA, 2000 bp, Oryza sativa
ttattatctacagtactttaagcacaacttttcattttttatatttgcaaaaaaaaattgaataagacgagtggtcaaacgttgcaatcataaacttaaaatcccttatattgtgggacggagggagtatttaattagtaccatatgcacagcacgtcagacacatctattgcttttatacctagaaactaatttcattccaatgctagtagtgctcactttgcaactcaagccctaactgagttccagttttatttcccccatactttacacagtacattcctgtttttcactttttggtagaattccagttttatttcgcccatactttacgcttcatctgtgatcacattttttgcaggcaccaaaggcgttatattgggtgatgtccttctgcaagtacatggatatctccatggatttagtcgagtcatgcttaccatcttcctctctggctatcctgcaatcctgacccttctgttgtagttatacataggtttacaaaatcggttaagccttagaactgttagcttttgagcttttcttctccattccatgatccagggtttataacttacgaggtcgcaatggtgctagttgacacttgacagtgccctgaccctgaaatgctgcaagtgcagtagctctagtgggattctcagtacagctacgcttttggtggtaaaatgaaatggagtagagcgcgtactgttgaacattcatgtgagtttttcatcagggacttgcggttattttcatgcgagattttcttaaccctatcttgtattttggtgtgttgagccagtcagagactacatagtgggaagctggcccataaaagttaaaataatagatttgacagtattatccatcagttttatgggagactaaattttacatatgcatgcgcgttcatgcagtatgcagtcggggttgtttgaaagcctctgacgatatttcaagtgtgtacagaggacgcacatacatgtgtatttatgatgaacgcggatgctcaaaacgggcacattcactccgctcttaggagcacatttgaaagactgagctataatattttaagattgttagattcattatgggtgtctcattgttgacaggtatattgtctatgtattctaggattttgaacttagatggattggtttcaccataacaaatttaataatcagttaagttaagctcaccttcataaataagagcaattgttggtcaaagtattgtcgcaacaaaacaaaatgtgttctacattttaaatccgagagagtaaggatgtgtttggttgcatgcctcagaacgtatcagattcgtttggttcatatcataattatggctcgtcacatttcctctatatgaccccaaatgtcacaaagtcattcttaacaaaacttgtcgctagcattttgctagccacactttatgtggcagcacaccttgctcctttggtgtggtttagcaaaatcacttagcaaccaaacaactgcgtttggatcacatgcgtctgtctgtgattttcaaatgatcccatggcatcctttagaatggaggaatttaagagaaattgagctaaactatgtgaacatcctatgaagttactgcattcaaggcgcccaacatgaaatctattcaggttcccaagttgtctgctgcttccgtaacgtcaaaattcgacagatttctggctggctaaaacacccacaacggcataatagcctcgctcgtcaaaacattcacccatttttagcttggtcatcatcaaaagtaggatcaaatcaacaatctgccttctcttcagccactcgatcccaacggcatctccaacgattcctacttgcaaggacagccatggaaatcctccaggttccccaggttacttataccacagctcgaatccgttccaaaccaggccatttcagtaccctcctctcacattttccccaaataataatagaggaaggggaaaaacacatttgcagccacatcat

SEQ ID NO: 2037 - DNA, 2000 bp, Oryza sativa
acaagttaacaacaaccatcgcttgtttttttctttggcatgttaatgggggcacactatattcacctgtgcgcgcgtacttgtaccgatgttcactagatttggcagcattttctttgctgataattctttttccggattccacccccatttaccttgttttctttttactgccaatatttttgggaaaatccatctgtttccagttttgtgaccgaattatgatgcaaaatttccacagggttagttatgcgaattatgcacaaacacatttaaaatcagtatccaattaccgttattacacttatgggttatctgaatatctgattccaattaccaaagcttttagaaacggcccatttactaacccgtccagtgaaagcccaatcacagtcatgggctgcgccattagcccattattcatgtgaatacttctattcacagggaccactacgtaaaagtcacacctaggttttcacctcgccgtcccactcccacccacgccgccgccaccgccgccgccgccgccggtttaattggccggagcgcaatctctagccgccgccgccgtcttccccctgagaaagcgtcgattccgtccgggggtgggcagcggtgggactcgtatccggacggccgcagattcgttgagcgacccgcgctgctggttagtccaaaacctttttacctgagcccctaggtttgatggttcttgatctggagaagtttaggggagaaatatggctgcgatcaaggattgcagcctccgcatttgctctcgcaagaaggtggggagtagtagggcggattttaggggcgattttgcaacacgtgtgagattgatttttttcccctgttaccgacggaactgtgactgtttcatttgaagttattgcattatctcgagtgaaaattcttgttccagtgcaggaatttagatgaactgcacaagctggccacgttagccatgtgatggtgatattggtttgatctttgtggacttgcttagtccaatcaggatctgactgtgttcataaatgtagtgttggtgaattgtattctccattatgtctggaggcgaattacttagtctgtacatgcaactggcaggaattgattcgttaatagttaccaaaaacctggatagattggatgggcattggttaccagagctcataatgaccaaattggcttcctcagataactttgtacgaacactgcccgtacctgttcctgatggcatttcattatcaataaattccatccttcttgtatgttgaccaaaaagatgtaaggccgctatcttgatttgtgtagtcatggttttttcagttgggcggtcatcccgaccgattaaattgttccaaattagtagctggttgtttctttgatttgtaagccatgttggttctttctgaattaatagttggttttcccgcaaaaaaaaagaattaatagttggttatttctttgatttgtaatccaggtttgttctttatttagaaagcgttaaacctctattaggagagtgtagtatatgcaaggcatataaaattctttacgtttctattgccgtttctggaaatgttacggtagctctattccgcatatgcttcctaaccattggtcatactattgtgtgctacagtattttgtttgccacatgttgggtgttgcccttgtatttatatgacatccatattgcccttgctttgattgaattgacagatggtagctactaccctgctttccctcgaggaactaatccaccgagagtcgtgtgttcccgtgattccgtaatattttagaatattgtggaattagagaaaataatgttaattgttattaaatcataataactggcagttagtgtaaaagtttgtactgtttatgccatatcattactcttgcatgtttttttatatgttgacgaatatgctaaaaatatgcagtttttcattctgcaggttttagtcttgttggcatccttctgttaagga

SEQ ID NO: 2038 - DNA, 2000 bp, Oryza sativa
  misc_feature (1792)..(1792): n = any nucleotide
agagcaaggggctctgcctcatgccggtggcgctggcgtcggcgatatcggcacagaaggggacgtcctcggccgccgtccgaccggagaagaagaagaacggtgatggcgatggcggcggcgacgaggaggacgtgaagggagagtttgacgcaccgaggaggcctcctgtcggccggccgaaggagatgaggtccagagtctaagctagaacctctgctttgttcaggagagatggagcttaatttagatcctaacactttgctacttatatgtttattattatgaaattttaattgcaagttgcaactggtgatctcgaactacattttgccggtgattagaaaattgttatatggaggttagttattaaatcatatataattatattttgtattgttgcggtccttgcggacaatgccattcagtaccttgatatttgatctatatagttcacaaatttttgtaaattatgtctttaactcatgctggttatgatttgttccgagtttggtgagacatattggatgaagtgccaaaattatatatatttatgaaatcttcgtgaccaaaccatcatgaattcttttgtgcagtactccatttgttcctattataagatgtttcggcctttccatcttttgtctaacattcatatgaatttgggtatgtatatatgaaacataaatacatggacggtcaaatgtttaacgctacgtttcacaattttcacgcagttgaactcaatttcaggaagacggcatggttgtagctagtaaactgaactcgaactcaatttcatatcaactttgaggcacaacacaaggcataatcgtatcaactatcaaaagaatagtgtgatccgtttcaaacgatgttcagatcgctcgaattttggcaggattggttccttcatggatcgagaaattactcgaattacgatcagagattggttgcctagttcttcctcgacagcagccgcgcccggagctcggcggcgtcgacgtcgccgaagcgattctcggggacccagcagccggtcttgggatccctcatccagaagatctccttcgacgccgccgccgccgccgcaccgccggcgccaccctccgccgccgagatcctcgccgccatcgaggagccgcgctgctgcaactctgccgccgccgccgccgcgtagccccggcggctgcaacacacaataacagatcacgtcatcagtgacctcgcagaatgccttccagaatccaagaaaccaagcaagaacgaacgatccaagaacccatccaagatcatatacccagttacccacccgagcgagagcagttgtccggcggcgacggcggaacgcggcattgcgctgctcctcttctgtgtcggagagagagcgagagagagacgcggcggcgagaggtgtcaggagaagagtggttgtctctgcctccggcgcggcgcggcgcaaggtgcaggtccaatatataggaggcggatgcggcgctagggtttcctcggcgccgccattgcgcgccgcgcgcgatgagaggcgagccgagcgcgcgccgcagcagccgccgcgggggcgcgccacgcgcctcccaattttttcgcgttgccagcaacgaacagctgacggccccgttcggttgaatcccagcccagcccagcccagtacgagaaggacacgcgagaagtttgggctcacaaaattgggccgggcccactaagctttgcggcttgaataagtctacttctcctccccactgtccacttcagtgactctactagtcgagtngtcttcatcttcgagaagggagaaatttcagagagattttttatttatttatttttggattttgggatcggcggccgacgctgtcgagtaccggagtaggggagctcgccggagtaagctcttctcaggctgtgcgggggtggcggagggcggcgcggcgcggcgagggggcatggacacgatgaggggggcgctggagcgggcgagg

SEQ ID NO: 2039 - DNA, 2000 bp, Oryza sativa
  misc_feature (1932)..(1932): n = any nucleotide
ttcggggatgaaagtgtctggttttgaagttgatggacgatttttagacttatgcaaaaatccaggggtgtaaaaaagacatttccctttttcttaatttagaagcccttttttcccttcagaaatactagttttctgttttattttgtgtagatctgttattcttgtcactttgaactcatatttgttcgtccaatatctgaaaagcttatatttaacctattgcagttccgatagtcttcagaggtgtacatctagctatggaagggataatgttagaaccattctcaaaggacttacaggacgtggggaggattcttcagatctatacgattttattgaatgcaatccaagtttggattattcaaattggtggacacaacggaagaagtttaaaaagtttaaggaccacaaatggataagaagcaagagacattctatgagtagactgagaacctcaaaggtatggttaagataaaagtgcgccaatgtacatcaccgcccctgatgttacccattcagtgggtcttttgtatatagttccagtgggtggttcagccgctagatctcatgggcgttgggcagcccagtaccggtggaggtaacattatccctatcttcccctcttactcagtactgtagctcagttggtcagagtttattggataggactaggatgggtccttccctctctatataaggagagattgtattgtggtttggattaagcaatgaaaatcgattagtctaatctctactccctcaatgttcttctccctgttctaaatttatatcccttctccagtagctgacgctgcctggatatcttcttggcggtggtgttttgaatgaagaaacattagattgaaggtgatagtgaaactttgataagtcacaagaatcttatagcattagaaatatcataactgagattgactggttccaggaagtccactcgaatgcgggatatgttaatgttctgtttgtacgtgtgcattatttgtgttactttataatagtagaatcactagcatgtactgtatcaagtatcatgtctgttacttttgtatctcggcatatgttctccaacaccctttgctccttgaattttcatgtaacttttgtatcttaacatatgttctctaacaccctttactccttgtttaatttgttcgtacttccaccaccgactatgtttggtctctcttgtgaaacttacatgtagtctgctcgttctttctaattatgcgctcaaacgttctgaacgtcggcactattatgctgatttttttttaaaaaaagaaaacgaatagtaaatcaaaggtgaatacatgaaaactgtcgaatatttttgtgtatattttattattttgtaaatttgtgtagtctagtttgcaaaataggatggacgctgttggtcgggtattcagatgtaaatgaagggcaattgaagggtatcccgatgtatatccaaaacttttgataagaaaatagatgtataaataaatcgtataatataatatgtatgtatatatatgagaaaagaagaaataaataggccacattaaaccctagaaacaagaagcctatcgttctggtctcctgggcctcactccccgcttcactcctctgatgtgctggccagccgcgtcaaccgatcagcacaggtacagagacccgtccccaagccacggccgccgcaaccacgccacgcaccagtcggtggtggtttggattgtcagctatactagttgatacctgtaccggaaaaagtatactcttgactctctcaactattgtccgagtactctaagtatcaaaaccagtacaaacaatgtccctcggtggttttgaaggtggttttggtctacgtggcggtcttgaccaagtctttgttctacgtgacgcttacgtggtattagaaaaaaaacnaaaataaaagaatatgtaggacccatatgtcattcacaaaaaaaaataatattgtggacccataacgc

SEQ ID NO: 2040 - DNA, 2000 bp, Oryza sativa
aattgtcgaatgtgtagaagatatcctgcgtcaatttccaaaaggcattgaagaatctaaaaagcctaagaatttttatcatttgctgcacttatgtcatatctacctgcggccaacccataagtgtgttgggactaatcaaaatcactcaaaggtacggttttttcatcatctagtttatttaggacagaggtatgttggttctaaccaaaaggaaaatgaggaatcccgactgctaactcgccagaaggattgcttccaagatgagcaattaccaattcgatggcgtcaagcagtacaataccatgaagcaggagttcaactgaagaaaagggtatacagcatctatgagaaacattctctcttggacataaagttcagtaatggagttctagaagtcccatgtcttactatcgatgagaataccgagtctctgttcaagaatttaattgcatttgagcaaatggattctcaatatgaaaactatatcacagcttatatcgcttttatgtctcagcttgtaagcacttctgaggatgccactctacttactgagagagggataattgttcatatgctggataatgacgatgaagtgtcagctatgttcaccaggctcagcacacatttgatatttggttctgatacctaccactaccttcaaactttatcctatgttttggaggaccattaccaaagcaggctgaacagatggatggcttggctctggcgtaatcacttcagcaatccatggttagcattaggtgtgttggctgcagtggtcgtcctactctgtaccattgttcagaccatattaacagtcctagcctacaggcaaccccattgatgatggcatttttattctctttctaagtgaacacattcctatttcttgttcaatttggtactggtatatatgttatctggtgagaatactactgtgacaggtatgtatccaattgaaatatgatgctagagtaaagtgcaactcaccttagatcatcccggtataaagtgaaacacgatgtaatttacctggtgcgaagtataatgtactagaaaaacagtaatttgcatggtcttcgattagtaatgtgaaacctatcctacttaacattcttttcaaataatgagaattccctttgcaattgcgtgacttgacaccattacatgtttgtatttagagttagaattataatgtgtgcaattactgtgtttgttgtttaaaataaaattgtacttctttcaacatttttgtatcaatcaataccactggaatctaggccactacaatcaacagtgtagaactaatttttgctcataaccttcgtaatttctaatccttgagagcaaacttgatgatttcttttaaccttttatgtactttagtttaatataacaaacataagaagtcttttaggaatatatagctctcttgtgcagcattgcaatagaaactactcacaattttacatgatggtatgcttgcatgtgtaatatttgtactaaatttactaccctccattgaaactaacatcattttctgggaacttctattctacatattaagcaacaggacaaattatttatttagcaatagtgaactaaagggtttgttcagattgatgccatttcaaaccatatcatttttttggtagaattgccgaatatgcgcatccatttagtttttttttgtcaaactttgataaatacataagaaattctgccaaaattttggcaatttaaaaatttggtaagatttattttggctacaatctggacagcccctaagaatattgtgggggtccctttattttcccacgtgcatgctttaaatagaatctactagatatttgattccccctagttcgctatgctaagtgcatttgatcgaaactataccatgtgactagagttgggatcacattttacattactatataaataggcatgcgagctgcttatttcatcatctcgttttcacttccttgcagcgaaag

SEQ ID NO: 2041 - DNA, 601 bp, Oryza sativa
gtactgaaaatgaaaagtctccaagcaaatagagaccggggaagggagagaaacaaaggaataaaagctacagcaatttcgcctgctttatctcatccaagaaaaatatttttgctgctttgctgaattgcttgctaggatatgtataacaaacgaggtggttagcgaaagggataccacagccgcaaactctccggtaaagcagccgctgtgatgatgacagaatgacaacttattactaataagctcttaatcctgaagattaacgcattccagctcatccgtctcctgacctttgcttgtctgtcccttcgcttcaacttctctctctcgctccgaataaaaacagcagaggaaaacgtgagcagaaaccgcagagatattgatcaaaagctgcgtttttttcccttctttttttggcagcaagttaattccaccctccactcctccatgttcttctactagtggcacagcagagcggccacaaccgctcacctcaccactccttcctccaatttcgcattcaaggcgactcctttggttagagtagtagaggtgcacgaaccaagaaccagaagcagaagcggaagcagaggcagca

SEQ ID NO: 2042 - DNA, 2000 bp, Oryza sativa
aagattcatgtagttttttgagtacatactcgatattctctgctatatatcttgtcttctataaaatattcttcaggaacaattgagcagtgagcactcgagtaggatgtggtcgagtacaccccattatcgaaaacgttctcaacaaatgttgagttgtcgcacccaacctaccaatgaagaccgacgacttatctcatatatagcgccagctacggctggattatttgagaaagggttgttaatggataattcctcatgaacgttgtcggcttgatcacccgacatggttgcgaacagacatccggatatgctacaagttgggtatgtgagtcatgctggccacatgagatacacatgtaatcagaaactctagcgcccctccaggtgatatacgcctacacctggtcctcaaccagtagatcgtagcgatctctcaccacctaaaaattcatcttcaggtgatcgagatacgcctacacctggtcctcgaccagtagatcgtagcgatctctcaccacctaaaaattcatctccaggtgatcgagatacgcctatatctggtcctcgaccagtagatcgtagcgatctctcaccacctaaaaattcatctccagctgatcgagatacgcctacacctggtccttgaccagtagatcgtagtgatctctcatcatctaaaaattcatcttcgcgtgatcgagatacgcctactactagtacttgaccagtcggttactgcaatctctcgacatctaacacgacaatcaacattgtcgtgatagtgacaaccaagaccgactagatcgccgttgtcaccaggacgacgtccaagactaacgacatcaggacgacaatggacaaggttaacgacatcacatgacgacgacgaaactcgagatcccagacttctagagggcctgagaacgagttagtaggtcgaggagccaaacctccaactacgataattattccttgtctttgttgtcattaggagacagttcttgcaggtcacgagaacgtcgtcaatccattactctggattcccttcaagtggttgaggtacgactacgactagtcttcgattaacaatgtagtgatcctcgtatcacgacttctaatggtcggggtatgactacggctggttttccaccagcaaagtagcgctcctcgtaccacgacttataatggtcgaggtatgactacgactggtcttcgaccagcaacatagcggtcctcgcaccacgacttctaatggtcaaggtacgactacgactggtcttcgaccagcaactatacaccaggtctttacccggtgtggaagtcatctcatcacttcatatacgtcaacttctgtaagtgtttatatgtgcaatatttgtctggtgatcctcctttcttatatcaccttcgtcttgaagtcagtcctactgtccctttacgatgttctaacaaacctccgagaaacctaagggaatttcggctggggacgcccagagcagataaggtcttgttggattataagagccgaacaaccatgtaaaacctggtcatgtaagaatgctcaatggatgcgtattaaccaagccgtgtaatcggaaattgacttttccaacttcacggccggaggctaggatttgtcaactttagcttggtttgttataagattcaagctgtctttgtggaaaatagtttttccataaaaaacagttgggggctaggaagggtaccaaactccgtttgctgagggaaactctagcgagcgtatttttttattgccgcacatatattcaatttattttcaatttttccatacatattgccctttgagcgttcgctcaggggctatttctatttaatattctgttctgagaattgatttcaggaaagtcagacatcaaaacagtcaagtcagattttcaaggctttgtcgcaaactttgcaccttctcgattactcgagaacggttgatggagcttgacaagtaatatggaatgaag

SEQ ID NO: 2043 - DNA, 2000 bp, Oryza sativa
ttgtgcattgtggagaagaagacgaacataaacactccgtgattgtatcagtaaactttctttgccatgtatgatcatcgatcactctctggacgtccgactatcacgagcggttcgtccgtgatctgttgagtttattatacgactacgagcgtacaacggacaggctggtccgtgatgatccagcgcaatcatgtgtaccaatcggccctactacaaaagcgcgaagctttgctttcgcaacccagagccgtgccaaattgcagctgatgtacgcacatcgtataccggaaagaactgttcgtcatgaagagcagaagacgtccgttgacgctgacggagaaccaggcgtgttgatgacttgattgcaaactcgtacggatgctgatgccgatcgatgcccctgctacacgattgttgggtcaccgcattagagcaagtctaacagtacagaatactaccagctccaattcatttataaccaatctaatagccaattcatacaatagttgcttactatactattaatatatgatcccacatgtcatacacatagtgtatcttagaatccgtgctgcagctggctacagatctgtagcccgctgcttctctctctcatcgtttatcttagagcaagttcaatagtagagagagttaactgccggctccaaaattcaccacattatttaagagataactaaacaacggtagatacagcaattggctacacccatgctttaaccaacgcatcctgtcaggtgttggtaacttctgaatgttcaagttctaattttcgattggttatcccgagcggcagtggcagagcccctaggcgctcgtgcttgagccggcgactgaattgtcgtccgctttgttctctctgctttccctctctttatcatatatgttaaaatattagataagcaggctttatacctgctcttattaaaatgtgtttatagttggctaacagcgttattgtacctgctcttactgcgtgacttgatttctccttaaaagcatcaccggccaaccgtgctggatagcatagtgccactgttgtagtatgtcactcgagagaggagcagggggagcacaagtgtcatgattccaccaattccctagactgtttaacgcctctctctccgtgaacctttttcagtaggagtactagctgacccatgatcatgccacagcccacagcacgcgcctagcagtaaaatagtggcaggggcagtagtactgtattagctggagcggtaaatcaagaatgtattatccttctactgcagctgaacaacccagattgtactaacctgacctgtaaatcaataagagatgctagaattacaccatttgaaacaaaaaaaaatcgctcggagcaggaatcctttacgctgggcctgaaagacgccacggagaagtggagaaagcaaagcaaagcgccgtttattactgcacgcgtctggggcacctgccctggcaagcatggcactggtactgtcacggcagtatcatcacccgacctcacagtctcacctcgatggggggcccacacactgtcgcagtgtatcgagcgggacccaccacctttccgacgcacccggctccgcctgacacgccacgtgatccgccgctgacacgcggggtccacgacgcggacggtgtccacgtgttcgcggctgggttttaaacgaagcaaaggaatagtactactccctctaccaccccgacagaaagattcgcgccaagtcaaaaccccgggcccgtgggtcccaccttccatgtctgtactggaagcgagcggtgcgggggacgggcccacctggcagcgagagcgaggaacccatgtgtgagtgtgaaatgccccctcgcgcccggttgaaaccttgccgcactcgtcggcagccgcgtccacacctcggctgctccttcccagttcccccactccactgccaccaccccctctgcttcatcggggaatgcgaccgcgcgctcga

SEQ ID NO: 2044 - DNA, 1263 bp, Oryza sativa
  misc_feature (29)..(29): n = any nucleotide
  misc_feature (50)..(50): n = any nucleotide
  misc_feature (68)..(68): n = any nucleotide
  misc_feature (73)..(73): n = any nucleotide
ttaggaaaaaaaaagaaggaaaaaccatnatttgcaaaacgcaatggatnttggatcaaattacaagntaatncatgggattcaaagttacttgtttgtcgattaaccaagtgggatattgttctgtttcttgatcgagaaatcattatttttaagacgagccaagaagttagaagtgtgagttgttgattttgaccccgtagtcccccaaggatggggccatatggctgtttggtagatcatgttcccaactggcactgctgatcattgtcatgtgcaaatcacattatcatgtttcgttttgcaggttcgttaatatgctaggataaaccaaaatgtgataaaaaatgagctaaacttaggacttgattatcgcaaatagtgatatgctaatagccattgttgactggttcaatatgtagtagaacagcaacgaaagctctactagaagatccaagaatattttgggagctctattgctatacacgcaatgtccagtgtagcagagagggtaaatctagtggacgagatgtcacaagtgaataacatctctcgtttgtcttgtttgtttgctggcacgtccggaatctgacgtcctgtggagcttgtggatgctgcagagttgtggctaagaggccacacgaaacatatcacgtgactagacaggttgcttgcttgctatagtgtgcacttgttgcacataaatatgattaatggcagagcagtttgttaattggaagtacaacgcaaatttcaactgtttattaatggcaattgccttttaggttggatttttatgctacggtaccagcattacttgcaacatttttggatattcttcactccaactccagcgaatattaatgtgcatgtttcctaggaaagctgaactttttcctggagaatacattgccggtgtgtagctcaagtatgggctgtgtttggaagcaacaaatttgttttggccacaaatattaagcaagaatctcgattacttgatgcccttttttgcatatccaaggcataaattgtgtttttgttcttttctctgtgaacaagattattccttcctcttgtcaaagattggtaaatacaatagagattcaccttttatatggtacagccatcattgttttggctgctaagtgccaacacacatgcacaaaagtatgtattctctggtttatttcattagattgtatctatgcgaacacaagtactttttaagcttgtttgttccttatgtggcttccgctaatattg

SEQ ID NO: 2045 - DNA, 2000 bp, Oryza sativa
ggcaaaattgtgcagcctacagcccgccaaggaaacttattttgcacgcactctggcatcatatgtataggtaaaggcagagatgacacttacaacgttgaagacagcaggagcaccagggcctgttgaaccaaattaagtgagatgatgcatgccacatagtgttgtgggtgagccataaagagagatgggaaagacagttccataccgatctcaagatcatgccacggatgtgcagctactgatctcctcgacaaggaggacaggatcctctcgttgagcttaggggcgcgcctgggctgcccagcagcagcattggtgtcctcttcactcatcctcctatgatcatatcataataggaaccatagatcaagcatcaatatagctgctatcagaatgaaaaaaaaaatatatttttaattagcttgagctgcagcctagcaggtcgagcaaacatctagcaaaaagcagagttgcaacttgcaaagttgctttcttttcccctaccggaactaaatacagtcaagctgtatacagtatacaaccccctgacctgaggctaacatccatgagatgagcatccgaacaagatacagtcgttgatccgattgatcttaacacctacctactacactcagatcagatccagggtcatgtatgaaccccacccaatccctttggaagcagaaaccaaatccgcaacaaactaaactcgatgtaatatagcttccgctcagattggacgcaacccacagaaaataaatccaagtcctgagaaatagcgcggatgaggagggggaagggagaggataccttggattggagtggcggctgaaggggtggaaggtggcggcggcggcgaagaagaagaagaaatgaaatgattccctgcactgcactgcaccctccgtctgaggaaacagtattaaagacgggtgggatgacaatttctacttaactccctccttccaacgttttaatacaaaatgagcccctaatggaagtacttgtgctaaggctagtgcgcgtcttgtgtgccaatctttggactgggagctcccatgttttggcagcaagtgggaatatccaatatcgcccctgaactttatatactcatcactaagggagaaactttttattctttctttgtgatggtagaaaatcatgtccctttcaaggcttttgttttaaaatgttttatttgagaggaattgcttgaaattacttgcacctgctcaactagtacactactgaattaaagttgacctgatgcggtttgtgttggtcatcgcattcgcagacaggccgatcaacattcgaaaaagggctcgggacattgcctgccgagttggttggtagtacagtgttccaatcgatccccatgtccatccatgtgggctcttgtttgacagcgccaagctcagttcaagtggattcgattagatcgcgattccatatttccatgccgttttggagttaactcggtttttggtcggtcacacaggtaaactagaaggcaggttgaccgctccaagctgcatagtccttctcacgatgctcttttctgatcctcaagacgctcgagcatccaatgctctcttctgttgtccgtagtacttctactcagctatctcagctacaagagtggatatcacacagaattttgactgcgtttgttcgtgtgatataggggtgcgtttttttacaaaaattttctataggaaagttactttaaaaagtcatattaatctatttttgatatttaaaatagttaatactcaattaatcatgcgctaatggctcacctcgttttgcatatcttcccaatctccttttcctcaaacacacccttatactctagtagtaaattattaggattttttttatcttattttctttctttcttgcttgcttgtgtggaaatgtgaaaattgagcgtctcgcttacaaatattacaaaagtatgggcgaaatgaagaagcaaaacggcaacggaaaaa

SEQ ID NO: 2046 - DNA, 2000 bp, Oryza sativa
ttgaacatacttcaaggttaaaccaagtggataggtacctgcagatgatcgtagtttgctaatgtcagggcagaatcgtttgggcctttttcaattccaaatgtggggtttctaacatgaaagtatcataggaatgagtaacgcaggaacacacctcattgcaattctctttcggtcatccacaagaagatgtgttttgctatcgacataagcaacgaagaacgtcaaaacaatatcaatggcaaagaatatatccacaatgttctcaactagcaaaagcttagatggtaagtccctcaggaatgctagttcaaacggacaaatccaggcagagtaaacaactaggactataaggaacagctcccaggatctgagagacacacagacaaagcaaacaaagatcatgtcagcaactgctgtttacttatatgccttgcagcatgtgataggtacagaaagtgcagtgtgaacctcacctgtaccggggatcataaggcgatatgatgaacttctgcaacttgttggagtggtttatagttgcaccaagggatggcagtagctctacagtgaagctatcgctgctcctcttgatctggagtccatcccagaactggtggaagcaagattttgagtgagcttgggtcatggttgctttgctgttcttgttcttggccacccaactctgtttgcagagggtgtggaggctgggtctttatatatatatatatatgtatgctgcacatgatgaacatgcagggtcaaggtgaggaattttaaaaagaagggaaccggaaactgctcgtgtcctgtaccttacgaggaaaacaacggacagggcatgcgtgttttagatgggagatgtgggaagctgttagctaagacaagtcggcagattctatcacgagacagagttgacttcttttggtagatgatcagctgcagtcaaattaactcctgaagcaatttatttccagctgatctgcaaggatagattctcttgcgaatgccttctgttgagcaagaaccaacaggctcctctccaaccatttgctctggtgaatgtgcaggctccttctgtggactggtgctctcctcgattcaaccaagaacagtctgtggtgtgtattgttttgctggtgtgttgtgcatccagtccttgtgctgaagtggcaattgtgactagtaattaatttctggatagctatgcttcttcataattgttacttttgtagtagccattggttcccaagtcaaaggttaaaaaaagaactcgtgcatcagtaagtggcattctgttaatctcagtcaaatttacttctgacatatgtttttcttagcactgccatccacatgtttgtgcaaatgtgaacaggacggccggaatcatggatgtcatttctgccagtaatctgcaatggacttaatcgttgggtatattcttttggtagttgtgttcaactaagatttgttttagtgggggtgaaggatccattctctacgttcatctcaactaattaaagcagatgaatggctaataagatcatccacaatctcttgtcagtcactcagtctaagtagcctccgtgttctgatgcctaccagttgctgcaattagtgtttatccggtgcactgattgggctgcctgttttcatgggaccagtgaggaatgaacagactgtatctccattattgtgatctctggcaaaagtttcacttgtttacaatcttatttgaagttctgtcttgtatcgcgttcttggtgaatcagccagtacttggtcagatggtacccacttcatatcttgtgctttgcaatggaccccgaagttatattctagacaaaggaaaaaaccttcttcttggtacactaattgttgggcttgtcgatgttataactgaataataagcgtatgatttacttttgtaatgattttgctggctggatatagcacttgctaattgctatcctgacagatgctcacatgtcatgcagggtact

SEQ ID NO: 2047 - DNA, 1735 bp, Oryza sativa
  misc_feature (1)..(1): n = any nucleotide
  misc_feature (11)..(11): n = any nucleotide
  misc_feature (13)..(13): n = any nucleotide
  misc_feature (27)..(27): n = any nucleotide
  misc_feature (31)..(31): n = any nucleotide
  misc_feature (33)..(33): n = any nucleotide
  misc_feature (39)..(39): n = any nucleotide
  misc_feature (52)..(54): n = any nucleotide
  misc_feature (58)..(58): n = any nucleotide
  misc_feature (60)..(60): n = any nucleotide
  misc_feature (63)..(64): n = any nucleotide
  misc_feature (66)..(66): n = any nucleotide
  misc_feature (72)..(72): n = any nucleotide
  misc_feature (79)..(79): n = any nucleotide
  misc_feature (87)..(87): n = any nucleotide
  misc_feature (135)..(135): n = any nucleotide
  misc_feature (143)..(143): n = any nucleotide
  misc_feature (148)..(148): n = any nucleotide
  misc_feature (154)..(154): n = any nucleotide
  misc_feature (166)..(166): n = any nucleotide
  misc_feature (177)..(177): n = any nucleotide
  misc_feature (188)..(189): n = any nucleotide
  misc_feature (194)..(195): n = any nucleotide
  misc_feature (200)..(200): n = any nucleotide
  misc_feature (203)..(203): n = any nucleotide
  misc_feature (211)..(211): n = any nucleotide
  misc_feature (216)..(216): n = any nucleotide
  misc_feature (219)..(219): n = any nucleotide
  misc_feature (228)..(228): n = any nucleotide
  misc_feature (234)..(235): n = any nucleotide
  misc_feature (240)..(240): n = any nucleotide
  misc_feature (251)..(251): n = any nucleotide
  misc_feature (257)..(257): n = any nucleotide
  misc_feature (261)..(261): n = any nucleotide
  misc_feature (267)..(267): n = any nucleotide
  misc_feature (270)..(270): n = any nucleotide
  misc_feature (294)..(294): n = any nucleotide
  misc_feature (300)..(300): n = any nucleotide
  misc_feature (305)..(305): n = any nucleotide
  misc_feature (307)..(307): n = any nucleotide
  misc_feature (324)..(325): n = any nucleotide
  misc_feature (327)..(327): n = any nucleotide
  misc_feature (330)..(330): n = any nucleotide
  misc_feature (339)..(339): n = any nucleotide
  misc_feature (349)..(349): n = any nucleotide
  misc_feature (353)..(353): n = any nucleotide
  misc_feature (369)..(369): n = any nucleotide
  misc_feature (379)..(379): n = any nucleotide
  misc_feature (388)..(388): n = any nucleotide
  misc_feature (393)..(393): n = any nucleotide
  misc_feature (407)..(407): n = any nucleotide
  misc_feature (415)..(415): n = any nucleotide
  misc_feature (439)..(439): n = any nucleotide
  misc_feature (446)..(446): n = any nucleotide
  misc_feature (450)..(450): n = any nucleotide
  misc_feature (454)..(454): n = any nucleotide
  misc_feature (459)..(459): n = any nucleotide
  misc_feature (486)..(486): n = any nucleotide
  misc_feature (492)..(492): n = any nucleotide
  misc_feature (496)..(496): n = any nucleotide
  misc_feature (514)..(514): n = any nucleotide
  misc_feature (518)..(518): n = any nucleotide
  misc_feature (543)..(544): n = any nucleotide
  misc_feature (556)..(556): n = any nucleotide
nccttaatccnanaacctttttaaaanggantncccaangggaaaaaggttnnntggnanttnnanttaaantttttanccccaaanggttttttcaaaaattttaaaccccccccaggagggggtaaaaatccngggggaanatttngggttnaaaaaaagcccnccgggttaacntttccaaaatnntgtgnnatttntanccccgggnacccnagnttttccccnaaaagnnttttnaaaccccttanaaaggncccntcccgnaanccctagggcccccgttaaacgggncccccnaaagnangcccgggggaaaagttnncnaangggcccccnaaagccaaangttnccgaaaccgtttcccnggggccttgnctttccccnccttncccgggtcccccantttggggncccccccaaaaggcctggccttanccttttnaaancggnttccnggggggggggttttaaaaaaatggttnggtccngggnttaaaaaattgggtttangggntttccccccaattttttgggaattnnttttgggttttngggggggggggggagagagattaattgagctgtgcagagtgtgatctgtgcgcttgtaaagataaaattcttttttatttttgtagatacagagaggaaaaaaaatagaggaaagttgagaccaagtgtcagttcagttcagttcagttcaaatctttaatctgaaactgaaagagaaacataagtatcgtttagttcagttccagttccagacacagttcagaaattcagatttgaatatgcaaatcaaagtcgccccctttcgtttcaaattccttctacgatctgtgcgggtttcgtggtcaccgccacatccaataacatgacatgcagatcctctgcagaattgctgaaacagtaagcaatggataatatgagggtccggatccacacaataggttgagttctttgggttgtgtttcaagtggccaactcaccttcgtttttctcgtgcacgttttccaaactagcatatacttaattaatcatgcaccaaacaaagaatcatattaatacatttttttaaaaaaaatagcatatacttaattaatcaatcatgtactaataagtcactctattttatgtgtgagagtaattagcttccaacgataagcaaagaacacagcctttagtgtctactactacatcagcagtactgcagacaattgaacacaaaatatgtcgtgcgcgctcctgctgatggtggcgacggtggataggaccttttcgtgactaaaatgaaaaatacagggactgaagcttagggtgatctaaaactctaaactttccatcacatcacatcacataaaaacttttctactcacataaactttcaactttttttccaaactaccaactttccccaaacttcggaactaaacacagccttaaaaatccaagagagggatgataatgaaaatgttctgttccgatggaccagatcgcaaagcagcccatcacgagagtatcagatcgaacggccagcatcgactcggggcccacctgcaggcggatgtgtcatgcaaagcttcggattcggatacgccctcggcctcctcaccaccacagccacgaggaggagaagacgacgcgccgccgccacagctcgcgtcgcgtctgcgctctcctagcgccgtgcgggggtttagctagggttttccgcttgcggcggcggcggcc

SEQ ID NO: 2048 - DNA, 2000 bp, Oryza sativa
  misc_feature (40)..(40): n = any nucleotide
  misc_feature (48)..(49): n = any nucleotide
  misc_feature (51)..(51): n = any nucleotide
  misc_feature (53)..(53): n = any nucleotide
tcctgtcagaggttcgaagttcccagaatggtgtatcacnttcaccanncnangcaaagttgaatcaaactatggcaatcatgccaatgacatcaagtggtccagtacctgctccaactacaaacttgaacataggaatggactactgggccaacacagctagctccactccagcaatacatggtaaagcaaccccaactgcagctccagggtctatggttccaggagagcagtgggtgcaggtttgttctattagcccttcccttcaagaaccgtgcacttgtaatattttcttcccgttgtagtattcgctgctgtgcttcataaatgcttttctccacttagggttccgttagcaaccctccattaagtactataggatgaacagtgcatttatcggtgtgggatggacggaaccctaatggcgatggcatttatgggacaaaatcgcttgtacgatgacattttatggaacttgcactcattgatagcatttcttggatttgggtgtttgtcaatggcatttcttcttaggtacagacattcatcagaaaaatcgtggtgttagtatggagtatgaatttcataggcgcatttcaagttaaattgatatattacaactttttattcttatttgggtgctcttcacctctaaaattatgtattttctatctcaatcctttcattttggcatgccatcattcaaaataagatgttgagtccttatatgaaatacaaaaaccatagaaatggcacttaatcatcacaatcctatggatacaaacatgaagttttcagtttttctggcaaatggagaaattagtcgtgttgactctcccatgattcaggatgaacgggaactcaaaaggcagagaagaaaacaatccaacagggagtctgctcgcagatctaggttgcgtaagcaggtatttgtttgtgcatttcaagctatactggatagaattatcttttgtagtgccttcaattgatgaagcctaacttaaattctgcaggctgaatgtgaggagttggctcaacgtgctgaagttttaaagcaagaaaatacttcacttagagatgaagtgaaccggatcagaaaggagtatgatgagcttctatcaaagaatagctcattaaaggtttggtttctcattcttcgctctcttgctattctgaaatatatactttaacactgtttttgttttttgttctgtaggaaaaacttgaggacaaacaacacaaaactgatgaggcaggagttgacaataagctgcaacattctggtgatgacagccagaaaaaaggaaactaattgagctatcgtgcaatgctcctgagcataaccctaactagattattggcaggcgcaactgtagtatgtgtattaacttcatacttattgcagttaattgttaccaggttgtgataatgttaatgccaactttgtgtggctggttcctgtttcagatctgtcttggcttatcttttagaagtcaagatatgactggcaatgtaggttgtgacccagttcactgtatctgttagaaatagtttataaactcatgtttacaaatctgtattgttgactactattgttatgtacacctgaagatgaaccagtattttatataagatgcagtcaggttgaacagttggttttgcttgtgctgatgtctaattgtcttataaactgtttgcttgcatcggtattgttcctgtgcatttactttacttgctataatttacaaatagagaatcttgtgttcgtggaagaactcagaacttttccaacctttgaataaattttgtagtttgttttactgactcttttccctattgtttcttccatcgagactgagctttgcttaggctacggtaaatagggaagcagtgctcagaagcattgtaactaagcacataaatttattgtctgtggtagtatttgtttcagcttttatattgtttctgatcagatgtttgtttagcttttagcatgatta

SEQ ID NO: 2049 - DNA, 24 bp, Oryza sativa
tcagtgaggagcggttgagtggta

SEQ ID NO: 2050 - DNA, 62 bp, Oryza sativa
  misc_feature (2)..(3): n = any nucleotide
  misc_feature (25)..(25): n = any nucleotide
  misc_feature (32)..(32): n = any nucleotide
  misc_feature (41)..(42): n = any nucleotide
  misc_feature (62)..(62): n = any nucleotide
tnngaactaaccatttcggaattcnaatttgnaaaccatcnnttgaacgacgatacgaattn

SEQ ID NO: 2051 - DNA, 2000 bp, Oryza sativa
  misc_feature (476)..(476): n = any nucleotide
  misc_feature (807)..(807): n = any nucleotide
  misc_feature (1248)..(1248): n = any nucleotide
  misc_feature (1283)..(1283): n = any nucleotide
  misc_feature (1289)..(1289): n = any nucleotide
  misc_feature (1749)..(1749): n = any nucleotide
  misc_feature (1754)..(1755): n = any nucleotide
  misc_feature (1758)..(1760): n = any nucleotide
  misc_feature (1764)..(1764): n = any nucleotide
ggaggcactgacgagtcaatataatgtagagcaagcagtagaggagggcaacaagagagagtgctcacgacaagcacggaaaattagagcagagatagcagtgttgcaagcaagacttcaacaagtggaagatgcccactccagtgcacaacactgacaagatgttgtaacagagaacttgaactcccatctcgagcgacatcgtcaagctaaagatcgaaaatctgagattgcggcgcacttaaagcaggcgagcgtgcaccaaaagtctctccaagatattatagactttactaagccagacgagtttgatctatctcaatatagatatgtctacaatttatttgattttttcatgggctgctcattagatgagtagatgctagtttcaaaatcttgtttcaggtttgaaatagctcttcagatattttatttgtttccaatatagcggagtgaactcctttattgttttttcnatataattttgatttgcaccagaaaagcacagtgaactccttcaaatttaataggagcgttgcattgttaccaacaatatttgtgcactggcttcttccctttttccttatgtatatacatttcctcacataaaggatgctcacgttcaattttttttagtggctttactactgtagcagtaacagtaacgccactaattcttcacgattctggcttagccatggatttcaattttttttttggcttttaaaagaccagcctccccgctttagaaattatagcgaaatccatggcaacagtgtaaatgtcgataaatataccatagcgaanattcatcttattaataagatcactgtaggaaattcgttacagtgcaaaattattgggattaatcgtcgtccgaaaatcttggacacgggtgtaacccaattaaataataaaatcactgtagaaagcacattgcagtgtacaatttatagcattaattgtcgtccgaaaatcatggacattggcatgatccaaccatatattaagtaagggaagtgcttctatgcttctttaaaaaaaacctggcacgaaaattaaagcacatcaacagtgaggattaaaagttgattaacagagtaatcccctttaacgaggggtaattttgtcctaagaaaaagctgaccatatctagcccaccctgtccgcatatcagaatcgactggttcctccttgacttgcacctttgacggaggcgccatcttcgccgccgccgccggcaccgcnatcccaccgggtcgaacgaacccatcttgcccgangccggnacgcttgccggcggcattcgacgacagccttgtggcgtccatgctcgcgcatgccggcgcctccgcgggctcctctccttgacctgcagcaccgtaaacggaggcaccatcttcgctgccgccgctgccatcacttcgtcctctccctgttcctggacgtcctcgccatggctcccggcggcggcgggggccgcggggcgggaagcctggagggcctgcagctagctgaagcgggcgtggatagaggactggagggaggagaggtgggagtcgaggtcggaccagcggaaggggaggaggatgggcgagtggaggacgaggctgtcgcaggcctcgcggaggcgttgcttcttgccatgcagcgtcgcgatggcggcctccatctgcgccggccgtcgtcatcgccatcagagatggttcagggcacagggccgttgccgtggcggcggcggcggctgtngcatnntcnnnatcnccatcgatcgattcttcgtgcggccggtaagaagccgacgcagtttatatataggcacgcggccgcgaacagtacgagacggataggatcagcgcatacaaccaattctatgtaaattcaaaagattgtgatcagccttgtgttaagttcagttcaattctgaatgcatatcaggtatcaccatatactgaggaataaaatggacatggaagctttggcaatctctgccgagaatc

SEQ ID NO: 2052 - DNA, 2000 bp, Oryza sativa
acttaagaaaattgcccatctggtgctgtggatagattaactgttagtacaaagctaacaaatactccctccatcaaaaaaaaaaaaccctgggattgggttgtttccaaattcaaattcgggattgaaatttttttgggatggggggggtatttcataagaaattatctaagaagcacttacgcataaggcttttggagaaatcgtacttttagaagcatggcacgaataatattcagattcagattttttatctcggtttcagttagcacacttttcaaacaactaaatggtttgtttcgtccaaaaactttatacataaaagttactttaaaatatcaaatatatccatttgtcaaatttgtaataattaaaacttaattcatcatatgctaatgactttcccgttttacgcgctaacttaatcttcatcagttttaaacaccacttaattcatacccctccgtttcacaatgtaagtcattatagtattttcacattcatattgatgtaacatcaatataaatgtgggaaattttagaataacttatattatgaaatggaggaagtacatccaatagctggtcaacattgctgtttctactcttcttcacctgatgatttattttgtgatgctgctccgaagccggtcgacggggaaggctaagaggatcatgcctgctccgccgccgctgccgtcggcggcggggaggcagccatcgctgaggagggaagacagcgccgccgccaccgctgccgccgccccaccgtcaccaagagaggatcaagtagagcaaattgccatagtttcatcaagagttctttttttccttgtaatttaggtttgaccaagatttgactcacacatcacctgctgcttgttcttgcaggtgtgcccaatctgcctgaccaatgccaaggacttggcatttgggtgtggccacatggtaaactgaaaattcagactaattcagagttttcttttttaacctcttaacagatgatgaaatctattcaaatatgtagaaacatttgtttgatcggattgtttctgacatgcaaaattgtagagaaaaaacatttgtttgattggattctctttctttgtgaaaacaacagtgctgcagggaatgtggggagagcctgaccaaatgcccaatttgtcgacagacgattcggtccaagctgaggctgtactcaggatgatcaaatgcttatggactgatggaatggagcttaaatctgttcttaatgtacagaatgcatgaacatatcgtttgtgagaaatactcaaatcaaatgcatgcattggatttgtgctgcgagataggggaccaaacgaatgattagatttgtttttggttttgttcatgttgatttgtaacaaaagaatcaagaatgtggtgtggggtaaagctagctccatgtgcataagttttcttctgtcttagctccttgtatagttactgcgaaatagaacgaatgacatacaatgatacaacggggaaataaataaataaataacttgaggagaggaaaaccgtaatttttttttcttatgttgcttggggagatttgcctctggtgatgaaaacaatagatttctttttgttatatttgtttatatcaaattgtgaattttgagttatgtactactactgagtattgtctggagtttgaccaattatattctgctagttatctactgggatttcttgtaaccgtcctgatgataaatagtagcaatgctgcaatgcactgagccattattctcgcaaataaatgggacataaattggattgatttgaagaccaaccgtttctgcagcacgccctttctgttgcttcttcctcctcccttatatattaccttcagcgtttcctcgtgcaaagaattccaaacaaagagcccaaatcattacgctgctgctgcttcttctgacgcatcataatacagagaaagaagctcattgcattctcaggttcagaaagaaggaaaag

SEQ ID NO: 2053 - DNA, 2000 bp, Oryza sativa
ttttgtgatgctgctattatacttgcgagatactactattttgtgatgctatgatacttgcgtcttgatactactttgtgatgtcattgagacaatatggcatatactgacttcctcgttatattcctgagctccaatgacttgctagtttctactttctccatttcacgatgtaagattttctagcattgttcatattcattcaaatgttacatatgtatgtgtttagatttattaacatctatatggatgtaggaaatgttacaaagcattatgaaacggagggatctagtggtctactggtcttcccttgcatggtgaaagaacttccgttacatagtgaaagatttaccgcggcaaactcacacattagcctttctctcgtttaaccgctggtctcccagcctccgcctcccaccgactcctcgccgccagccgccacagccgcggaagctcatctccgccgcaatctaacgccagcgccgtcgtcccttgaccaccgccgtgccgccgccggcggccgtcggtgtcgtgctgcatctactggctactgctaaagcaagtggagatccgacggatgcaaccacgggcacacgccatgtgaggggacatgaggtgggcacgtgagcgaggggcacatctgtctgtatcttctccctcctcctactcccacaaaaaaaaagccgttcttgatggcgccatggagatcttgggccccctcccaatggcggaatcttctcggcaagcggcaattgatggctgtacttgggtgaaccgcgtcgcgaccagctcggctgcgaactgttcctcgactactactactacagtctctacttgcccttgctgctgcaatggtggtggtccatgtgaggtgaattgatgagctaaccttgtaataatgtttctctgaagatctgaagacttcttgcaaaagcaatataatgtggagttggaactctgaacttgaagtcatgggtgttcttggcttgcacggcgagagatttaccgctgcaaacctgtcaaaggggaaaatgtggcatcggctagtaaagttcagatcaccagctagtgaattgctgttcttcagaaacatcttggcaacgtttcaggttgtggttgggcacaaggaacagccgaacaggagcagattgttgggctaattaaacatctgcaatgtgcagcagggacaaggagaaacatgatgagagcattggcatttttctaacaattcttaagtgacagtttggcaggggcaagcgtgccacatgacatggggatcgtctcatcattttgcttttctcggtctctgggttaatcacatgagctccaagtgtaccatgtgtctgaactctgaaccacttgatgaataggattcctgtaacatgtttgatgtttctttggaagcctcaacccaagaaagaacacacacatgttgacttgggcagtcattggagaccctggtataagcaaggagatgcctgacatgaataggatgaggcacacagaaacttctgcagattacagatcaggacatgaaacgctatagtagcaaagtactatggactagtataatccatttgagaattgagatgagattagcagcaaacgggaatagaaagcaaactgaaacaggcatttatttgggcggcattaaacctgacgactgtttctgtcctgataaatgttttcaagtttctgaccccaagccagatttatggccaatataacagcaaccttacacagttataccactaatttattgccgttttatcagaacaaagcaaatgtgcaattaaaccccataattgcagggaaaatgaggccatattgttatcactgaaaccaaaaaggtttaattttctcttctcattttctcttgtagtaacagtttgttttcttcttgtaccgagagctactactttacctttgtgcttttacagcctttctcagcgcggtacacactacacgctgctgactccggtgaccatagagaaaggcaa

SEQ ID NO: 2054 - DNA, 2000 bp, Oryza sativa
cctgttacattcctctgcttcgtgcaaaaacggatcgcaaacaaaacgaacaattcgaacaacacttgtgtatcctagagaggaacgtacatcgacattgctcagatacatgcaccaaccaacaagtcagagtttttcaatctgtttatcaaccttattgcattttggtaaaaaaaaagacacacaactaacccgagctctttatgggtgcttgtgtggatgagttagtcagtacttcttccgcaccgagtgccagatgagctttatctggtaccacaaaggagatatcccatgaactccccttgacaaccgtgaatcaaagacgttgaattcacggcgtcgtaaggagtccagaaggacctgggctggtacccctgggaggagtacagggattgcttccgctggcacagaagaggccagctcccgcgccttctgcaggtgagcatcagcaacagatgcaaccttgaaaactgcatctgggagctcatctcccatcctgacctctgatcggccaccttcccgtgtaagcagaccgcactcctcagctatacttgctgggatatacggtatcctcccttgcttactcacatggtgaggcaaagccttgagtagcagtagcagcccactagctttgcctatgtgtgaggcggcatgatcagcgatagttgactgtatcccaccagcttgcaacgtcatgtaaaggatggtagattgggtgtcctctgcatacctctccaattcagaaattgtctcaggaatggcataatcatcccggtttgcatcgtttatccttgcctccacagacctcttgagccaatgcttgctaatcttgtgctcggacacaacagaagagagcacctgggcaacagggtgctcaaccagcttgtttgcaaagaccttgtcgactacatctttccaccagaggaggcgcataaggccagtcttagggtccgagacaacatccatggcctttgccgtctcaatgttgaaggctcggaaggcgaatgcagccttgcgcatagctggaggtaggtggagaaggcagagatagtggtgataatcatagttgcgaacttgctgcacacagtacgagagggcggttcgcaggttaccacccgctgcagctgtactacccatgaactctgtttgagatgtgaaagaggaggtcctgcaatggagatgaaagcagacatttaggtacattccaatagtttttttaaccgaaatcacttattacaattccctactatgcataagtaatgtaaatgataaatactagagaaataatagatagaacgtacacttggtgagactacaaacaaagaaaaaaaatgtacaaaaaaaccatggtctccctctgtgcattgcatgaattccagattagaacaagcatcttttgtagaagaacaagtgcaggtgaagtgttggtatgatacttgtagcacaaatagagaaaagcaggagacacagaacaaatagtagctatagaatgtgcatccattatgctatgaatttatcccttccccattatttgggatatcactatttttgttttcatttgccacgtcataaaatcacaggaattgtattttttttgttctctcttcatcctactcaattattgcggagagaagtatgtagcaggggagtagatgaatagaagaaaagtagcgatggttgtgatatataggaaatatagaaggaatcattagatagttgagaaagatggtgccgtaatgtgagcgagagagttgtggctggctgctatggcaattagcagcaactagcaagggctgaatctaagaaaattagtactccctccagtagccttgttattgtgcggtgcagaaagtaacagatgaactaggggttgaagccatagccatagaatagatagattaagagggaggaggggaattcgtactcagtagtttccgggctttatgagtgaaggaggttgttgccggaccggacttgagtaggaggaggcgcaggcggtc

SEQ ID NO: 2055 - DNA, 722 bp, Oryza sativa
  misc_feature (20)..(20): n = any nucleotide
  misc_feature (24)..(24): n = any nucleotide
  misc_feature (48)..(48): n = any nucleotide
  misc_feature (212)..(212): n = any nucleotide
ccttaaagagcttcaaaaantcgnagcggtccaaggtcctcaatgagntaagcccggcgccgtcgtctccctgctctttcatcagtagtagctggtaggcatgcgccgccgcgattttgggtggggatattttgaatcggagggcttggctcctggcgggcctggttaatttggtccgtgaaatggtccttggagtgatttgatctgcgggngcctatggatttcccggaagcaaatcgtgatatgatatccaagattgatttgatagtttaagtgactgttttagactgtgtggataccgtggctttcgttaaccgctgttttctgggcatgcagagtgcagagtttccttgtaagctgatgttgtttaaatgggcagaatgttacattgttcgttatatagtatcttgatgtactagtggatcgctatttatttcctgggaaaaagcactttacatgcttaagctgggatgctgtttagattttgatttcctgataatcgtgcgaaacaatctatttcttatagccatttctagagaagatgaaatgaggcaacataagttacatttggtgtgctgtcaaatgttatgttatttggtcaggaatgtaccttctctttgagcaaagcgcttaagggtgaagatcagtagtttagataatattttctggatagaagatgagcacatgttctagtcttcaattaaaaaataatcttttagcta

SEQ ID NO: 2056 - DNA, 2000 bp, Oryza sativa
  misc_feature (549)..(549): n = any nucleotide
  misc_feature (553)..(553): n = any nucleotide
  misc_feature (555)..(555): n = any nucleotide
  misc_feature (557)..(557): n = any nucleotide
  misc_feature (1422)..(1422): n = any nucleotide
  misc_feature (1991)..(1991): n = any nucleotide
tttcaaccaagagaaataagactgtaatacccgttgcaacgacgtgtgatgaccgcagaaaaatcttaatcatcagcactataagtacaattattacagccttagtggctcgtagaatttgtttgaccatgcacatcttttttgactcgcttttcgttgcacggccctctaattaatctgtgtttttgcagtggaaatctactggagacttacaccttgatcatattgataagaggacgttgctgtcagatgacatttgcatcttggccagatggctctggagtggttgcttggtcacatgtattgttcgtcgcatttgtcctggaaaaacgtgtgatgatctggtgttgtgtcaccatatttattgtccaatctttcagaaaaaaactattattattccttaaataaaaatattatcattgtcatatgttgttgttactattatccagaaatgggttaaaatgctcatagcaataatggcatatagcaaagttattttttaatagataatggaaataaaattctcttgccggatagctggatcagctnacanananacataattattaattctcttgctggaaatcaataacaaagttatttttttatagataatcagtaacaaagatagctggatggatgttgaaaaggtggagatatattccaatttttttagaaagaaatatattccaatccggagtccaaacttttggtttctcttgctgtagctagcttgttaatcttttcctcctatactagtaccagtaattaattaattattagtatccagtaaccaagccaatccccaatggatgcagtagacctttgaccacctccctcttcaagttagaatcttcttactaggtgctaaggttttgacaaaaccacaagaaaatcaaagctaacctagctaagcaaactgagagaacatttttgagtccccaaacccaatcaaaaatcccaaattttatactccctccgttttttaatagatgacgccgttgattttttctcacatgtttgaccatttgtcttattcaaaaaatttacgtaattataatttattttgttatgagttgttttatcactcatagtactttaagtatgatttatatcttatacatttgcataaaatttttaaataagacgaatgatcaaacatgtaagaaaaaatcaacagcgtcatctattaaaaaacggagatagtagtgacagtcaaattcaaattccaagccgtcccagcaccaagagaccttctccagtactctactgccttaactatttttccttttgtattatactaacgcgtttctctctcctccctctctctgaccattactctctctctctctttctctctcctcttttttttttcaccaaccatcgtaattgctgactttgagagaccaaaaaaaagaagcnaaaaaaaaaaggaagaaaaagaaaaaggaaagagaagcagacagaaggagaaggaagcagagcgagagtagttgccagaaaaccaaacaaaaaaacaagccaagaaaaggccacctcagtgagagagggaagggagggagggagggaggagggagagatctcctgctgcctcgcgatttccggcggcaaaaaggttcgattttgatccccgtctccggattcgcccagccccgatttgcccttgcggcgcggcctcgctggtttctgcaagtgatagagaaagatcccgattttaacagtggcagttcgtggcccgcccgcttctgcttctggttttgggcgattcggcggttgctggactggagggagtcgcgggtgcagtgttctggttcggatctgagcgggtgttgggtgttttcaactctaattcgggcgagcaatgagggttcttgatgcgtgacctgatgcgggaggcgtattgggagaagatctcttgaagttttttttttttgggttttggtttttttggggggtttccttggagtggagtctcttgcccggatcgccanactcgttct

SEQ ID NO: 2057 - DNA, 2000 bp, Oryza sativa
  misc_feature (417)..(417): n = any nucleotide
attatgctagtacatctggaaatgttaaagaactgggagaagaatagcataatccatgttccacgccaggaagcttcccaatcatgcccccgttctatgataaacaatgcagacaaaaaaacaatctatgatcagactataatcgcatgatatcgaattataatatttgctatcttccaaattgttcaactgttcaaattttttgcgccgtctgtccatgatgagctcctcaacagtttgttttcagatgcagggtctgtctgtctgtcggcggcggtgacgatgaagatgaagcttaacagtagcatttgcactgatgacaattagattggttactagatcattttggtgttgacaggatggttaccatggtatgatcttggatgaaaaaaaaaaccatggtcctgcatttttttngattggaacactgacaatatcctcattgaataagtttattaccattagcatcatctgtggtggtgcctcagctttcatgaaatgaaagtcaatccatgatcaccatcgattgtgagaggctaaataatacagtattgatgttgctgatgaagattgaacaattcatttgcacaatgaacaagcaatggggaatatatatatatatattgaagaaaggaaaggtaaaaggtgagaaggcttactgttttttttatttttcttttttcgagatgagaaggctgcatctcgataagctagagagaggacggttaatcaaatgtttaggggttaattagccttcttagtcgtgctaaatcgatcaaaaagggggtaacacagcacgtgacagacatgtgggtcccactggaactttctatggggcccacgggcgcgcttgaccgcgattgggcgatggaggagtcctatctgtaacgggtagaaaagtcggtgtgcgcacagcacaacaacacctgttcccttttacaccttttccccctcccattttcccctattttttaaattttacttactctctccgtgcagtcatgattttccgtacctaacttttaccccgtacctaacttttaccgtgtgtcttatttaaaaatatttttaaaaaaattaaaaatataagtcacgagtaaagtattattcatgttttatcatctcataacaataaaaatgctaattataatttttttagaaaaagacagacgattaaaagttaaacgtgaaaactgatggttgtactatttttgaacggaggtagtattaattaattaattataaaaaaagaaaaagaaaaattccaccaaaccaccccttcctcctcctcttcttcttcttccccgcaacgaggtgaagtggaggagacaagagaagctcgaagaagcttgcagccgcattggtcgtcgtcttcttcagctctcacctcacctcgctcaggtaatgtccattcttcttgttgttgttcttgctcgggtggttagtcgagttcgtcgtctgccacctttgggttgggggcgaattttgatctgggtaaacgagaggaagaaaaaacaactagtatttgggttaggtgggtgtccatctccctcctcctcctcctccacccatgtgaggcgcataaataaaatttaaggaagaagccacggccatggcggggaccatggtccgtcgtcggaatacctccaaccccgcagtcggcggcgacgaccagaccacgcatttcttttccttttttcttttttctcgaggaggagcaggagcggctttgctgttgcatggtgtagtgtagccaagccacctgggcgggcctcgccggatcgccgtccacgtcccggcgaccggtgaccggccgctttcggccgcgggcaccaccaacctccctccctctctcccaaaatctttgcatctttcccgagtccgacacgtgaggacgattttcttgcaatgccgttgaattggtactagtagtataagagaggtgggggttttgatgctcatttcttgggtggattggggggagtgcaggtggggaggag

SEQ ID NO: 2058 - DNA, 2000 bp, Oryza sativa
agctaaatcgacttttcatcacagcatcacaggattcaccgcgcatacggatagctaaaatccgagaaagggctaaatttgagccccgggtccacaggccagtgagccaatacgcagcatcagtatccgctggtacatgtgtcattgcaaggatctactaaggaaaaaaattacggagtgagaccccagcggttgccccacgggaaaagctgaacgatcgctttgttcttatacccgtgtcacctttttctcccttccatccacctttgtgtccttgtcttcatctccctcctccataggatgccgtcacaggctcacagtgaggcagcggcagttcattcttggtgagctgcagcagagccaccacctgttgtcactggaggtcagttcagttcagctcactcacctcacctcactggctactggctactagtgccttttcttgagttcttgaaaatcttgcttccttctattttactcttgcccttttggatcctttgtcaatgcgcggtgtgagcacactccatcttcttctttgtttgctggctgggaaaacgatggggaaatctagagcttgggctaaggacctaatgggtttggagctagttagatggtgatgtttttggcttaattgcttaactacactaacatgcatgccgattgcagaagccgctcttgctaaactgctggtgctcttaagggatcctgtcttcttgtttcaccgtggagcccttttggggttttcgccatcagttctagctgatgtaccattttcacttcctgctgcgcagaaggaagcttattttgagttaatatttctagtgggtttagagttagacttctgagctctgactgcttgtttctgcatctttcttttctctcatcttcttctcttgccctccttgtgaattgtatatttgtctagatttagatgcaatcaatttgcataaatactgtctaaatagatattgtgaggttgggcctcactccagttagcaataaaacttcgttcagaggttttaaggtttactactatattcgagttgtccaaaatagtaaatgccatcaaaatagtaggccctaaagattgtcgagacaaagaagaagcatttcgtttttagaggtgtttaagtacttcagttcttttgacttctgagaggacgtacctgagtcacataaatgcctttgtaccggctggttttaattgcatcggttggtgacgcttctggatcaaagtgataggttcaatgtcaatgggcttccactattggagctgacacagaagctaaaagttgacgggcaattctgttaaaatttgttttaagaaactctatagctgtattttgccaaaaactttaccttttgaagtggtaggtacaaagagagtggaacagaacaagcttcactatatcctttactttcttttctgagctgagcatcgctttctgcattgaaaggaaaatgatattatggttagctgatgaagaaacttattaatcatgaatagtagattagatagtggtcaatttctattaacatggcagataattaacagtactttacttctgaacaatcattggttaacaaaatacttgctgagctggcatacgccagccaaagtttttattaagcttagaaagtgttcaaagggatttctttgttttagtccacgagtccaaattcttgtatttttcaaccttgtctcatggaataaaaaactaacgtgtatacgatataattatatgaatttaactgggataaaatacaacttgctttcagattatgttagcttgggatagttttgcaaagatgacttgatacacacaatttcagtttcttaatagaatagcacccaaggaaatgttctgtctgtatccaccttttgtacaatttggtgggaatatatcttactaacatttatatttcttattaatttctagggagtttagaacggcgttgaatattgatagatatttagcatctcactaatggataataaa

SEQ ID NO: 2059 - DNA, 2000 bp, Oryza sativa
  misc_feature (196)..(196): n = any nucleotide
  misc_feature (198)..(198): n = any nucleotide
  misc_feature (212)..(212): n = any nucleotide
  misc_feature (227)..(227): n = any nucleotide
  misc_feature (1459)..(1459): n = any nucleotide
gaacgatttttatgttttccctaacaaatttatttggtgtttttaaaatttcacatcatctaccacccttcttgaatttcctggatcctttggggctgtaattttcagatataccaaatgttttgacctagcaacgacaagatacagtggaggagcaaaaaaacaaagtagcctgtgcaaagcatgcacaaagaananacaatagaaaggtnttttttgggtggcanaaaaacggttaaggtttcaacagttgaaagtaaaaaaaaaaaaagaaaacacacacacaacgcggaatgtgaaaggtatgggcattctctagaaggaaggagcgttcaacgtgtttgtcagttgacaccgtctcaatatgcgggctttattcccaggggtcccagctgtcatccagcaaggggccgtttagttcccaaaaagtttttccaaaaaacattacatcgaatatttggacacatgtatgagtattaaatataaataaaaagaaaaactaattgcacagttacgggggaaatagcgagacgaatcttttgagcctaattagcccgtgattagccataagtgctacagtaacccacatgtgctaatgacggcttaattaggctcaaaagattcgtctcgcggtttcccggcgagttctgaaattagttttttcattcgtgtccgaaaaccccttccaacatccgatcaaacgtccgatgtgacacccaaaattttcttttccccaactaaacacagcaaggtttaaccatgcaccacttagcaatacaattattacaatctattaaaagcacattaacataacatacaacaaagtaaataaataaaataataggaacccctacactaacatgttacaagtcagctgtaaacacatgtgaaaaagagaagagaagagaagagaagagaagagaaggaaaacaatctatatattggtagccagttgtagcacagactctaatactgtacagactctaataacacgtgagtgtataagaggtgagaccatatattaatggtgtaatatatgattatagctaacttagctattagatcagctataaatgaattggagctaatagttggttatattattaaacttactctcatatgctttccctttctcagctccagctcattcgctattcgaagaaaaaaaaaactaccaccaaaatacgcaaaaaataataccagtactagatctcgactaatcccgcgtcacgaacttgctaatcagtcaataaacctaatcaggagacaccaaaccaccgaaaaaaaaaggagagaaataataatattcgcgcatccatcacgaccccaactcgtcctcaatcgcggccacccgccgacccagcgacgacagcgcagggaagaagggaggacgcgacgcgacacgagcgcgagaggaaagcggaggagatcgaggagaaactccatttccccccccctngccttctccgatttccctcgcgtggaatccccttggactcctccccctcccgccgccgcgcgagccgggcacggcgagcggcgccgccctgcccccgccgatctgctctgccttctcctcaggttcgccgtcttgttggattcgcctttttttgcgttcgtttcgggcgccgtcagatccccgcgccgtgtttggtgagcgtgagctaacggaatggcacggccagatctcgtgggggggatccgaggcggtcggcggatgctagatctggggcggggagctgtacgatcgccgccgcgttagatctggtcccgttgctcgcgccggattccgctgcttttgttgttcaaattgttttggtttcgagctttacctttgcgggctattgggttggatgctccgtgatgcttcgaagctacgggagaatgttagtgatgatgcttttttggatcttatggacgaattttatacaggggcttgcaccgaggaggaggaggaggagagagctgagcagaacaagctagattctcaaggaagggcg

SEQ ID NO: 2060 - DNA, 2000 bp, Oryza sativa
  misc_feature (186)..(186): n = any nucleotide
  misc_feature (1991)..(1991): n = any nucleotide
cgatgacggcggcggtagacgcgatgtagaggcggcgtgtccggcgcgtagcggcatggtcgatgcggctcgtggtggccggcagtctagcgcttgggtggcggctgatggtgggcagcggcttccggcttcgagtcggcagcgcgtcgaccagcttggggggggcgtcggttcttccgccacccntccccacctcccaccccctatgaaaccaccattcttctcttcctttctctctgccttcctttctctcttccttcccctccccctagtgctcatctctctgtggtggtggtgaagtcgcaggtggtcgctgaagttgattggtttgtcccgcgaagcccggagttcttcgccggaaatatggttgacaccgatgtctatgtgccctctcttcatatctcagttcctctccaggccgaccatgcctccttggtgccccctccattggctatttgcttacagatctggcagtgctctttcggtgcttgaggagtttgttcgtccgcggtgttggtcttgtctgtctgtagttagggctcttaggcctcgttggtgctggctgtgtgaacttgttgaagcgccaattttgaagcggtgtgcttacctctatggtgcgagagttgtttcctcttacttcttggaggtcctgcacttttgagtgagtccgggggcaaaagccctgcttagtcgtccgggatcggcaatatcgacgcctgccggtgctgtttcctccttggaggtgttgccttgtggactctcccctccttgtgtgaaaacttagtccagctgatgggcgggtgtcgacaacggcttatgtcgttgttcacctccttggaggcttcgtcttagggtttttgctcttccctcggccttctgcggtccgtagtcgtttttgccttcaggctttctgtgtctctatgtgtaaggtttttatcggttttactttagcaaaccgtatagttgtatagtttttggtccggtttttcttataaacagggtcaactctattttgtaatatttgccgcttccacttaaaaaaaactgactaaaagctgtgaattgtttcagtggtcaaaaaggttattacacgtttggtgtgatggtggagaaatggtctactgcgcgcatgatttttagcttcaacggtggtaatgccaacgaaaatgtaaccggtcagatactccgaagctgcatcctaaatgcaggtcctctcactcactggccactgggcctgagcactaaatccacattctctggtcccacacctgtcaccgtcccatccccacctcggccacagagagtacagcgtaatcaacacttcaataacaacccacatttccacaaattgataatccttacgcgggaacgacgaaaaaactctttcttcagctaccatttcgaccctgcagtcatctcactgacgggtgtgccccaccagatgtgggccaccctatatttattcgaaatttcgaaatcaaatcggtgcgagcgatgagccgatgagtagagtagttaacggttaatcaggagcacacataggagtatactcgagcgaagcaccgcacccgccgccacctcaccgcccgacgacgacgacgaggccactgcgcggtggggcccacatgtcggcaccaaaataatttcgtcttggtctcttctccctctcctcctcgccttctcctccccccatttcgtcggcctctctcgagtcctggactcctccctcgccacctccccaaattagcagaagccgcgcaccacgcgcacgcgcacgtccgcgccgaggaggagctggcctcgcgcgctcttcgaggagagaccgcgggggaaaccctagaggctgcgccgccgctcgccgccggccggccgcggcgggtggtggggcagggcctgacgacgaccggttcaacaagcagtaagatctgaggttttgggggtgggattagggttgttgccggggtttgtttggtgttgcggcggcgccgcgnagggggttc

SEQ ID NO: 2061 - DNA, 1493 bp, Oryza sativa
  misc_feature (707)..(707): n = any nucleotide
  misc_feature (1040)..(1040): n = any nucleotide
  misc_feature (1043)..(1043): n = any nucleotide
aatcagtgggcccattatttatgccattagatctgttatagataacacaaaactaattaaatctatcaaaagaaatcaactatcctcccaaccctccagccgtacgtgcgtatatagtatgtacgtacgttttactcctcccaacatattctcaagtttcaccacctgccgcctacctctgacaaatccgtgggatacacaacaaacaaagataatctctaacctagacaccacgccatagttattagttactagagcacttagtatggataaggccagtgaccggcatttgcatagcaaatttctctagtcctataaaaattgatcttcgtttaatatagctttgataggacctgaatagattgagaactctgcttggtttctgatatggagactgtctaattcccaagagaccacggcgtttaagatttgaaaaactatactcgcctgattcacaatacatcagcatatcgtgaattatgcccagatttgaaaaactatactccttaatttgaaaaatgtcgggaaattagcatcagtgttccatcggttaagtggttccctctaggtttctttccgagacaaaaaccctagcaagcatctcatcttttccatcactcaagtttttagggattaaacatgatttttgatagttagcctttaatctagtaccttgagcaaaagattgaagcagaacttttagagtnaaaagctccttcccacaatccttaacatagagctatagccggaacttctcatgtctagatcccgtccgcaggtggtgacgatctttggtgaacgtcatttaagggtatccaaagccaaaaaaaaaaaaggtgtatccaggcttggtttaagcacagtaggtggcaaaattaccagtacttacaggaaataagttaaatacatttagttattttgtgtgattattatctaaaaaaagttattttgaaaaaataaacactccagcggtctccacgcctgagaaattagtattatcgtttctaaaaccactttacaatagcttccattgtaaggtngtntacgagtcatggaatatacgaatacgctataccttcatatgtacaataaagctccatatacgataagaaaatcgataagagattatggaaataatttttacggcaagtacatagcagtgtactactcgaaaaaggattgagacggtaccatatcgtgcaacattcacatggatgatagaacactttcagaagcataagaacttaacatttgccttctacatcactacgttcagtcaaaaatttatgaacattgctgcgtatttcatggaagcttagcaagtaggtagtgattcgattttggcacaataaacaacctttttgttcctacgctaaggcaaatgcaagaagaaaaacaacacctttgtccgacccgtcctcctgctccaggcaccagagcacgaggcggccgtgggcatcggcctgcatgagaagaggcgccaccgcgccacc

SEQ ID NO: 2062 - DNA, 1252 bp, Oryza sativa
  misc_feature (1)..(1): n = any nucleotide
  misc_feature (6)..(6): n = any nucleotide
nccccnccgccccccgaacctcgcaggtaccagccggcgacgatcctgacgatgctgcaggagatggggaagcaggtgggcgcggggaaggggatcgactggagggcgctggtgcggaggacgagcaccgggatcacctccgcgcgcgagtaccagatgctgtggcgccacctcgcctacggccacgagttcgtcgagagcgtcgagcccgcctccctgccgctggttcgccactcgccgagatttctgttacttttttatatatattcgggaaattgttgagattttatacagtagtagaagtagatctcagcttgttttcagtgttggttgttcgtttctctgatggtgctgtgctgctgtgaccgataattcgtaggacgatgggagtgatctagaatgtgagattgagattgtccctgctccgggtaatgaagcattagctgaggccacatcgtttgccaaggtatcactttctggaaagaccattatcttgtacaaccgaagcctataatttcgtatagcgtggatgcttctttcgagtataagatgctaaaactggttgatttccccttattttcgcacctttttttttctgtgtgattatgtagttcttgtgtgtgtgcgtgtgtcattttgggttcatacgaggcagttgttgcacatattatttgattatggtcgtgatctcctattttatcaccgttcagtatctatctgataatgtgtagtgtttctattattgttggcttccgcaagcacagtttatgctttgacactaacataggttgttgaataacttagtagttatgctagtgtgtatagtttgagatagacagaatatgggcaaacatattcaaaggctattattgatgctcaatactggcagtgttcatagcttgattggtgcttcattatcaactggaagatagtgctccgtgtgtttttcactacaaatagggcaataaaaagttcctttgtggatgtgaaaatgcatgggaaaaatgttctcttttttcagtgtgtggccttccctgccatctaataatttacaagttaaaattgtgtgtagtggcacacttatagtgcttgcaggcagtcttgaattacatgtgtctagaaagacataaaagggcaatcaattttagtttatggaaaagattgtcgtatggaatgtgatgcacaaaaccacctaacctctagtttctttggcaattttgcatggtattcttttgaggcctgtggttctgtg

SEQ ID NO: 2063 - DNA, 2000 bp, Oryza sativa
  misc_feature (1117)..(1117): n = any nucleotide
gacatgatagccataagttaaacaatacatagagatgcagtttttttatttttatttttatttttttgatatatttttcacacttgggagaatacaggaaccaaccatagaaaaaataaactcaaatagacaaaatatgtgacttgtagaattttccaaagctctatcgaaaagtcattcgggtgtcatttattaaaataggcgtaactttctcatacggactcagaatcaggcaaataatatatcacggacatctacagaaaaagttacatccaattctccctagcttcgcaggttcagcgatattaaaacctccaaattccgcttgcaagattgtgttttcgaggagagaagtttttcggtagagatttggaaaattccacaggccacatatttcgtccgtttgagtttattttttatatggttggttcttgtgagttcctaagtgtgaaaaaaatgtcaaaaaaataaaataaaaataaaaaatttgcacatctctctcctctgcactagttcggagagagaggagaggagaggaaaaattatacaggtcacatattatgtccatttgagttcattttttctatggttgattcttatgtgtccctaagagtgaaaaaaatatcaaaaaataaaagaaaaataaaaaatttcagggggggtgccagccaatctggcgcgctccccctagccacctcagcatcgccccgccacgtcggcagggggacggcgccagccactctggagccaaaaaggaccatttctgggataagtttttttaggggtctatttgcaaaataagtttttcaaaaggaccaaaatgtgaaaaatccagatttgtagcacaccacggcaaaccaaaaaaatatatttacccctttacttacaccatagccccagataccagacctctccatttgctaggtgcaccgcgctgctcctgctctattgcatgctgatccggccacgtccatgcttggcgacggcggcggcggtcgggtgcatcggatgagaaggtgaaggcggttacatcaccgccgacaagggtggtcagctcggaggcagtggatcgggcaggctgggttgcatgcgacgagcttctccggtggccgcggtngggggggggtgaagctccgtccctcttcacatctcgttggcattcggcccatactaatgtaagtcccacaaggtaatgtaagtccatcttgtgcatagaaaaattattgacaaaaacacatttcaccaacttgtccttatatgttaggaaaattctacctagttgatgcgggatatggagcaaaacctggatttttacccccttttcatggtgtgaggtatcacttgaatgagtgggggactaatcctgtacagaatgagaaggagctattcaatttgaggcactcatctcttcgggtgaccgttgagcgtgcatttgggtctctcaagaggtggaaaattttagatgatgctactccattttttccctatccatctcaagtggatattgtggtagcttgttgtattattcagaattggattatagaagatggtggtgatgattttattatatcagaggaagaatggatagccaactacaattatgcaacatcaagaagtgggcaagctagtgagcatgcatacatggttcagttcaggcaggataccgcagaccaaatgtgggaagatcgtcaagctcactatggaaattgaaaattttaggtttgtagtctatgtatttgtatggaactctaagacttatgtactcctttttaagacttatgtatttgctgacatatatttgcttgctgaaatttaaggtttgctgtaatttgtatgcttgctgatatttatagtggtttctgatatttatatgcaaactgacattaatatgtgtgctgaaatttgtattggttgctgaaatttgtagcggtagctgaaatttagatgcaagcttaaatttatatgtttgctgaaatcaatttctttatacatgctaggca

SEQ ID NO: 2064 - DNA, 1065 bp, Oryza sativa
ggtttgcacgggagagagagaagccgggcgggaggaaggagacgaccgggtgggtgggaccaccggtcgggcgcgcggcgtcagcgcacgtgcggcgcgcgtgcgcacgcgggaggggagtggctcgggaggctgggtggggcggcttgggccgggcggcgtcccaggcgggaggaggcgggagaaggtgggccgggaaggagaggagggaggggcggcccagaaggaggaggagaggagggagtgggctgcccgggaggggaagagaggcctgggagagagaggggaaagagagggaggagagggagactttgggctgggccgagaaagagagagggaggactttgggccagacttggcccaaaggagggagagggatttatttttagtttttctttttagtaaactttgataattgtttttgttgcttaataattatttccggtgctctgaaaattcaagtaaaatttgagggctctttttagaccaaggagaatttaaccaaaattctccgggccacattttgaatttttcttgtacgtattttagtgtttgccaatttcttttcgaattttaattaattctattattccttttagagaatgatttttaattcgggatgaatttatcaggacgtgacaaccagcatcgctccgcggtttcggcggagaagcagttcaagttcttggccaagcacttttgctgatagcttttggctcgggggagaacagacgcgaagagcaagtactgttcaacgtcggcgacatcccgtacaactacaacgccatcttcggcagtgcgaccctgaacaagttcgaagccatttcccaccacaattatctcaagctcaagatgcctgacccgataggggtgatagtagtcaaggggcttcagccttcggccgcttcaaaaggcgatctagccataatcaacagagcagtgcacaatgttgaggccgaaccgcatgaccggccgaagcacgcgccaaagcccactcctcatggcaagataataaaggtgcagattgatgatgccgaccccacaaagctcgtatcactgggggcg

SEQ ID NO: 2065 - DNA, 2000 bp, Oryza sativa
tttaatttccttagttgccaatctaaatattgaacataatcaaacagataaatgagaaaaagtttaattttcagctctctgattttccttagttttctgatttttttatcaggaaaacacactcagaaagctacctagtacatgatgagacgaatcttgaggaggtaatgttctatcctatactagatagctatattttaggacggagggagtagtagttttttttcctcataatttcaaaagagtagtaccgaaaaataataatttccatcttgtgaagtgggctcaaacttgcaatgtggtttgccgacagaggtatcgtgaggcaggtacggtccaacaagaaaaatattatagtcaaaactgtcttttccatcgttttttttactccatcctgtcaatttacggctccatttcagagtcgatcataacggatgagatcgaaatgacaactttgaggaagcaacatattttaatccagagtgtaaaggctaacgatggatcaaactcaattgtttattgcagtagaaaggaaaatgcatggctaacattctttcacaaaggaccacaaccttttaaaatgatctcgtacgtactggaagtactactgctaacaacattagttgatgacagtactaatctcatgtaattaagagttttccgacttgacctcgatcagttggtcaattatgttaatgaaaaataggacgcctattagtctattaatttagcttgattaagggggtatttggaagagaggggctaacataagtccttcagaggacttatgtccccctaattcttacactcatcagtggatatgatatgagtgaaacaaaagggaagtttgattttctaaaccctatcgtctctgtccattcactagctagaccagcagaagcagctggtgagtgaccaaacacttcacatcctatcatagctccctaccctaaacttgacctctcaatcgccggtcaatcagtgtatttcttcagctgaagatggtgtttgaattttcctgaaaataaagatgaagataaaaattaagtgttttacgtaaaataagatgataataacgtgtgattaattgagttttaattattacaaacttgaaaaatggattaatcttatagtctataacaactttcatatagaaagttttcgcacgaaacgcaccgtttagtagtttgaaaagcgtaccacttttatccaaaaatttatctagtttttattagagagaaaaaaaaagggcctaattctcatcagcattgtctattggtgcagacgtaggagtatttaattttcactccatttttatccattgtccacgactcttgttgggagaaaagcaagagagaatcggagagaaaagttgcacagtacagtaaaggagtgttcctttttgcttactcctaccggactatcacgggcaacgatatgatttttacaaatactttaatacaacatagtactatatggccatattatagtttaatgtttctgacctttattaccattttccaatcgatattgatatattttcgtcaatacaacaaaagataatatcttgtttttctactactctaatgtgaactcatgaactcttaagtatacaatttttatgttcaatgcactaatcatcccaatctcatattactaattatatataaatatgtaccttgcattagtagttgcttagtatacatcaatatttagaaagtgcttctatagaagttaaaatgcctttactgtgaggcaatttttgaaatgctaaataatacctctacaatatgaaattaacaaaatatgctagacatacctctaaagcgtctttaggtaaaagtattctaggtgattttgcaagtgcctctaaaattccagaaattcatataacagagcacaaattctgcaacttccacataagagatcgagcacaaaaatttcacatcacattgcagagcacgaggtgaggatggattcatgctcctgagagagggtgg

SEQ ID NO: 2066 - DNA, 1684 bp, Oryza sativa
  misc_feature (886)..(886): n = any nucleotide
  misc_feature (933)..(933): n = any nucleotide
ctagtacagtagtacttgtggttgctgtgtatgttctcgaaggaccgggcataaactctcatgctcttgctgatgcaaaatgaaatcaatgggcacctacagttcgtttgtcaccagtgatttcagatttgtgttgtttgtactaccatcagttaatttactacatgctgcaatgatttattgcagccaaagatgttcagattgcagaaagaacaaaatacttgaccgttactcgtcttctgaaagtctaattgacagtgattgctgcaggtgttctcttgccgactagttctgaacataatgagtttcttgtcgaatttaattaaagagtagcattctgatttctgaacatcaaacataactatattgggatgcagtttctgaagagatgagacttctcaaacttatccaattatccatatgtcctgatcctggcaagtggaaagcattccacaagctgccatgatgtattttagctatcacccaaccaaagaatcgtaataagaacatttaatggtgataatcgaattgtttgtatattccatgtttaaatctgcagttcaaattcagcatatgggttttgtagctatcccttttcctttctgttgtgcctgtcctttttatcatgtgacttgttgaactcagaactctgaagcgtggacgacagagtaacattgcatcagcaaatatctcacacagctaagcttttttcgattcaacaacctcttacgtttgctgtctgctgtcaatggagagggaccagatcagctcaaggctctgtctcaccctgttcatttgaactttttttttttttactgaattaacagacaagttctgaatttcactcagaactcatgtaaaagaggttcttgtgaacattttatcnccatgattataggtagtataaccaaaactgtcattgcgtagtttganaggactcatcgcaattgcgattacttgcgtattagacaacaacatttgtattggagttagaaaactctcacacctttcttgcaactcacctacccacaacaaaccttcagagcaatataggtggagtgattaagtaaagaattcaaaattcaactagtatcatacataatttgacagccatttccgaagacttggtatcaatacatcatcagatagccatggctaaattcagaggaacacacacatgtgaactatatatatgcatgatgcaatagtccttctgtacaaaatgattcttcagttaccaatagctatcagctgatgcctctctcttccatctgttgatcactgccacagttcgtcagttagtttgaagcgatctcaggaagacagaaggtatctttctttctctgcttaattccaaaaattcactagaaaagatttcacatacaatcctgatgagccagaagaatgcagctttgatctctgtctctttaagttactgaaaatttgattcaacatagactgaattttcagactaaatctgtctctttagtctgatgaatattcagactgaatctgattgttcccttgctgtgatcataccctgaattttcgctgtatccttggtgacatcaacttatcctgtcctgacagcaagaaaaagcaggccttgtgaatgctgcaactgacacttgcatccattcttcttgctttcatgtgtcactgctagggcaagggtgatcaccac

SEQ ID NO: 2067 - DNA, 104 bp, Oryza sativa
  misc_feature (28)..(28): n = any nucleotide
ttctcgggggccccctggcggacacgangcggtgtccgaggcggtcaaggtggcggcgccgttcctgctcggggcgtcatgtagccccggccatggcggggagc

SEQ ID NO: 2068 - DNA, 2000 bp, Oryza sativa
  misc_feature (893)..(893): n = any nucleotide
gctcatcgatgcattcggtgccaatgccctacaggccgctacctatatcgttcacgggctcaacccaaatcgaaagccccgccatgaagttcgatgacgcggacggccaccatcagcaccgatgccatggactgtgaggacgctacatattcatgaggagttatatggcggaatggattttgatacctcgaggggatgttcccttattgtgtgcatgctactcaaatggttatagaaaaaaaataaaaaaaattgagaagatgtattaacatgtgatatagcactccacaaacatgcaagttcaaattcaattttatatctcacaacgaaaaaaataaatttaactgtgaatatttgttaactagttgtagtttaatttgtttttttcgtaacgagatgtataagttgaatttgaatttacatatttatggagcgatgtatcacatgttagtatatgttagtacatgttacatatttttttaatttttttcataatcatttgagtgacatgcaacaaatgagggatatacccacgagggataaaaagagttacccttaaatgacaaccgactactatcatcagcgctgagatagcgtggatgctgccgatgcccggtatgctcttttttctcctcaatactcgcgtattccacattcataaaaataaaaacaaggcttctaacgacaccaaacaattcataacaacgaattcaagacactgcgggctatgatcgatccatcgaggaaacaaagcatgaaaaacgtatatttagcacacttgcacagccgcttgcctttgctgatcccagcctaatgtggccttataagccttaggcccaaataggtacgttttttttttctagtttttccctattttgtgacataaaaatagntcggaactttatatccaaattttgtatttaaagactttgatttcttttactattttagccgttttaaatatttttaaattcgagtaaaattttgtattaagtagggcgagacaccacctctccccctaagaacatgcgcggattagcatccccgtacgaggaattgttcaagaccgcaagctaatctagtactccctcaatactcgtaaaggaagacgtttaggacaatgtttaagtcaaaccttgggaatatatattatgaataactctcaagttgttgagtttgaaaatgtaaaaattatatgaatagatttgtcttgaaaagatacttttataaaagtatacatatatcacttttcaatgaatatttttatagaaataagaagtcaaagttgtgttttggagaccatgtcaatgtcctaaacgacttcctttgtgagtatgaagggagtacagttcatttatgcgtccagggatcagttactacatctgtcttaaaatataataattttttgctataaatctgaacacataattattttgattcatagctaaaaatatttatattttaagacggatgaagtattagttaagctaccgcgccgtgcatggcaacacgacgaaacaccagcagcacccccgtgattttgggtgttccccggtacgcctcatggcgagacttgatataagtgcatctgtgcatggctcgcgagacctgaaaaccgtatatgtgggcgtgtggttgagaacttgattgggatgatgatgagacccggtgggtcgaacaacaagcgtacgtagacgagccaacgcgcgtacgccatttttcccggccctgcgtcacacggcattcttgtcccgtatccgcgccccgcgttcgcatcgatcgatcaaccggccaaccgccccagatatggcctctcgcgcgcgcggggacccaagcaaccaccgggcaaatccaacgcccaattcgtcgagagatttttcagctggtgcgtagacgtcgctaacccccatcgcctgctagtataataagatgacgcctacgtcgttccgtgcctgaatccgtggcacagctacgtacgtacgtgcgtgctcgttacacgt

SEQ ID NO: 2069 - DNA, 2000 bp, Oryza sativa
  misc_feature (215)..(215): n = any nucleotide
  misc_feature (249)..(249): n = any nucleotide
  misc_feature (692)..(692): n = any nucleotide
  misc_feature (745)..(745): n = any nucleotide
  misc_feature (897)..(897): n = any nucleotide
  misc_feature (932)..(932): n = any nucleotide
  misc_feature (954)..(954): n = any nucleotide
tcattgtgtgaacctggcatgccaaagaatgcatgccatatccatagatctttagatgcaactgcttccagtataattgtaggctcctttttatagcccctatacatcccgtgccatgcagtaggacaattcttctagctccaatgcatacaatctatggaacctagcataccaggaaatcctctgctcgctccaattgtaagtaacctagcagnatcctgttcattaggcttcctcatgtactctggnccaaaaacctcaacaactgctgcaacaaactttctcaaagcttctagagcggtgctctcaccaatacgaatgtactcgtccaaagcatcagctggtactccataagccaacatacggaaagccgctactaccttctgcagacaagataatccgagcacaccggctgcattcctcttctgcttaaaataatcgtcatgttcctcaacagctttcattatgcgaagaaatacatgaagcctcatccgaaacctatatcatgatgcaattaaattaaattagcaatactataaaacacgacacataaaaaattacataaacattatagagaacatgcgaacctgcgtctaaagatgtttggtccaaacgttggattatctgagaaatagtctttgtaaagaagattgtgccacaatagtctatcccgatgcactacctcatgtccntgaacagatccaattcgacccggattatttactgattcctcaatgatcatttncgcagcaccaaaaaatagatcatgctcctcatccgacgaagagggatcaatcaattcgttcattacgaactcattaaattcatcatcggactccataccctgcacgcaagactgatcaatttctactgatgttaattgaattcacacaagantgcagtaccaatcttcctctacatggcgatagtgnacgcacctgttggatgagtggncggcggcggcgtgatgacgcaacaaggaggcgcgcggcgtgcataaacgatctgccgacggcgacgcggtgcaacgagaggcagcgacgtgcagaaggaagcagccggctgtgaacgacgtccaagcgatggccggaaaccagcggcggcagcggagaaacgagaagtcgcggagtcaaccggtccggaagaacgggagccgtgacgtggacccttttgaatatggagagtcaatatttagctaggctgttggttttacccctctgtttgggatcttttttcctttttacagacctctttactctctaaacttagctaatcatatacataatctcttggagttgcaaataggttgtaagaagaatgcccccacgatgaccttggtccacacagagttatttttccctttgacagaagctgaatatcatggcatagcatcctactatttccaggatgaactgacaaatgccggtgtattcgaagggcgtacttgcgcaactgatgcaggccagtagtttggcagcttctaaaattttgttcattctgctagtgcatcaaaggaggttgcgttttcttctcaaacattgttagtgatctgcaacagactttgggttcacacgatagggctgaagtgttcgtacaggggtgtcatttctgatcatcaatatggcatgagtcattttacacatgttctttcttctgttttattcgatagcttacactcatacaatttagttttggaaagaattaatatataacctgttgcatgctcatgattctctcataaaaaatatgtgcccataagtagcgaaagaactcctctacacattatcttcctaacttgttcacatgtaaatgccatcctacaagttggccaaaatggacaatgtcggtcatgggcctcacctttttaagtacttcatgacaagaaacaagatacccaatatagcaccgtgcactttgtttctgtgctcctcagatagctattcgattcttggaaatccttaggctacccaccatagtaacataaaatcctacataatttc

SEQ ID NO: 2070 - DNA, 2000 bp, Oryza sativa
  misc_feature (322)..(322): n = any nucleotide
  misc_feature (989)..(989): n = any nucleotide
gagggtcccgggtgtgcgctactcctctaaaacagcccatttgaagtgtgtaagcccagttgatccattccaacttctccatatataagctaaaatcccctcacactctccctcccagccaccagccccaagcaatccaccacaaggcgacagctgctcctcgacgctagatcctctcccctcactctcttcctcaccctgctgccagccccaggccgcccatcacgacgcgcgattgccccaatgcagtcacagcaaaaggccggaggcggctgctcctctgtgccggatccactccacaccagctttgactcttcaccgnggctcctcacctcctcttctctgcgtctctgtgccttctcgtcggtcgtcgactcttcaccgtgttgccacgctgtcgtgctttcttgtcggccactgaactcttcacttcggcacatggccacattgttgccgagtttccttgacaccacacctccagccaccgtctagcccctagtcacctttgcaaggactcaaggctcttgatgtggcacttctagtatgatgctacagaaaatgttttgctgctatattgattttagtgtgagattgggttttctagattctgttgtaatcagatctgggttttcccctaatttaaaaatctgtgttgtttatctccactttgaagtgctattattgtaaattgtgttgtgttgtttgaagggtgatttgattccatatgggggcctgtcaggttgcgaggccctagaggggccgagagtagggattgatttcgccccgttcattcttctggggcccgggccaaggaaacccgtaggaaagcggggccgggacgtttctgtccaactcaccccccgccttgccccgttgccacccctactttcacacatctttcattttctacaattcctaactaggatatacgtaaattaggcctataacacaacaaaaaatgttgcatctcagtatgttaactatatttngtttttaaaaaaaaatcgcatggaactagcgttattttatgtctttctccaaataatatttttttagtaaaatactactagccaagaattacaaaacttgtaaccagttaagaacaatagaggttagaatatcatttaacgtacaaacatgtagaaaaatctcattcctaaaaacatcaaaccaactcttaatcaggcaagacgttgtcgtaaacctttcgatttgtttgtttccaaataggccaacaagcaaaagatatgttctcaagaaaaccctttcttctaaactatagccttgctactagcatttgacagattcccaaattagtattccacctaattccaagatgatcctagtagctcttgctaaagaaacatgaaaaacaaatgcattaagggtttctcttggccccacgcacaaagcacaagatagatctacatcctcctgggcataatgctttctgtccaacttttgtcttgtgttcaatttgtcccttagaagtagccacatattaaaaaaatcacatggaacagtattcttttggtactgtgggggcggtggtgggaggacggggtgggattggttcatccatttgggatgttggagttggagcacccaaaacacaaaataatgacttggtactgaagattcttattgagaatttgcaagagatgttctaagcccttgtattccgggagaaacttcgaacttccaaaagtacttatattttggaatggagtatatttacttatcatacttcccttattaaagggttaggtttggagtatatttacttattatacttccctttattaaggtgttaggtttgttgttaatggcatttgcaataagatgttttctttccttactatgaggttttacctataacaaggtaatagattatatcacccattggatcaaacaccaatgaactgttcaaatatgcttggagctccttaaaaagtccttatattttatttagaattttcaatgttatcatttgacgatct

SEQ ID NO: 2071 - DNA, 2000 bp, Oryza sativa
atttgggtaggaaagagaattaaaacaacccttacctttttcctttaaaaatatataaatagtattattaaaattaaggggacgggacggctcgtagtatacaatcaagacgccgatattaggaaaagacttaatatgaaataattagaaggggtgaggttttaaacccatatcgtctagcccactaccttgtggagctagctagaaaacccctaagcatttatgattctccttatctcttcatcctcgtcccgctcctcatcccatagataccgcgtagtttcatctcgcgtgttccaccctgctcactccgtttgtgcgcgttgcgccatcccaccgtgtgctctagatcctcacgtttgcgttgcacaccccacgcgtcagggtggaaccagctcatagccaccttcaactaaccattgttgaacacatagtaaaaaaaaaatctaatctctatgatacatggtgttgttttaagaatgtttggtttgctaaacccaacacaaattatgggtaggaaagagaattaaaacaagccttacctttttcctttaaaaatatataaatagtagtatcaaaatttaggggacaggatggctcgcagtatacaatcaagaagctaatattagggaaagacctaatataaaataattagagggggtgaggctttaaatccatgtcgtctagcctattactttgtggagctagccgaaaaacccctagacatttatgattctccttatctcccgaggatgaagaaatcgggccagaacatcattagagttctgaattgctaaatttgcaaagaatgaagaatgtgcatcgaaaataataacatattaagactgtggtagtattactagcacggcaattgttcgatagttttcttctaaactgacacgatgatgcccaatcacaccggaccatctcgtgggctcgtggcaaatgttcaaaccggcccggttggatgcagcattaggccgacatgtaaaagctctgtatgcttgtagcccacaacaaaaactcctcgattacgagcttacggctaactccattcggccgtggacacaacggaggcctctacaagaatccaagacgcaaatgctcaaatggcctaatgaacaaagaaagggacaaatggcctggtgaccgagacaatcaggcagaacacaggagaaatacccaagaatcccttctctagaacagatcaacgccatcaaatatactccacacttccacagatcgacacgcatggatgccggattcgacactctttggccgatggtacgagctggatttgcacgcagcctcctgctacatttcgtctgtgtcgtctgtgcgctgcagtgcctgtgtgcccaccacgtactctccaactatacatgcaaaggcagccacacgtacatacactgtagtttcacccgctggctacgcccacagtttccaactcccattggacccatgggaaaagacaagcttttcatggtttctgctttgtactgatcatacagaccaacagtgctaccactgccacagtagaacaaatccgtttagccattgtaccgcaagcctaatgcggacaggatgagtacattataatctctgttagtatagaccaagcaacaattagccacgccgagtttactgtggcttagccattaaattactgtggcgttgcccatttgtagcctcatggctcggtcactccctccctctctctctctctctctcttcacgggagggcagtgtggttttggtcggattccgccaagttaggcagcacatgcgctcgccttcccctgtttgtccatagttccatacacctgcaaacaacgccctcctttccctcccttaattgtcggggcgctctcgccgcccgcgcgccactgcgctgctacacgctacgggataagccaagcttgcttgctttcgtagtcgctttgctcgatcgctcctctcgatcccatcctagattccactcggttctgcttctgctcctt

SEQ ID NO: 2072 - DNA, 2000 bp, Oryza sativa
tttgcttccaaatagtgggtaccatgccagggttcgccattcgcgttgagcacggttcacgtgtgcaaccttggttcacaggactatagtcagtgttcctcatatttagatttagtggtgaactccgtgaaaatcatttgctgtgttcggtgaagctcataccaaaatttacgacgcaataacaaacctctcatttgtgccattccgtggaggcaaccgaagggaattaccggtttgtcaagcagtgtggatatttatagaggccgttggatgtagttgtcgcggcaacgccgcagcttcctgtcaattgacaatctttatcactgtttgctttcattatgaagcatgtttctttagtctagttacccttccttttaacaaggatggtacaatgctttcacttattttgtatggcgatgtacttgggattattcccctgatccctgactatctctaataaaaatgttcttgagtcttaaaaaaaagaattcttagttctaaagctgcagaaaaattgaaattttcttgcacaccttaagacaatgttttagccttgatacctgcaagttatgaatttagcccatctttgtagtttatcatggttgactctctaatacttcgtgatggtgaaagctcttccaatatatatgcatggtcttaaaaaaatcataatgacgtatttcacgaaaaataagaagagatggcaaaaatgtatataagactaatatattgcagttgttctattgaaataagaagatctatcaaagctatgaagaaaatttttgtattaacgtttctgcttaaaaaaactttacaatctacttggtctaataaaagttgttatacatccatcctaaaatataataatttttagcattcatttttttttcaaaaacatatcaattccaagttgttgggttctgtatttgagaaaacaaaatcaaaacttaactatttgatgggaaacaccatatgaaatcttgcaaatttcggattggatcactttgaaattcatgcaataccccataaccataacacctcctctcctccctcctcactcctaccgctgccatgacttggtcaagtgagcgctcgatgccccacctcctgtgtcgttgtcgtccaccacactaccacccggctaaactggtggtcgaaaggtgccgacaaggcacccctagcaagcctcttctccctttcctagccctccttctacttaagggcccctttgattcgcagcatagaaaaaacgcaggaataggaaaaacacaggatttgaagtggtaggattttgaaatcctatgggaagagaaaacagaggaaaacataagaagatccctttgatagaggcatagggaaaaacaaatgaatctgcacatcacttcatttccaagaggtctgacctcttttttagtttcctttgaaatccactgataggagtgcaatcctatggaatttatacttgccttttctatgaatcaaagaggcttgaagaaaaaaaatcctttggaatcccattcctccaaaaatcttttagcattcctttaaatcaaagaggccttaagccagattcaccaataccacccgccattaacgttggcccgctatcttccttcatccacgcggctctctagcattgttgcctacccatgtccattatttctcattcatagtcgtatcactgtttccacaacaatccatttaaacccgttgataccctctatccctaaaccctaactttgtcagggcattgcatgttattaaagcttcgttggagtttaaggagaaggagctgagattgtgggagcgcgaatcaccgaagcaaattgtgaagtaagaaatttataaggttttaggcccaagtctaggataacaaccatttatccattaaaagaagtactcagaataaatccccttaatcccaaggggtaccgtgaaaaaaaggagtacggctaaaccctcgcgagtccccactcttcctctccccgttctgcatcacc

SEQ ID NO: 2073 - DNA, 2000 bp, Oryza sativa
  misc_feature (1889)..(1889): n = any nucleotide
tttatttctcaactaaactgttcttagtcttttgtaaggcatactgcacttttcttccctctgccttatgtcgtagttatccttgtgcaaggataagtcagtttgaatttgccttgcctattggatattggatattctagaaaaagatgatgcttttatttatttgatcagacttttttaattttgcattattgaagataattatgatgtcttgtttatctttatcttctatttttctatttttgcttttttgttcacttggcgcatgttctaaattctaatatgtaacccctctagctgacttttccccttaaaatctggttcgttgttatattattttatttttcgttgctggtggcaataattgactttacaaaccatggggaatgttttgggttcctgcaggtatgttgtggatgcagccgatcgagagaacatggctattgccaaaagcgagctccatgatcttctgagcaagccttctttgactgggatcccattactagtcattggcaataaaattgacaaacctgaagctttccctaagcaaagcttcacagacgtaatgtaagtacacgctaagctattacagaccgataaggttttcttacgcacaaacctgtgttcgacaagttatatgtgacattgcagggggctaaagacaatcactgaccgagaagtggcatgcttcatgatatcatgcaagaactcgacaaacattgactctgtcatcgactggctcgtgaagcactcaaaaaagaagaattgatctaaatttttagcttttgaagtacgcagattctctctttttgcatgttgcgtagcacttggcctgtaaattatgcaagagttattgttgatcagggaggttgtgttcataattttgtaacctgctttggcattatattggcagactgcatctggtattgtgcacgcatgtgcttccttccgacttacaagaggttccaccctcgtgttgcatacttgcttggtgaatttgaaattatgcgtgatttgtggatcatattgtttactttggatgaaactaaagggagacaaaaatgttgataaatcgatgctgcaatgaattgcaaatttgtgcttgagactctgagagtaataatatgtagcatgagagaaatatttaaactatgtatttggttcttttaagtgaattgcatcatcctgggagaacagttgtataatgtgtgcaggtaagtaaaggtgctggagcaccaccttgcaatttcttgtacagtttgttatgaaattagaagggatttctacttgtacaatttgatatgaaattagaagtgcaaaagggaaattgcacgttatgagaagaaatggtttagggaaagtacgttcatttgctatcaagtttatctactcgaagaattttctatcggcatacgttcgtttactatgaagtttttctactcgaagaattttctatcgaccgaggtttgtcttcccccgggtctgttttccagtgttacaagttacaaagctttgtttccaacatttttagattccaaatacttaatttaatctatgatacgaataaacatatcatctcacgtattttctctgttttttaaatatataacgttgttgatttttacaaacatgtttaaatatttgtcttattcaaaaatcttacacaactacataagatataaatcatgtttaaagtatttttagtcataaaacaactcacaacaaaataaattatatgtacataatttttttaataaaacaaataattaaatatatgttcaaaagtcaactatgttatctatttaaaaatgaaagaaggaggcagtatataccagttacgagcttcaaacaacgggaaaacgaatttcaaactcgtttataagaaaacnaaaaatcaaactccaattgaccaagggtgaagggggtcttgactctagttctagtcgccgctgtcttgcggcctcctccggtccaagccccctgatcccctgacctcaaag

SEQ ID NO: 2074 - DNA, 2000 bp, Oryza sativa
cgcaagtattagagtaataattaaaaacttagacgtggtgtctaggttagagattacctttatttgttgtgtatccaatggatttgttagaggtagacgacagctggtgatagccttggatcccgtcctagtaatcctccacgttcggatacatcatagagctgtagccgaaaccacatcggcagaccagcaggggtcggtgcccgaagcaacatatagggagttaccttcaacttagcttagaaagtcacagaaagtcctctctagcctagctagcctacctttagttgttcttggatagtcttaaccttaggtagattacacacgtttcctgagttcgatatccttttggggtcacccaaaggtgaagtgctacagcggttttccgtgcgcttgcggatttatccgtggtcgtaagaaataccaacagctgtcaatgctggggtttggcatggattctatagatgatgtcttggtagcggttggagggtattttcgacaattcgcatcagcccaaccgtcattacctgcctataaatggaccacaccttctccactctttcacacactcaagcaagaagctcttgatctctctctcaattttagtttagtactatagtgctagtggagtagaatagaatagttttcttagtcatcgagtcttcggaagatatcgggtatagatctagaagcttttctctcttctattgtaagacttattgaattaataaaatattcttctttatattcttttaagataatggattttcattaataatgcctctaattcttttttatatatcttcggtactttacttcatctgagtaccagctttattttttacttgtatcgatatagttgtgtagctagcttaccagagagatgcaatggtgtaggtttaatgtccgagtattcggttactctatgtcggatgcatgtttatagagtagtatttaataatataagcattgtgcttagattattaagtatcattatctgggcatatatgttgcggaacagtagaggtgggccgctgatggtgatagctcaatacgagtattcctccattttagtatatattcctaagacactttcataggatgggtactcctctgtatttgaccctgattggatggccatgacagattgtcgtaaggaactcggcaatcagggggtggtctctcgaaacaccaagacaatgttaggggtattggttgcatgactgtatagtagcaagtgtaaactacagatattagaagtataagaacaaattcttttcttattctttcaccacatagcctagttttatttaatgagagtgttggaggtacaccatgagggccttcggccgagcctaccgcaaccaacaacctgggcaacagactcaagccggaggccagcggtgaagatcgagagggcagccatatgggcgaaagccacatggcaaaagccgtggcttaaaaaacacgcgggctccgccaagcatgaacttcgtcagagggtcgtacgggcaaaagcctaggcgcgaagacacgggcttcgccatatatcaaaccccaccggaagaaggcccagtgggccgttgctccttcggggaatttcaataaactgttgggccgtgccatctagcccagtaagggcccgtacatgtaaaggacaaaatatggctaaactgtaagacacgcttcgccagatgcaagagcagcagcaagcgtacgaagcagcaagacaagccaagacccacactcagcagctctacgctcagccctaagtttttcccccacacactgtatcgtctccggtgtacttcgccaagcccgccccggccgttgccgtacgtccgactccgcatgtaatttcggcgccggttcgcccggtggcaccttcaagcacagtacccggaagcctaacttcacacgccacaagctatgatggaagcaacttcgaccttagaagcaaaatttcaagccttcttgcaacaactcaatcaaccccacaa

SEQ ID NO: 2075 - DNA, 2000 bp, Oryza sativa
cttctagattgagtgtctagattctctgtcagcctacgcttgaccagaaggtggagtgttgttttccacgctgcgcagtacaacagacatatctgttggtttgatcagcctattctcttaagtatgtctactaaccagactgttttgtttgataggacatgaagatttacattccagtggcgcccgaagcttctaggttgtttgtttgctagttgagctgattatactcgcaaagtacggtctatatgtcaagttcaccatatactccctgttggccgtgagcttccaggtcatgatgtcataaactatgaacctagtggcgcctatagctgttttaaccacattcaaatatcaacgaaatgccatatatgattagcttttgtgatttgacgaatatttgaatccaggtgtcttcctctaggctgtcccacactaaacattctttcgttttgaggccataaagattgcagaggccaagagcctcggtgttttgttgtctaggcaatgtgagtcctagaacctcaccgtgtttccgttctcaagagtgatgatggtcgcaaacgcaaaatgatctgtgtatccagctggttaccagatccggcatgcctacccaaggtatctccaatgccttccaatattcaaaccaaagccatcgcaaacttaaaaaacgctcttgtgaagcgacgcgacgcatatttaggactcatcaaccacaaagttctttcggtttgcacacttttttttccaattcaactgcaagttttattctcgcatatttttaaacttagttataaaaagacatggtacgaaatataggtcaagattcattggcatacagtcactagcaagaattttagttctctctctagtctctactggtaaaaataagtatatagctcgctggccgctgcttgagctaaaaaagaatagttggcaacttgctgctaatgttcaccatttctgaaatcttttgacctccaacatttgagatgccacctgtaaaaatgcgagttaaattttgatcttcggaacatgcagtggactatcccaattaaggacccagcaagtgttatcctctccgtttgaataatcggcggtgaaaaaaaaaattgaagcttcgtggcagcctcgactctgaacagaaacggccaacatggacaacgtgcggtgccactgcgatccctcgtgcaggcgtgcacggtgcagcaagctagctagcgatcccgtgggtctcgtacttacctcttcacgacgaacggtaatccagaacaaccgcggcccgggatagcattcgagacttgcgcctcgcggaatttaccagctgcttccacgtgacagagcctcacaaaatccacctgcctcgtcagactggtttgttgtcacgcgtacgtacgtaaatttgttctcacgcgcacgtaaaagacaacaggaatccaccgtgacttgcttcaccaccaccctgcatgcatattccattttccagagggaaaaaaggtgttcactgatctccagctgttcgcatggttggtgccctctccttcccgggtagttggggaatgaaatgacgctgggattgcacggttagtaaagtgtttaaactggagttcttactgcttgcttggtttaaccacaacccggtccctctggtgtgcgggctgggctaagctggtggccggctcagtggccctcgctttatttactccttaagaatcgttcgcttcagctgaacctctctccgccccgcctccccttccgtctctccgcgctccagctccacgccaattaaaccctactcctcttgcgttgcgttatctgcggttccgtctcccactactcgcgcacacgtagaaacggaaggagaaacaaacaaaaggcgccgagtaacgcagatagagagttgtttccgcaccgagcgcgtccgcggcagtgtgtgtgtgtagcggtagcgcacgcgcggctcgcgggcgcgccggttgcaccagctgtgcgttgcggcgacg

SEQ ID NO: 2076 - DNA, 2000 bp, Oryza sativa
aaaaaagttttattgatagagcagaaaaattttacaatattataatcctgaaaggccgtaactaggaaaaagaaaaaaaatataccaccacccacacaccggcagcgcccacacacaggtccgggagaatgctagcaccaaaccgaccgccactaagcgtgaccggcaccactagtccaacaacggaacacagacgagatcgcccaaaaaaacacccttacaaccaccacaaagcccaactctatccacgtcttccggatttagggagagagggtgagagagaagatggaacatctctcctctctaggccctccgacgtgaccaacttgtagaaactaggacaccgctacaagaggatgagaatctagagcgtgcttgcaccaattgctcgagtggtttcgacaagggggatgccattcgccagggatgaaaacggtcgaaaatagttggaaacaatacattattttattattttttcgaaaatgaacggaaatggtcaggaaatttccatatttatgaattcatctatttagtgtcaacttcaatgccacactaacataaatttaaaaaactaaaatttgaaaatagtaaccatcggtaaaaatattattatcatattagttttccgaaaacggtatcgatacggtcggaaaattcccatatcattttcacccctaccatttgcccctattgctttgagcatgtgttgagggatatttgtgtcttttgtgtaatcaaaagaaaactttaattttacattttctaaacctacatttggaaaactattacaaataacatggcatgaaagtattttaaggggcaaatcttaccaacttttactagcgtgtcaaattcttttccgaaattcaaactgaacttggagtatttgggagtgggtaggaagtaaagaaacaaactactcgtaaatacctgcatgttgctgtcttatcaacatgtgagtgcctggcagaattatatttaaaaaaaagacaaggggaagatccttcctcttgctcaacgagattcttgcatatacactggagtactctctatacatttttctctcttgcgaacacatgcaaacacaaaaagctttaaccgtagctttgttcagtcttctactgctgctggccattctcccttcccagtgtcacactctcaaagtctcctctcctccatcaggtgttacctcctgcagatcctgattggaatttggaccttctcctcctcctcctccaccacctcctccttcccagtctggtaaaatgtgcaggccataaagccctcgcaatcctagaacagttgcatttctaattcatgtatagtaggaaagaaatatatatattcctgctctgttctgttcttatcttttgctttgagccaaaaaggttagagcttttgtgttcttcccccacaaatatcccctagtgccttttgtttggccgtggtgtggaaaagcatatgaatgggggagcatctcaattggcatactgctgttgccccccagcttagctatccctttccatccctgcaagaacccttctttatagatctgtgcccttgctgttcatggaaccctgtgattgaggtctctagttttagtgtttaattaagctctccttgccttgccagcttttggatgatgcttacatcttactcctctattggttcttggataggggtttcctcatttggtctctcactcgcggtgtaaacaaagtatatgctccaagtaagctgctacttttagctgcttctctgattcttgagtgatctccaaggtaaagctcccctcacttgcttctagttgctgttcttggtttgagcaagaaattcaggctgtttttggagcagaaatggattgtagcagcattctctgctgcaattgatgctggtggttggaagaacaccaaccatgctgctctgtgtagtaagtagtggtagtagtagcttgtaaaaggacggtccattttgcagtgcagaaggagagggaggaggag

SEQ ID NO: 2077 - DNA, 1885 bp, Oryza sativa
  misc_feature (3)..(3): n = any nucleotide
  misc_feature (24)..(24): n = any nucleotide
  misc_feature (44)..(44): n = any nucleotide
  misc_feature (67)..(67): n = any nucleotide
  misc_feature (103)..(103): n = any nucleotide
  misc_feature (121)..(121): n = any nucleotide
  misc_feature (309)..(314): n = any nucleotide
  misc_feature (316)..(319): n = any nucleotide
  misc_feature (356)..(356): n = any nucleotide
aanaaccgcgggcggagcccaagntgcggcgggttccgccgggngaaagccccggggctggtgctgntccttcgctggggtcccgcagagccccgaacttcgncccttccctccctccctngggccgccggccacggcggcgtcttcctccccggcgccgggtggtggtgccgggaggaataagctgccgcccaagtccccctcgatctcgtcgttccacagctcgccgacgtcgtcgaggctcgccggcctcggcggcctcaatcgacccgcggccgcatcctcttcccccggccgcgtctcggcccnnnnnncnnnnatgatctccgcgcccccgctcccgctcccgctcccgntcccgccgccgccggtgacgcccgcggcggagacggtggtggtcccggcggagacgtcggcggcggtggcgccgttggtggtggcgtcggcggaggcggatgcggcgggcgacgaggcgctggatctgaggcttttccttcgcgggagggacgggagtacgtgcgtggtgatggagctcgactccggggtgctctgcgacagcagcgccttcttcgccgccatggcgccgccgcgcgggcccgccggtgacggaggagggagcggcaggaggatcgaggtggacggggtggacaatgtggaggcgttccgcgccgccgtcgagctcatgtaccagcctgatccgctgcggtggctcgccgccgctggcgtgtcgcgctccattgatgtgctcgaggtgagggaaacgaattaagcttaagcagcttctcttaattgattttgtgttactagtagcatgatgtggttgcaaaagaagtagtactacttgcaataatggatggcattttgttacccacaacagggcaggaaatttagtgggcattgcaaccaaacaatcattcacggtacattgatgttgtgttccttatatgttcattttccgaagccattttggtggtagataatccagtgtggtgttaccaaaatactccattttcacatttttttttgataggcgcacaagttagagccccagcgtttgcctttcagcttataagccactgccaaaatttaatttggaaacttaatttttgaattgattatgaggtttttttcattgtagtttatgtttcccagcattggcttttaaatcgctaactagttcacatatataaagttttacgaacggaatattttttgatcgctgataagccgttacggcttataatcagcatatgccaaacaacgatagctctagcattcgagtgaaactaatatgatatgattgtgtgagaagcatttgacctgggatattagtgatttaatatcatctaatgcttttattaaaccattgctttcatgtaagttatgcaaagtgatatgtaagtatataattataaccatattagatgttgtagatcactcactttctatgtgaattgtttgcatgctggtattgtttgtttaatatgttaaatcatggattagataataatacaatcactataagtcttgtaaccatacacattctatggcttgatgtccattagatcacattctacagctatgaaagtcagctacaaatgcatttagtggtttgaatgcatctaggcccgcaattaaaagcaagtattcctgttgcccataattgctatctagtgatccaaataaagcagccaccattgctgtccaatatctttgtaacatcttttcaattctagcatgtatatttctcaagtggggatttacagaataatatgttattaaatgcttctttcttgcattggtaatgagtttattaaatgccaactaattaatcacgtacataatttgtttattaatgctttaattgcaggtgtcttcatcaatc

SEQ ID NO: 2078 - DNA, 2000 bp, Oryza sativa
cccttgctggctcaaaacaaggtaatattgcagtttagcacatatctgttattctagtatcattttactgttcatttctggatgtagaattctactgatttccccattctctagaatgatttcaccaatggcttttaacatatctattgcactctgttgcttatatcatggaaggttacctttgtatgattgcttttgcaatttcttggacttacctgaataaaaaagtgaagcatcacattgtcacatgttcaatcaataattggtgacaacgctgcaattttccctgaaagatctcatgtttgaacctttcttctatgaattaatgcttgcaatatgttctttctcctcttccttttgacatgctgataggctgatagctatagatgtttccttgtgcaggaggtttcaacatcagtgggttgtggggagtatgaaggtagtaataatcagagccagaaccaacaaatggtgtgtttagttcacaccaaaattgaaagtttgattgaaattggaacgatgtgacggaaaagttggaagtttgtgtgtgtagaaaagttttaatgtgatggaaaagttgaaagtttgaagaaaaaatttggaactaaactcaggcctacaggtgagtaaacagggtgcagcaacgcagaaaccacagaggctttctaatgccacaccagcaagagaaaagctgaagggggataatgcgaaacgtataggatctagaacaagcccacgatcatccacgtcccctacaactgaacctaaccaaacgaaaaccagaaggcctaaagctcagcaggtacagattggtgccgagcgcaagtccagtgattcaagaagaagcagaaaaaaacctgctccaatttccagcatcttgtctcatttgcacatcggctacctgtttgcctggccgcaatattctccagatgatagcacggcaatctgctgtcattcgcatttctgtgaacggagcagcaagatcaacattcgaaggtgagaccttgcaagtacatgtccactgttgaatagcaactaagcaagactgaagtggtgttccttgcttcacctctgacaccattgacacattagcctgccattgagtagttaattgcttttgattgacttgactgagtttgtgtcctctccactctccaggaaagtctcagcgagtcatgtgttgtgttacagcttgtaacatgagccaatgtgttaatgtttctgtaaagttggcgtagcgccatggccattgacgctataatgttagtaatgttgattagtgcatggcttatttggttgcacatccatttttcctaccatcacatattcttcaacctgtactgcttgttatttagatagctcactccaattacatattgcaagcttgtaaatatttttcaagaaggcatttcattccttaaaacatttttccccaacggaaaccgttggccggaattgatttcgccttatttgtagagaaatagcatacacagaacagaatgtactgatgtatatacgagggttaacgacgttgtgaaaccgctaatggttagtttgtgaaaactgatacagtatgttttagctgttttttttacggtttttactggtttttggtaaaatggtgaggagcggtttttaatttaaaacggaaaggtaaaccctgggagtacaattcagtcgttcaaagaaacagaaaaaaaatcatcagtgcctcagaggcagaaatcacctgtaatatgtgtataatcattgttgtatgtgtgaagtatatatttccctatttttggcatagctaaattaatcctttattacacaaaatctatggccgtccagcgtaattatgcactcctgtccactcgtccaacaacaacctgctaaatttgcgtcttgcaaagatcacctgttcatataatactctgcagggctcccctctgaaaaaagttgagatttcagacaattaacatcactaggagagaaatcaagaaacaagctagccagca

SEQ ID NO: 2079 - DNA, 2000 bp, Oryza sativa
  misc_feature (900)..(900): n = any nucleotide
  misc_feature (903)..(903): n = any nucleotide
  misc_feature (918)..(918): n = any nucleotide
  misc_feature (1060)..(1060): n = any nucleotide
cactcgctactggcaccagcaaggactgcctttttgtcttcatgagtgaccttcttgactatgcacacttttcagtattgtctcgagatttgctccgacgtcatctactttgtcgcaggacgttgccacgagaagttgttccagtatccctgatgcgggactaacccatcatcttacatcttgacgacgaggggcgatgatctccatatcttccttgatggtgttgccctcctcgtccctgtttcatggctgctctagtgtgatgggcaagtaaagtgctaccgcaacggtgagtttctccaacggcctgctccatgataggagccgtgatgatgagctcctccaacagcctgctcctcgctaggagcatctgaaggaggttgttaagcacatggctttggtgtggcggttatgatgatagtttggtggatgaatttactagtgtggggtagactaataatagaatgatgggagtgataactaatagaaaatcatagtttctatagtaaaatccaagagccttacaaattaaatgggcatttctttaaggactgtgaattggatattttgatagtactaagtagtgaaatttccggggtggccactccgtacggccgacgccgctcgagtctcgacggcagccgtccgtgctcatcgtgggcttcaggcccaacagatgatgccccttgctcctcaaggcggcccacgcccgaaaaaaaaaaaaaaaaccctcccctccgctggcggggcagctttcccctcttttcccttcaaccgcggcgcggttttttcccctctcccgcgcatccgccccgcgccatggccgcctccagctcctccgccccgccctcgccgacgcctacgacatcccgtgggtggagaagtaccgccccaacccgngtngccgacgtcgtcggnaactccgacgccgtcgcccgcctccaggtcatcgcccgcgacggcaacatgccaaacctaatcctctccgtaagcgccatttcctcgaacaccttgcgcgcgctctcgctaacacccaagcagcagtacgacgaatcgtttntaacctttttttttttttaactatcgttttctacaggggcctccgggcaccgggaagactacgagcatcctgtcgctggcacacgagctgctcggacctagctaccgcgaggccgtgctcgagctcaatgcctcggacgacaggttggtgcggccgtggcgtggttttgacttggcgaactgtagccgtgcggcgtgcgcccgtggtgtggactgggtgtgtgacggactgacggttgattcgtgcttttgcaggggcctggatgtggtgcggaacaagatcaagatgtttgcgcagaagaaggtcacgctgcagccggggaggcacaagatcgtcatcttggatgaggctgacaggtaatgccaccccctagtgcggatgatgtgacaccattgctagtactgtgccttatttagtccagacatgccaatttcaccacggattgctagaggttaagatgtagtaggattgtagtgataccaacagtgtgaaaatggagaaacctagtggctgctccatctctgtaagagcaaagctatattatctcgtagagatgatttttttttgtgaatacacaaggattgtgcatcttttacattaagactgaggagttgtataacatttacaaggtgaaaactgaaaaaaaaggcaaaaaaaaagggatgctagggctgaatcttgtgtcatgggtgttgcgacctaaatgaccaaagccctgctaagcgccatagtgcagcttcttccaccaccacctgggcaatttccggccaggacttctgatgattgttgaagtagttatgaattaaagacttgttcattatgatttttaagcatataactactgatatcaaggatatagctagttgtttctgagtttgcctcacatgcacttgctacatgcagcatgacatcgggagcacagcaagcactgagacgaaca

SEQ ID NO: 2080 - DNA, 2000 bp, Oryza sativa
  misc_feature (1181)..(1181): n = any nucleotide
agccatgacaagctgtcaagtccatttgatgggatgggtgcattctggaaaggatagttgtagaatcttttaggacttatagaagatatttctctccatgagcccttgtcatttttcagtgcacgcatttcagactttagtttaacaactgtctgtctctgaatttgaagaagacacatttcgacttcttcatgaaccaaagtattaacgtattattcagctttctgtctctgaacaaatttgctccacactcacgctgcatttcttgggtttatccttatgagctgaaaatctgcatacttgataattacgctaactatttctgatggtataatgtgcagctaagaagctaaggcgggtgccaagaccgacgcctaaagcctgggcgtcatcatcctcatgctcctcaaccaggattttaggttgagggtatcagtgtcaactcaacactcatagcaacaattaattacatcctgtagtaaacttataacgagtatgaaaagtaatagaagaatgctatgtaactagatgaaattgaattgttatctaagtaatcgttgttctcaaataaaaaatccttaattaattgttactatttaaagaaattaatcaggtggatagcttggtgagtgagttagaacaaaattaagatgaaaatcaaatcggaagttggctatttttttggctggtaagggcaagaaaaaaaaactcactaacgctagtttcagaagcagacgttgcattggcgttgtcttgaagaaggcaaagagttaggaagacgtgtaggctgcatctatctattttacttatttagccaaagctcaaaaaacaatatattgaccggtgtcataaggcctcttggtgttacacgggaagtcatcgattgtccatattctctaatgaaaattattttagcttattaggaaaaaatattttataggtagatatatgtcctaacgatttaagagcaaataaaaaaaactacgttgaaaacatcgtaagatcaactttaaatttaagtttaaaaaattcaaaaaataaccttggcttcaaattaactagggcattcgaggagactctgtaaattaggacgaggtagctggaataagctgagactgtaaccaatgtgaaatgaaggatgtgattaggaggagtcatatcccatgaatttttttaggacnaaaagtaatgcccagcgagacgttcgatcgttcggttgtctacgtggcaattatctatggcgaggctgtacgggagcctgtttgcatccggtctccactaatttcctttttccggtagtactggcctgtaagcgggccacccatgtcatagactacctatctatccgctttctccgtaccgagcaaacggctccgtgaacctggtcttggtacacccgtgagagctacaggcctacagtccacggggcacgggtgcaccgccaaaccctcgccctcgtcgtggtggacgagcaaaacccaccacccactccgctcctcctcctgcaagcttcctccctcctcgcggcgaggcgagccatggcggcgccgttccgttcgtctactgccgccccaccgacgccctctccccgcatctcctcttagctcgatcggcttgctagctcctcggccatgtgctctaatggcgatttctcggtttgttcgcaggtgagagcgctctcctgaggcctgagggcggccttcgacgggaacctcggacgcctcaaaggttgctactacctctcctcctcctcctccccttcttcttctccgccgcgtcgatccccttccccgatcgatgcgtctacgcattggcccccttttgcatgcgcctgttgcgtgattttcctcccttaggtttgggtgattcctcctgtgtggaacgcttggcgatggctgtagtactgctaattaatttggccatggaatttttgaaggaagggcgcttgctgcgttgctgttgcctttgggaatttcccacattttattttattttcggtg

SEQ ID NO: 2081 - DNA, 1409 bp, Oryza sativa
  misc_feature (172)..(172): n = any nucleotide
agcaattcagttactaatacggtctcaacatgtcactaaccgaattttattcaaaattttgtcgatttgatcatcaccctcagctaaccaaattgattgaaataacttaacaacacaatagaccaccaaggtttcgttcagaaagaggatgtgctgggattgattttttaangaaacttctatgttaagaagtttagcaattcgagaagattgttaatagaaagtgatgaagtagttgtttcacatagttgtttagaacgcactctaagcccaacagaggaaatcctactttcttacccatcccaatcaaccccacttctccactcacctagacaccacacggagcgccacctcttggcattgcctgacgagcgatcccgcgctgcctactccgcctctacctgacaaccaagccatgtgtcacctcctggaagttgcgccaccgcttctccgcatctgcctgaggaccgagctagcgttgcattctactgcgatgccgaagaacccgagcccgagtcagcgccactatcctccaacccggcctacactcgaacgtcatccaaagcttgaggcatgcccgccagctgcatctcctctagaggctcttccttcactcagcctctccaacgacgatgacgacaccggccaacattggaggatatgcgatttttgtgtgcctaatttgttttgatctaaaatttataagggaattgtgtaattcttttgaattttctaaaactttggtcaggatagagactgaaatgtttggtctttattatttttcaagatcactcggtctttatgaccggaatgtcaaaaataaaataaagattgatctaattgaatgtcaacccctactatatatatcttactttggcgcatgaatgtatagggcttgttcactttatcgcgttttggcattaccaaattttgatagcgttgaatgtgtttggttggatacctttccaaacattgatgacgtttttgttagaggaatttttgggaactaccaaattttggtagaatgacattgataagctcatgcttagtttgttgcagtaccaccaaattttgatagcattgaaaatagcgataaagtgaataggcctgtagacgagatcagaggcccaatttgaggcatattctctcaacaaaattgagccatgcttgggagttgggaacctctcaaaatgcacctagaattaacctctcactctccaacagaatgccacactgaccacaaaatatagagctaaaaataacctacgcaaactacaccctcaaggcctcaactgcctcgacaaatgttgtctataaaactcccgttcttggcgatcctcttcgctttggaggagaaccttagccctcgaaggcctcgagccctcccctaccttgttctacctcctccc

SEQ ID NO: 2082 - DNA, 2000 bp, Oryza sativa
  misc_feature (53)..(53): n = any nucleotide
  misc_feature (56)..(56): n = any nucleotide
  misc_feature (58)..(58): n = any nucleotide
  misc_feature (62)..(63): n = any nucleotide
  misc_feature (65)..(65): n = any nucleotide
  misc_feature (534)..(534): n = any nucleotide
  misc_feature (554)..(554): n = any nucleotide
  misc_feature (594)..(594): n = any nucleotide
cctaccaagccggctcttccggccccgctgccgccgacgccggcgagccccgncgncncgcnncnatcgatcgcgccagctggaaacccaccgacgccggcgcaggccggtgcgccgccgccatcgatcgcgccgggaacgggaagcccgccgccagcaaacgacgacgccgccggcgccgggggcaagggaggcgggggtgtggtgcgtggcgaacccgacggtggcgagcgcggtggcgcagacggcgatggactacgcgtgcgcgtcgggcgcggactgcgacatggtggcggcgcctggggcgccgtgcttcctgccggacacgctcatggcgcacgcctcctacgccttcaacagctactggcagcgcaccaaggtcgccggcggcacgtgcgacttcgccggcgccgccatgctcatcaccaaggatcccagtaagtacgcagccatgtcgatcgtttgcattattgggccaaggccttcttctgctcattaggcccaaggacggcccattcccatttaacttgtttntttacttttcactcgatttnaacttccccctccatttcatgttataaaacatttttcctnttcaaacatatttagggttcgaccatgtttataacaacaaataatttcataaatataatattgaatatattttgataataaatttgtttggggttggaaatgccgctatatttttctataaagttggtcaaatttttaaaaaaaaagttgataaaaaaaattcaaatatgaaaaggaaggaatggtagttctgaaaattttctccttttctgcatgaattttattgatgaattttaatgggttttgattattgtcacattgttttgtttcattaatttgtgtaggttatgatgggtgccggtatgtgtacatgtgatgtggtacggatctcttcgggaaatgaagatgttttgcaaggcttttgggcaatcgaatccatgggtctcctgcacaagtatatttaccgaagtaaatatctcatttttgaatggtcggacagtccacagtatcagagtcaaaagcataccactttgtatggtgtattctctgacgtccacattcacaggctagttgttctattaaaaatgtacaaatagatgtgctagactattattaactgtgtcaccattgatccggttgcagtagtacaaaaaaacagcgtattaaaaaacagtgtgttatatcataagaaacttatgggcttaaaaaattgcaaatcttccacggaaagaaagtaactgaatttattaaaaagacaggggcttaaaaaattctaagcaaaccggtaaaattcggaagcatcaattaatcataaaaatagaagaaattcctacttttaataaagaaagtactatattattacttctgtgtccgtccgagcacacatgtgcagctcacagctcaagacaacatggtcgatccgtttagcggagggtcgtgctggcacgacctgtctagccaggctgtgcttcagttgctacccgggttgtcatgccaacacaacaagtgcatgtgtgagccagcacgacatgacccaggaatagcgcatagcttggcccgtgcgacacgatgggaccgacggagtaaaggaaaacggaaaaattgaagaagccaagggttcagggaagaggaagcgacggaggatgcttgtcgacatagatctgcacggtagcatcgtggtatggccaacccaattcgtgagcacaactactaagcatagcgatcactatggactcaccagctcggggcgaagaaagtaggaagtgaagggccatggcattgcttgacgatgaggatgaggaatgtgctattaatgagcgggggatctcatttgtgcaacatgtgccgaagtttgtgcaacatgatagaacagactctattcatatttttttttcttagtatatgttaaatttgggctaaccggcctcaacacagtccacgtaaactaatcgtgccatgccaactca

SEQ ID NO: 2083 - DNA, 2000 bp, Oryza sativa
  misc_feature (419)..(419): n = any nucleotide
tctattcgcagatgagtagatgtttgaaagaagggtatagtcaccactgccctggaacgctatctccttgacggtgatctcacctagtttagtttgccggtacctgcaacaagcactgagtaatgccctccatatcacagcatcaggtttcacattcattgtctttaccaagtcatatgcttcatccagtagcccagctcgtgacaaagtatccaccattgcaccataatgttcaatcctcggagtgatagaatactttgtagtcattgcttcaaagtattgacgagcctcttcaaccatgccggaatggctgcatgctgtcaagagtgcaacaaatgtaaccccatcaggaacaagaccttcactttccatctcacgggaagaacatcaccgcatcagatccaagaccatggtgctgncaggccaccaatcattggtggttccatacagagacatggtttctctctaatttggtcatgaatatcccaattgccacggtcaattcttccacattttgcatacatatcaacaagtgatgaacttaaaatatgggttcatttccaatcccagttcagccattagttgatgaacccacataccataacaacgggcaccagcttgagcacaagctgataggactgaggagaatgagaagccatcaggcactagacctgaattgaccaacttgctgaaaatattcattgcatctttcaggcacgagttccttgctgtacctgcaatcattgaattccatgagaccaaatccttgacaggcatcctcttgaaaatctgatatgccttgtctatctgtccacacttcaagaatcccatgagcatcaaatttccataaaagggttcggcactccactccagcattagccaaaatagtttgcaagcttccatcacgcgaccatgatcaatgtataatttgaagagattgagttactatacgttgattagatagcaggccaagtttaacgagatgggaatggatttccatgatagcatagatatttgaacattttgcacaagccttgagaaggagcacatatgttctgtaatcagggcagaaagcagtgaaacgaagcatactgttgtaatctgtcagtgacttttccggagatcctttctccaaagaagctcggaggatggcattagtgtatggaaagatggctctaactggatatctcctcaaacagtttgtgtaggacattgtgcaaataagcttctcaaatgcgatcactacaatgcagacacaaaataggcaatttcaccaggcaggtaagtgtataaacattttctgcaacctaatgtaattcacagaataccatcaacgagacaacgataaccaggcaacatggataagatgaaattcaaacatcatgctgaaaattcaccctgctttgagtagtgaacatgcttggttcacacaagatgattgcaaacccattccaaatcacaactcacaacacttgattaccaaacttattcacggttcacacatcaagtagccaaccccggatctagatcatgaccagcgtacattgctatgaaggggacatgctgaaagaaacacagaaaaaaaaaacccagaatttttcaggaccgctaaaactaggaaaagggaagatacacacaacaatcaaaatgcacgaaaaaaaaaaggggcaccaccagagctaattacagatcaaacaaacaagaaggcctccaatgccccaacgcagcacaggtgctcgacggaatgcctgaacagagactaaccaaagcaacacaagccaatgcccaccggcagcgaagggatgacgcacctgagcaccccgcagggccgagcaagatccaccgaggcggcggcgaccaccgggttccgggatcacggaagaaagaagaaggcaggacgaagcaagagatgggaaagcgactgaagcaaggtatatgcccaacccacccacggagatgcgcggagcggaagcgtggggtgtgctcaggaacggacaccc

SEQ ID NO: 2084 - DNA, 2000 bp, Oryza sativa
  misc_feature (19)..(19): n = any nucleotide
  misc_feature (104)..(104): n = any nucleotide
  misc_feature (106)..(106): n = any nucleotide
  misc_feature (110)..(110): n = any nucleotide
  misc_feature (115)..(115): n = any nucleotide
  misc_feature (121)..(121): n = any nucleotide
  misc_feature (148)..(148): n = any nucleotide
  misc_feature (153)..(153): n = any nucleotide
  misc_feature (202)..(202): n = any nucleotide
  misc_feature (213)..(214): n = any nucleotide
  misc_feature (221)..(221): n = any nucleotide
  misc_feature (278)..(278): n = any nucleotide
  misc_feature (282)..(283): n = any nucleotide
  misc_feature (304)..(305): n = any nucleotide
  misc_feature (322)..(322): n = any nucleotide
  misc_feature (346)..(346): n = any nucleotide
  misc_feature (363)..(363): n = any nucleotide
  misc_feature (368)..(368): n = any nucleotide
ttctccaaacgatctctgngaaaatcattccatcaattcatgtctataaactcatatggaagttctattcaaaatcccttaaaattgaatgaccactatatctntncctngggcnaaattnaccacaattcaacccgttaacctctgngtaanttccttcaccatttccctagctctgtcctgaccttttcagctatagttngccatgtgggnngcccggnacgggacggcccaggcccggccgtgcctgggccgaggcttttcgggccggcacggcncganngacgcaccgggccgtgccgtnnagcccacgtgccgcacntcacggcccaggcacggcatcaanaacgcctcgggccgtancgggncgagcccgaaaggcatcgatgggccgtcgggctttttcctcagaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccccatactttatgtaccgggcctggcctgccggcccatcgtgccgggccggcccgaccgtgccgggccagcccagcgtgccggtggggaggcccaggcacggcccgacggtcgggccgggccagcacgggcccgatccaagtcgggccgtgccgtgcttgggccgggccaaaaaggcgtgccgtgggccgggccttcgggcctcgggccttatggccaactatatttccagcccactgccactgcaccccaacaaaggcagctgccccaaccgagtttattacgtgtgccacacaatgcccctaggtgccttgccatcactcctcccgaccattcgctcgaccacccctctatcttccactagcatatccccccggcccctaatttgtttgtgtatgggtccatatcctcaatgaacagaacatgaggaggtgactaattctcataattattaataagttaaaaaattacgtggagaagagatgggaccgcatagatgtcgtacgctagcgaaacaaccaggaccgccaaacttgcatctacttaaagcaatagtatgagtccctcgatgaaaatgcctaccaaagatctccatgctgcaccgcacatccatgctaggttttcataccggtccataaacactcctttagggagatgctcgagcaataggcccaagcagaactaggttttccccaagtccttcatctcaagctcaatattaagataagccattgcttgtttaatgtcctgtgtggtgccaaggatatttagataattgacatagaccgagatgatacaaaatgcattcagggatttctttataaacacagggggacaatcataattctttgggaaacctctctttaggagatatctatttaattgattgaatcacatccttccggattgttttgatccgtacattgatcgctgcaggcgaacaatatagatgttgcaatttcctttcggatttgggatcttgagtccttcagggactctcagataaagttccaaatctaatgccccatacaagtatgcggtcaatagatccatcaaccgcatgtgtcggttcacatgctccatgaacagatcatgaggaggtgattaattatcattattctaagtttaaaaaacataagtagagaagaaatgggaccacatagctgatttttgggaggcctgcatgccctaggctagcgaaacaaccgggaccacccaactagcatctgtttatagcaattgtataagaacccctcaatgaaaaagtctaccaacgatctccacgcatctatgcctagtttgcttaccctccctccaccataaatacgcacccaactgtaacatgtatcaccaaacatatcgatccatccctgtaccagtcaagaaacaaggaagattacaccaacaaacaaactagctagcca

SEQ ID NO: 2085 - DNA, 1721 bp, Oryza sativa
  misc_feature (1147)..(1147): n = any nucleotide
  misc_feature (1165)..(1165): n = any nucleotide
tggttaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacatcgggtggaaattgcaagcttagactggaggaacaatccattagggttacctaaatggtccgagtgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccggtcttggagattttaatcntgtatagttttcaatatnaaaagatttgataactattgatatttatacaaaaatataaagcacagtataaaatcgccctccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattatttttttaaaacttttaataaaaaaattaaaaataaaaaaaattcttcccttttctcctgtgaaaatttacatggccttgttgtgcatttgggccttttggtgtggctcgttcgttcatttggcccgaagtggggagggggcccagttaggttaggatgctttttagttgggtaaccggttacattacaccgcggttggttggcaacttggaatgcagctgcaaaggggacggg

SEQ ID NO: 2086 - DNA, 2000 bp, Oryza sativa
  misc_feature (191)..(191): n = any nucleotide
cgcgcgcgccgcccacgctgaagcccaggaggtgcacgtagtagaacgtcgccatcctggggttcctccccatcggcgtgaaggacgcgcccgccgctgccgccaccgcgccggcgccgaacgttacggtggaggaacggttggaggagggcctcaccgacgaggtccggtccacgaggcagtaggagaanctccggccgaagctgcgggcgatctgggaagggaacgacagcctgcaaggccgaagcccaagagtcccgaagcggcgatgaagagcccctcgttgtcgtggccgcacccgatggccaaccgctgcaagcgggcgccccgcgcgaaggtgagcgtctcggaggcgaagtccccggcggtgacagagccgtcgccgtaggctacctggtagaggcaggagttgcggcgcctgtcgcagccggcggaatcgaggcggcggcagatgggcgcgacgcagtccaccgcggcgtaggagccggagcggcgcgggtcgaagaccctgccggaatgcgcgtagcagtggcggcagggcgcgcactggagccagacgacgtcgctgccggtgtcgagcaccatgagcgcggtggtggcgggcgtgccgaccccgacctgggcgaagtactccccggtcccctgcgggaggccggacagcaggggcgccgcgaagccgccgcggcggcgcgggcgcgtggcattgttgggtgcagcaagcagggcggcggcgcgcgcggcgtcccgggcgaggaggtgcgcgagcagatcggaggcggtggcgttgagcgcgaagtgctcgcggtgggcgaggcggaagtggagcgtggaggcgttggtgcggggcgcggcgaggctgagctgctgctcctgagtgataggatccggggagagcgggttggcgagaagggattgggtgcgcacggccttggagaaggcggcggggagaggcagcaacagcagcgcagcgatgaggaagacatggaacgccattgccgttgaggggagcatctcgatctcgatcggaggtggtggagatgaagcagaggaggagaggataattgggagagagaggtggccggcggttgctagctggggaattaaatgttgtttcttcttcttcttcttcttcttcttcgcggtggctgatcgatcaaagtgaattgaattgaagtgaaagccaacagcggcggctgccacgtcctctactggatcgatagatcgatccgcacttcactgcagcgacttcaattcgaccaaggatgcactgggaaaatcatcacttgctgcctggatcttgcacaagtacacacactcggttaattaccagcagcagtttacagtctacaaggaatctgggcattcgggaatcgggagagcgagatgtgccgtgtgcgtgcgtgtccgttgtttcaggacacacaccatgatggcaatctcccgttgggcctaccagccgaaaagttagctaattggcccatggcatcattttgggcccaaatgcatgtggtcccgacgacagaaggcccacaatgtcgtccgtccagcgcagcgcaaaactgggggacggcaaccaatcgcagcagtccatgttccgcggcgcgggtggatcggcgaggactccatcttccccggcaattccggcgaaagcatctcaaattggtaccaaatggcagccatggcgagcgcgacaaaccgccagaggcacctaattttggcactggtcgtccccagcagagcagatgaacaagagaggtgcctcgcaattcccaaaacgaaacgaaacgaaaggaaacaaagcgatccttcttgcgctccggcgccgccgtctccccctcgcgcggttgcctgagccaagaacaggatcggaggccaggccccatgcatgcatgttaattagtctgtcactgatcacttcatcccattagccattagctgtttctcatccagacggacgcgccatccaacacacatcgatcgatcggaggttgattggccgg

SEQ ID NO: 2087 - DNA, 2000 bp, Oryza sativa
  misc_feature (433)..(433): n = any nucleotide
  misc_feature (1346)..(1346): n = any nucleotide
  misc_feature (1355)..(1355): n = any nucleotide
  misc_feature (1386)..(1386): n = any nucleotide
  misc_feature (1394)..(1394): n = any nucleotide
  misc_feature (1402)..(1402): n = any nucleotide
tagaatatgttgccttagttgccagtcatgtctaagttttgaaaaatttaactaacgcatatgcagctatttggttgcgtcatatgtatggaaagattcatttctaataaattataccccatacgtcaatgataaaaagtgtgaaaatattttcttagaaaatgtccggtagctattattgttgaaaatcactaaaagctatcttatctgccccaaaataaatactccatccgtcccataatataagggattttgagtttttgcttgcaccgtttgaccactcatcttattaaaaaaattgaaattattatttaaattttttgtgacttactttattatcccaaagtactttaagtgccaacttttcgtttttttatatttgcataaattttttgaataagacgagtggttaaaccaaagtaagtaaaaactnaaaatcccttatattatgggacggagggagtacagttttatactgtttatgtccaacgtttgacgacatgtcttatttgaaaaatttttacgattaatattgtttttgttattatatgataaaacatgaatagtactttatgtgcaactagttttttttaatttttttaataaaatttttaaataaaataaacagttaaacgttttagtaaatccattatttagggacggagttagtacattaatttcaatctgcggcacgcaacgctgccgcaaaacttccgtccatatcatttcaccgtgtaaatatgatttcaccttgggcccctttagttctccaaatttttttctcaaaaacatcacatcgaatctttagagacatgcatgaaacattaaatatagataaaaaaaactaattgtacagtcatggaggaaatcgcgagacgaaacttttaaacctaattagtccgtgattagctataagtgctatagtaacctacatgtgctaatgacggcttaattagtctcaaaagattcgtctcgtagtttctaggcgagttctaaaattagttttttcatgtctaaaattagtttttttccacgtaatacaaaaattttttttccccaactaaacacaccccttgtattgatcgggaagaaaacggggatctactgacaggtcacacagctcgcagcaatcagccgctcgctgcggcgctgcctcctgcccagactcgtccatcctgtggctggctggctgcgcgcaccgcgcggttgccacgcaccgcccgacgcacacctccccgtgggtggagtcacgcctcacgcagtggctcccacaccacacacgtcgacctcgaccccacaagccagtggcgggaacccagcgggtggtcgcccgcccgccaacccangcggctgcncggggcccgcggccaaagggacttcaacgcntggtcccntggtggtntcgctcgcgccgcccgaaaagcgcaccgtcttttgatgcaacgcgatgtgactcgcccgacccaactcgggaactgaggccacgcgcggggcccgtttttgaccggtcgccaccgcgaccaggccaagtcttccatcccatcccccgccgcgtgcgctgctgttcctctgggccgcctaaccctttcgcgggctgaaagtaacctgaaaccgcgagaagcccaacaagacaccgcgaggtccatggcgcatttgccgcggcgatcgagccgtttactctttaaaacccgcgcgggagccgatcccccgcgcgcggcaatcggggcattcgccagccacacctctctccatcctctcgttctctctctgtctcctcttctctctcccccgacggagaggagagaaggcgaggagccgggggagatgggatcggactcgccgcccaagaaatggggcctcagggagcagcgcgaagcctacctccggtggttctccctcgccgacgacggtttgccccccatcgctgagcacgacgccctctttatgtttttgtcttcctcgatctttgccggtgaaaatgtctctgaatctgttggtgt

SEQ ID NO: 2088 - DNA, 2000 bp, Oryza sativa
cgcagtcatgagcggcatgtgaatatgtcatgagtatagacttgtgttttattcttccaaaagctgaatttaaacttcaaaatgtgatgtgatttgtggattatgtccttgctgccatggaaggtaataaggagctatgttatatgtgattaacacctactttgatgcccatttgctaagtgtaagcttactgaaatttaattgaaaggaaatctgaatttgaaaatggtctttcaaacaaaatatgctttatgctaaaaatatccattgtaagctttactttgaatatgccatgcatgtagagtattaggcttgcttggtgcttgccagtacaatttatttgtactgactcctgcttgaattgttggtttgttgtatgcttagacttggttgcaggtgagatcactcttgagatgtatgatttcacaggggatgtttcgttcttccataatggttcttactaggatctaccctagtcagttgcatgaaagatcttttgggtagaaaatgcttccgcgaacctaactatttggccggtcggccatatatatctaagtactatgttgtatgatactaactaagacttagaacttagaactccttatgttagagatatcatgtgcttggatgaaagtgtttagtgtgttccttttgttaggaggatattaaacatgagtatgagttaaagatatttgagacaatgtagatcattagctattttgtgtcaagtctcctgaatgtgtaacacatctgatcaccgccatcgagtggtttgacaggcacatctcgggctgaagttaactggcaggctaaaggcccagcaattaccaaatttggttgttaacaggtctcatatatctttctctcgcagcgtcgaatgccttattatgtttgatggaagaattgatttattctattcatccttcaaatataataaggggttcggagtacttccgacacgaaccaattgtagaaaatcttataatttattagaatcattgtggttcttaattttccctcaaattgacacaaccatacataaccattgcatcatttttaagtgaccacatatcaatagacttccctctattctatgccatagcagtacatagatggttttaaatattatattccttactattaaatttgagttttaacactcgggtcgacaaaatgtatttaaaaaatatatatcacacatattataggatgcgaggtctagaatatatctactctatttttattgattgatatgtaagtacatacaacaaattgtgtcaaatgtgaactaattaaaaaaaggaataaaacgcatttattagcaataacctttttgagatttgttaaaataagagcccaacacattcaattaaaaagaaaaacaacaccttactttttaatttagacttaaaagacctatgtcttcttaaatgatgaagaagattaactttatagataggtgcttatatagattaattaaatatttcatattataaactaacaaatatcttaaaagaaatatttaagcaatgattcatgaatgcccacgcgaacgcgtgggctacctcttctagttaaaataacacgtaactaatgaattgattaatgaggagaggtgctgactgattagcagaaagtaattatggttaccagttagtgtaaagacaaattcgagaaaggaagcatgcatgcggaacactcgatgagaggttggcagaggcggcttgctagagaccgaccatatcgattgggtggccgggtgtcatggagtggagccacgtgacaacacctgcttgcctttcgccagcaatgaatcccccagccatccttccatccagttcccaggctataaatcccagccacccttccatccattgccacatcgctcagagaaacacgcacacaagaaacacaggagtgagggagaagaagataagggaagagagagcgagagagagagagagaggggggtagcaaagcaacttagctagctttgctag

SEQ ID NO: 2089 - DNA, 2000 bp, Oryza sativa
gcgtcatggttcacctctttttctaaacaagttttggtccccgcaactgtgagatgagtagtctccgtccgattttaagagtcgttttcgtctataatatttgatcgtttgttttatttgagctaaacataaagtatttatgttttattatctaataataatatgaatattaattataaaaaaaattaagtacaatgaacgagtgaatacagaaatagggagtagtactgattgcaggccgcagcatcaaaaaatgctttccggttaacctacctccgctgtcaccatgtacactaagtaaaacagcaggacaagacaactaatcagtacggagtaatcaactatggtcagatttgattaaaaaacaacaacagatttgatcggcgaagcagtagtataaaatgaaggagattgaagaaaacgagaggagatcgatctagcttgggtcgcagtacgtcgtaccttcttcgaatcgaatcggtggccgtgtccggcggcgggggcggcgcggccatgtgttaacgcgagctggctgctggccaagtgtcgagcacctgtcgttctcatgcggacgcgggcggtagaagctcacaggctagccggtgaccgtggaggaggcgggccgacggccgtcgcggccgttaaccgaaggcatatatatacgcgcgcctattacgatttgttttgtgacagatatgcatttgctttcgaacctgacagacgtgagacgtggcctacatagcagcctcgcttccgcatttgaatgctccatctataccaacaaacgtttatttttcaccaatctagcacgtaccagtaaaaaaactagaatacgttaacttcattaaaatataatgtaattatttctctctttatctactcctaatacatttatcatttacttttacaaactctgatacaatggttgctttataaaattttcttttataaataggaggatccaaaagtgatcttattttatgacgaaggggtagtaaattataagttatgttctaaaatataaaatctgatcacataagctgtttacagtagcataaatcataacaatttaacaatttgtttttcaattggaaacggttcgtattgtggttgtttgggcacttttgtaagccttgcatatctattgagtaatgcctgagtcgcagcatcaaggtctgacctaaattaagcgaagacgaccacttcgcagtattgtgccaattccagttttaaactatcgcagacttgttgcatagctttcgactaagcggcaggccgatgtaacttatgaataagccaattagccaacattaataggaggtctaattccgcaacgaaaaagcccaagaaacataaaacagttccgatgaaatccatggagctattatgagatagcaagcactagctcctagcacggcttcataaaaaaacaatcaaattctataaatttaagccgattaagattagatataaaattatcatgatcggtagaaggaaataggcatagaaattaaactagagatggtatagaaaatgactggagtgatggttgtgaacttgtgatccattgagatgaggaagtacgctaaaaaatatttatattgtggtataaattttgaacactagaaatatgtatattttggaacagaacaagtatcatctatcgataggattaaaaaaccaaattaaatatattcacaacaacatctgagtcaatttgtagtaaaatttattcgaattctatcaactttcgtcggtaaccgattcattcctgaaagcccggtgcatctgcaaacagcgtttgatccgatccggccggattatcgttcgttcatctaactgcacgtcacgccctccgcgtgtgcctccccttcgcccgctcgctccgtcgttaagccagatcgcccgccgctccgtgccctagcgccgccgccgccgccgccgacaccggaatcgccgggcagactgcgagcgcggagccaccagcgtggggcggcggg

SEQ ID NO: 2090 - DNA, 2000 bp, Oryza sativa
tggcgtactggtggttttccaaagttcctaagtggattggagggctccatgagcttcacgtcttgaaacttgcagtgaaggaggtgtcagatgatgatatcactcttcttgcacaactgccttccctgacaaaccttggattgcgcatgcgaggagcacctaagcagaagataattatctataagaaggcattcccagttctcagatacttcaaattctggtgtagcacaccctgcctggtctttgaggcctccgtgatgagcgaagagctgcggaattagcgctacaaaatgccattgatatgcatcctggtcgtcctagtgttaaggtcgtcagttgcccgcatacacagttccattctgacatttccgattaggaggaagtggacagggataacatatgccatctgaacaaaacctagtaaacgtcgctacttgataccatacttgtagtagtaactgtatgcagaaatttttttattaatgtgaaatacaacagaaaatcgcagagcaaacatgatcatctgctaacagcattttgagtactttgatggtaaacaaaccccactgtttggatgtgctgctaggctgctagctagctatcgaatggccttatactattgctatttagtggccctgaaatcgatgtaatcaccttctgtcttcaggcaccacacatttcactacctgttctcaggaaacacatcctccctctgtctctaaatataagtgattttagtaggatatgacacatcataatacaatgaatctggatatgcttctgaccagattcgttcgctgtactaggatatgtcacatcacactaaaatcttttataactaaaatcccttatatttagggacggagagagtatatatctgccgcatctgtagctgcagagctgttgacttgtttttgcactctgagaagatgaactatgtgatgtcatggaacttcctgaaattatcatacatcgaggattcctctgctgcaggttgctgtgagagcaactgcagcatgtccggaacttggcaagtgaaaaataaggttcgccaggcccatttgtggacaaaagtgatttcctgctaatactattccaggactatatttgctattgtttgtgtgtaccgtggtttctgttgtttatttgatcacttgagaaggctaaccctaactaatctcttcaatcctgcatacaaaattgattttttttccccttttcgcacgcaccgtacgtgttgagcagtatacccataaaaatggcacaaaacatgatgattgatgaaatcctgtatgtatgatatgatatgatatgacgaaacacgaaactgcgatcgagtgattgatattgcacgttttgcttgatcttgatcaacatggaaatggatcggtctgatgaactcacgttgtaactcctcactattgagttgaacatggacgaaattaatatggtgatggatcagcgatgggtttataacttcacctatcaaaactaaaatattgacgtccacgaatatcatgcacaaggggtatgctttcaatctgaattttatggggttaagaactgccgctgatcctcgtatcttgaatcatatattagggacacacttgcggatatcctccgtgagaatgtgtgcatgcgtctttggggttaaaagggaaaatgacaagggtatacctaagcaagaagaacctataattttgtagttgtgttccatccaatatgggaaggaaaaatgggaccgatggcaagcatgcacaaaaggaaaagcgaagttaaagggcaagctaaagatggaacgtgtggttgggacgaagcagtgggggatccagtccctcttccccctctcgccgctctcctctatttatagcttacatatgcgcgcctcacaacccgcgacgaacaccgaggagccagcaagagacaaacctgaccaaatccaccctagctacaaattttcttggccgcgcgcggcaggcagatcgagcaggcgagcgaag

SEQ ID NO: 2091 - DNA, 2000 bp, Oryza sativa
tacaatatcttgcgcaatgtatgcgcttcgtgtgttgctgataaagtacacgtaccgacgtacgcgtataaatctgtgtatttggattcgaattcatcattacattcaaaaagcaaaccaaaacaaggtcagtcgtaattcaaaccaaaatacgactgaaaatagtaatattgtcgaatatattcattcaaccacgtatgccgtgcataattccaccttccgtgtatctctacctattattaaaagtttaaaatgtttttgccatcatcttcgtacgtcgcaaatccgtcatccgttcagagtcctaagcgtgtttgtagttatttccttccgcgcaacgtgttttaagccgctaatcgctcgtgtatctcttcatcagtccgatccttattatctgtattctttccaaaaatcacagcccagtatatattaagccggtacatgttgtagtcaagcccacgtttccaactgcccacgtcacacaaggaaagagtacagccgtatatcatgcaaagctgcttctgatctattaccgctatattctgcctcacgtatatacatgcatatacatctgtttactctataaacatgtaaaccaaaattaaaattttacaagtctattactattataaaaataaaagatatttctgcggtccatcatccatgtttgagtcggttataaaaattgaagatgtttccacggttcgtcattcgtgtttgagtcggttttaattttatgctttggttttaatctatatcaattctcttctctatctctatctcttctattctctatctctactattataaaagttgaagatgtttttgcctgtattttggtacgtcattcttgtatgagtcagtttttaagtttatttgcttttagaaatatatatccgtatttgaatcggagtatttgtttaaaaaaactcgcatgctaacttaagatgatcggactcctaactgcagcttataattttataaaattacatatatatccaagcgaactcctacaataaatttcatcttaactaaaccatataacaataataaaattaaaatagacttcacccgtccaacgatacgggcattttttctagttactcactggtagagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagtcccggttggtagcaccaaccgggactaaagatcttaactttagtcccggttgagatttgaaggataccaaagattcaaagggttaggtttttctttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgattgattcgttgaacgagggaagtggaaagacaaagagggatagggagctcgcctcctttttttgaatcgccgaaattgtacgacgacccttcttgttccaggcatacgactctgagacgtgacggtgtcacttttccggcccggtaaagtgacagttatataaataagaataagaaagagaagcgtgatgttgtcagcaatcaaattatcgtaaatagatagtacggttgcgttgtttcaatttctgttcgtcggtccttgggttacgaaggtgtgggcttactaatacggagagggttccgaatgataaagtgtcatgaaagttcgtgaaagaatgttcttgtttttcgttggaaaacccaacgccacggccacaaaacgaaaaagtctcccgtttgttttgggagcagagctttaaaaggatatagttacc

SEQ ID NO: 2092 - DNA, 133 bp, Oryza sativa
tggaaagaaggcgcgggtgcaaactttgaagagtgaattcaaggcactatgcatgaagaaaaccgagaccatcgatgagtttgcaggcaaaatcagtggcctagcaaacgcaatgagtggtcttggtgcaacc

SEQ ID NO: 2093 - DNA, 2000 bp, Oryza sativa
  misc_feature (864)..(864): n = any nucleotide
  misc_feature (914)..(914): n = any nucleotide
actattctccggttttaaatagtgaggattagagcttagtagcgtgcagagcaataatttcttgtccaatttgtttaatatcaacatgcaagttttacactaattgcaatcccttcaattctagaattttgctttattatttcttttgatcataaaagtaactactttagattaaaaaaaattacattgtagcacttcagagccaatactgatatgcttcgaattggcattttctgcagccattctttgcgccagtttccttgcatgtgctgttggcggtaatgaaagagctgaaacgatacatggtagagagaaggaaatattcagcatttcttgcttcccaggcgacatcttcctgatcttttggtgattatcagcagccctgtttcatgcctagtactatcatccacaccaagtctgatatagatggtagataatctgcaacggttcagccacagctgggggacgcgtcttcttaccatcaagcaactgctgggcagacaggtagaccaaatggtgtgtgcctgtgaactcgcagaccaggtgaagatgtgagggaacccagtttttgtcacaaatacggcgttcttccatgaaaccagcttggtgaggccttaactgatcgtcgggtatcattcacattttttggtgaggccttaactgatctctgaaactacagaccgctatctaaagccaatgcatctgtaaattgttgtataatttgagagcgcttgacaaactccccgcagaccaatgttggattagcagttaacacgaacttttacgggtttgatgtgtgtgttcacgattgtttttcatctgcaacgcatgcatgggattccccctctcgtcctacaacggcanacccggacgaaggaactacccgtgtggccgtaactgcatctccgcccggncagagagagagagagagagagagagagagagagagagagagagaccgctagagtaacatgtgcgaaaagacctgcaccattcggttaatacaatttccaaatcatagaaataaaaagttaaatgattcggataggacatggacttcaatcattaagaatttattattttgtacaagagatcttaaaaattatatgaaatactccatccgtcctaaaatgaataaaactagtactacaaatttagaacggtactaggttttaggtcctttttaagttcccaaataaaaattttcactctgtcacaaaatgtttggacacatgcttggagtattaaatatagaaaaaaaactaaattgcgagaagaatcttttaagaccatttgctccatgatttgacaatgtgatgctataataaatatttgctaatgacggattaattaggcttaataaattcgtttcgcagtttacaggcagaatatataatttgtttttttattagtttatgtttaatacttcaaattaatctacgtttaatacttcaaatgtgtttccgtatatccaatgttacacactgaaaactttttacctctggaactaatcagggctttagtttatttaagtttgagatggggagggtaaggttataataggattacaatgtaagtttacaaggctacaatctttgaaatttgataggagctatttctccggaacgaacgaagcatatatggaaaaatcgtaatttttcaatactacgatatgtaatattttgaaaattcttttaaacctaatgagccccgtattgttaccgtggcagcctggcagggtgcaaggcaaccaccggcgtccagggcacaccgccgcttcgcgacgaccgccatcggcaaccgctcgctgtcgctgcagtagactagcgcggacgctccctccttccctccatcccaatccgtccccttcacttcactcccattcccatttcctctcgctcccaccaagaccaaccaaacccctgtttctccctcaaaacctccctctctttcccccccgaatgctcgagcgctgcgcggcggaatcccctactcccctc

SEQ ID NO: 2094 - DNA, 2000 bp, Oryza sativa
  misc_feature (1518)..(1518): n = any nucleotide
gatttcagttttcgaaatactcctaattaatgttgaaacggtgagaaaaaagaagtgaatgtctaatggtacagattaaggggctgtttggatgctatatataattttcattttcgaaacaaaactatactataaagttttaaacaataagctttggcacatgtgagctaatgcacattttctgtttcccactgtgtgttaaaagagtgtgaggtctagatatttgtaaattgtgaagaattgtcaactgaaatggatccagatattagaacatatgtgaccagttcctttcttcatgtccatgtcaccatgtgagttttattttgtcaaacctcaaaagcccaacttaagctcacgtgcgtgtgatttatactgtttgttagagagatcacccgtgaggggatcaagttagttgattccgtgttcaaccaaaattttcgctttgtaatcttatatttttttttcaggttacgatcctccggtattgtaatcttttaaatcctctggtattgtaatcttgtaattttttttctagttacgatcctctaggattgtaatttttttctgctctattaataaaacttcgttaaaaaaaattcgctttgttctgtttcttccttgtgattccgcgcgttatcttgcagaaaccaaaactgaacagttctccgcgcagccgtgtctggaattctcatgcaatggaatactagatcggaacaagcatgcaggcacgagacgcatttgaacagatcggagattaagctgcaagccaatgcatgtattgattaacggcaagatcatgcacattatcgcaggaaggagaggaagaatttacggtgctctaaagaccaaagaaaaggaaaattctgtctgatctactgatcaagactcgagggcgccgtgtccttcccttcctgatcctacgcgtggccccgcgccggcgccgccactacggcggccggcctccgggtggatgagcagcttgaacctgccgtcctccttgcacggctgcagcaactcctgcgacggcagccgcatctcccgcagcacgagccggccggcctcccggtgcgcccggaggctcagccacggccgcccgcccttgccgatcaccgatatcggcggcgggaacgccctcccgctcctcgtcctcctcagcaccatcacggcgtgctggttgtcgtcgtcgtcgtggcctacgccttcgctgctgctgctgaggaggacgtggtgcggcctcttgcacggcggggccagaaagtcgaccgcggcgacggcggcgccgacgtcctccatggcgggggaggcggcggtggcgtcgtcgtcgtcgtccggatcgaagctctcggccccaagtgcctccgtgaggaggtcgaggccgccggagtacgggaggaggtgcggcgggggccttgattgtgtggcggggcgcggcccgagccgctgctcctcgggggctttgtagcagtgcagcggtggtggcggtggtggtggcgccatggacaaacggacggacgggcntcgcgcgcgcggcggttcacgtggcggctagcagagcgcccgcacgcgggtgggcgcgagctatatatatctgcgatggcgagagacgagacggcgagatcgcgcggcgccgatcgatcgagagcgagtcagcgggggcggataggggagaacgaagcgtgcgcgatctgatcgaccgatctctctcgcgcgcgcgcgtgccgctcttgcactagagataagactacgtggcacgccaaaactgtcctgaattcgtggcaaacggaaaacggaaagaacgtcgcgcgcggacgcagccgccgcgccgagatgagaagaagctaggcaagctagaagcccctataaaatagtaccattcacctcactatatcattgatcatccgagtcctaactgggtctcactaagcgaggtaagtagtgtgttagtggaaatggcgacggcgagggcgagggccgcgctggtgtttgtggctctgctgcag

SEQ ID NO: 2095 - DNA, 979 bp, Oryza sativa
  misc_feature (28)..(28): n = any nucleotide
  misc_feature (35)..(35): n = any nucleotide
  misc_feature (38)..(38): n = any nucleotide
gtggactaccgaacgcagcatacggganggaggantcngggaccgggtcgttgctgctcctcggtcggtaagcctagcctcatgagtgatgatgactagtctactggagtagtactagtggcctcgccagctccattggttttgttttgcaacttcaccacgtcggcaattaccgcaacaagccgacctaacggagggggtgggaacatgtatgcaccgaacctggtgcatgtccacgttcagcgtactacctctcaacttggagcatctctgcttattagtgctctgttttggccggggtgcactgcacccaaataccaactagcaccaccagaaatgtgtcctccctatactttatactctaccagccgactagagtatactagcactactcctactttatccgtttcacaatatagacaatgctagaaagtcttacattataaaacatagggattatataattataaatgaaaaaaattactaataaaatattagtacagaattccgaatgcgtacgtacggtatcgcacatccgctgcagcagctgcggaattaaacaaaccgggaatgcgtccacctcccttgaactcaatccaaataaataataataaaaaagaaacccacaattccgggcagatgcctctgtgtctgcaacacggtcaatccacgcgcgcccctaaccccaatcattaaccccgtatgttaacgcacgccataaacgcagacgcacggccaccgtccgttcctctatgcgcacaaatctcaaagctccccacgccgctttcccctcacgctcctgccgccttccgcgaatggatgcgccggtggactcctataaaacgcaagctctcactcgccgcagtccaaacaggcaaacgcactcgcatctccaattcggtccgaatttttccaaattccaattgctcatcgcgcttcgaattcgttgccgagatccatccaatctttgagttaagac

SEQ ID NO: 2096 - DNA, 2000 bp, Oryza sativa
  misc_feature (1731)..(1731): n = any nucleotide
  misc_feature (1733)..(1733): n = any nucleotide
atgcaaatagccacaagccgtccttgtattccccttgcacgtttgcatcattggtgtggcttgctgagtacggtggttatactcagccttgctattattccctcttttcagaagtgtagtgcttctgagctgaagacgaagttagaagaccaaggcttagaccccagttgagttttgcctgtggagtgaagctaaagcactgctaggatggcctttttccgctgctgtcgttctctttctttgtgaggactaagtgcctcttctgtaagtatgttacgctttatttacgtttggaactgtatattacttgtcgttttgtgtgtaccctggctggtcctggacagggatttaatacacaaaatagtctggaaatttgggttaaatttctgggcgtgacaacgacgagcgtcaaggtcgaggaggcttcttcgccttcgcgaggcccgagagcaaaaccaggtcgagtgttgctatcgcgtcctgctctgccaccaccgtcgccgcggcttacacgtcttcttcgccgccgcctcgcttctctacctcgcggctgccgcgccgccctcctcctctcctgcctcgccccgccgaccggcctaccgcctacatgcagagagagagagagaagaaaccgaggaagagaagagaggaagagatgactcagcctgacatgtggggcccatgcgggtcccacgctaactccgccgtcacgtaggataaaataggggtcaaaaccaccgaaggatctattgtgcccggttatgattagttgagagacgttcggtatttggttttgcggttgggggacgattttgtaactcgatgacaagttgagggaccttcggtgtactttttccttgttgatttgggcctgcatgaatgattgctacaaggccggcccaatgtgagtcccacccatatacatagataggtccttaatttgcaattgccccgctctggtctgggaagaatgaatgaataaaacgtacgaatggtggggagggatgatcggagagaggaaatatatggagcgtgcatgcacacagctgtcgtttttgtgaagaaacacagcgttattggtgttgtagaggcaagcaggcaggcaggcaggcaaggggaggggcaggaagaagggaagaattgaagaggctgaggctgttggattggaaaccgtttccaattctccatcctctctatcttcctctcttccttctcctccggtccctctctctctcccccctccatctccatctcctctcttgtatgtatgtatgtatcttaattgttgcagctagctaagaacatcaatcaaattcaaatattacatacataagcctattgattgatttgcttgctgcagttagcctacttacgtgtatgcatgtcaaaacaagacgaaataacaacaggcatgcatgtatgtatgcttattttgccgtgctagacggcttttgattcgtcttctttgatgggcattcatccctttcagctccaacccctacaggtatatttgtatgcgttcatccaattcaactatcatcattccatcttttctttgccattatcttgttttggcgtcaacattatcacataaaactagacaaaaattcaatattaccacaaacagttgcctagccttttttttgtgctgaaacacatgcatggctttgaatttcaaattcaaagctcataattttatataaatttatattctaacatgtttacgaaacncngtaattcattatcgaaagcgcataccactgaggttatcagaattttacactacttcaatattactctactaaaaaaacaaattttcgtatatcccttaatgctctgcttgttttgcacaaaactttcttctagctttgggaatgatttctcaaattatatgtaggataattttcatgtcatcgtctggacatatataatttcatattgttcaaagacatgctctatgcttgactcttgttttgcaaatatcctgattgcagttgatg

SEQ ID NO: 2097 - DNA, 2000 bp, Oryza sativa
tgaatggcccatacttccatcatcatgcatgatagtactagtttaatactggtttataataccagtactagcagtttggtatgcgatcgtttggagtgttaaacataagtgatcaaataattaaatcatttggcacagtttgccttgagtattcagttagcaattaatggccaaaaaaataataatagagagagaaggagcaattgccaggtagttcgatcgtctggtggcttgtgccatctctttaatataaaagcagatggatcgatcaggatcggtttagcgaggcattaccatgtgctcgatctgctgctcattagctcgccttgcttaattagtctggttacaacaactgatcatgtggagtggagtcctgtactgcagtcctgcaggctaatttctctcccgagttttgattatatattccggtgggatgtagagcttaatacagtggacattgttgtactcatgtaattttaacaattgtcaagctctacatttcacgacagttgcttctgcaattttcgctttgaaaaaaaaggtgtacaagcaactggcgtgaaatgtggagcttaaggggtgcaatttcttcgtaacattctgatggtcaaagcaagaggcgatgcagtagtgcaggagtttggtagagagcagttcagtgcttgaagcattttcaaaatgtttaggcaattccagacacagctgaatatgagttgctaccacttagaaaacatgtatggatgcagaaaaacggtaaagagagaagggcaagcaatgggtgtacattgtgaagtggggttgtggaaatttgcagtggatctcccagaacaagaagcatgatgatcatggtttgctaccacagaaattgcttttggcaacagagagagagatgcctccggaccaatcatctgattctgactttttcttatgttccagaccacaccatccaaccatcatcaactcttctctgctctgctctctctctctctttttctttttgagggatgacatttggaacgtttaataagaagccaggggttgaacctagttaaaaaaaattgattaaattaaaaacatgtctagctaatttacgtgctacgcaatttatcttccaattacaatacccaatagagacattctctaaaccaaatcctcgactgtgtgttcgctcggcaggtcaggttccgtgtgttgtcgcctcctggctagaccgctctctcttcctcttgtggcagtcggcttcaggattggtggccaacctctagggcctgctttatctgagcatctccgtgccggtttcgactctctgatacttctggtctcttggcactatggaaggaacggaactccagagttttcgattctacgctctcttcggtctcagtggttctagagtatatctgcttggaagatcatctgtggtctttagcgtgcattgctacttttggagatttattgaaaatgtaacgtggctctaccccttcccaccaatcggagtttcatagccgccgtagtagttttttttccttcctagctacaatttttgttttgcttttcttcattcccctagcataagccgatctggctgattgcgttgtgtatcaaaaactatttttcctctaatatattaacgtgcaattattttacgcgttcgtgaaaaaaaatagaccaaatctcaggacatgacattcatcaactctgctctctttcttcaaagagatacggagtatcatgttttgttggtctcctgttaattacgactactcggtgggcctcaaattgggcctggcatgtaggcctgccacgagggccatacaaagcccaaccccaacaaatccaggcccagtatgacagtgtccaagtcaaaggtgcgcgcgcgaggagcgcgggccagattgcggagccgagtccacgacccgatcttggctccgcccttgccgccgcgcgcggccttctatataaaccgtacctgccgctgcgtgctccggcgtgcaaccgcc

SEQ ID NO: 2098 - DNA, 2000 bp, Oryza sativa
cggctcaccgccactcgttggggacgcaccgtcggaggcagcatcggcacggggatcgattgcgcgatgtgggatgaaaacggaggggatatagatagataatgctcgtatcatatttgtgttcatattctttaccgatataaaaacaaatacggatagctcgaatacagaaacaatacggattatctcaaatacgaacaaaaatcgaatatgatcgggcacgaatacggaaacatttttttctcggaacacgaaaaccaactcaacttctaatagaaataaatatcaacatatataattagctcattttatataaaatgaagtataatttataattttttaaaaaaaattaaataaagtatgtatatattgatgtattgcatatcaatcactttgcaatcagaaaattaaattaaacaactttttttcaaaaaaaatccaagataaaaagggcatttacttccctctcgccctaggcccccaaaatggtaggaccggccctgattaggcccccatctttttctctattcatcatcagccaatgccaaaatttaaattttaaagcttaattttgaagatgaatttgaagtttcttcatcaaagtttattttttagcattggcatttaagtcgctaagaacatatatataaaaattttaccaacaatttactgtattattattttgctaatatgccatatggcatattatccgtattatccttaggttctgcgaagacaaatggttgggaaatgtaaccctgcgagaacagtactcgttcctctacaacattgtcaggcacaaacatgcaactatcgaagatgtctttcaaaatggatatcccaattttcatggagaagggatcaaattggatcgaagttagtcacatggaacaccttatcaccacacatcgctaatattggtttaatttaggagcaagatgagtttccatggaagatgacccctaatggacagctccatatggagtctcattatcatctctagtttatagtgacatctcgaatataaatagacgcccttggaaactaaatatgccattgaaggttaagattttcctttggtaccttcatcgtaaagttgtgttaacccaagacaatctagctaaacataattagcaaggcgatcaaaactgttgtttatgtaataataaggatacaattaaacacattttctttgaatgcctcttagcccatttagtttggtccatcatttttgtggcgtcaagaattactccacccgatagtgtttcacaagtggtcactagttggctttcgggttttcaaaaagatatgtaaccatatgtcctgttaggggcgactgccacatgctagttgctttggttacgtaagaactatatagtttttgatagaaaagttatttatcacacatacatgtcatatttgtaactatccattggatgcacacctaggttattcttaaaaagccgagctcgtgggatttggttattgcgacgtgtctacacttggagcgggtggtcaatgagtgttttaactagggacataggtggtgatctagtcttaggatgatggtccttgatgcttcttgtacttaatttcttttaaattggttcatatgtgtttagttgtgtggatccttgggatgcagaggctgggagtgttacttagcgtagtaatatcaccttgatataattgaccgagttcaataaaagattccattgtcaaaaaaaagcaaccagttaccatgactatgcacccgacacctggcttctcgctaatgacatgtgattgggagaaatgcgtggtggcccaaagacttggcacatatgcatgcaaccaactaatttttgaccacaaagctcctgcggtcctaggccatcgccttacactatttaaagcaatcacatcccactttcataatagcaagcagctcatcaacctaggttagctacttcttgttgcattgaatcatccatcatcaaatcattgggatatatattcca

SEQ ID NO: 2099 - DNA, 2000 bp, Oryza sativa
aggaatctgtttctaccactcacaatatgaagggtaccataggttatatacctccaggtgcaagctcttcctttctatacatgatgtccctcaataaccttttatcctttttttatgtgaactatgctggcttatgccaaccagaactttattactttgataaacattactaaggatcacataatttatatgggggaaggtgggaaagaaaaagaaataaccttttatactaaaaaaaataatatctttcttggtgaaattttatggtcttcgaggtggtatcaagaggtactctcttagtccgaaaataagttgattcctactttccgtagaaaatttaatagtgaagagttgaaaatgtcaaagtacgtgtccctcattgatagaaagatggtattgtaaggtgattagtaaggggtactaaagtgaaaaaacttataaatttatgcatagtgggtagataagggtagaaatcggcgtactttagtttagactaaaattttaaactacagaaacaacttatttttgaatggatggaataggatgttttgtagtgtaaaacttggtattttttggtatagatatcaaactttaaattgaaaattgtggtatctaccgataagtccaccagggctgtaaaatttttctgtttctcattaattgaattttctattgtttcgtccagaatacggatatggagccaaaacatcgacaagtggtgatgtctacagctacgggataatgctccttgagatgatcacaggaaagagtcctgtagatcaaatgtttggaggagagatgaacctggaaaaatgggtgcgagcgtcaattccacaccaagctgatgaagttgttgacaagcggtttatgatgacaggttctgaagaatcctcagctgatgggcagcaacaacagcaggttgatactgtggactcgaaactgctgttggagactcttttagttcccatggtggatgttgcattatgttgcgttcgggagtcccctgactcacgcatcagtatgcacgatgcactgtctcggctgaagcggatcaatgagaaaattttcaagtctctcgcagtgtctacaccttgatttcttgaagaagatggtttgctgtgacggccaattggagcatcatctgaactgtcttttttacgtataaaatttgttttcagtgctgtagttctaattaattaagaatggagatgacaacactgaccaagagcacatctagctactaagggtgtttcagtctcagtggcacggtcaatttttaagttattgtactcaaatgtaattatgtaaatacttaccgagttattatacccatgggctgaaagttttgtaatagttaaatgaacacagctcccaaattcttgtaccaatggtgcaattttctttttgaaaaaaaaagagagagaaggaaatatataagagtagttgtaccataccatggaaataaaataattgacagttactttcttgcaaacctatgtgctcttcttatcagatgtccagatctttaatctgtttagaagttggttcaatcctttgacccacaaaatgcttggcaaaacctgttatccaattgtaataccctgtgcttcaaataaatacttccctcatttcataatgtaagactttctagtattggtcacattcatatatatgttaatgaatctagacacacttatatatttagattcattagcatatattgtaaaatcaaaggtgtttttgattattattctgtgatgaacaattggcatttgagattattggttttgatatttggaatttattcacgaagtgattttggtgatgattggatttgcaggtgaatcgcaggttctgttatttcatgtgaccggtcagaccaggctctggtagccggtcagaccggcgtgtatcgcgcggtcagaccggcccagcccgcggtctgaccggccgactctgtgtcggtttcggtttcggatatccgtgattatttcatgatt

SEQ ID NO: 2100 - DNA, 2000 bp, Oryza sativa
ttaggcctgaacagtacttcagcccaatacttttaacagcgtggcccattgtgttccttagggacttaggcatattttgctttggcaatattatgcgcacaacagtgttgcccaatgctgatcaaaccctttttatgcggtcatataattctttggaattattgcaatgcaaattaaaaaggtgcccgacagaaaggcgttatgctgtttttgcaagcttttttaggctacaaaagctgtttgggttaactaggaatgacttgtttttattataatcatttccttggcgtgttatatgcctgttttcatggtaaatagtcatggcctaggctattcgacttatttattaccataatctttataatacttgatgggtaatctttagaatttttattcggatgcctgtcaagtgtgttcattcgtgaaccttttagagtgtaaaccactcggatttcttttattgtggctaaaaagcagtcggttagcatgcctattttggcgccgcatatgcttttgtcatataatgcacaattgtgttgttattttgtctttcaactatatgtttagtttgttaactaatcacatagttgggggctacacctaattaggtgcatctattcgatgcaccatattcttcttcttttcgccctttacagtccactcggcaggttttggcttgaagagtttgaagtactcggattatcatctttgagaaggctacgatggtcgactgcaaaggactcgggggctactgtggagattatgggtatcccatatctacacggcgatggtattcgaactgggtacaggatacctaacgtagatagaatatcttatttgtatcttgggtttgtttcttaacttgtgtatcatggaaacaccctgaaacttagtcggttacgactgtatcttacctatattttcatattccgtaagggatataggttatcttttgtaactcggactccttcccatatataaggggggtctgggcgcctataggggcatatgttggtttttcccgaatcacacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacaccgataggcttcgtcacgacgggttttgtccatggaaggtaatcttgcctatccccagtccccctcgctacatgccagcgcaattctgagtaataaaccttaactgcaatctgttttacatattacagtagtgggcgagatgctgttgcaattgccttctgcgaagcaaagcttctcgcggtgttgaggcggcagcaatggacacatgaaaatctgaagcgcaaagacatctgtgtccttgttaggaatgcaagatcagcggcataccgacgagcactggcaacaattgtcctggagcagcaagaggatgaccttaagtttctctagtctgtaaaccttaagttgcttagttatcaatgttgaatcctttttcagaatcctttataactatctgattcatttttgaggagtgacgagcaacaaatatgcatttgctcgagtggtaaaattccaacttcccagtaaaatgtgaatctttttcccctttcataaatcagttgccacatgcagtctgggcccacatgtcaatagcacaatcaaatggcaaaagcaaagatatacaaagagggtgtatctgtctgtctgtctgtctgttctgttgtatcctttcttcacggcaaacgcatgatttttacagaagggtgttggtcacctttgctccctattttgccgggaaaacgtctggggaacaacttgacctctcatttcccgccaaataaggtcagccctctcctttccctccctattcaaatacatctcctcacttgcttcctcccttgcagattttcagacaccaccctaccccaa

SEQ ID NO: 2101 - DNA, 2000 bp, Oryza sativa
  misc_feature (270)..(270): n = any nucleotide
gtctccctgacaggcctctgacatgggatgaaccgggattaaagatgatctttagtcccggttgtgaaatatcaaaaaaaaaattagccgggactaaaaacaatctttagtctaaaatctgccgacccagtaaagatcacttctccagtagtggagtgtccgataataattttgcagtctacaaaaaatagataaaataaacagaaaaatagaagtattctttgtgataaggaacttgggctgatgtacagatgcaatcatggatcagtnaaaaaaaaatccaatccaagttcgatctaccagatcatgcatgactacgtactgctctctccatttcatattacaagttatttttggtttgttgaaaggcaaacctatttaggtttgacagaattgtagaaatatatagcatcagtttactcaaaagaatattcagctgatattataacgaacagtctccaatttgaattccagaaggcacgtgctattttaagtcattcagaagattggtttttcttctcatctacaacgacaccgaatctagactcataagaactttggatactccatcgcccaatccaataaatttcaggcgtcaaaagatgcgcatccacaaaacgaaaacaaattaatgctgcacatctctatcatcgcatctgcgactattaatttagcggcctagttaggacacactcgattttgtttgaaataacactagcacgggatcagtcatctcaatcgggcagcaagactcatctccgtcggcaagggctcccgtcaacaagcaaatgtcactgatgtgagaaaatatctcaatcgagcatttgaccatcacggatgacagttatcttaatcgggccaataataacgcccgtcgaagataggtttgacccagcagatgagtcaaactataatagttaggcgtctgtcacggatgactaatctcaatcaatcaggtttactgctatgctcgtcacggatgatatttatctcaatcgggccttaaacacaagcctgtcacggataggccggcttgacccagcagttgagtcacttttatgaattatgtttttcttggaaaaaagagaaaaaaaatcatccctttcaacctcccaccaaaataatgaacagtaggataactacacagaacaacatggtggagtatttatagtgtgtgaaatacatatcggttactgccaatgaatggacaaaggtaacaggcactcaattatctcaatcgggcatattactaagcccgtcgccgataacagacatcggtgacgggccttaaattaatctcaatcaggcttagttttagcgtccgtcaccgataactatcatccgtaatgggcttatgtttgtggcccaacaaagattataaagataattacaatcggtcctaaacgtacgtccgtcacagaagagtcttatcggtgatgggctctagatacatgcaactcgattatgtctgtacgagtatatatttgacagtgtttattttgccccgattgagatgactaagtcgtgacggcccccaaaacctaggcatttgagaggccgtcacagctgtgagagaatctgtaccagtctaaataattcagttgaacttgcatgtttctcaggcattgtttagatggatcgtattatttaagcacggattgtaaaagctattacgcatcatggcatattatgcgcctttattcaaaccccatccgatctatgcaactttattaatctaatctcacttgaagttatatgatgaattattaataagttgaagctaatatagagttccttttcattttggttagtataattaaaaaaagtgatgtattcaccatatgattagagtattgatatttatagtattagtagaaatagtccgtgcaacgcgcgtgttagcgactagataagtataatacctctagtttatgtttaatgtggtggatcactttatataagtctataatcttccaccgtatctcatcgtgatccaatct

SEQ ID NO: 2102 - DNA, 2000 bp, Oryza sativa
  misc_feature (1985)..(1985): n = any nucleotide
tatgttggtgatggaacatcttcagatgagttctagcttgctgtcatcttcagaagttgagaaacatcaactaaagtcgtgaaaaaactaatctttctcaggagcaaattaggccacttaagctgaaaaacaaataccatcggatacatgattggataaatgatgaccgtctgatcaatcatcaaatacgtacgtgcattatccctctggagccttctagtgtctctcgtcacccacttggcaagtatgaaaagtaagcaagcaacacagttgggaacttaatggtccacaatttcatatgttgggtacttatgaaatttaacacatggaccaagtgaagcaaatactatctccatttttgtattatatgatgccatattaacttttagatatatgtttgactattcatctttttcaattttttttcaaataaataagatataaatcatgtttaaagtacttttagtgataaaacaactcacaccaaataaattacaaatatgtaattttttaataagaaaaattggtcaaccatgtgtctatatattaacgacgtcatctattaaaaaatgttggttatatatgtgacctatatatgggcaacttcatagtaatatttagggcaaagatcattttaattgcaagagaaaaaatcttcatctttaacaaagatggcttctcatatggtcgcgcaaacgtacgattttgagtggctagtacggatgaaagcatcatagagtgatgaactgatgatgacagagctgatttatagatgatcaccgttgttgtggaaagctaagtgtgccgcgtttttttatccttgcttgccatttacgatcctcaacatgtaaaaaaggaaatagtaagagagatcgaagtcgaattacttgaaagaaagaaattataaaggttgaatccacgaccataatatacaagcccaccatcctcctctctcctacggggctggctgccacgagtccacggccactggccattggtctactgtcgagcagtgtttgtgaaaaataaaaaaataagtttatttgaattttttaaagcaacttctgtaacgaaaattttttaaacgaaacaatatttaaaaaagcgcactaatggaaattaaggaggtagccaagccgatcccattttagaacacggccttaaaaaagcatcaacatatttcatttatatagttgtacatttaaatctccaaagacgtaaataatattacaaaatatatacatatatatatttgcaaacgtcaaagttccgtaaaattctagttaataatctgttttcctattaattattgaatgatactatttccgttcgatgaccatactctatttcacaacgctgttgacaaagaccaagcttctacttctctacgaaccacagagtaaattataaggttagaaatccttgtgattttattttcagatttatctctactactcccccaccatcctactttcccactatttataaacacaatcctgtaaaaaaaacatattatctaaaacaaccgctaaaaaaccagtgttttaccaagaaaaaaatgaatcaataaatctgaacccataaaaacatcaaacccaaacaaaatcccatatgcaccctccgtctcaaaataagtttatttgtgggtttatatgtccgacgcttgatcgtccattctattttaaaaacttaagtcacacacaaaatattattcatgttttaccatttcacaataaaaatattaataataaaaaaatttaagtaaaacagacggtcaaatgttagatataataacccataaataaacttattctggggcggaggctagagggtgtagtgtaggactttgtggacttttcaaagtttccaccaaactcgacggagtttatggatcctcacaaaatcacaggttcaactccaacccagtgaacccctccacctcgcgcgcgccttcctccaccaaaccctaaccctcgcaaccccancccgcgagcgccacg

SEQ ID NO: 2103 - DNA, 2000 bp, Oryza sativa
caaatcacaaaatattacattcacatatgcacatccacatcctcgacatccacatcatccacaaaaatacactatggaacaaaaatgacacaataatattcacatcgtccacgaaaatcacggaatattacattcacatcttgcacatccacatcattcacatttccaagaagactcattttaaaatcccacaacaattcatatcagtaggtatgttattgctaaaaattgaaaagagaaggataaacacgtggcaaaagtgaaggataaacacgtgacaatagcaaagtaaatgcagagttagaaactgtagcattcagtacctagtgttgtactaactagataataccccgcgcgttgctgcggggaataataaataaatttcaaagatgcaccaagagcatagtagcacatgaggaggaaagaaaaaaaaattaatcctaagtgattgacttcgtaaagccttcatattatggaatggagggagtaaaaattatgtgatgagctatctccactttggtagccgtggttaaaaatgcaacagaattgcaggtgaaatacatagttgctgaccggatagatctagtattggaacaataaaattaaagtctattacctcgttgctgaagaatgaaaaatatacaccatcaatagaattatgcagaactatatgtttaatgtccatatgaacctttctaaagaaaatctatacgaactgagactggaaggaaaatatataggtggtgtactggaactgatatcctcattgacttggtagccttgtattctgcataaagtatttcgtagtacagctctccctcactgatccatttagctcggttttagtacctcagtagttaatcttgcaatagaatgctaataagttcttgaataagttgctgaaatatcatatttttattgcggtaagaaatgtacatttagccacaagtaaaaattattatttatatgttgtcatatgatacgccaccaggaatgtgcagttgaggcatgtagcaaatctggtcgatccatgactaccatacaattacaaaattgataaccatcactaaaaagactctcattttatatttaaacatctacatacatagtccaattatcacggttagctggggaatcataactaaactgttaaacgatcatagagaatagtagaacaaattcctgcttagctatcggagttgggaaaaggattacctctaaaatatataattaagttctcatccttcgttaactcctttctgtgttcgtagctttcagaaaacttccgaaataccaatattactaagctgattcagagtcacaaaaagagtctatatccagatcagttgcatcagcaccttatatataccgagatatagcttcaccagctaaagatcataattgaataccaattaaaaaaaacttcatcggcttagcatgcccatacattcttagatctgattgggtgacaaatcaaccaatggatgtatatgatattgttttccatacccttcaaccgcttaagagacaaatcaagagtaaaaatcaactaagtcagtaatcatgggcctaaaacctgggaaacaaaagaggatgggaaactacagcaacaaaaaaaatgtgttagacagtcaaactgggtaaataatgctactatatcctaaatatgaaccatagtacaaaattgaattaaatattgataggagcaatcgaaatggtgtgcatgtaaaagtgaggttctattttgatgaacaaaatccgattgagcaaacaaaaggaaaggggaaattggtgtgtgatcacctgtgttagatcattggagtgattggagagataatagtgtgagatgcatatgaatcaagccagcaaaaatccaggaacaggagcagactgccagctccaattgcttggtagatcgatggatacgcaagagggataaatttgatatagtggcagaactaaaagagggataggaggagaagaaaaggcaagccattaat

SEQ ID NO: 2104 - DNA, 2000 bp, Oryza sativa
  misc_feature (1512)..(1512): n = any nucleotide
gcactgatgagtggcaggttttcttaaagggcctttctgcagcagcaacttccctgtcaaacaaagaaaaattcagagattactggagcagagaaaacattcgaagataaaattactacttcctactagtaaagattgagagatagagtggagtgatattgatccaactgtgttgtttcagtgaagcaatataaagcagtaacttcacctacagcttcttgagtcattacagtgacccttatgagttatgacacattgaggcaaataaaactgaccatttcattgaactgtaagtctgtaacgaactaacgattcccagaataagatgtgcatcaacgtcctagatgccaaccaaaacaatatacgccagaaccacctacagctttgatatcttgaacaataccacaattgtaataatctgtttatattgtgccaaacctatttttgtttttttcctcccttcccttcaaaataagacaaaatggtacttcgtattccaccctcccaaaattaatgaaaatgtttattttgacagtatgaatatgcggcaatacaccctatttatctggaaaaaagatagtgcatttgattaataatttattaatagatctggttggttcctttggcagccaacgcagcttcagccatcagtgattcagtgtcaaatgctaccatacaagaatgtcaggtaccataaacttcttggaactatatacctataatcaactagaaatctacaaaactaagcaaaattgaagcaagaacggaaaccaaattacctgtggccgagagcgctcagctccgttggcggcggcatctcctggcggctcccgtccatggccgctgctgctcctaccactcactaatccgtagcttcaccggatccgccggccggcgaggagaccgggcaaccggcggcggcgcgtccgagcctccgaggcgaggcgaagcgaagaagcggcggatatggatgcgtcggcgaggccatgatccatggcccatgggaggcccaaataatccgcaggcccgtagaacttcgcagtccggcccaaatattgagttgggcccataattttcggcccacatggagagaccaaactggcccacgttgaaggccataagacgagcaggagaaggggagagagagggcaaaccgacatcgccggagaggtcgccggcggcatcgtcgtcctccccgtcgccggagatcggacctcctccacaaggtctgcgctctctctaccctcccgccttctcgcgcctaaaccctgttcctcttttttttttcttgataaatttctcgatctcttgtgtcatccaaccctaaccaagaaacgggcgcgttcgctagggttggaatttccactggatttttgttgttagatgtgcttgctaacaaagtaacaaccctagattgatatggttgattaggtgggtttatcaatcgtgtcatgtaaatcaacgtgcctcttctacttttggggttgatttttttaatagaaaaatagtacnctttggatgagcggtgttgatttttttaatagaaatttggaagccaagcatgagttgattgatgtacaaatggagagaggaatcagtacgcaaaaatacactcagatcatttttatgcgcgttatttgattacacagtactgaagtgctccatagaaaagctcaaaactgtactatgcaggaaaacatttcgattagagaaaaaaactagcccttttcctctatgatattgtatatttgtatctccctgaacataaaaatgcacctggttgaattgaaatcttctttcccattgtataatgacgatttaggctcagttcgtttgtgatggttctcaacctctccttctcgatttccgcgcgcacgtttttcaaactactattttgatgcgttttttgtaaaaagtttttatacgaaagttgtttaaaaaaatcatattgtttcatttttgaaaaaaaaattagctaatacttaattaatcacgcgcta

SEQ ID NO: 2105 - DNA, 2000 bp, Oryza sativa
  misc_feature (467)..(467): n = any nucleotide
  misc_feature (1931)..(1931): n = any nucleotide
aaggtgtgagagactggggaattgcatgtaactcagagagctatatcccataagacaattggcaacaggtgcttcaacttgttggatttgtgtcaaatggttgttgagtgcttctatgttcttcatcaaaccaactagctctagtcatccggttgccactcttgccaacgtccattcaaagccggttaagaggaggggagttaggcataactcttgggatgggtcgtcaaaagagaatgagtaaattcaaacgaggggatctaatgtctctctaactccacttataactaccaagtaatctatttacattagcactcatcatacagaaaggattcaactttaaggttgttgtccattcaggagggggctaccagaaaagaataaggaggtccgagggatgggtcaagggtcaaagtgtaacccagtatttggaagacatgaccaaagcaatggagagggcaaacaanggagaaacactttctgaggggtacgcatattctctcaatcacacaacggaaacaatatccaagaagaaatgagaggaggtgcacgaagagagttccctaagctacattaccatgctaacaaaaaagcaagatgaagcaaggaaagaagttgcattagggtagtagcaaacaaaggggaaggcaaaggactaagcctatggcgcatatcttgtgggaggctaggaagatccagccatcacttatcatggatagcttgattattttgaaaaaccatcaaatataaaaattgcattgctacaacctaatgctttctaatatggtcccacattattcctttgcaaggaataaagtggttcctattataactattcttttgtagagataaatattacatgatgttcccaaaatggcattacctagcgattgtgggaactccacctgaatcaagcaagatgttttgtaatacggtatgagatgaatccacctaaattgttgaatgagaacacaaccttctaaaatttgattgttttccaaaataatcaagctatactgctaatttgagaagatatctacaaacacttggtaattacttctactatgtcatccttatcataattatatgcaattttcgtgttataactatcctgctctcgatcggttcagctggctacggctgcggaccagcagctcatagctcatcagctccgctgccgctagccacagctgatcgaatccaagcaaaaccccagataaagcaagaaacgtgcactagtactccatctgtctcaaaataagtgttgtttatatttaacgtttgatcgttcgtcttatttaaattttttttatgattagtttttttattgttattagatgataaaacatgaataatactttatgtgtgactatttttaatttttttatatttttttaaaataagacggacggttaaatgttggacatagatacctacgtctgtacttattttgcacttattttaattttgagaaagaggtagtattatatcggtaacaaagacaagaaaacaattcctcttacgacacgaaggttggtcaagcaagagtcgtccgatccgatctgagccccccccaatccccagctggcgcgccttacccgcgcttgtcgtgtcgtgtcgtgtcctcacgtgccgtgccgcccgggaatttccccttcctcctctcgcggcgaatccaacaacaaagttgcgcgttgccgccgctcatctcatcgatcagctgcaaaaagcgctactactagtgcacacgggcgacaagccacacacgcaaaaatcgttcccgactcgtggcgacgcaaggccggcgacccgtacgtgtggcgcccacgacgagacgagagagagagagagagagagagagagagagacagctcgtgtggtctcgtctcatctggagctgagccgagtagccgacgccttcatttccattntctcctctcggctctagcttggccggagaacacgaggcgtggccgcgtcgtcgtcggaggagggagcag

SEQ ID NO: 2106 - DNA, 2000 bp, Oryza sativa
atttactcataaaaaaagtagagattttaggggtttgtaatcatcccgtacatgattgataaaaagtgtgcatactgttttttttttctttaactattgaagaacaagtagttgttgattgggtaatcaaagaaaagttcagctacttgtcctagcaaagatgaagtagtagtaatactctctggatggtacagtttcaattatttgcatgacttaactgaatgaagtttactctgacagagatacctgttccaattcaaattaatgcaatttatatctaactgttgccaaataagattgaacgcctgttcttttcttatccgtctatcccacataatcatgttaatcatataccaataatacataatctgcatctgtcaaatttaaaccgatcatgccaaatcgattttcttgatgtgacaggtgtaatctgtcaaacttaacttaaaagcctccgaaaagtcacatgcagatgagtatctggctccctgtaaattagtcatgcaaatagcctgtgctcttgatataagtggatttagcattgcttgaactgtggcctttggcaagccagcaagctgtgacatattctatggctaaaacttgttaattatttacttaattcatctacctatttctgaaggtaatgaagggtctcatgtacacgataatcgtgttcagagaacgccagaatgggacggattggaagctagctaaatatctgaaggtgactagtagaaagctgcattttctgaattcatctgtgccaatttacagccaaccaaatgtcccattttcgctcaccgcgtgtatcctgcgagaaccttgacgtttgtggcaaactggcaacctaaccgtgaggcctgccttggctcgtacaccctgacgagttcttctcacaaaaaatgaaaaaaaaagtttcgaattcagcacagtgcatgattggtttcaaatatgtactcccccgtccacgttacaagatgtcttggcatctctatctttcgtgttagattcattaacatctatatgaatttagatacatatgtaaagtatatacgtagatccatatataaatctattcaaaatccaaaacatattataatatgaaacaaatgaaatataaatctattcaaaatccaaaatatattataatatgaaacagataaagtaactttgatagacacaatataatacaaatacactgacaaaactgagtgagcaaggtttggtattagtcatgtgcacataacactagagttaggttaaggtctttaatgacagccaaactctgcagaactttttttttggtttcaagaggatgaagaaacatatcttgacacatgcagctcttaaaagaaaatctaaaagtaacatgcagggtgatgccatgttattaggtttgccacatgcagctgaatgatacggtgcctgcagctgcacccagaacacgctatcaattgccacaagtagatcgtagagataacgcctcatccatttcatatctgaaagaaaccaatgatagatgcaattcaatcaccgttcacataattcattttgcagatccccatcatgaaagacacatgtattaactacatagaggatgtaaaggtgtaacatggatgaatttagagcgcaccactgatcctacaaatagcatgcaaaactacagccgctcaacacaaacacctggcctatttttaggcatcctcttccatctccagagaagtgagccccagcctcatgtcacaagggaagcactagccaccatagaactctctctctttttctccttcctcctaggaggatcccaaatacaccaatcgtgtcttggattttcccaaacacagcgcgcactctcgcccttcacctctcctccctctcacccttccattacatggatcagggagggaggaaggaggcctgaagtggcgcagagtaggcgcttgtaaacaaatccccccatttgcttcttttgcactgaagaatccctgaagaatccagca

SEQ ID NO: 2107 - DNA, 2000 bp, Oryza sativa
  misc_feature (256)..(256): n = any nucleotide
  misc_feature (1850)..(1850): n = any nucleotide
gaactccggccaaggagagctcttccagagcaagagtcgacgacgacaccatgcgcgtgctccatcgccgcctccattggtgacgatgtcctgctgcttcatcgccgcctccagcgcccacgccgtcgggccgctgcggggagtcttggcggcatagccagcggacgaaggaggcggcctcgcgagcgcggcagcgcaagaggaggtggccaccgccgctctagcgccaacccccctgcccgtcgcagttgccgcnacgcccgacccctctcttcctcttgcagactcgcacgcaacaccggccccggaaggtaaagagaggggggccactgccgccgtcatcaccaccactccgcccggccttcgccaccaccgccgctagcactggatctggaagttgcggggctacggcggcgcaacgggacgaggaagctgcggcggcgaggggcggcgcgagaggacgtggccaccgccgctctagcgcccacccccctgcccgtcgccgccgctgccacgcccaacccctcttttcctctcgcagactcgcacgccacaccagcccccgggaggaagagagagatgagggggggggagacgccgccgtcgtggccaccaccaccgtcgccatcaccaccactccgcccggccttcgccaccgccgccgccaacaccggatctcgaagccacggtcaccagcgcatggcggagggagagagataagagagagagagaaagggagggagggaggaggaagaaggggaggggaggaaggatgacatgtcgggcccacatgcctgtgggtcccttttttgaatgacatgtgggcccataattttttgttccacgtaagcgacacgtgcacgaaaaccgggtcaacaccaccacgtaggcgccacgtcagccaaaaccgcttgcaaaaccacccagggagtcaaattgcaccggtttcaatagttcgaggagtcattttatccggttttctggttaagggttacgaattagattcggccgacatttaagggagtcaaagtggactttttcctctggtaaaaatagaggggtaagtactaaaatataaaaattgggctgggtgtatgtgaacccccttaggtttattgggctccgcccctgcatttattgcatgttatctgaatgattatgaaaaaaattgacaagatagatcaatatataatatatcactacacaaatatgcaagttaaaattcaacatctacaaattgtaacaaaagtaacaaaataaactcaaattagtaaggtaaatttgcagttaaatttgttgtttttattataacatgtataagttaaattttaacttgcatatctgtggagtgatatattacatattaacctattttatcattttttttattttttttcataaatacaccatcattccaaattgatcatgatatatatttatgcaccaaacccaaaaataatttaaatcacatcaataaagacaccatgcacacattctctcacaatgcatgtatcgattaaaacaccatgctaattacatcttagcatatacacattctcccattgctatattatctgtattctgatgaaatccgtatccatatgattatatgatgatcaatttagaaaggagagagtatttagttgacatgtaataaactggtgaaaaaaaaaattggatagaagaagatagagctgacacgtgggttttaggtattttggttaaaccagtgaaaccaaaatatatggcatcagtggagggtggaacggcgaacaggtcaagctccatggacacgcgttgcgcccgcgcgcggcaaaggcgagttttcctccgcaaagctacatggagtncgcgccgccctcattttcttctcccgcggcctttggagagagagagagaggcgacacccttcttcctcccccaaccctttcacccgcccaaactcatccatccatcgatcgccctacctagctactctcgatcgatcgaccgcccgcccg

SEQ ID NO: 2108 - DNA, 2000 bp, Oryza sativa
  misc_feature (1016)..(1016): n = any nucleotide
caaattctatttttttttacaattaaagtgttcactatatttcctagcgtagccacttcatgttacagtaccatcgttgaagtccattgattatcacaaattttcatagtagcaatctacgtactgattattttttgtagtggtaaatcactgtgcatgttcttaacaatagccaaacattagggagcaattatttttcttctgacctgaccatcttgcaaaattcctgtcaaaattgtcctttgacatttctttgtattgccctatctaatgacaatgtcaacatgctgtaaattcattacaatgtccatccgaaatatcccagattaaggactttgtacaatgtacatttatgcagggttcttctcctggtcagtatccccttcctaacattatcagttggtgccatatctttgtccaacatcgtgaagatgggatctttgccacatgaaatcctcttccagctctcattaaccatttgcttctgctcatatgtcatcggtctggggccaatacccaatattctctgctccgagatgttcccaacaagggcccgtgcaacatgtgcaagtttttgctcacttgccttctggtttggcagactactttcaatttactgcttcccggtgatgctaagtaccattgggctcagtggggcatgtgcgatttatgcattcgtgtgctgcttggttctcgtgttcgtctacttaagagttccagagacgaaagggtcttcccttggagctcatagctgagaattttcaagttttcaagacaagaatgtctatagcagatatgtgcactatgttcagtattcaaggatgacccaggctgagtgttgaatgattgcttgctagtccgtgtacatagacaaatgtaggtttgaatgttgcaaattttgtcctagttaggagaattggccatagatgtttgtactttgtagttgttcattgtctttctgtgctttggagatacataaaaaaggaaaatcatacatgggcttcttttgcagtacnaaaaaagtaatgatgctgtatacagacaaagattacctggtagttaagtaggagtaatactcttcaatgttaacatggtgattcagcactcctggtgaagttgtgacatttctgatgctatttccaggctcaagcagtgtgacacatctcatattcagaacaccatctcatgttcagaacaccctgcttttgatcgccctcatggtttgcaacaccagaaacaaggaacaggaagctgtttcagtttactaattttaaccttgttcattgtctttctgtgctttggagatacataaaaaaggaaaatcatacatggcttcttttgcagtacaaaaaaaattatgatgctgtatacggacaaaggttacctgtagttaagtaatactcttcaatgtaacatggtgattcagcacttctggtgaagttgtgacatttctgactctatttccagtctcaagcagtgtgacacatctcatattcagaacaccctgcttttgatcgccctcatggtttgcactccagaaacaaggagcaggaagctgtttccgtttactaattttaatctttgcctaatttgctaccctgactatttttagtgtgtatttacaggacaactgccacatcacctccctcattttttttcccagtgagagagaaacaggcagtaagcaaatcctgttaatccagcctaatccattgcatattttgcatttgcaccatttgcacgtctgctgtgaagaatctgccattgcattacctgtagctgcattgcattgcattgcattgcatcatctccattgatcaccttgttgtctcagctgcattatcctatttttagctcccaaatctgcctgcctaaccactggagcagaagaagccattgacaaaaggcacaaggaggcaaagcccccaaagaaaggcaggaaaacattagagaagctggaagaaaggtagaggaaaggctgtgaccttccaccaatttgg

SEQ ID NO: 2109 - DNA, 2000 bp, Oryza sativa
taccgcgacaccatgaccatcaacgcgctggcgcggcagacgctcatcaacggcggcggcatcttcgagatgaccgtgttcccgcggaagcacgcgctcgccatgtcgtcggcgttctacaaggactggagcttcgccgaccaggcgctccccgacgaccttgtcaagcgcggcgtcgcggtgccggacccggcgagcccgtacaaggtgcggctgctcatcgaggactacccgtacgccaacgacgggctggccgtctggcacgccatcgagcagtgggccaccgagtacctcgccatctactaccccaacgacggcgtgctccagggcgacgccgagctgcaggcgtggtggaaggaggtccgcgaggtcgggcatggcgacatcaaggacgcgacgtggtggccggagatgaagacggtggcggagctggtcaaggcgtgcgccaccatcatctggatcgggtccgcgctgcacgccgccgtcaacttcgggcagtacccgtacgccgggtacctcccgaaccgtccgtcggtgagccggcggccgatgccggagccgggaacgaaggagtacgacgagctggcgcgcgatccggagaaggtgttcgtccggacaatcaccaagcagatgcaggccatcgtggggatctcgctgctggagatcctgtccaagcactcctccgacgaggtgtacctcggacagcgcgacacgccggagtggacgtcggacgccaaggcgctggaggcgttcaagcggttcggcgcgcggctgacggagatcgagagccgcgtcgtcgccatgaacaaggacccccaccgcaagaaccgtgtcgggccgaccaatttcccctacacgctgctctacccaaacacctccgacctcaagggcgacgctgccggcctctccgccaggggcatccccaacagcatctccatctgatctccatctcatcagatgaggctgctccacggaggcgccagcgtggacaagagtagttttacggtggtctttaccggtagtattttactttcaataattgccatgacacctacacccggaggtgtcatggaggatgaattcgttgtgtaatttccctttcagttcctaataaagaataaggaagcatatggttgtgtagcattttcaagcaaatcctccatatatctaccatgttttgaattgaaaggactgaattaccgaaaatcctttgatgaacattatctgaagacttaataagttggattaatgtctaacaaaccattaagtgatttaaattgtctgtaaactgatggcaacaatatgaacaaagagcaaaccactagtgaatgtgaatcaagccaatagaactcatctcaggtcataactgaatgatgtgaactgtcagtaaactgaggctattcttgatgcctttctcctattttcttatactaaacattttaatcaggcaaaatagcattttctaagtttggttagcctcctaaaccgacgaaagggagcaatccgagggaagtggggcccaccgtttcttccccgccccaacctcgcaacggtctcaacacttttctcgcttcccgccattttctcgtcgcctcacactcccctcccctccacacatacacacccaacgctctcccacacctctcgcagttctctcttcttccccccctcatctccgccgcctcgccgcgaacgggacgccggccaagagctcgaagctgatgagagatagcgacggcgaaggggccggcggcggcctcccgcgctcgcacccgtcgaacctgccgctgccggcgccgcactccgacccaaacctccagttctccgggacggacgatgacttctccaaccgtcacagcagctcgtcggcgacgggcggcgcgagccccgggtactactccgactacccgtccagcttcagcggcgagtgctcgccgtacaacatgtcgccctggaaccagaccatggcgtcgccgtggtcgcaccacagcgacgcgtcc

SEQ ID NO: 2110 - DNA, 2000 bp, Oryza sativa
tcatactctcatgatcaaggggtcattatcatttccacatataaaattgagctaaacttctacactggaagttggctttccacaaaaatatccatccaaataaactcctacaatgagttatgctttcttctcctggaaaagttattggcaaaaagaaaatgagaaaaggagggaaaggcatggctagagaaaaaaatgaagaaggaaataaaagcttgctctcaacacattgggtaaagaaaatatagccatgtcccctccacaatcatgccaagagaaccaatttggagagaaagtgtagaaaaaaggaggatcatttctttatttcataattccacaaaatattatactttctcattttccaccataaataaagacccttgatctaggagtatgattgatgatcttcttgagtccatatttttggctttgcaatacatatgatgtaggtatgtcaccagtttatccctaccaagctccacatatcagccatagaataggggtaaattctggcacactttgtcttggtgaggatccaaaagaaaatataaatctttgagagacaagagaggaagtcaaatatgaggaacatagctagtttgcaaaagttcataaaaatcccatgagtctgacagagaagcaagaaggactggaatcaagatcgttccatttatcaattactcaagatggtaagatagccactgaaaaagttcataggtgcaggtatggttgtgaatggtttatatgcttgattcatctcttgaagaaattcattctacattaacctttactcagggaaaagcaaagggctaagtgtggggggttttgttggcggttgttaaatgccgattctataccgccaacatctgcataaagtttagataatcaaacatccaaaatagtgataagtgcttaatctcatatattccacaagtgttggtatatatttgtatgcagatgataaaccccggtgttgggaggaaaatcggactaaagtgaggagaattatgcatccatacaaggaggagttgtgaacttcatcgaaacatcagtaaatcaaccaaaaactccaagaaatagataaaggaaggtccagggagtccaccgaccgaaggctaggccaggagggcccagcccaggttcggccgaacccctggtgatcaccgttgatcccaggttttggcgtggacggtcgtgatgcattcctgatggcggctgcggggcatttctgacaattcgcatagtataatcgtcaaacctacctctatataatggcttcacctcctcacttcatacgcacttccaagcttgagctgaattataagaggctatattgtactatattgtatactagaataggaagagagtagagtagaaggagtcgaaagaattccggagttgccggtaatcttctcctacttttattctatctattactctgaatttaatataatattcttcttgagtaatttagatttatcttgtgagaattacctcttggttaattcctaattagcatacgggattattgttccctataaacagctaaaatatagtgattgctatggtgagttataaacactaaagtagatattaattgcttagacgtggtgtttgggtaattattatgcagtaatttctgcgtatcccacagtacgttgaggtgggtgtagaggtggtgatagccctcgagatcactaaagtcatccctgtccgggtacgcagtagagcgacatctgggaacagcgggttgccagtgcctgaagtattgcgttaggattaaaattaagctttccctagacactgtttctcactagtaaatcctctctatcctggcctattatttgcttggtgtccttggatgaaccagaggaagctctgatcacacacgttcccttggattcgatacccttggaatactccgtagaggaaagtgctacatcggtatatccgtgcgcttgcggattttatctgtaaccgtatcatataccaacacacgt

SEQ ID NO: 2111 - DNA, 2000 bp, Oryza sativa
  misc_feature (1727)..(1727): n = any nucleotide
  misc_feature (1783)..(1783): n = any nucleotide
  misc_feature (1786)..(1786): n = any nucleotide
  misc_feature (1799)..(1799): n = any nucleotide
gttgatggaggagtcgcgggagatcataaggtgccggcggagtgggaaaccttttccgtcgaagcataaagatcatgagcagattgaggattctgagggtgcaaattctgctccaattttgtcatagaaagctagaactttgcctggtcagaaaaaatgagggcatatgcagtatgattttcgtgataataccaagggggattctactcttggaagtatatggctgcttgttaggaatatttgtgtagaaagacaggagggtgtacaaacaggttggtgactgatgaaattaaattgcattatcattttatctgatctctgcaagtcattttggtttgtgcacagtagtacgcactggcggcactgcaaagccacatttacatcaagcctttgtaaagtccaactatatcatttagccaccacttactcacaatcttttcatcaaatcattgcaaatctcaatcacctttcttaaaagggcatagattgctgaatttgattttgtccatactttttacatataaaattcaccaagtatgctgcaacttgttgctgatttgaattttaattgtcaatggctcctgtatttatgtccatgcttatgcctcatggttggtattgcacttttacagttgtcgtaactcagtatctccctttttatggcatggagataactggatgcactacatttccttaggctgaggtcttcacttcttggctggcaaatgttttatggtgtttgtttggttaatgtggtagagttacaaaacagataacatgatttccattgctggaaactttttgtgtaacattatgcgtgcaattgtcagtttccagaatgagaatcaagctttcgtttgcatgcaccagtggattatttaacttaaatttctctgttgaagtacttgtcctgttttaacatctacacaatcggatgaacattagttgtttatattgcgccttaactaatttagataatcctagcttttttgtttgtttgtttttgttttttttccttggcagggagatcatagtttgttttggtgctgtctgtcttggtagtaagcagtatgacaatcgatcaattgcgagaaattagatagttgtgattggcagatgccatagtcagggcattagctctttgtgctattctgtttgttgtgattgctgaattagatcaagaccacattcagttatgtcaaccagggaagagtgttcgttgttgtcaatgtttctgtaacttgattttcttgtataaattttctccaactactgattagcactctctccactcgcttgcaaaaggtacagtgtgagattttctgatatcacatcttctccttcacattttctaaatttaaagctaacaataatttcttcatttcttgcttttgcagagattagtatatcactattcccaaactggtgtctactctttaccgtctttcctggagaataattgctgcaagctttggaatgtgtagtttttttttcatcgagtaattcatccacattttcaaaagcgcggtgcttctcttctttgaactggattatcgagttagcttgtgaacttgtcagaatcttgtatacgttccaatcatgggacacagatctatgtgaaatcgtaaattctgaatgtacacatttccaagctatctcgacattttcactttgaaatcttaaaccaaatcatttgaccaacttcacaaaattctacagaaaagatnggagaatttgcacgccttcatagatgggccgatagcccatctgtattgcagcccantanaccggaaaaaagnaagaaaaggaaaaaaaaagaatggaaaggcaacaccgcctatccctccatttcccaaggcggcaacgcgcgtcgcacgccacgcggcaccatttcgcttcgccttccccggcaaaatctccccaaaaaaattcgaaaccgcgccgacgcctccgcttcacgaaaccccaaccggcgacgcggcgcgctcgctccgacgacc

SEQ ID NO: 2112 - DNA, 1105 bp, Oryza sativa
  misc_feature (2)..(2): n = any nucleotide
  misc_feature (5)..(5): n = any nucleotide
cngancgtgaacgaacgcgaacgaacgcttaacgaacgcgaacgaacgcgaacgaacgcgaacgaacgtgactgaaacatgaatgaacgtgagtgttagtgaacgaacacgaacgaacgtgaatgaaacgtgaacgaacgtgattgaaacgttaacgaacgtgaatgcacttgaactaaaagtgtgagaacgaacgcgagcgaaatgtgtacgaacgagataattaaactattgttgaacttaccatatatatatgattatatatacttgaaaacatgaaatacattatatgttcctttgcatttagactaatacattttttttgcatgttgcagagaagacgtcgtcgttgtcgtccctcaagccgaagtggtagctagccctcgaaggaattcacgcaggcaagtgatgtaaagatgtgattgttagagatataatataagattgttagatttctaatataagattattagattattagagttagcatatgtgagtgttaaagattattagattattagacttagcatatttgagtgttagagatagttagagatttaatataagattcttagaggtttaatatacgaaacttaattagacttagcatatgtcagtgttagatatttaatataagattattagagatataatattcgaaacatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatatttcaaacttaattagacttagcatatatgattatctaccgtacaaatacacgatacttagacttagcataaatgattatttgagttttaatacaagattagtagagtgttaatattacgcttagcaaatatttcttctatgaac

SEQ ID NO: 2113 - DNA, 2000 bp, Oryza sativa
  misc_feature (114)..(114): n = any nucleotide
  misc_feature (120)..(120): n = any nucleotide
  misc_feature (245)..(245): n = any nucleotide
  misc_feature (252)..(252): n = any nucleotide
ttaaggaaatcaatctactaaaggaagcttatccctaagtgactgagtttaaagaggatgcggcatggcaatttatctattaattaggaatagtttgttagtttccctttatcnttaggntagtttccttcttatccgacaaggacttgtatcaacccatgggtataaatatgtacacccggggtctatgtaatctatcctcacaatcaatacaattcggcgcatcgccaccttttaccttttcnactttantttatcgtccggcgagacttggcatctgacgcggtgctgcatcggtgttcgatctccggcgaaagggtaagtccaatgttccgtcggcccaggcaattgtatcgtttacgtcggcgtcgttcaaggctgcatcagtacattcaacctcttggatcgctctggtttggatgatatatttgcctacctatttatcatatgtctctattaatctagtcttagcatatcaatttagctctatcggctgcttctcgttttagggtttctgccgatatcggctaaatcgcgttgctagattagattagctcagacatctaccaccctaaaaatcagtcaacggcttgattgtctagatattatgtttcttttcatacttggtgctgcatcagttaagtttgatctactaagtcatgcttaaaaccataatctctagcctgcttcttgattgctaataagggtttcatcggggtttcagctggtgagttatctggacgttgcatcggctcataaggattgcatatacatataagttggatttagccgatgacaacaaaggcttcactgtttaatctaatcttgtggatttcatgacatcggacctccatccgatgtgtgctttgaccttcggatcgatgcttatttatcatatcattatttgctgattggtttatactggattatattgttattttattacatcgtcgtcagccgattgcctttatatcattatctacattggacatatagccgattgcttaaacccctatcggcatcggctgctatcagcatcggctattatcggcatcggctggaactactccatcggcttgtcagccgatcggttgttttgatctactatttgcatatcttgtcagttacaggatcaaactgactggcacgctcgtatctcaccaatctttagacctgcactggagttaagcagatctctcaggctggtgtgttcgatttttttcatcagtatctagcatcgatccacatcagggccatcctagttacatctacatgattcatttaataacctccttaattgatgctaccataatggttttattttggtactaatcaaaacacacttttgaacaaacttgagaggataagcgttggaatcggtacaatatttagagtatatttgccacagcttcagctctatcaaacggttatgcttcacttaaaaaggaagtggatgaactgattagagttctatcacaaaataaattaaagaaatgaagtaaagtttaagctacttcatagctctattctatactcaactcctgaagttaattaaatttataagagatggagttttaccgaacatgcagtactctcttagctagaaatatgtggcgtatccgcatagactgggctgggatagagaacaaggcctagttggttttgggctagaattttgacgagcctttttcacaaaaaagagaacttttgatggaccatcaggcatcagcccgagccccaaactgggccaggcaccatcagtcatcatctctctcggtctcggatagcggggatgcgctttgcgtaaccacgtaacgcgcgcacgtacacggcacggtacccccactccctggccaccactgcttcgcctcgacgagatccatacctcccgggctcccggacgcgcgcgtgctagctcgctcgccgatcgatccatcgtctccacgtacggccgcgcgaaggcacgtagtgaggtacgtgaggcagcagcagcagcaagc

SEQ ID NO: 2114 - DNA, 2000 bp, Oryza sativa
gaaagcataaagtacaagcgaagggcaatatagtcattttgggagaattctaatggtcaatttagagtcaactcacaacatgggtataaaagtgatcaaaataaaaactcaagggcatacagaggatgaggcaaaattcaggggcacgtaaaggattaagcgaaaacccatgtctctaaaatatgtgacctcctatcatgtccatgtctctaaaatatgtgacctcctatcatgttgaattatccacacacctcagtatacttctcaggattaccacttgaataggataaggttaaacaaccacaaagaatagctatcaggtcattgtcaagatccattatccactcaacagtatctgtaagccaataaattccatgaagaaaatcaataattcattcttgatcagttggtcttatcctgtcccacaaaaaggataggagaagcaacccatcacaatccatcttttataagccaagccgggatgatgtctgaataagtctaatcagtcgcattgcatagaagaagaatagaagcatttgaagcctcctcctccaggttgcagcaaaagcacaggaagcagcgagatggaaggcaagagccggcgaccggagataaccgtcgtgccggcggcaagcggcggcgccgccgccgccgttgatgcggtgaaggcggcgaacaaggagcccatcagcccgggctcgccgtccctggcgagcggcgccggcaaggagagcctgagccgccatgaggccgccgtcgtgtccctgcccgcgtggaagctcgacgcgctctgccaggagtccggctcgtcgccggcggtgatgagggcgcgcttcccctacttctgaatttctgaatttctgatgaagccatgagctttttgccatcttcgtacgtgtgtgtgtgtgtgtgtgtgtgattgtaactgtgttgttcatggctgagtaaagaattatacttcctacaagcggctgtgatgtatatgtgagctgctttagctgacgcgttcatctttggacgctgtaaaaactaaaaactgccagtttttcatgtagcatcattggaaaaacatagccatctgtttgcgttgaagtttggtttgattctcacttgtgggcatgtgtttggtaaccttaggatgtttgcgaacgatgtgcactgatatatgtgtaacccaaattacataggagtggtttgttttgtaaaaaaatatgtattacccctctattctaaaatataaggcacaactatttttttatatatttcataatattagtttacttaaacgccgtgggaatggctgagaattagcgcggcgcgtcattgacttttttcagaaaaacctttgctctttccgctaatagcgtgtacatccctgttaacttggcctgtcggacctcatgctagtataagttatatatgcatgtatacattaactatcacatcttcgtcctttaaatttgttttattttaaatcctctactataaagtcaccaattacactgcttacatgtacggatgtgatccaatcgagagtacgattaaattctttcttagtcattgttttaagaatggttgagccttatattttaggataaaaggagaagtaaacaagctcaaatagataaaaaatatataattagaactataatatccggaaaaagaaatccaaattcaaatttaaaatccaaagttagaaatttcactttgagttcaagccatcaaaccaatcggaaaacgattggactcctggaccataaccggcaggtggtttgaaacctgatctgatttcagaacatcaaaaaaaaaaatatacctatattttttttttcccagggccccgtatacataaatcgctcgctccccgtatagaaaccgaatcgccacctcggcgcatccacgcaacccacccgtcgcgagtcgcgagcagatcaaaaaccccatcgccgcggcgatcaccggagggaccaggccgggcggccatccgtactccgccgcga

SEQ ID NO: 2115 - DNA, 2000 bp, Oryza sativa
  misc_feature (691)..(691): n = any nucleotide
  misc_feature (828)..(828): n = any nucleotide
  misc_feature (832)..(832): n = any nucleotide
  misc_feature (865)..(865): n = any nucleotide
caaacaagttaagaaacaccaatgtgataaggaaaaaaaatatttgtattgtagcaatcaacagtatggcttggctgtggacgagtagtaacaagaagatgataaattcaatttacagggcaggtgtttacctgaggaaatttcggagcaatctttgttgcttcctcggcatcagcaagcgcaccagtgatattccccattgacaatctagccctagacctgcacttagcatcaagcattcatttcagttaacgcaaactctcattctcacttcccaatagtgcaacgaaggcagcatttcctaagagaaaaacataaattgtgaaaaattaagctatcacacatactcccaatcccaaacactcgttctcataatcaaagctacagaaaggacctgcttctgtacgccaagtggagaccgccaccagcattcatctcgatagcctgcagtgcatacaagcaagcaacaagttagaaattggaacaggaacactacatgatagtacctgtagcacgggagatgcagcttccttgacgccattttcaagagaaaagaaaaaacaaattggcaagcacactttgcttggtaagaatggggtgaatcctctgcagagacctcagtcaggagggcttccgcttcggcggcgccacccttctcgagggcggcctccgccttctcacgcgccgcgancgcggcgagccccgccgccgcgtcgaatccggagtcgccgagcaggtgctccaggagctgcgcggcgcgcgcggcggtgcccacgtggccgaaaaacgcggagcagcagccggagacggaggcgccgaagtttgggnccgncccgcagcggccgaggcaaccgcaggaggccangtcgaagcgcggcggcgcgagcccctcgagcgccgccaggacctcgcgcccgccctggcgcgcgcacgtgcggttggtgcagacccgaatctccaccgccgcccccgaagctctcgccgtcgtgggactccggcggtggcgcggggaggcgaaggagcaggagaaggcggttgcagccgctgccgccatcgccgccgacgaactctgatgaggcggggggacacggaggtggagtaaagtaataatacgtttttttaaagggtttctttgcaaatttccgcggacattttccgggtccacgagccaaaccggatattctgatctcaataccgacccatgtttttggtgggccttacgaaagcctgtctctagcgagcccaactttagtgggcctaaatacggttagggaggatgtgcggcccatgaaggctcggcccattatactgcaactaggcccaatacctagccattcagagtttcggacctgtggctatcgcggaagggagcggcggcgaacccagctcggtgagtcgtcgtcggcggcggcggcgacggcgacggctaggaccacgtgacgcggatcagctcggaggcagcgacgacccatctctgatctccctcacgttcagaggcgcgaccaagcgtcgagggggagcgctcgacggcgaggtacgcgtgtgcagatccccttcaactctaggtcgcaacgaagcctcgacagtgttcccaaattttcttgatttttctgtcacctgctagtttgttgatctgcttgatttgtttgtcgcctgctagtatgttgcaactatcggtgctaatcgatttaggcgattcttgcacatctttctgtgttgactcgctggtgttagcctgttaggagtgatgctctctagctgttcgatgaaatgcctgataaaagcatctttccacgccaatatatctatacatttattcgcacgatttgttcccctttgctaatgtacctatcaccatcgatttgcatgcgataggatcattggatcattagattactggtgaatgtcgtataatgatttttaccatacaaagtattgaacaagaatgcaagtggcttaatggttcattgttctttctgatttctttttggtttgtagag

SEQ ID NO: 2116 - DNA, 1406 bp, Oryza sativa
  misc_feature (27)..(27): n = any nucleotide
ccatcacaaataatataatgtatttanttttttatgaagaaaaagaaggagcaaaaatgaaaaataagaaaaaaagacaataataattagtaggagtacctaccaaccgtggactagtattacctgctgaccaaccgaccttgcaaaggaggcttatatatatactccagtaaaagctgcctgtttcatcgatcatcgatcacagacaaattaaagcatacagcaattgattcagagtagttagcttaactagctcctctgctttaattagtttgccccttccaggtagagtatatatgggtagtataggaggagtagcggtggtgctggtgggcatggcggcgatgctggtgggcatggcgtcggcggcgacctacaacgtgggcgagccgggcggcgcatgggatctcaccaccaactacacaaactgggtcgcccaaaagaggttccatccaggcgaccagataggtatgcaatcagaatcgtatcgtatatatcgattggctgggctgccggtgaatacatatatatggtaatggatggggatggttgcagtgttcaagtactctgctcagcggcacgacgtggtggaggtgaacaaggcgggttacgactcgtgctccacctccacctccatcgccacccacaccaccggcaacgacgtcatccccctcacctccaccggcacccgctacttcatctgtggcttccccggtcactgcaccaccaccggcaccggcaacatgaagatccagatcgacgtcgtgcaggcagattcctcctccgccccggcgcctgtggccaccactactcccccttcgccgccctcctccgccgccacctccctcaaggccaccgccgcagctgccgtcctactcgccgccctcctcatcatggcttaattaattaatactcctagctgctagcttatttgttttcttttccgatcctgagagagccatgtatactaccagtcccagctagctttttgcttgtatcctcatccatccggattgattgtacttatatgattagtattttagtctttagaggaggcatttgattatatatatgtctagtactatgttgattatctctcatgcattattattatttaattaattgtaggggaagttcattaggagtactttcgattggtcaacaacgcaagcaacttaactaactaacaatagagtcatatataacatgcaatgcaaattaatgtatggatcacctgattaattgggccgtcgttccattcccagccgatcgatcgcttcaactattcgatatatatatagctgctatatatatataagcaggatcggttattaatttatcgagattgattgattgatgtatggttatggccggcggtgtggtgatggtgatggtggtggcgacgg

SEQ ID NO: 2117 - DNA, 20 bp, Oryza sativa
tatatatgagcgggagcaat

SEQ ID NO: 2118 - DNA, 2000 bp, Oryza sativa
tgtagagaacatcaagcagagtgccaactgtggagggaggtggaagttatggtaatttccacttttccagtcatgcaatcaacttggttgtggacaaagtcatagtcttcagggcagtcttaatttgttaagctaacttatgttaatgatttggtgtatgtgggtattgaggcacccattgaattcttgtacaaaccatttgcacatcctcggtttaaaaaaatgtgcatctcccttatattaaatgcaatatgcatgcttgttgagaacctctgtatgtaatagcaagctgctaactgtttttaaagttggaaaattaattaccatgcaattgatggtttattagctgcaaccagggatattagagggaagaaattcatttgttgctgggaaagatctgagtgccctatagttacaaacaaacaaaagaagaaatgctgttttaaaaagatgaacacaggaagcaacttctaactttccatacagcgtacaacaaaacaaatgttatgtgttgttactaggttcaaagcaacttcctcacttttgcatacatgcagatggaacatgaaggacatacatagacacgtcttaacttaaacaacatatatagacaggccttaagtatgtgatttactacttgttcgcatgtgccttacggaagtgttcgcacgtgccttacgtaagtacatatattgttgatctccacgcacacagcacaattgagtgcacgcattggtgcacagattgtccatcgcgcaagaacacacggaggcaatgcagcatgcctacatgcaaagatgaatgcactagagcaagcgtagttgcgcctttctgcgtcgattgttagtttgttacacaatgataccttcaaggtggtgtcataacactgtgctacgtgctgcaacactcccttattatccagaaatcctcaacgccgagttaactacagaaaccagacctaagacaaaataattccgaaacccctaactccacgtaaggctccacaaacatagcagatcgccatccgaattgtctaaacggatgatcccgaacggcagtaagcaaccagcgaccagtacgacgacctaattagatcagcaccatttcaccaccccggatcgacgcatgaatctaacgcgagcaagggcaacagctctaatctctcaaagacgccggagaaataccttggaaggaggtctcctggccctgggcggcgcacaccaccgacacgccgcgggcgcgtcccgagcggagccggacgaccggggcagcgcggacgccccggcactgcgggaagaggcgacgctgcggggttaccgcggcgacggcgacgggaggagacgcggctggcttggcgacggagacggcgagggcggaggaggccatcggcgccggcggatgtggacgggcggtggcggtggcggtggcggttgcgggttcggtgaggaaggcgacgagtctggtggggatgagactgagtgaggtggacagataagctggggccgcgggtcccccgctgggccgagggatgatccggcccattacgggagaaagcccaaacggcccgtgagcccatcatctgggacgcggagcgagcaagcccaccacccacccaccctgcctcgctcgttgccggcgagcgacgcggcgacgcgccattgatttgcgcgacgcggaagcctcggcggcgcgtcgggttctcctcgttttgggggcgcatgtgcgctggcgcgcgagaagcggcgagggagaaggccgatggccacccatgccatgcgcctcctctatcttcgtcgtgtgggggtgagactgagaggagggggggcgctccgaggacgccggcgagcgaggcgagcagccaaccgcgcataagtttaagggcagccagccatgagccaccctccgagatccggatctccgcgcctgcgtaccatcgatctggcaacgaagcggcctgcagcggagcagcgcggcagggaggaagaagggaggaggaggag

SEQ ID NO: 2119 - DNA, 2000 bp, Oryza sativa
tttttatgaacctaggaccatgatttttttatgataaaacatatttttacaatggtatatactactattggtgatagtagatgccactcagtagtaaggaggcacatcgatcaacatcaccaacgagaagaatgtggtaatccatagcagaggaagcattataatcaatatacggttgaagttgtggcggccaaggttgaatgaaggatatgatatggtcatgactatttaattcctacaaatgagactttcagtgttgttaactctaagcccaaattttaatttttgataatcatgtcttcatagttcatatatatgggtttgaaagtaaacttcatgaagttttaaatatctacctaagcacatgttgagaggattcaccaaagtatagtctatgtgcatggcaataaatgtagcatcaatttcaatcgttgggcaccctaccagggcctgtttggaagattagcccagggctaattttgagagctaatgtttagtcatgaattggtaggctaaacattagcttacgatggcatgtttggaaccatgggctaattcaaagctaaaaggtggagagaaagtagaaagagaggagagagaaggagagagagagagagctgctttgctttttgatggtcccaacacaaaattagccccattagcaccccttggaggggctaatgttttgaggggagctaattcatattagctcaaaattagcccacatgtttggatcattgaaggctaatttgaggctaaaaggtgatggctaaacattagcccatggaaccaaacagagcctagaaacctttgattctacatattaattagagaggtgcctacaaaatcattattatcttacgtgcaacatagcgtgtgaacaaggaactatgatcaactttttatgcacttcacattttaaaaaaatgagtgtaataaaaatctgtcatgtcagatgacaaatatctttcaacaaccgaatcattctctagtcaagttttctctgcttactcttactccctctccattgcacattaatagctttcaagcaatgaacatcgcctcaagctccaaatgagggtggatccttatggtctacactacttgaatgccaattagaaggatttctggtggtggaatctatccactcggattcaagtcctaaacttaacacatgtgcttgtatttatagctaattaacgacataaccatcgatagtgagacgactgcagcgtcttcataaatttcaagatatgtttgaaggattcatgaaggtattcattgtcaatcaactagtgtattatagcgtgtcgatcctttgtacaagcggcacgcaaaggcatgccccagcatcagctaattaattaatcaatcgattaaattaaattctagttggttaaagatgcaatatatgtttagctagcacttgggcggaagcgcggcagaggagttggtggagtagtcatctattaactagatagtacttcgcgtgttgctgtgaaaatatgtatgaaattgacataagcaaattttataagataaaattaagtgacattggattggtgtgcgtataaaatatagtacagcttaagtaaacgaagaaacgtacaactttgaaattttattaggaaaactttacattcatcaagtaacaaaggaggaagctatgataataagttgataccatcaacaattattactctattttgtggtaaaaatagaataacttgatatagcatattttctcctgaataaaacgtaaagggcgcaatgaccgtaatatagtgttggctggtaatctattcttgttatttttgttatgttttgttttggaagatgaaacaaagttttattatgtatgcattcgctatgaaaaaccatgtctgtcttgttagggttatagatatcacatactcaattaatagtaatcgattaagctcggcgggacacaccacatactaagtcttatatggaatcatacctcgtatatagaaggacaa

SEQ ID NO: 2120 - DNA, 2000 bp, Oryza sativa
  misc_feature (368)..(368): n = any nucleotide
  misc_feature (1069)..(1069): n = any nucleotide
  misc_feature (1762)..(1762): n = any nucleotide
gatctaaataatgcatcagaagatgaagatgaagatgttggtgatgtgtgtgggcaatctttgaccatggctgcaaatgatgtgtgtgggcaatcctcgaccatggctgcatatgatgtgtatgggcaatcctcgacaatggctgcatatgatgggtttgggcaatcctcgaccatggatgctcctttaatccaaggcggatttacaagtcttttatttggagttcagcgagattcagccatggctgctagaaagttacatttcaattaatagcatttggctcaacctacaatgagtaggctttttttgaatagattttggtgtatccatgaacctgtactcttttaccgtgttgcactatattttantttcattttgcattgtgttacactaaactatcattgacgttgtcagttctatccataaatttggtagctatgtatgatatatgaattatctacattgtttctgaaagaccagcttctagacatcacattctagatttgaacttcaggatttcagatcacacaatatttcatattttatttttgaaaggaatcagatgaataatcaaaattttcaaggcatcaatcacattgcagatttcagaacatccaacatgccatatgtatttcaaataaaagaaatacattgtacagattacatagcgatctgagtttccttgcaatttgaccaaaaatgcggtccaaacttacagcatatggactacaatccttgcatactcctaagagtatacagactacattgtatggattaacagcgaaggctacattcatcaaactacaatccttttagcaccatccacttctgcctgctgtatttaccatccttttaggcaatcaattttcctcttttgtattttgcacaaggttacaatagttctcaggataacttgacatctggcaaaactagttctcaggatacaaggtgttctgaatctttacaaactcctaatagtgtatatactacatagtaggaattacaaagaaaggctacattcattatcttgtcattgattgttctatgtcacttcttcagcatcctctcnttcatgctcttccaatcttcaattgccattcatgccgcaccccatatatctcacctgcaattctgcattggcctcaagttgccagctgccaagtgtgccaagaacaaatatctgatttttgcaactgattgtgctgccatgtagtgcatataaaagaaaaaagagagaaaccaaatgtggttcagttcagatttggctctgtcttgtagtgacagaaaaagagaagccaccaggtggttcagttcagatttgtcagggggaagccaaagccttatgtttctctagttgtttcaactattttcagtggaagtgtcacagctgaatatacaacatgcaacatatcttactcctccactatgcaatttattcagtgtgatactcaagtttcagatttttgcctgttttctggtgacctattcctagtcaattttgatgtgagcctactaccccactttgcaaaatgtccaacaattttactgatatgatgattggtcggccaggcaccgagcgagttgccaagacagaatgtatgttttgtttatgcaaaacaaaaaccgattgtctcaaactagtactaattaacactatcaagctgcaatgatagatgctaggcttactacctaatcacatgaaaaccaaaactgagcaatcaaaccagaatctagtgaccatgattaactaccgcaatgaaanccaaaaccgagcaatcaaactatgaaactcccaatgcacgggagggtgccgcctggcccttccaccgtcgctaccctgctccaggcatgggagggcaccgccactgccctgctctaggcacgggagggcgccaccactgccctagctgtccgagggagccgccgccgcattccgtctccacgcgcccaacagcggatgagaaaggggcgacgggataagaaacaggcggaggggaacg

SEQ ID NO: 2121 - DNA, 2000 bp, Oryza sativa
acactattaatctatgaggctctaatgtccaataacaattgaaaattcctccaatagaaaggtatttggaagtttggccatggacccttactaattctaagctacattgttacataatccttcatgtgaaatcttgactaatcttaattgaagcttcaataaaaaaaactaaaaaaaaattctatacctactacatatttacaacccattacattctaaatcttaatgtacaaacaaaccatatcactatccgctaataattattacatcttaatactcatgcaaacattcccacatcatctactacaatttattaaattaaagctccacatgcaagcatatcaaattatcaccccttatcatttctaagatatctcaacatataccattcatcatttctataatattaagagtacatttatccttgtattcggcagcaaaagcgtgggtcatcattttattacttctactttggtggtcaaaatatctatgcatgatcctcacactatagtttagatcttaggacccatatttactctttttttttaataaagaaaccaacactaatataccaatttcattgaatatagcagaagaaaaggtattgaaaaaaaatgtaggagaaaggaaagcactaaggaagtagaagtgttttgctcctactaaagccaagttttggcctcctccttgatttgtcctccgagagatgtgacatacagttctttgtgtaaaaaaccctatgattcctttcctatcaaatttcccatgccgtaaggaggatgagggtgcaggcttcttttttcagtagtcacatgtgactataatgtgataaaacattttattagatcataatttggttggaactctgttttattgttttatcatgtactccctccgtactcgtagaaagtcgtttaggataatatttaagtcaaaccttgggaatataaaccatgaataactctcaagttgttgcgtttgaaaatgtaaaaattatatgaatatatttgtcttgaaaaatactttcataaaagtatacatatatcacttttcaataaatatttttacagaaacaagaagttaaagttgtgttttcaatactgtgtcgctgtccaaaacaacttcctttacgagtacggagggagtatgtattaaaagaaatacaataatcctctatttctaaataactacaaccaactaactgcaattattgtatactaagtaagttcgattgaattaagtaaaatataattttgctgtggggtctccagtttagacctgaccaaagacttgaaacttgaattcttgaaagatgtaacgcaagcatatgttgcggtcaagttgatgcgcttaatttgcctttggctctctacacattcaaaaaggggaattcaaacgtatttacaaagtgtaacattctagatgaatttgctgccttgtcaaatgtcatgttagtctgatagtctcatgccttgactctgctgcatcaacttattatattcgagtgataactaatttgccttcttttcgaggacctaaatgctaatttgcttgcgaacagaacatgggccaggatattccaaagatattcgagggctggaaaacatgggccatgcccaacttgagcaaaacggacagcccataaaccgggagtacctatacatctttcgaaagatttttatgatcgtatcacatagatttttaatctttagattaaaatccgatatatataataaaaggcaaaaagcaattaagaaacaccataatggatactaaattaccatatcctcaagaaaaagaccaaatccaatacaaaatttaaaatttacatgcgaagattcaaaaattacagtgtaactaacaaaagttacagtgtaagtttcataaattacactgtaacttataagaaaaggcactgtaaatttgagtgagaaaatcgagtgagagataagaaaaaatctttcgagtgagatatagcaaaatcgtaaagggatatattc

SEQ ID NO: 2122 - DNA, 2000 bp, Oryza sativa
gcgaggagattgctgagtactgaccgtttgttgctgcaacgttttcctcatcacttatatggtgtagtcccagttgcatgtgcacaattattcagccctaattatacattaagtttgtacttatctcatgtgaaaaagactctgccagatgctgctcctgctgctgcagatccaaagccaaattctcattctggcattatctttctctccattggagactcttgcagtgcagttttgttttcttccgtgtattgtttgtgtcctggacattccattttgcactgtagataatcatttttgtttgctcaaaattcacgtgttcttggcaagatgtttcagacaattaagtgagaatcctgtcggcacgatgggatgtgtctcacctaatttctctcttgatgcctggcaattaagcacgaacagttagagccaaccatggcactagattaggttattccattggataattgcgacgtctccacctgtaatttggctgcctgcataggtgcatagataatccagagaggtcaaccagagtggttgcaatagcaaagcgacaatagattaaatttgattgatgctgggtagtagtacgaactaagattgatgtcacctaatacatacagtacagggctacctactgtagagataagagctcaattatctatcatacggctactgtcatcctcaccaaactcctaactgaacaagtatcaaaatctttttaagtcaaccatgaaagtagaattggaagtgtaaacagtacagctcacctgctatgatttatttgctttttctgttgtaagtgttaggactatttcagtatagccaggaagatctgacaataagattagtacagtactgtacctttgatagagtctcatagaagttagggtgtgtttagttcacaccaaaatttaaaatttgtttgaaattagaacaatgtgacggagaagttgaaagtttatgtatgtatgaaagttttgatgtgatagaaaagttggaagttcgaaaaaaaattgcaaataaacacagccttactcttgatcatacacaatctaaaaactaacaggatgttcagactctttctttttttttctttttttgccaacttaagtgaagcattacgaggtttaacgcacatttatgcatggttaacagtaaagaaacgaacttagaatcatatgccgttgcttacacgcgcaccaattgacacctacagtaaacatcaagtgaccatttcgggcatgttactctttcccactactagtttaactatcactgatttatttttgaagcaagggtgtatcataatttgagggcagtaatagccgtcgaatgcactgttaaaaaatagagaaattttacagtcattaagtacttcaaaatacctaaaatttgcactaatggtattttagtttgttaccgtgttaaaatattggcaaggtctaaacctaggcaacttttggtagcactagcagtgccaatttctttgacaacttatgtgtgttgttgacatatttcggtagtaaaccaaacactagcaaagttactatttaaaataccaataatttggtagggcatattttagcatcaaactaaaatggccctaaaaattttcgtgcctcatgatgctccatgtaccaaattttacactgttaccttctggtgatgctaaaattaacccaaaaaattagattagcaggagtccggcgaattcgcgtggcaacacggtaattaaatttactctcgatgggcgcacgttgcggtaattgtaaacgaggggtttaaaaagcgcgggagacccgctccaccttccctcctctcctctcctctcttctcttctcgacctccactcctctccacccatcgcggccataagacgccacctccccttcccaccacgccatcaccaccaccaccaccacctcaccgccgcctcgcacgcagacggcgaggcttccggcgcggcggcggaagagtagcgcgagcgagctgag

SEQ ID NO: 2123 - DNA, 1655 bp, Oryza sativa
  misc_feature (46)..(46): n = any nucleotide
atttttccttaagaagtcaagaacccatttttgtgctttgttcctngctttttatatggagttattatagtaaaagccttttcttttccattggtcgtgtagacgctgcagcttcggaagatccgctcttcgtggaggttgaagccgacgtttggaaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggaatattctcaacacctggacactatgggatggttggattattatggaattggattcacacctccccctctattcaaaaccctcaaaatggttttagggtgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgctgccgggggtcgatggacatctctagggcaaatgaagcctacacgagctgcggccgggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtatatcgtggtggtatgtggcacgtggttacacgtgaggaagatgtgtcttgtgggtaaagatgtacacctctaatcaaagaataatctattcgaatagtcgcgccctcggttatgggcaagccgagcaatgtacccaagttagtgttttaattcttaaaacctgcttaacaactaaaatgtggaatggttggcctgggttcgcttgggacgagctgggacccagggtcgggttgccagttcggtctgaatcatcgtaggccttgggttaaggcaggttcgtgtgggttcacggccttgattaataatattgtatagctctagaatcgtgtttacaaaatagctttgagcaactaagtgtcttttaatgctgtttactgcaaaccctaaccctttatattattacccccttgtactcccctgcatttattctgcacttatgggtgtgtcttgttgagtacggtggttgtactcagtcttgctcaatttttcccaaacccagaagaggagcccctagaagatgaaggctttggtgtctagctcgtgcctgccatcaagcgcctgtggtcgtcgccctagtcttccgctgtttttcgtttgtcttcttgtgtgctgggtcttcgccgcccatgtaataaattaattaattatgcttccgcttgttaaactctgaattgtatcaacttttggtgtaccttgcctcctgggacaaggaata

SEQ ID NO: 2124 - DNA, 2000 bp, Oryza sativa
  misc_feature (1128)..(1128): n = any nucleotide
aatacgaattatactatcttactaaaatattgacgaataaattaatagaaagggaaactataatagcccgtactattgatggtgtgtgggcggcagccttcaaacaaaagttacctcatgaagagagtatatctcaactggttattgtaagtttgtaactgaattactggcatatatggcggggaacacggtctatgcacgtaagttttttcgtgtatatcacaaacaattctagaaaaattttattacttttagtggcattacatctatatgtaaaattttattttcaaattcattatatatatgaaaaaaaaaacaaaattctaacatatttatattattaaaactataatattttttacggctaatataataaatttgagctaagactttacataaagtgtaattttattcgacgcggatataaaatatatatttttagattttttttatgaaaatttgttagctgacatggtgtgtacgtattcgtacatatgatatatccctgcatagtgtgtgtcttagactctttgttccactagtattcgtttaaaaaagtaaaggaaaaaagtataccgtaagatccctctacttgtcatcgagttataaattcatcctccaaccgtataaaactagatattcggtgtcccttaacttatcaaaaccggtcagaataggtccttcggtggttttagcctcgcttttagcctatgtggcggctgattcagcgtggtacccacatagaccccacatgtcaggatgctaggtcaatctctctccctttctcctctctctctctctcacactttccttctcctcatccgatgccacgaggagggcagcgccgcgacgacggccgacgacggcacggtggcggagaagctcatactcttagtgatgccgctgccgccgaggaggaggaggtgaggcgagagcccaggggtggtgggcacgtcgtccatgccgaactgggtgctctcgtcatcgaagtggtggtgctttgcgaggggatgtgccagcggtggtggtggaggaggcgaagtgatgtactccagcatgtgaagcggcggcgtcggcgggctcatggtggcggaatagcggcgtcagtgggtgagcacgactgcgganaggcggcgtaagcaggtgagagcggcggcgacggcgggcaattgcggcggcggcgagcgagtgcggctgcggatggggaaaggcggaacgccgaacgacttccgcagcgctcggctttgtcgtcggcggcggctccgggcacgggcggagcaaggcggggaacgcggagcagaagggcgggtgagcggcggctccgagcggcaaccatctccgagagacgggctcctcccctgtcggctgctggccgccggcgcccatcgctgcggcgcccggccccgcctccacctccgtgcccacctcatgtcgcgcgtcatggagacagacacctcgtcagcgtggttcctaggctcgtcgctccgtgtcgacgcactcgtccaggagggcttctcggcgccgtcgacatagcaacctgataagagtgagagagagagggtgctgacatggcatcctgacatgtgggtcccatgctgactcagccgccacgtagaataaaaccggtgtcaaaaccaccaaaggatctagattgaacggtttttaagttgggagatgtcatatgtctgtttttgtggttgggggacgattttgtaactcaatgacaagttaagggatcttgggtgtactttctcaaaaaaaaaaaagagcccaaatatgcctctctcagaccaggccgtcgtatatacgagcccacccccacagagtccatttcaaacccccaacgtccaaacctaacggaacggatcggcgaatcccatcaagataactctcccacatcctcggcgcgagacgtgaacgaaacgtcccaagcctaccgccgccgcgaggatctctcgaatcgcgcaactcacagcagagggagaggaagaagccgagcg

SEQ ID NO: 2125 - DNA, 1320 bp, Oryza sativa
  misc_feature (4)..(4): n = any nucleotide
  misc_feature (6)..(7): n = any nucleotide
  misc_feature (769)..(769): n = any nucleotide
  misc_feature (857)..(858): n = any nucleotide
  misc_feature (930)..(930): n = any nucleotide
  misc_feature (1042)..(1042): n = any nucleotide
  misc_feature (1044)..(1044): n = any nucleotide
gggnannccccccccccccccccccacaacacaagcccgtgcaatgcatgccaccaaatacgaagagacacaattagtacagttctagatttgccagacaagggccctttcagcatcttgttcctaatctccgcgtcagacatacacattctgttattcttatatcttaatcagacagggcgcagatgggattgcatcatttcgattagttaatttgcaacgattacgactcaggcactactgttgactacagttggttaattttgttgaaaaataataataatttggctggctgttaacactgttttatcgtccttcatgttgggcttgactgaaaacgtgaaacatgatggttttaactggtgtatgctaaaaaataaaaaagcagatgggccgtacagagaaaaacagagcgggaatgaagaaaatttcagagttcggcggccggccgtgcgctcgcgtcaacacgttgtactggccgttgattctgcagattccgcgaatcgtgcggatgctcgccggcgcaacccacctccgccggaatctgcagcatcaacggccagtagcgctccacgtccgaccaaaagcagcatattccacggttcccccgggtcgagatgcccagctggtaggcctattttcttgacaaatttgaattttctggagcacgtcattgtcaagtctcatggacacacaggacatttgaaaaatactaccacaacataactaaatttataaaagaaaatcatattttttgatatactattcntgttgacacaagctcattttttaaactttggatgaaaaattaaaagcgtctaaaattgcgtagtaataaccttttcgtcgacgaggcnnaaatcggctgcacgtgttgctcgccttcgcacgggcggaaaccggaaggagacccgcgccgttgtttagttnggggagagaaggagagagagagagggcgagtaaatacggaaacgaagccgcttgctttcggtttcctcctcccccatttccttggattttgcgaggtttcctcttcctccangntctcgaatccgagcagagaagaagcaccagccggggaaggcacgggaaccctaggttggctgcgccgccgcacgcacgcacccgctccctttcgtgctgctgctgctgctgttgttgccgccgcctgcatcgtccccgatccgccggccagccagctagctagcgagggaggccaggtgaggcgctctcggcgttcgttgcgcgtgtggtgaagtcttcgggtggtggggatcgcgaatgcgggtgggtttgggggaatttctgtgagggtggtgg

SEQ ID NO: 2126 - DNA, 2000 bp, Oryza sativa
gattttacaagtttgtgcatttttgtgttaaacatatatttgtttgggcattttcttaattattctccagattataaaggatggggtccacatggctgtgagggaccaatatgcaaaaaggcccttgaggtttctaggaatcaacccgcagtcctaggcccatatgtcagtgtgtttctacaattgtaaatggatccctgctgttaatctaattcaaaggagacatccctctgctctagacagagcagagctagcgatggctgagctcgatccggcggcaaacggtgtctcgtttgaggttgaggtcaaaagataaaatgaagagcaagctctcgcgattccattcctctagttttcttggttaggggacatcggagtagcgccgatggcgagtgtgagcggaaggtgttttcgggtgatggtgcatgtgcatctacagtcatgtattggttaagtgggtgcatgcatgtgagtatttgaggtttcatggggtatataacatggttgttggccggagttgatgaggtccggacgatggcggcagcacacgaaaatggcttggcgacggcgcttcactccgggatgacgtcgacggcttgatctaccaatccaactggcatgcatgaggtcatacgttgttagcgaggtctcagggatgcttcatgtgcaaagaatcagacaatggctcaccagagaaggcggaatcgaccatggcgacggtggcggattcaaatcggcgccggggaagaaaagatgcgttctccgtgttcttgatgtcttcggctggggttcttgaggcgttttgaagagtaggtcgaggtgagattcttggcgcagcggcttgctccgagatggtcgaggatggctagacgacaacgatgattgaagcggcgacgctccggtgcgtgctccagggcgtcgtcggcgtggtcgcgtttcggtggctgtgatgcacaaaacgggaggtggtcaaaagagaaatggttcggcattgtgtggagagaagggaacgcgaaaaacatacagatgacctcgacccaatcggcgttggcgaaggtcgtcgtcactacgaccggcagcgaggttgaggatgatggagaggctgaggacctctccctcggcttcttcagctccagagtgatgtgtggagttgggcgactcggtctggaggagatggaggcatgactcagtgacttgaaggcgtcgacacgtcgtcaccacgcgtcgacgcgtccaggactcggtcggctctcgatctctccctctgtgtttcttggtcggctgaggatgagggacagaggaagggcgagctggagaggctgccaggtggggccaagtcgatggaagctaggctctaggaagagaggtatgggtaggagtttgggtagacttagtttttggataattttcggaattatttcttccccctaagtttgcaactcaatatcttaatatgtggaccagaagaattagtgtagattttactggtggtagatgtttatatctagattccattttctttggttgcacttaaaaataatgggtagactgctcacagaaattaaacaaagataggctattagaaagctagattgaatttttaggaggcttaaacagaggaggaaaattctagaaaaattacatttattccatgataaataatctagtattcgaataaattatttcccatattcacttatgtgcaggtaaatgtacttttggatgaaatatggttttagccgattaaaatttaatttgatttcttttagttgtttgctttgactgattaatttgaggtatcaacttgagtgttaacatttgacaaaaagtacagaggataagtttgtgctaatcactatctacataaatttttccatgattttatcttgcacaaaatattttagagaattaggatgacctttgtttgtatatgtattcccacttcataattgcatctaatattattatagggattacattaaacttcttttagactgaga

SEQ ID NO: 2127 - DNA, 2000 bp, Oryza sativa
tgtattttatctataatcccatattccgttaggatatggactggtattttgtaaagcggactccttcccctatataaggagggtccgtgtgcctctcggggcgcaattcttttctccaatatatataatcaataacatactcggtggaatcatccccggacaggagtagggtattacttcttgaataagaagacctgaacctgtataaaattccttgtctccaaacccatccactttgctagcttgatagccacccccttttattattgccgaaatcttgtttcgacactccaatatgtctaaaaatcatgttttggtgctttttgaactttttcattccggtgaaaaacaacacacccacgtgtgccaatataggccaatattggcattaattgacaaaacttcaccgcgcgagtcacgagtgatttttcgacacggacgaacccaattctctatagtatgtccaaaaacatgtttgtgtgctttctgaactttttcattccggtgaaaaacatcgcacccacgtgtgccaatataggccaatattggcattatttgacaaaagttcgttgcgcgagtcacggagtgatttttcgacatgaacacacccaacatagttcaataagtccaaaaatcatgttttcgagctttttgaaatttttcattccggtgaaaaacatcgcacccacgtgtcgcaatatatgccaatattggcatcaatagacaaaagttcgtcgtgcgagtcatggagttatttttcgacacggatgcacacaatacactccaatatgtccaaaaatcatgttttagtgctttttgaactttttcattcctatgaaaaacatcgcacagtttgcttcttccttcatccgggctaggcacgtactccgagcacgcacgtgggccaatataagccaactttggcattaattgaaaaaagctggctgcgcgagtcacggagtgatttttcgacacggacgcacacaatacactccaatatgtccaaaaatcatgtttcgatgctttttgaactttttccttccggtgaaaaacatcgcacccacatgtgccaatataggccggccatattggcattaatgacaaaagttcgccgcgcgagtcacggagtgattttccgacacggattcacccaacatactccaataagtccaaaaatcatgttttggtgctttttgaagttttttattccggtgaaaaatatcgcacccacgtgtgccaacacgggccaatattgacattacttgacaaaagttcgccgcgcgagtcacggagtgatttttcgacacggaatcacccaacaaactccaatatgtccaaaaatcatgttttggtgctttttgaagtttttcattccggtgaaaaacattgcacccacgtgtgccaatatatatcaatattggcattaattgacaaaagttcgccgcgcgagtcacgaaatgatttttcgacgcggacacacccaatacactccaatatgtccaaaaatcatgttttggtgctttttgaaggttttctttatggggaaaaacatcgcactcatgtgtgccaacataggccaatattggcattaattgacaaaagttcgttgcgcgaatcacggagtgaattttagacacggacgcacccagtacactccaatatttccaaaaatcttgttttggtgcttcctgaacttttttattccggtgaaaaacatcgcacccacttgtggcaatattggccaatattggcattaattgacaaaacttcgccacgcgaaacacgaagttattttttgccaagaacgcacccaatacactccaatatgcaaaaatcatgttttggtcctttttgaagtttttcattccggtaaaaaacatcgcacccacgtgtgccagtataggccaatattggcattaattgacaaaagtttgccacgcgagtcacagagtgatttttcgacacagacgcacccaattctctacagtatgtccaaaaac

SEQ ID NO: 2128 - DNA, 2000 bp, Oryza sativa
gtgcttctccaagagtgcaaggacaacaccatggtcctgcatgatgggggctaaatcaggtgaagaaataatgtgggggaacacagagaaagaaggcgcagaatccgcatctaggcttcttcttctgcttggagtgagcggcttgcaaggagtgtcaaccttcgcaggagggtggccaccttcagatggaatcagatcagcagcatgatcagacgccattagttgccttcacagcctcgtctcacccggttccgccgagcgggagagattgcggctgcagcttctgtggacaacaacatcacacgaccgctgacgacctctgttctcttcattgtatctccccctatctccacggtcaggctctctgcttctgctagaggagcggccaccaaaccgcccccatagcgatctgcttctgtgcctccttcttgatctttgctcttgatgatcatcttcctcatcatctgaatgccggtcaggttctggtaagggcctgtaaggctccaaaggcctagagaccatcctgcttcttgctgcatcatcagtctcaccatagcgccactgataaccacggtagtagcgagccaccaagtcctgcacagaatcaacatgtatgatcataggataggttagtcccttttttctcgcccaaggagctggctgctctggctccaaatccgggaaaggggtgtcaactggggcactttcagcatcatggcgggtgatggtgaatcttgacgcctttgggatggagcttgggtctgaaatccagatccacacatcaaaagtgctgttgttgttgcgacggcgggagtattcttctacatagtgcactgaacatcgagggccaatgagcttggccacagcctcctccgttcttccatgcattggaatgccttcaatgcaaagtcgcactctgaaatggatgtccactgcttccgcattccttctctcgtcccacggccgaaagaagtactcacgtccgcttcttgtcaccagtcttggctgctgcagaactgcttcatgatcactgtgattggcgaaagtgatgaagaaatcttccgggtggaacttggtcacttggatgtcgttgcggtggatgcggtacgcagtgcgaatgtcgtctgcaaaggtactgagctcaacacgccctcccttgccagtccaggccaccactgatcttgcagtgaagagggtgcgcagcctttcaacttctccagtagcagacatcatgcagtggctcaactcaggcctggagactaggtcactggggacctcggccattgccgaagctggatggctggtgggaacagaggggggaacctgggatgttcttggagtaggaagaagaggagggaaatcttttttggtagggggggaggtatgctggtcctggtatttaaagagcctctttctgcatgaagaagataaatgaccaatacctagacagaaccaacagcggaggggatctctgcagtcttgcaccctatgctttgtacttggcaatggaagcatttaccttccatatgggtgaggaacctcaatcttcttgaatgctcatctgaggggttgttgcggggattgaaggcatggggaattggagattcgcatttcctccaccagtacttgggttttaccaaatgccaatctgttgatggttgggaggcgctctgctcagagagccgctgtgcagtaactctttcaacccgcctctcctcccccaacctggagaacaccgggggtttaaggcgagcctgcagcggtagacgagatgtaactggtggttgaacgtctctcaactggttagtcgctcgaggagcttgactttgcaagatcttgcttgggggctgggagattcgaaatgacggccgatgcgaaattgcagctggctggggatctttcctcagtacagtggagtaaagcgagcgatccattcttgagaggtctagatttgcagcttgacctgtaggcttgggcaaaagattttgaactggagaaga

SEQ ID NO: 2129 - DNA, 2000 bp, Oryza sativa
  misc_feature (418)..(418): n = any nucleotide
  misc_feature (508)..(508): n = any nucleotide
taaatgtctttgactcccagctgggtggcatatatagtacactgtactctctacagtaattaatgacataatatttgaagtcagcataacttgctagaaacgactaaagcaagaggtgcgcgtgcagaacaaaatgctactctgactcagcacactagctagtaactcgttgaacttgtacaaatattatcaagaaaaaactctaggaaatttagattgtgatcactagtcaagagggctgtgcgattgatcaggctatatacataatcatagattccaaaacaaagttgtattatatatatagattcttatagcactgctggagaaaggggcatcactcccggttggtaaccctctaaagtcctggttttgcaactggaccacgaattcaagactaaagatgttaaaataaccaagngtaaagattgatctttattcccggttaccaactggaacaaaagagggtagcgccaggctctctaatccctattctcctcttttttttttnctttttcattgttctttgcatattgattttacaccaaaatcacatagatcaacatcacaaaatcgaacattgacatcacaaattcacacatacatcacaaatccaccacaaatccagacatacatcacaaatccaccacaaatccacacatacatcataaatccacgtatcaattcgatatacaaatttactaacacaatacactacaatttactaaaatatttttatatatatttttttaaaaaagacgagtgatcaaagttttgaagataaatagtcctattgacagttactaaaaggggaggtgaatggagtacgtgttatggctttatgcaaatttggcgtgtttgatagaagagaatatttgtgactacctgagaatacagatgtgatttgcatagaatagtgacaggctctaggtagtagatctgaagcaaaatattcgctaaatcaatatactcctatgttgttattagtgcggtctcactcaatcaccacaaatccctagaccttaattcagtcttgttcccagttgttgccaaacgacgaagccgtaagtagggatgccagtagttagtcccgttacccgtataaaaacccgtttactagttcatttcttacacgatagtataaaatttagaagaaaaaataaactagaagagagatatataagcgggcttaaaaaaaacccgcttgcatccctaccgtaagattattatatacgacaacagatgatcttccaaataggaggcctattctctcgtgataggtagaagggatcaacaactaattaattataccgtagtgcgtgcttactacccattaatcaattattataccgggataatgaactcagtctaaaatctctgttcatgttggtctaatatatattatcactaactagtctgatcaaaataatgcagaaattcctattctaaaaaaaaactgcagaaatcaaggattcaagggtgtacctgctgaattgctccggttgatcggatcagcttctgaaaatccacccacggatcgtaactcgccgctcgccacacgcccaaaccagtacaactagggcggcggtgcgcgccaacgccaatcgatcggccggtggtggcggtgacgcccggtgccggcgccggccctcatggaaacgagaggattggtgcgaccgccggagtgcgctccgatggccgattggccgcggcggcggcggcggcaccgcgagtcggcgagacgacgcctgatcaggccgccgcttctcttccccaatccctctacctcccggtcttgtactgtacatcatttaggcccagcaaagcccacgtagtccgttttttatgtgggcctcatcagtccttcctcgcaactaaggcccatttagcgaaacccaggctcgttggcccagttctcccctccgtcttcagttttctccaccatgagaggactgctacagagttgtggagtggatctccgcctccggtgagctccagctccg

SEQ ID NO: 2130 - DNA, 2000 bp, Oryza sativa
  misc_feature (595)..(595): n = any nucleotide
  misc_feature (613)..(613): n = any nucleotide
taacgtcggtcatatgcatatacagctcgaccagacgatcgccaagaacgctaagaatgcatcccacaaagagagtagtggcctcattgaatgctttctactggtcagcagtaagaactcccataggttttgtcacaccctaaaaatccccaaatgtataaattgttgcttaattggaattattagaaatgattttaaaagtctagaagaaaagatctaattttaaataataaattccaatataaaagtgggctagataaaattttattaaatacttcatttgattctatagttcctagatttttctgagatttatttaaggcaaggaagtatttttaataaatggaattgcatttcatgaataatttaaattgaaaaaggttttaaaagtcctcttttggctttgggccgaaagtcggcccaaaaccccctctctttctctccccggcccaatcgcgcccggcccagtccgccaagccgagccaccgctcgctcctctctctctctcccgctgacaggttggggccacctgtcagggcagtcgtattcctcccgccgcagccgcgccctaatgcgcgcaagccgccgctaacgnccttccaaattcgaccgntccttttccgatccgatcgaatcaatagaggggaaatgatcccgggataccctatatcttttctctttcggaatcgtcatctaaattcgtttggaaatcgtgggattcgagctcgattcagattcctttttcctcccgaaccctaaaccttccatcgccgtcgccggtcgccgtgggcctcaatcgccgtcctctagccctttataaggaccctcgagacttcctctctccgccgccaccctcgccgtagctcgccgccactcgtagtgctctagccgtgtcaagtcgtgcgccgccatcgccgccgcaagtccaaccgtgcgccgccgccgctccagtcatcgtcatcgctcgggaaggccaccgtcgggttcgccaggtcgtcgccgtcctcgtccacccctccgtttccgccaaagatcgccggagcaccgccatcgtcgtcgacccgatcgtcaccgccaattcaaactcgtcggtgtcgccgtccggttgccatccgccgccgtccgtgcctcggtaaggttcgtcgcgtcgcccgcttcacgtagatgccttccgtttgcgccatcgcgccgtcgttcgccggcgagcgtgcgtggccgagccgccaccggtggtgacgtcatcgccgacgtcagccatagaccgcggtagaccgattcgatctcggccgttcgtttccttagaccgtcccgtgcacctggtccaccgtaaacccgagcccgctgacgcaataaatctcttttccttttcaaaaataattctttatcgcgtcataattcaattaaaatatatataaatggtttaaaccaatttaatctttaaaaattcatcttagctcggatttagttggttcaagtctttaaatttttctaaaattgatatctacatgttaaaaatacccacatgtactgttcatgagtgtttatgtgctgttttggtgattttgttcttttctgcttagattccgacgttcccggagagtccgagtttgcaggagaagattttgaagagttccaaggccagcaaggcaagtcacacagatcccaaaagaccctttgagcatgttgatcccgtctaaagctattatttctattcaactattgtatttatttttgaatgtcattgggtggaaataacctattgccttgttatagccattttgttattgattacctattctttgtcacttggttaacaattggattagctaaaacattatatggttttagctaaagtgaatcggatgcttagccttgcttagagacactagctcatataaatgggatacttatgattccctattatttaatgatggcttaatgatagttcacgatggttaatcgtgattggttaattaattaatgtgccaactaaaatctga

SEQ ID NO: 2131 - DNA, 2000 bp, Oryza sativa
  misc_feature (1428)..(1428): n = any nucleotide
gctaatgtggttgcagatgccttgagcaggaactatgctgtgaggttcaacgtgatttggaacatctgaacctcggtatagttgagcacggattggtggctgccctagaggcacaacctacactggtggagcaggttcgcatagctcaaacaagtgatcctgagataacggaactcaaaaagaacatgagggttggaaaagcccgaggttttgttgaggacgaacaaggaacaatctggatgggagaaagattgtgtgtacctgaaaacaaggaattaaaagacctgatactgacagaagctcatcaaactcaatattccattcatcctggcagtactaaaatgtaccaagacctcaaagaaaagttttggtggataagcatgagaagggaaatagctgaatttgtcgctctctgtgacgtctatcagcgagtaaaggcagaacaccaaaggccagcaggcttgcttcagccactccagattccagaatggaaatgggaagaaattggaatggatttcattaccggtttgcccaggacgtcatcggggcatgattctatttgggtagtcattgaccgactcaccaaagtggctcacttcattccggtgcacactacctactcagggaagaagttagcagaactttatctggcaagaattatgtgtttacatggtgtacctaagaagatagtgtctgatcgagggagccaattcacttcaaagttctggcagaaattgcaagaagaattgggaacccgtctaaacttcagcacagcctaccatccgcagactgatggtcagactgagcgagtcaaccaaatattggaggatatattaagactttgtgcgcttgactttggtggagcatgggacaaaagcttgccgtatgctgagttctcctacaacaacagttaccaggctagtctgcaaatggcaccctttgaagcactgtatggatggaggtgtcgtactccgctcttctgggatcaaacaagggaacgccagttgtttggtacagaagttttaaatgaggcagaagagaaagtcagagctgtcagggaaagattgagaatcgcacaatctcaacagaaaagctatgcagacaaccaccgaagggagctcgttttcgaagcaggggaccactggtggagaaaccatctttcgtcggtcggccgaattccacaatagtcccggatgcaataaaaaccggggctaaagatgatttttagtcccggttaaaaagggtaacgggcatatttgatctttagtcccggttggtaacacaccaaccgggactaaagatcatctttagtcccggttcaaatgctatcagggcctgtcaggcgggatctttagtcccggttggtagctcggggatctttagccccggttggtaacaccaaccgggactaaagtcccacccctatantatataccttcttcctctccaactgcgtgcaagcttcaaaatctcttcaaaaaagaggggaggtcatgccaaaatttctagtgaatttattttggtgattacgtacaaatcggaggtgcctaaaaggtttgcaacttcatcctccaatgtttttttttgtcatattacatttgcaactatgttttgtacacttttttgtctccaaatttagttgtaagttgatgagaaagaaaatttgtgtggggaagaaagaatatatagaaatttagttgatttgctaaagaaggttttataaaatagttgagaaagaaaatatagtgaaagttaatcttaaataatagaaaacaaactaaaatgaaaattaaaagaagtaaaacacattaaaattagtttaaaactttagaaatagtaaataagaattatttggtgtaatattttatgatttttgtatgaataaagatatgtcattattgtatgactattgaaagagtttgtaattatcttataattattgtatgactgtaattattgtaagaataattatttgtgtacgattttttttcgacttatgt

SEQ ID NO: 2132 - DNA, 2000 bp, Oryza sativa
atcaaaggggtgaaaactcagtgatttactacggtacaccgtacaacaggcttcacaactggcaccatatgacgccacggcctttactgatttagcataccagcatggtggaaggactcatgagaaaagtatccaagtctcaaaacgaaagcatgttctagtttacagcagtaacacgactatggcaccaacgacgggggaaagagaaaaacggcaatacagtctcatacagaatgcaacacatttgcttccaggaaaagaatgacaagaaaatggttgaccatcgccaacgggaaggaattgtaggcagaggagctgtagcaaattaacgccttttcgctcctggggattgcagtaaccggcctgtgtttctcagagggctcgcgacttgacgatgtccatgctcatctcactcgggtcagtggcctgcagctccacctggatgccgtccagctccctcttgaaccgatccttggagctagcatacagcatcttgctcctcacccttgatgtatcaggagccctgcagagagtaagatgcacaaacacattgcctcagtgttacaattgaaatagcattatatagttctgttacattgggcgtttgacaagctgatggatataaacatgttttatgatgcttacagttaataatctaactgtcatgatttattcattattcaaataaagaagaaactggtagtgccaaacagcttgcagtgtttagagacataatcctgagatatgttgattaattcctgaagttatcgatccacaaatccaacatatgggaaaaagatcaattcagtgtctgtcaggctgttatctgtaattgtaatataaggttgctttacatttttttggcaaggaattcaattttctttacatgctaatatcagtttcttaagatccatggcttgggtgaacagtgaaacaatgggcacaaaagagctttagcagaaatgaccaaaagcagcattgttcctttagattattggcactgttcattgtctcactgacctcatttccctatcaaaattgttccttaccgtaaaagtagataatatgtctaataatcactagtggcagtgaggcattctcataaaaaagaacattttaagtacaggtagcgaagacattagtgctgataacaattttgataagcaaagagatgcctgatatcaaagtgtctaattttagatctatgatgctatttttagctaaaaattgataggctaataattatgcctctttcttgttcctgtttcaacctaatctaagctaattttacacttttgtaaaatagaaactatgaaatatatttctgcgtttccctttgataatgaatttgaagtgctaatgtgcttttgaacaggtgacaaaagtgcagttaacccatcctataaaaaagtgtttcgttacacctggtaagtctgaagatcgaagggaacaccaaactgcaataatctaacgtaagcaggcaattgctcacaaacaactcaatccaaattgagacttttaggtcagtaactgccacacgtaagatcgaaacaaaaccaaacataaaaaatatgctatgtaaatagaaatttacatgttgatgaaatcaacaagaatatgacactatgttgacaggggaattgttaccaggagatgaagaatatcttgctcttctggcagttttcatcagtgacaaagtcaaaatcaaataccgcgtagcggcactcatctgctggtaagcaggcagtgaagtcgtcatagctctcacccggctgccccaacctgtccaccaccacctgctggaccttctcattgatcttgaacacgatgaagcggaagctccttttcgccttaagttccaggaacttgagtttgcattcgtcacacacggccattcccgacgccgaattcgacttacatatccccacaacatacaccatttcgttaatggacagatcttgatcaacattctgaacgaaagagattgaactgcactcacc

SEQ ID NO: 2133 - DNA, 2000 bp, Oryza sativa
gttagtcgtgaggcaacgtctgcaacttccaggaggtgaaggttgatcaagattatatcaataataaggattatcctgagcaaggcaagtcatcactattccttgaacatgttgatcccaattgcgaaattgttttgtttgcaaataaaattgcatgcaatgatgaacatcctacttgtgattatgccatgccttgattattgtttacccttaaatctttgtaaccatgtttacgtatgagtccctagtcaactatgacaattgcttaggaatgctattctagaatcatacatactcatatttatcaaatgctatatgcttgggcaattacctttgggaaggtaattgagatgcggcatgtggagacatgagcgccacattgccatgatgttgatgacatgatttgtgaaaggagaaataaaattaaaacaactgttttcgactggggtggacggaggatttgggtggtatctggaaaaggctagtaccgtccccagtcaattaaggaccgagccatgaagttaagcatgaaacgacccccgtacaaccgtacttctcgaatgggtatagacctagcggattagatagccgagcggaggcagtatcccagcatagatggttcacccctgagtgaggcaggtgcgctacgatgggacagccgttgaggtagggccgagaagcgtgccctacatcggtgtcgccattggtaggactgccatgagtgtgtaagagagagaacttaacttgaaccataatttaatatgcgtgacttctctttcccgggagcgccagaactcctctcactgctagaaacatggacgcctagagtgcatgaggatttaagttcatggagcgggtactgccaatgcgaggttatcgaaaagctttgccgtgatgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtggggggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttgttgtggtggcttcctgagtacggttgtactcacccttgctattcatatatcttttaggagagtgttgaagagaagcccttgtcggtacgcttgcgtatctaacaagatgatcggagtgcggtcttgttctaggtctcgttccccagtcgactgcctgtggcatgttaaccgggcccttatattattttgtcttccgctgttgttctctgatagttgttggcctacctggccctaatgtaagtatttaactcttttagcctaaattcattcgtgatatgttgtgatccaactatgaatgtgtgtaccaactactgatccagggattgatacggataaacacagaagatttccgattcccaaaattgggggtctacactacgttaacggcgcggttagtcaacgtgcttgacaccgacgtcgtctaagctatccaccctaacatcctatgtgccgttcctatcctaaccacctcgttaaaaaccagttgtggaccctcagatcttcgacatttcaccgaaacaaccgctgcttcgtggcctatggtaagtggtttctagaaaaatctttggggttccacctttcccaattcagtctctctagggtgaggcccgtgattctgcagccgtaaaaaaaaacctagctcgattcc

SEQ ID NO: 2134 - DNA, 2000 bp, Oryza sativa
  misc_feature (121)..(121): n = any nucleotide
  misc_feature (350)..(350): n = any nucleotide
  misc_feature (352)..(352): n = any nucleotide
  misc_feature (357)..(357): n = any nucleotide
  misc_feature (359)..(361): n = any nucleotide
  misc_feature (363)..(363): n = any nucleotide
  misc_feature (365)..(365): n = any nucleotide
  misc_feature (367)..(367): n = any nucleotide
cgcggagagaacccgtcgccgtcgccaagggtccgacgaggtccagccgcgaggacagcggatccaaccgccgccagccggaagcgccgggctcggcctccaccgcctgccaaatccctcngccgccaacctgatgatgggttgataaatctccaaagcgatcccttttaggactccttgccagtggtagcatttccaaattatgcattttggtccctatttaacgccgtgtttaattccaaaataattcttcaaactttcaacttttccatcacattaaaacattcctacacacaaactttcaacttttctgtcacatcgttccaatttcaactaaacttccaattttntntgaantnnncntntnggactgctagcaatgttgttagcggtctgaaaatttccatctaagtccctacgcctttgaattgtatcgcccagcccccactctctcccctctgccaatgccaattcactcgctgtctctagaggcagcccacactgcacccatgccccttccgttgttctcctccactggaatctaggcccccaaacggcttcgccatggcttattgtctcagcgaccgcgcgaaagttgggggtttgggcagttggttgtttgcgattttcactgttcgccgtccatggtgccatggcaatggcagcccgccaccttagcttgaggatggcatcacttggggcgttgatcacggtacgtatgtttgccctccgttggatctggtacaaccaaacaccgctcgacgtccctcaccaccaaaagtcagtgcaaatgagcccttctagtttttgaattcacgaattgataagtatcactatatttggtcttggatttgtggataagtatcaagtcagggatgtccggcgatgaacttactaacaacatcctgtaaaccaatacaaggtatatcatcctgtaaacaatataaccaagtctcttagctatgtaaaggaaaaaatgttggttcagttgaatttcatggcatactttttttctttatttttttgtgactttacatgtcctttaacatgtggtttgattatgccatgccatgcagaataatccctgcggtcgcaacattagtaagaaaataatgtgcacaaaattcattcttgatcaattgatttactatagctatgttttccagggggaaactagttgtcctaacgtatgtttagttgttcgaatgataaaatttgcacttttagttattattccatcttcactttactatgtgttggccccctttttgggttaaggttatcaatcacatctagaggtttaaaactctatctattggctccatttgctccttttctagatgtgccaaactgccaataagagcagtgcatggacttttggttcttcatttactgttgggtgtgtgttttgaattgcatgtcaaggttcatcatttgatttgtgcttcgttgctaatatgctttatttctggctatatgatcaatgtaatttattatataaaggattgtaatttttttatttattaaatgatctttattttttttatagtgataagatatgtaacttatgcactttgcatgtttcaggtgaaatttcatcaatataggaaaatagattataccatcagtttttgcacacggtgagaaatttaaaccctttatttctaatgggggttacttcagttcatgcatgaacacataatgcactatcttgattccgcagcacatacttgaagttgttcatcttgggttgaaagaaaaaggtcaaaccgattgtattaattttgcagcaagccaacaaactaattgactggtggctatgctaatccttagcttaattgaggttttttagtctggttttggttggttccggcggaaccgtggatgatcgcccttgccacatacttgtgccgaaactattctcttctaggactaataacttcttcattctatgacttctcttatttctcagcggatgaaatttgactaggagaggcacc

SEQ ID NO: 2135 - DNA, 2000 bp, Oryza sativa
  misc_feature (1695)..(1695): n = any nucleotide
  misc_feature (1712)..(1712): n = any nucleotide
  misc_feature (1729)..(1729): n = any nucleotide
gcacaacatggaggaccaaatgtagccatcgcttgtggagatgaactggatgggatgtgctatcagcctataactttggccggcaatatgttcacatatcctcttcacctatctcgaattcattgtcacctccctgatggacacaacttcaacaatactgacgccttgaggaaacatgtggtcgccatgtcccaagttaccaacaacggatgctcgttttcccttgtcaaccagatcgacaaccaccactagctcaaggagaggtaaaaggggaaggagaaggaaatgggaaaaagagacagaaaagggattggcttgtgggcgggtggatgttttgctcctgcctaatttttcttgatggtttcgacgcctagcacaagcattcttgtatgtattttcacgtttatatgacaagtaacatgttgtacacgtagataatatggtctaaaaaaaaagaatgtatagaatgcctaatctaggctgtaagcatccttcctctctctccgaatctccttaaaaaagcaagaggccgaaagttaatagattctcatgaggaataatttggcatcaaactttttcggttgaacttatctagacccaaccaatgaataagtattcactttgtatttggcagtcattttgatttttcacaataatccagaaattttcatccctattctcaactgaaaaaaaaagaacggcaagcctggtaaaaatggattttcgctcatgcgtattaactgtatcaccgtttatcagtatatatgagtttgcgtaccatgtaggggttgttttgttctctaccttaccaaatcattggtaataccaaattcttgacatgttttggtactaccaatttttttggtaggatagaaatttattatacatgtttggattactaccaatatgatgtcaaatattgatgatataaagaagaaggttctagattagtgacaaattgatcattggcattatcaataatttggcttcaatccaaatccatactattactattcaagataccaataaattggtaggacacattttggtatcaatccaaaatcgctcgtacttcctgcattgcataaaaaaataaatctaatatgagatggagtacaatttttttatgaagggagtactacctctatttcaaaatgttattaactttaacacaatatcttattctaaaatgttgctatttctctatctaacattttctctcaaccaatcacaatcattttctatttaattttttatctatttttttctccaaccaattataatatttttccaatcattttacctgttttttaaataccgtttccatataaaaaatgctaacattgtgtgacggagtaatatgagcgtcatcccagttcacagatgcagctgctgctcccgaaccgtaataaaggctccaggcctttactatttctctcccaccttttgctccccaccaccacctacctctcccctcttattcctcctcgcctcctccccgcatccgtacaccggcgcgccgctgaattcctaaccctagcccttgcctccgcctctcctccatggccgccgcccccgcgtccccgttcgcgtagccctccatgggatccgcccgcgccgccgacgacgaagggaggagaccgaccgggggagaagaatgaggtgctgcgccagccgcgtggcgtccgccgggtnccgggccatgggatttncgggtggggtgaaggcnacttcgctccgcagcagccgccgccgccgcgagctgccgtcgccggccccgttctccgagcccttcaccgaacgcccggcgatcctatataattaactggccgccccgcgccgtctctcctccgctgcatcggtcgccggctctagctgctgaccgccgtgcgtagcgggcgcccgcgccgctccacgcgctgtcccggcgatctcgcctggctcatctcgctctgcttcctctctgcttcctgattcgttcgtgcgcgtggggtgatctg

SEQ ID NO: 2136 - DNA, 2000 bp, Oryza sativa
  misc_feature (1799)..(1799): n = any nucleotide
cgtcagataataaacacccggtggattcaattccccaaacaggaatagggtattacctctcattgagagggtctgaacctgtctaaatccctgtctctgcatccatccacttttaggtctcgtacgctacctccttttcatattgccgaaaatttgtttcgacaaaaacacaatcagtaatctttttcagcaaaaggtcatcggcagttttgatgcactgcacagagctgaaaagtcgttgaaactactcctctgtaccagatatctaaccaaaatcttttatattttagatcggatggagtatattggcataccgtgtgcccatggcttcgtttcaccggcctttcgtggaaggatagtgtgatcgctgccatttttgcattttgcagttgcaacgtcggtctcacagtcgtcccgctatatcgttgttgacgttgctggatgactactataggctacatccatctgtgcagagtaattggtaatttaaatgcctactatatattataacgcacaaacctctaaagtttggtggacgtgaacatgtttacacctgataattaccgtgttaatacgacctcagtagacaacaacttaaacaaaaaaaaagattatgataatagtgaaaacctagaaggtacaatcgaaaccttcgtatttgttgacacttgagcaatttctccactcctaaatactccctctatctacttttgatagttatatttctaaatctgaaaattttatttttgataggcatatttcaatccaacaacctatcatcttaatgactttctcggatttaatgcgtgactctttattcttccacacaagatttgctacatgggtatcgagaaatgtaaatattaatgaatcgcttgtttacgagaaataactagtagcatatttaaatagatgataagtagaattacttatccttggtctgtgtgccaagatgaaatatgacttttaaaaatagatggagggagtatatctccacctatatagactaaaaaggagaaaaagaaagaaagaaaagaaaccatcgatcatccatggaccatggttcaattcgtggcaacttaaccatgaagataggaaacatggaagggctactattattatactcaccgtggatcgaccataaaatccacggagagcgggagagcgcaggggttgtctcgcgctagcgcactcccatctcctcgtctcacctcatcttctcggcgctaataaaaagggaccctgagacttctccgtctcaggtcaaggcgacccgacgacgtgacgagagaatctctcctctctctctctctcgctctcgcgtgaggaatcctcgtccgtcccggtcccacgctctctcgctcgctcgctgacgtgcgggacccaccggtgctgctccgccagtccgcgtgccatccgcgggagccgcgaccgcgaccgcgaccgcgaccgctggcttccaccccaagccccccctccccaacccgtaaacccctccagcagcagaggcctttgcagttgcttcgccttctccatctctctgcttcttttgtttgtttttctttcccatctactccgctcctccgccgttgcctccccggctcgccgtcaccgggagacgcgaggtgaattccgctcatctccagtcccttctcttattttcttgcgatgatcttgcggtgttgcagaaaatagtttaaaacctgcgcctgttttcatctcatcctcctctcttgtggtttcttgatgagcgcaggcattgcttcttctcccatgcgccgccgcaatctcatctctcngttttttttttctgttttctgtttgcaaggtcctgacctttttcaaaggcgcgaaagattgtgtttttcatcgtcttggggggtgtcttctgtgatgtgctttcaagaaaccctcttctggtttcttgctccacggcggcggtttgagtctccgtctcactgataatccgatttggagcgcgattgcgattttggaggggt

SEQ ID NO: 2137 - DNA, 2000 bp, Oryza sativa
  misc_feature (108)..(108): n = any nucleotide
  misc_feature (1923)..(1924): n = any nucleotide
  misc_feature (1929)..(1930): n = any nucleotide
  misc_feature (1933)..(1933): n = any nucleotide
acatggtgaacgacgtatgcatgcagcttgaataatgtgcatattgatgagaagccaagaaatcaacaatcacaccattagttactcatcaatactgatttttttttngttttgcatatgcgctcatcaatcacgaacgaagtgagtagtactgaacacataaaagcgttgtacctctaaaacctgtttgcttctgaatgtcaatagtccatcacggatctcattcttaagaacattcactaggtcaattgaactctcacagcacttcagaggccctataataaaaaccgttacttttagattctcagtgttttaggtagtcagtacaaaatgattatcattaggggtatgacacttaccttcaccttttggagttataacctctgatccagatagaccaacaatatcgacaacactgacctttccctgaaacaaggttaaaacacagaacaattaattccaaaagccacaaaagattaggatgctatatagcttatatagaggaaaataataatgtttaccatgacttgcctaccatataaatggccactatgaataaaaactcaactctgtaatactaattccatggttctatgaagtaatctagtaaaatgaaaaaaaaaagtagggagttaagaaagaattatcaccttaaatatattcatgccatgcatttcaatattctcgcctgcatacttgtatggatgaacattctacagtacaatgtaaagaatgggagattagtcagtagataacagtcctttccatcagtatatctatgcacaaagagccaaccatggccacacaactttgcaatgaacaagaaagtgtagacaaaagttccacctttgacgggacaatctcgactgctggtgacggagggtgtgactctctctcgggcacgacattaacgcagtgggctgcagctttttcatgcgacaggaagccggccaggcactgtgagagaattgaaggtgaccgcattgcctgaaacgaccaaatcataatgacggtgaaaagaaatgtaatgcagtagcactgtaatgatggtgaaaataaaatgtaacaattcttcgtaatgtcaatacaatcaaagtgacgacaaataaagtgtcaaattatcaaaatcttgggcatgtaaaatttctttctactgggataactcttcttgaacccttctcacttccaaaggacacagaaaatcaacaactggggcacaataggacacccattcctaccggatgagatttcatagccggaaaacttacagctacatcacacatcaagagtacccaaagtagaggggaaatcgcaatgagctaaacccccattgaaatgccaaatgccacaagaaacggcccaaagacctgttgtcaacagctaaaactatagagccaagaaacatcacatccaagttccaacatcacaaattcaagagaagatcaagacatctcgaaaagagggagagaagatgaaggaagaaacacttacttgtacgaacccccaagatctgtccccaagaatcacagacaggttccaaagaaaagtcgggacaaaaacgcaaaattaatcaatcaagattacgaacaggaggggggacagatgatatgagatgagcagaagaaagatagagaaaagctaatcaaaacaggatgcggaagagtggtggcgagtttggcgactggtgagaccgaagaaactgcgaactgcttttctcagtgccaaactgccaatgccagtgcccccatcgatttgcgagataattacggaaatgccactagctccggggccatcgatgggcccgccccggcccatccggcccacgcgacgcagcgccgagaccaacggccagccacgcagcctcctcgacccgtgtggcttccccttcgctttacgcgcgcggcgcgaggaggcgccccagcnnggcgnngcncggaaaagggggagagctggagggagcaaagcatccatctgcggcgtcggcgtcggcgtcggcgacg

SEQ ID NO: 2138 - DNA, 2000 bp, Oryza sativa
  misc_feature (86)..(86): n = any nucleotide
  misc_feature (222)..(222): n = any nucleotide
  misc_feature (445)..(445): n = any nucleotide
  misc_feature (962)..(962): n = any nucleotide
  misc_feature (965)..(965): n = any nucleotide
  misc_feature (1455)..(1455): n = any nucleotide
gagccaggggtcgagcggctggtaggtgaccggcgacgacgaggacctgtgacgacgttgcttgccgccttgatgagtcactgcangacggggacctcgccgatggggattgaccaccggaggaacgcggcggcttgaaggtggagtgcgacggtggcgcgcgaggtcgccgagggcgcctcctcgctcgcctgcgggaagccgggaagggaagttgaaganaagggagagggaagaagagagaggaaagagagaggggatagggaagaagggaggtgaggctgacatatggggcccacgtgagccccaccatttttaattattttgtgtttgttgctgatatgtggggccacgggtttattatttttggattcaaattgccacataagctccacgtcaaatgccacgtgggacaaagactaagttaaactagccacgttggcgncacgtcagccaaaaccgccttccaaaccgccaatggacctggtttgcactggttttgatagttgagggacctgttgtatctggtttttcggtagaaggacgaaagtcggatttgttgacaagttgagggacctcggatgaacttatttcccccgtcgtaggccttctaccaagtagataagcccactaccaacccgtccaaaaccgcagaaaatcagcagtcctcaccaccctatggcgtccgccgccgttgccgccgcggccgcgccgctgcggcgttcgctccttccctccctcaacccgagctgtctcttctcctccctcgcgtcctcctcgcaccgcctatctctaccgcgcgccctccgccccgcgggccctttgccctccgatgtcgaagactcggacgattcgaatgccggagacggcgccggcgaggccctcaggaagagccgcaacgacctgaaacgggaggctcgtcgcgccgtgcattggggtatggacctcgctaagttctcccntcnccagatcaagcgcatcctcaggtgcctatccagcctaccttcacatccgattcttggtagtacttcttgttggagggcacctagtatgtgattcttgtttctcagggctgcgtcgctagatcgcgaggtgttcgacgctctcatgctcgtgaaggtacatcctttgttctggtaatagcttgtatatccgttgttcttgtaatagcttgtatatttgattgcaaatcacgtttttgtctgttttcttgttttgtagagatttggatcagatgtgcgggaaggaaaaaggaggcagttcaactatatcggtatctttacttactgggttaattggatccatgccactgcaaatatgtcaattcaaaaaaatgtcactactattcagtatatcggctacgtggcactgaaaattgtggaaattggatccatgccactccatcacgttttccgtcaaaaatctttattagcccccagctgcacgtgggccccnacctcccttccctctcttctctttcctcttcctctctctccaccaccgtagatgcggcaggaggtgtcgtctccgtcgtctccatcattgtcttagagaggtcgggccaggctgcgcctgcgtcgtcgttgttgtcgagcacctcgtctcggagccggtgagccacgcggtctctgtcaccgttcaagggaggaggaggtggtggtggaggaggcatcaccgacgactgagtacccatccttgccaccgttgccgaggacctccatgatgcgcggctaaggcagcggcagctagaggggtgcgctatcagcaaggaccctctcctcaattaatccatcgctagtacgctgctctgatggctcgcttcgccgtcgtcgccatcatcgtcaccctcctcgccgtcacggccgctgtgcaggccccgggagtggcccccatcccggcacccaagatggccccgctgcctgctcccccgacgaggtccccggccaccgcttcctccatcccggcaaaggacaagagtccatggtgcaacagtcacaaca

SEQ ID NO: 2139 - DNA, 301 bp, Oryza sativa
  misc_feature (49)..(49): n = any nucleotide
atcccctgatttgcccttttttcagaaaataccccctcgttttagcccnttattatttcgcggagtggtcccactgcttctagatgcgtggacggtggatcaaggcgtgagcccgaatctcaaagcgtcagcgcctcccaaaacgaagccctccttgctcggctgttcccttgctcccctcccgactcccgtcccccgccgccgcgcgccgccgcccagagagagagagagagagagtgagataccaagctcgaggacagcaccacgcgcgacggcgagagagcgtccgtagcccaaggcg

SEQ ID NO: 2140 - DNA, 2000 bp, Oryza sativa
tgatttgtcatctgcaacgtaactggcattcaaaagagaactaggtactaactgacaaacatgtgcaagaagagatccccacctactgttctttggggcccaccacacatgcactgatcagattgacaagtacacacagtggctggataatgcagctagtggcacgtaatagaaagtcatagcgtaaattcaaaggtgtttttgattattattctgtgatgaataattggcattggagattattggttttgatatttggaatttattcaagaagtggttttggagatgattggatttcacaggtgaatctacaggtactgctgttatttcatgtgaccggtcagaccggcggtacgtgcgtggtcagaccggctagcccacggtctgaccggccgactctgtgtcggtttcggtttcgggttggtttgttcggatatacgtgattgtttcattgttacgacttctagatggatactatacgtatgtaatactgttgtttgctactaatgagtcaagttagagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatatttatgctagagttgatgcacgtggttggtgaagattccatatggcatacgatataggtattgtgtgcgtatgggatgcggagtcgaatttggaaggagtccaaatttggtatgattggttatgtaaagtttgtttcttgtactataaggtttcctaaggtgtttagaatttctagtatgagtttggttcgtgactttaggctgcctacctcgggtataaatagagggggatcgtgaggcttcccggtatcgcttttgagagcaattgagttgagtttagagttagggtttcgagtttagtcgaaattttagtaaggagtgctgttggtgcactctgtaaacacagagagaatcaataaagtcgtcatccactttaagagttcttcgatttgtgtttcaccgggtttcggcggtctaaccggtgatataccaacggtcagaccggcggcaagcggcggtcagaccggcgtcggcgacaggaggcagcgacaaggttcggcggttagaccggtagatcaacaccggctagaccggcggctacgcttcggtcagactaatctactccggtcagaccgatctccatcgatttcgagggtaacttttatttccgctaaaagttttcggtttttgcgtaccaaccattcatcctccctctggttggcttagttattttgattcgttcttacaagtggtatcagagccttattttcttctttggatttttatcgatctagaatttttgccatggctgcttctgttaggttttcaactaagcctcttgtttttgatggaacagatttttctcattggtgtagtaggatgcaatcttacattatggctgaagattatgatatttagagaaaagtttctcatccttatgtgattcctgaagtaattaatactattgctgcaaaaactgagtttgaacaaaattgcaaagctcgcaacattcttttgagtgggatttctattatgatcgtgttgctcatcttcaaactgcccatgagatttgtaattctttgagtaattttcatcaaggaacaaataacactaaagaacttcatcgagatcttttcaaaaaggaatacattaaatttgagatgaaacctggagaagctttggatgactatctttctaggtttaacaaaattttgagtaatcttagatctgttgattcttcttatgatgctaattatccacaatctgagatttctcgccactttttgaatggtcttgacatgtctatttgggagatgaaagttacatctattcatgagtcagttaacatgtctactttgacctttggattcgctttacacaaaattgaaaacacatg

SEQ ID NO: 2141 - DNA, 2000 bp, Oryza sativa
gggccggcgatcgccagacggcccatcaggggcccatgagcccctataacattatgtacccctataaatgtcccttttataagggtaatcatgtaaattcccctgtacaacctaaaccctggtagtaagaacctgtaatggggctataaatagtcccctagggccatgtaatggggggatcccaagtgaaattcaaaatttaatacatttcatttttccaaccactgttgagtaaccacgtctttcgacgtatgcagttgtcgtttcgacaacattatgtatctgctagcatactgtttggtagcattaaaacaaacaaacaaattaaacaatagtaataatgcttgttcttttttgtaattattattactgtttgctctagggccattcacagtgcaaaatactactacgagaagcctcgtagtgccacataggacagagacacatgtctcaaatgactttctccccacagtgcaaagtagctttttagagatgtttcagtcttgcatgccagaccccttttttttaattatagtccccatattttgtaatttacaggaaaccacaatattttgccccaaacaccacataaattagaaaaagaaatataaattttgcacctccccttcgctcgcaaggaggccaccctctatctcctccgtgcaccgcgcaccctctcccgaactgcaccgtcggctctccttcttccccgccccatgccgtagtcctggatctggtcagtgagcttcaacctcggacatccaagggaaaaagtgggggtgatctagtactactatggtgtttagtccacatctctatggtagttgcttttgcaccatttgtagcagcctcaaagtatatatggccaatcttgcaatcacctactcattgtttgttggtgcctttcttatggaagtatgtgctatcggcattgtgatattgtcatcaatgacataggcacattcgagaacccatatgtcttagtttatctatcaggaagaccattgaggagcagagaagttagtggtgtcaatttctatggggcaacttagcctaacaacatatgtaaattttacatcataggtccacacccaggatgatgttgaaggcacgtttcctctaatttcagaggataaacttttggattaaaatgacacgcttttcaaactgctaaacggtgcatttcgtgcgaaaactttctatatgaaagttgatataaaatatcagattaatccattttttaagtttgtaataattaaaacttaattaatcacacgctattaccacctcgttttacgtgaaacacttaatctttatcttcatcttcatcttcaggagattcaaacaccactggcttggatacgatccatatagatgaatcatgaatggcacgtacaaacacgtccagtggtggtggcaattaatgaattttcatacaactttatagtaatccttattatatgctgatgttggagttcagatgctttcctgctgcttattattgaatgtaagtcattgatattgtttgatttgtcttcagttttgatgtgttctttgttcttggttttcttcggctatatgatatctctcggctatatgctagcttcaaaattttcactaaggtggccactaatagaataaacaggtggctgaccgtatagtgagtccaactcaaacagctttcatgagaggtcgcaacatcctagatagggttgttgtcatacatgaaactgttcgtgagttgcatcgcaggaaattgagtggggtcatccttaagattgactttgagaaggcttatgacaaagtaaaatggcctttcctactacaaactcttcgcatgaaaggtttctcgccaagatggatttcttggattgagtccttcatttcgggaggaagtgtagcaatcaaagttaatgatgacattggacggttctttcaaacaaagaaaggccttcgacaaggtgatccgctatctcccattttattcaatattatagcgg

SEQ ID NO: 2142 - DNA, 2000 bp, Oryza sativa
  misc_feature (828)..(828): n = any nucleotide
  misc_feature (1072)..(1072): n = any nucleotide
  misc_feature (1075)..(1075): n = any nucleotide
  misc_feature (1077)..(1077): n = any nucleotide
gatgaagagatgtcgaagactgtggagttgggatctaggttcagcagtcgatgcctatggagtacgttggaccgccgctgcttcgcttccgctatctcatctacttcttttggtattttgtaatgtacctgacaatgctcggtctatttgggtcccatttgggctacccttgtataattaatgtatagttcaacctgtataacgatgtcagcttgtgatatacaactgtgccatgtgtgtaccatctactgatctagggaatggtactgtaaatcacatggggtttcctgtgtgtaaaactgggggcccacatgaaccctagggcacacaccatctttgtcttagcgcacgacacaattacaggtccgaaggtccaaatcagacttatactggaagatgtatattacttgtttttcatattcctgacaacttagaaggaattttaatgttggaccagcaccatctaaaagtatactccataagctttccaacaaggaataacgggtcccaatagtacttttggatcaatggctatgcccatttgaagttgatgctctcagaggtccgaatccaaattcaaaacgtgtaaaattttatctcttacttcttgggaaagatcttgatttggtccctaataaatttctttgatgatacattcatttcttgcactcggtatttttcccttctcccaaattgttgggaatctctccctctctcttatggaaatcactctctaatctccctcatgcaattgcttactagttccctataagtttcatgcacacacacacccacccactagaatattacaagtagaaaggaagaatngggaggtgcacacatggactacctcttgctttctcggcagccatgacacatattttcattcctctatcaattacttatatacaaaaccgaactgcatatgtgcagaatgaaagatcctttgaaacaaatagtttttaattggttacaaactttgtaaaatcttgggtcctctctgtaatttaacttcctgtaaatattttgcattttaatggaaatacagtgttgggcaaagccgtggcagtcnttntnaaaaaaaaaaaaaggtgagcaagcactgcatggatatacatgcagctcacacgactaacaacccaactaactcaactaatcaatcttgcatgcacacactaactcaacacatgcaagctaaccacctgatctatccatgcatacacacacattctcacaatgtgtttgtgcacacaattctatatgctaacaaacacataaatggaaaattatttccaacaagaacacactaaacttataatgcagtaacgtttattcaaatatataacacataaatcttacatagaaagcatgcaccgttggttgatgaacacataagatagccatggtcatattcgagccaatgttatcctcataaggtagcatttacgatcttctaaaaaagttaattttaatggtaaaacgtgtgctggatttgtgcgtaatatacatgagatcactaaagaaaacattgagcgaatgaacgaaaagtatataattgtccgtagtgattgttgaaaaaactaacttttgaaccaaaagatcttgtttggttatacttgcataaagaccgatttcctactatgcgaaaatctaagttgatgtcttgagctgctggtccttttaaggtcaataattgtttcaaattaaaaataattcaagaaaattgtaaatattcaccttaacaacacttaaacttcaaatggccataacttggtcatttgaactcataattggaccgttcagatctctaatttttccataagaagtcaagaacccatttatgtgctttgtttcttcctcttatgtggagtttattagagtaaaagcctttttattttgggttaattggatttgtgcgattacaaattttctcgtttggaaaaataccactggtattcgtgaaacttgccatgtgccattgaatttttttaaaattcgaa

SEQ ID NO: 2143 - DNA, 1247 bp, Oryza sativa
  misc_feature (3)..(3): n = any nucleotide
  misc_feature (10)..(10): n = any nucleotide
  misc_feature (13)..(13): n = any nucleotide
  misc_feature (18)..(18): n = any nucleotide
  misc_feature (24)..(24): n = any nucleotide
tanctaatgngtntgtanacatanagggtgccatatatatattttgaagagaatatagggtgccatatagtccctgcatctagccctccttgaatacagaactaaatgttgtgtaattaagatccacaaatattcagataccttacatttgttagagttgcttggaagctgagattacatgactatgatattcagaattaaatgctgaacatttgttagagttgcatatagagctaaatgttgccaagactaatttgttgcaaatcgtaacttcccaaaagccattacaggttatgttttaaagcctcaatacatggataccatagccataaaatatttatacttattctctgttcccattgtttaacatgtaactgactgaaaagcttgctcactgtattttgttatcaggtctaacttgagcaacagaacaggaatggctaagtgggggtgtcaagactcaagaagttcagaaagtaaaatacttttcatgccacatgtaagaatttacttacaatcagacaattccctagtctaactccaaattacatacccgaaagttgaagcagtgcagggacctgatgcatctgccctgatatcggttctcgttctccctgatagtttgagtaataacacctacagtgtgacccatgcctgtattgattatcaggcgccacaagacatgggctgtggatgccagatgattggagaagagaccagccagcatcgtgacactgctgagtctgatacacatcatgaggtaatcagcactttaaaattacttgatccggttacttatgttaggtcatcaactgatggtttcatcagcaagcatagtaattctatatgacacaggagcacgtttctagaggacagagactttcatgattctattttccttgtttggtatcaaaggtgtttagaaccatgtagcttagttatataaatatgaattaaactataagcaaaataactatacattgtctaggaagcaagtcctgttgactgcttcaccctgcgttgtttttcctctggacggccacgggcggctagccggggaggcgtggcagaccgcatttggccggcgcggcagcggcggtaggagtgctcggaggccagctcgacgcatagaggcgcgggctagtggcagcggaggtcggcacggcgcgaggaggcgcagctggcggtagtggaggctggcttggcgcgaggaggcgtgggcggtggcgggaggctggcttggcgcg

SEQ ID NO: 2144 - DNA, 2000 bp, Oryza sativa
  misc_feature (1555)..(1555): n = any nucleotide
tgatcttggaggcaggagggctagcgtggcagtgctcgatcagagttattacctccataggcggtgggtctgacaagacggtaggcgatggtcacatcagatcgggtgaggccaattctcgagttcgatggaatagcgggtccatagatctagcgctatacgtggtagacctagagagatcgatgtctttagcagtcacccgtgctctccctaagtgtcataggtggcaagctttgcaggaggggacttgtagttttggctagagacattggcttggtggaggttggcaaggtgtgcactactccaaccttgatggtgtgcatgctgtaggatttagcggtaaccatattgaggttcttttgacaacaaggactcctgaaaacggcattgaatcgaactcaccacacctacactaccatgttgaggttttgccttgctcaggcctgaaaacggtattcgcccaaatcattcacatgttgagcttctttgtgacgcctagggtctgaaaatagtgtggacccaacttattcatacgttgaggttctttgtgacggccaggacccgaaaacgttattggacctacttcatttagttgaatcatacttacactgtactttcattctcgcttcaaagaaaaaagtttgaaccggtattatagatcaactgatagcttttctatttaagctgatgttgctcgaggttggcaattattcgtgttacgctgctggctgctgctgccggccgctgatgctgcagtgctattactgctgctgggctgcttgcttggttgggcctgctttgcggcttgggctgctagctagcttgctttgctcttttttcttttcccccaattatttgcggggttacattcttgttcgactctagtcgataggaatgcagtaaatgttccttagatttgacaaagatttccatgtcaatttttatttgagtccgataaagcgcgtccaggaaatccacgactggacaacaagcttaaaaaagttcaaattccaggcagctatagaaatctgtccgcgagtacactaggggtatgtttagtttgcgtcaaaattggaagttttgttgaaattgaaacaatgtgatggaaaagttaaaaatttatatgtgtagtaaagttttgatgtgatggaaaagttggaagtttgaagaaaaaatttagaactaaattcagcctagaaaaggtcacacgatatagtcattgcaattatcacggatccaggtcctatacagtacagcagagaagaactgtagctacagcgttctctcctccactgcggaggatccaaattgaattgtcacatgtccccaacgatactgttgtgtggtgttatccggaagtttgctccctattgtcttaaagaaaattctagaagttctcttccataattagctttcaatccagttttagaggatggttgtcagtatgttaaatcataaaacgccatgtagtgggacatttcaataccctactctgtacttaatcttcaataaatttgtgtccttgataacgtgctcacccccccccccccccccnaaaaaaaaaagtccggattgaaaatcatccccggcggctactaggctgccaacctttcattatgctcgaccaacgtggcgaacacgtgcgtacgcgcaggagcagggcggcgcatcacatcacagcgaatagttggcagcctatttcaatagttaaatatttggagtatcattttagcaaacacacgacaatgctggcgcataattggaaatggattttgtccagccgcacagcctgacggtatcactcacgcacaccaactgctcgctgcttatatagcctcaggtcattggatacgtaacatactgttcgcaacgctatatatatcgctatcttggcagccacgatcccagcattccaaataagctatatagatcatcatcaagactacgtattattcactattcagggcatccatcgatcagagaagagagacgagcgatcg

SEQ ID NO: 2145 - DNA, 2000 bp, Oryza sativa
  misc_feature (965)..(965): n = any nucleotide
  misc_feature (981)..(981): n = any nucleotide
cgttgacgacaacaattaattgtgcgaatcccactggatcgttgggtacccactggcaagcagctggtttgacacagtatgcatgatcagtagacggatcgatgcatttacgcggtcgatcgattttgtcgcagatttagtcatcatccaatagggaatcaaattgatatgatcactattttcgcctagttgatcggtgatgggtacaagataacagaaatttaagggaaaattagttaatcatagtactgcaagtagcaatacgataatgcatggtacacaaagtacaatcttacgcactatgtacagcgtgtacttggggccgcgattgagtaggtttgaaattaattagatatatagtgatggaaaagtctgacacaaattctctgaactattcgctctctttggtttgaaaggttcggtctcagtctcgcctacacactgtcagtgcaaatgacttgcacacaacatcgttcgagccagctagcgagatgtttgtcaggtcaggaaaatagttctcaaattccactagtcactggtagttattagtacctaacaacagtactggttgttgtgatgtctcgctctgtattacaaaaaaaatgcttaattacctaacaaattaccaaatgaaaatgcctttacacaaaaacactccagtggcaatctatggagctgaagaagttctaattgtacacttgcacagacagaactttacacacagaccatgctgtcatgtattgacgcgtacattattattttcagtgtagtagaacattgaagtcgatcattgctaattatcgtgaggacctttagtgatcctcaagtataatgctagccttgatcattgctagttttaaaattctgaaataaaaattccgaaatttcggatcaatcgatcgccgccccaatccctcgccatccccaatctccccaataggaaactatttcaaccaatttttttnggaatttttctttttnggatttagcaaaatttatttcaatttgaccaaatatatttaagagttcaaattatttcaggccgaaattatagcaatatctaaattttgtatgttatcgatgcctcgataggataaggataggattaggaaaaaccgatatattaagccctgatcataggtgatgtgcgtgtgtttttcaagcatgggtgcaattgaagaattaaaaaataaggatgtgtaccgttgagacaaaacggtttggtcactagttttttaaccccctcaacctcaagcacatggtttgttgcaaactactaaaataataagcattcttatattcggcaaccaagatttggtttcaacaaaatattcagcaaccaagatatacggggatctagtttatccatgccatctgctgaacagacccatgcatccttcaactaaaatgatttattaatcattacatgactaaaatcataagcttgctaaattatgaccatgttgggtataggatattatggttgttgttgaatccttcggaagcattttaatatcgaaggaagtgttcaatctttttgagggaaaaggaagtgttcaatctgccaatgacaagttcacaacaaggatgcttcctaggaaaggagaaaattgaaatgagagtttcaaagacattgtaccttttgtgatatttcctgaaaacatgaatggaaaatgtcactccatatgaactaaagacgctcattcctttgctccaaacaacattagttggtagcaacttagcataaaattcagttaatttacttagtgcactgaccaaacatcctcgtctactcttgcatacacaacacacaactactccctagtctcaagtcacaacccacaacaaggcaactactcctagctagtaagcatcaatgcatggtcaaagaggtctatataaaccttgctatgtaagcatgttttccacacagaagaaaaagcataagctacacgcactaagtacagacaagagatcgacaaacataatctaattaatca

SEQ ID NO: 2146 - DNA, 2000 bp, Oryza sativa
gcgattatggtcggcgggaggccgcaacagccaatcgatctcgcctctttgcgcttccgttggaaccctatttctccggcgatcacccccctcacgatctccgctgcactctgcgctagggcactccggggaagacgaagcagcagtggatgacgaaagaaaatgagaaaaacagaggggcctcgatgaaaaaaaaacaagtgtggccggtgacacacacggtgcgcgtgagaaaaggcacggtgcgggccagctcagctgtgcacatggcatgccacgtcggcgcgaccacggtcaaatgacattttggaccggcgatggtacatttagcaagtttagtggcctaattacacgatttacaagttaatggacctagatgatatccgcccgcaagtttaagggccgctactgtattttactcaaaaaactatactagaggtaaacgtgtgacagtacaagaccagtcaaagtctttccaacgtctctcgcatgctgtacgtacgtactataacacgtagtagtagaaccgtacgtacgtcttcgtgagttaggtaattaatatgcggctacacgagaggaaaaggccaaggaaaatcattggaaagttcattgcaacgtgccaaatattaatattgcctctgtgcatgctcaacgttatatcttgtgcctccagctgggcatatattatggtatgatccttaattttaatcttgaaagaaactacctttttaccatttctttaattctttagataagaaaaagaaaaatattctctagaaaccatatctgtcacggtatccaccttgtcatcggctatgtcagtgttactcgaagctttatttctaattaagggtatctttactctatgtgtgtgtgtatattgatatttctcaaccaggttatgaatagggcccactattgttgttgtaactttaagtattgcattagagttagaaaagggatgaacctagctttgggttaagccctcaaccggttcgtggagtgttgtggaaaaaaatggtgacggttacctctgacgaacgtcctccgtcaaatgtgagtaaagtcatcagcgaccactaatctctgactaggaccaaaacacgtcaaaggtgacggtttgaataccgtcagagatgacctgattcggcgtagtgtgcatagctttatatgagcctgtacttaggccttgagctatggccgaggtagcccggttatgatccatcattggttgggagccatcacaactttgaaagacacattttcggataatgtgatatggatacatatgcacacacactagaatactagatgataccccgtgcagtgcagacggaatattggtgtgtgcaatgcagttgtaaaatttcaatacgtacatacgagaaagattatatatacacgctgatatgaactatagaagtgtcatccaatgtgttgtcaagtgatggtgtaacttctttacagtaataacgttctacgctagctaagtaaatcactgaatgctaagttatttactaattagtgatgaatagtagctacaaaatggattaagcataggaatgatccaatatatggctctctttttttaaaattatgtggtttaatgcatgttgagctattggctataggatatataaataagccagaaaaataaacatcaagttgcattcactacctgcccagatgaagaaagtatgcagctgagctgtgtgccaaagactattaaagtacagtgtgaatacatgcatggaaagtttgcgacaattgaccacttaattatatttagtggaagtaattaacatctactagaagcaacgtgacagtgcaggaccaagtctaaagtgtctttccaacctcgatctctcgtaatcgagcttagctatagctctcatgatttaactgctataaatacctcagcaagcaacaagtctcagcacaagacattaattaattagcttgagaaactcatctgctggatcgagcttctctgttaatta

SEQ ID NO: 2147 - DNA, 2000 bp, Oryza sativa
  misc_feature (595)..(595): n = any nucleotide
cagggcctattcgaaaatgtgttgggcacggatgcgtcaaacgtgggtggtccctggccgttggatccctgtcaacgccggctcacccttcgtcctcgccgttgcaggggacgaccgacgacggtgatcgcatggatgtcggtgccgggagctcatcagcaacgaggtcgtgcgcgagataatcctcgctaggatttcccgtcgctgagcgtgagaagcatcgtggactaatccgcaggtgcagggcgagcaaaaccaataagaattttctttctagttgtcctcgattaagccaaattaggaaccaatcttctcgtcacgctacagagttcaactaattcaccttgaaaagttgatggtcacaaactcactagatcttctgctcacaaactcactaggtattgctgtccaattaattcagttgctctatgttttcggcaattagaatttcggaatctatgctagatttgtcgagctcagttcctcaggatcttgacatgtgaattctctgtctgctttcatttttctctgtctgaggatttcaacttttggattactgcgacactgatccatgctttgttccttaattagttangtgttgcgcgagctatcgacttcaaaataatatgctttttttttgtgatcgactgatcgccatatacctgtacgtaatgtgagacgaaaccactattcaattttgcagctgacgttgtgatgttgatgcctgatggtgctctactgctctgtttcctgcgttcccgaaaaatactgctctgttaatctgtttccagcgtaaattaaaacaaacggccaatgataatcgtttttaattttttggccgagtcatcacagactcacagtatgtcaacaactgatgtcagtacacccgttctttgttattatgacacatcactgtcatgaaaaccacctgataggttaacaatcagaaccaagcagtttctgattctgagacccattcttcagaaatctggaaattctacgatatctatctgcctgactatctctatctcgatctcgtccaggattgttcttgcgaactaatggttgtacgcaaattcgtctccctactgcagtctcagtccaagtttcctctttgatgattcttcgaacttatcgcgtagattgggactcgcgcatttagccgaggaaacacgcttagcagcaagactcgatcagctccgatcctcacgttgaagcgatgaaaaaaaatcacctcgaattcgatccaggcggcgagacgtgaccaaatcacgtacaagtcgtcgtcgaacagacctggttgtttaaactactaattctaaactgcagagggtcagagagaaagatcgtacgaaacttgtactgctaatcatgcaataagcatgtgttaatgccaggacgattcactggggaaggaatcacaccgtgggcatgctgttgactagcggaataataccactgatttaagtagggtcatatattgatatatagcataactgctaactgccagttgctagtgcctcttcggctcttccagctgggagtcgaaacaaacaaaagagccgtcgttaagcacgtccaagtaattaaattagtacgtagtagtaatccctaagctaaaaatatggccagttgtagctgacagctaggagtaagagatgggcaagtagagagtatagagaggaaggagagaggaagcaatatgggagaacagtagtgaagcctcgaaccggctcggttcagtccaactcaaccacgtagaaacgtgcgggtttacacggtggcgaccgcttcaaatgtgcgggagctttgactggtccccagccagctcgcctataaacgcgcgcacgctcgagccagctaccacggcatctgcttgagttggagcaacacaccaagaaggccagagagattcagagaactacaccgagaaggcgagattgtttgcgtggttggtaatttggccggccttgatcgatcgagcggagaagagaagagaa

SEQ ID NO: 2148 - DNA, 2000 bp, Oryza sativa
  misc_feature (879)..(879): n = any nucleotide
tatccatgattcaattaaaactactcagatctgagttggaagtgccatgtgatcgatcattacttcacggcatcacggcgagctggatgacctgccatatgaccagcaagcttatcaagttatcatcccatttcagaatgttccgaccttgtttagttcctaattttttttcccaaaaacatctcatcgaatttttgaagtattacatatagataaaatgaaaaactaattgcacagtttgtatggaaatcgcgagacaaatcttttgagcctaattagtccataattagatataagtgctacggtaacccgcatgtgctaaagacggattaattaggcttaataaaatcgtctcgtggtttccaagtgagttatgaaattatttttttttcattcgtgtccaaaaaccccttcctacatctggttaaacgtctgatgtgacactcaaaaattttcttttcgctaactaaacaaggcctcaaaaccggaattcacacccacccacaatcatctcctcctagaaacaattcagtcagtcagattcaccgcggtcaactcatcacgtcagttaaaaccaggcaaaatatcgcctgcgacctcggggtaatttggtgtagcaagttattaagggacacgttatatttgatattatgcttcaagtacatgatttaaactcgacataaatatgggtagcctaaaatgaacttattccttttaggcgcgcgtgtgttcatgctcgctgttggacttgtaatctgtctgaactctggatgcccccatgctcaattaatcagctctgagttggaagtactctatcagagcatcactgacatgcttctaagataccttgctgtatcatactaccacctccatcttttnatatatgacaatggatagcctaaatttgaactagtcatcatataaaaataaactggagggagtatttgataaccctgctatatgtagggctcttgtagaggagattttgcatgcatgggattaacagggaacgacagaggaaaaaaaaacattttctttgatgaagtatatatgtggtctaaagtttacagcttttctgggcacatgttcgttgttgttatcgtcacgtatcgtcgtatcgatcccatgtatggacgacggatcattccatcacggcgagctggacgatcgacctgccatatatccatatgatcagcaagcttatcaagttatcattccatttcagattgttcaaaaccggaattcactccccccacagattcagaaatcaaccatcacaatcatcatctcctcccagaaacaatcaaataatcagagtcaagtctctggaaaattaaggaactcacaagttgcctccaaagaattacagtttttcgacgatccaaacgtcatcgctacatcgtctgaaacctgaacccaaaccacaacatgcagaggagtacaaaaatgacgcaaattgaactctcttctaacggaagcatcctagctagctaagcatgcacctagacacagtgcagcatgaagagggttgaccgggtcgggtttgacttgggaaaaattaaactagactttgacagggatatatggatcaatggaagctgcgaaaacagcaggcagctcatggtttcgagctcgaacgattcgcagagagcgagcagaggcaaaaactcttgtcagcccacaggaaaatttgctgccatgccggcgtgcgtatatatatcgcatgcaagctggtttgcatggcattgtgcagtgaacaagagacaaggacaagaacaagctagccggtcgagatcagtttcagtttcaggcttagctagcacagcaacagcagcgtcgatcgatatgggccgttggttgaagccagatgtacgtgtgccgatcgatgtgatatatatgtgattcttcttgttgattgattcgatcgatcgtagatggtgtatatgatacaggatcagtgaaagtttcagggttgttttttttagtttggaggtaattaa

SEQ ID NO: 2149 - DNA, 2000 bp, Oryza sativa
acacatatatacatgtatctagaagttcttacaattaggcattttatcacataaataacgctccctccattaattctaaatataaggacacaactacatttttcacatatttcatcataatatacataagacatgcatgcatataaacaattaactagcacctcctctccactaaattattatttttaaaatccttcaagatctctaattttattaggtacatacattgtatttattagagtgatctacataaggtgacaataattatttttagtcttagtgttaaaaggatagttgtgccttacattttcaaacgagggagtatattacagattaaatttggttaaagctttatatatagaaaaacaaaatatttcatatattttaaaacagggaacattagtaaaatgattatgtcagcgcctcaatctccgcatgcagatcatgcagccaaccatgcatctccatcggctgtgcgttcttatttccttttgttctgtgcgtggtcgagtttgtcactgacaagagcgtttgaatgtgtcaaagtcagctgcgatgggatcgagagcttcgaagtcgtcgtcttctgtgtaattatattcatcagtagtagtagatcgatatgctagtgctggtttgcgatagttaattagtgcaactaagagttaattactactccctttacctctttaccttaaaatatgacttaactagtgctctacgattaactagtgctctacgatgtagaattgtatatatatacacacataattaactagcatatctctttcttctaaattcatttttgttaaatcctccactctttaacatctcttacattcggtgattccaggaatacacgcgcacacacacgtcactacttcacatgcaacaccgcactcacacatcctcgaatacgcgtctaacacatactcaaagggatggagaccagcgatatatttttgatctcactaaatttctattgaaagtccacttgtgtgtataatgtttgtgggtatcaggatttcaatcctggtgggtggagtcatgcatctatgactccaccatccgccgatgcttcccgcttgatatcgcttacataggtgcatgcattgtatgtatttgttgaggtgattcaaacaaaaaggtaataataattctttgttgatatttatgttattgatattgcatcttttattttatgatatatctagtaactcttctctcctagacgatccagatgttaatatgctcatcattaggtaaacatagggcctatttggtagagctctagctcagcctaagtttcagctccacataaaataggagtggagctggctggagctatcgctatcacaaaatgaactagaaagatagagctaggtttatgttgctccacaactccactctgaacgtagctcttagagttaaatttagaagttgaagccttaccaaacatgccatcaatactgtgaattttcacaggccaagaacagtgaaagaacaaaattttgatctatcgaggagctagtagcgctcttgatttaaagaccctattgtttagaacattaggacttatttagagcatagaagctagtgctaattacttctgtaagtacatgagctttgtctctttggtaaacagttctttaaggcctcaacttgatccctacttaatgaagatgccaactaaaagactaacgtgtgtgctgttaagaaactattgttgcatatggcctcaagcactataaatacccatgcagtcctgcacccaacactcaccatttcctgcactcatagagttagctaacaatggcacgcactaagcttgcagctcttggtttcgttgttcttttaagcattggactagccagtgctgcaagagtagaaagatattctagttcccaaggttctggcacaggaggtggagagggaggaggatatgtgaacggtgggggagcggggaaaggaattggggctgggtccggtagcagcaacta

SEQ ID NO: 2150 - DNA, 2000 bp, Oryza sativa
acagatcaatgacgtgcgcccgtgcagatgcaatggaaatatatatcggccacgttgccacttcttctaatataataaggcaatgtcgttgcctactatgcacgatgtgagctaatcacacgaagtggacaacaagttcgtcatgtgatttgttgtctttctcctttgtgtgtcgaatgacagatctcacaattatccaaaaaattttacaaaaaagcatttcactgagctttgtgcgtactccctccgtcccacaatataagagattttgagtttttgattacaacgtttaaccactcgtcttattcaaatttttttgcaaatataaaaaacgaaaattgtgcttaaagtacggtagataataaagtaagttacaaataaaataaataataatttcaaaattttttgaataagacgagtggtcaaatgttgcaaacaaaaaatcaaaatcccttatattatgggacggagggagtaatagataagccaacatatcgatattacattcgtcttcctaaataaaactaacatttatatttggttgtgaatttttttaatattaaatttggaccatgatatacttttgcacatttccattaaaatttttagtaagataaatgatcatatattacgttaaaaatcatcaccatcaaatatttaaaaactgagagagtagtttggaacacatgtttaagttacagttcatttaaacttgaaatgttggctattattattgatcccgcatcaaaaatcaaaggcgtgatgccacattttagattatccaatttacagtacattgctgatacaaccgtttttatggaccgccacttcgaaaaagcaaatactccatccgtcccaaaatttaagtatttttagcacagtgccaagtcaattattttcaaatttgactattaatagcaaaaaaataaaaaaaaagattaatcatgtaaaattgatgttactagatttatcattaatcaaagtattacaatatgcaactctttttatttaaaacattttatatttatagatattgttggtcaaagtagcatctcgaagactttgtcggagtccaaaagctcatagtttgggacggagggagtaatacttatctcaatctctagaaacttatcaggactaaaaaaatcaattttcaaataagtaatgttttttttttgtttcggtaaagcaaagcaaatactggacccatggttttaaggctagctattcactcaatgattcttgccgataaaattcatcacaacaaaacaaattagagtctggaggtatagatttgttgagaaaaaaggaccgtgaataaagtattagacctaattaagtatatacatatgcaacatgtaatatacctacatgtattgaattcagacaacttttgagtatgtacttcaatacccaggagcctccctgtgcccaccccggaagcaagcaaacaaggaagaacaataccaacagcattttgcatgtaaaatgggtagatatgttagcattcctaaacatttctgtaaactctataattcaaatggccaggaagaccaagagcattttgactgtaagatggacagatatgttggcattcttacactacccattttctataactcaaactagaaatgggtcgaggccagttctgaattataaaattagtacaaaaactaaaataactaaaatatatatttctccaaaaacgatttggaaaaatcatacataaatttaattatgataaattgtgatttgttcagatttaagcatgacattgtgcttgtaagttatatgatattatatggagcatgtgatgattttttaggttttcttttaagtcatttactaatgcaaacatagttggggtctagcttgggccaggttgtcaaaaaactagtataaagccacacagccagaagctaaaatttccatccataaacacatcagactgccatctccctcaactagttgcaaaatcacacgtcttctacttccatcag

SEQ ID NO: 2151 - DNA, 2000 bp, Oryza sativa
agtactctgaggacctaaggtgggagaggcaacaaacaggccactagatgtaaggtcaatgggaagataagggcatggcatttgccgctgcgtactacttatctgtcacagacggtgatccaagggcagccatgatggagtactctgaggacctaaggtgggagcggcaacaaacaggccactagatgtaatcatgtaaggtcaatgggaagataagggcatggcataatgatgcaggttattggaagatcactactacctgtttggccgcttgaacaatatatatgtggtttaccctctgtacatgtaataatgtgaatttgtgaacatatgtaatgtatcatctttttttttctcggtgtgatgaacttgatgaaatccatagcaattgctttctttacatatataagtatgacgaattactcatgttatgatcatggcattttcggctggtgtccatctttatcgtgaaattgtccattgagcttttgttaaacttttcttgtctatgtcctgaaatatgggtttcgccaatatgtaccgtggggcttgagaactctcggcgacttctatgttcgaatagtatttttcatgctaatgaaaaaggcacgtgttacatttgcttcaaagcgttacatggccgttctacttaatcttattatgtgttgccatgttagtggtcaaatctggagaagtcctattaatgattggaaggttcgattttagttcatatttttacaacgaatctttcatgataggtgtacttccttggaagaaatatgctgcatgcgcacagaatcaaagagttgctaaaattggaggtagaaagaacattaaacacgctctactgaagcctatggaaatcggacgcatttaagcgcattcaactcaagtacatgaaaccaaatacaggaatctaattcaaatcagctcgatttcccatataaacggcaaaaataatcctgcctgcaaacgtgtcctaaagatagtcccaatttgcatatgctcctcatttcatttgctcctacctgaatttctgggactgcaattggcaagatccaagatgccggtcacatgatccaaactggagtaaaacatggacacaccttaggcccgtagctcaggtcttcgtcaatgacaattcgaaggcctcttgtttagttgcttggcacgggcatcaaatacgtttcaaactgctaataagttaatacagtcttcgttcagtgcttatccagtatactgtgcagctgaagtggacctgtcagcaagtaaagccaagaggccaatagggaataattaacaccttactgtaaatgacagttgatactaatgtaatgccataacttctataggatcactaagggtgaaacctcataataaaaaggataatgtagaaatatactagtactaggcaggaggccaatgtgtatcacacccatgaaaactgttcgaatatttttggcagcacacctcaagagccaagagttggtaaggttcacatacagatggttcatttcaatgccaatatgaacccagctcatacgactcaaaaatgtcgaacccttgcctggttctatcaacaagggaataagtattaatattttgacaaggctgtgagacaaggatgaccagctcgatctcttagacttcgaatttacaccctaaaaaattttcaagctaaaatgtgatactcttcaaagtttcaaaacaggagaaatatctctacaattctcgactaaaagaaagcaacttacagtgtgttgtccaagtgaatgggctagttgatgccttggggttcggtcttccacttgacatagtatccacttgcatagtcgcattagtagccaatactcatgggcacactgacatcgcgaacctccctctcccccttctataaaaactcagctgcattgctaagttcttccccatccattgcaacggcaacatacacacaccaccaccaacatagcttcttttgtcactgactacagtatcacaga

SEQ ID NO: 2152 - DNA, 2000 bp, Oryza sativa
  misc_feature (226)..(226): n = any nucleotide
  misc_feature (1461)..(1461): n = any nucleotide
ggtggaacaacaaatgaaacgaattcccttaataaagggtttccataatatgtggctgatttgttgcaacaaaatgtttcaattcactgcaacatttgatctatacataatgaaacattgtgagtgcactaggtaaatcatttttggtggaacaacaaatgaaacaaattcccttaatagaggcttaatagagggtttctaaaatatgtgggtgatttgttgcaanggagtatatggtggagacacatggaagttggtggcacggacacgtggtggggcccaggagcacgtgcacgtctggggagagcacccgattttgctctccccccgccggtcgcccgaggtaagaggattctcgttaaaaactatgtcagtaatgtattaaactgaattggttgtcttgctagaatcttagtaaaaatggtacactactaatagcttatttcacacgataataactcttctttacaataatattaaaatagagtttctatgataatattttttttataccagatggggtgaaagtaattttttttaatcataagaagagggagtagggggatggttaatttacctaatgtaaacaatatgttgatctcttataaacatgtacattttggcagtggcgatcctaggtacattttcccggtgtcctcagaccccggataaattattcaattctaactaaattatatgatgataactactatataagtaaaaattagataattattacgcattggacccctggtaatttttgttctaggttcgccactgcattttggcaggattaaaaatatactaatagaaatcgaagggcaatcaagataaacagaaaagcaaaattgctctgttataagctgtgaaaatttgagggggaaaaagatgtagctaattaaattgtggaaacccccatatatcgtttcgacttgtgtcaatgtctacgggcgtcgctaatgggtgggtgatcgctgtgggtgatcaccccccatctccccctgacacgctcctctcccccttcctcctctccttcttttcctacttaccaccataaatttttaaaaaataaaaaaacaaagttaaaaaaatttatgtatagaaatactatatataaaaaatatttgaattcaaatttaaatttgaatcgggtatataaacttttgacttataaactttggttctataaacttgagatgtataaactttagatgtatagaaaatactatatataaaaaatatttgaattcaaattcaattttgaatcggatatataaatttgaattaggtatataaacttttgacttataaactttgggtctataaacttgaggtgtataaactttagatgtatagaaaatactatatataaaaaatatttgaattcaaattcaaatttgaatcggatatataaacttttgagttataaactttagatctctaaactttagatgtgtaaanttgagatgtacaaactttagatgtataaatttactaaaataggaaaataaagtaatacggtgccaaagaaaaaaaccacgtggaggagaggtgagcgatcacccattaggaatctcgaatgtctacagtctacgtacgctgcattcatccatgatccatccggagaggaaaatgacaaatcaacagtcatgctaggagtgctgtggttatctcaccacatcttttggttgctactccacttgctataatcgtgccatgccaaaaaaaataaaataaaatccttggtcgacctagcccggcccagttgcaaattaacctgtatctctagttctctacacagactacacaaggccactaggtcgcaggcacgggacgggacgcatgcacatccagaaacgaaatcacgagtccatgtctccatgagccttgttgctcgctataaattcccatcgcgctcgcgtcttccagtatagtcgtcgtcatattttaccctgctttcctctgccactcgatcgccacggctcgcaggacaagaggcc

SEQ ID NO: 2153 - DNA, 2000 bp, Oryza sativa
  misc_feature (1533)..(1533): n = any nucleotide
  misc_feature (1583)..(1583): n = any nucleotide
  misc_feature (1585)..(1585): n = any nucleotide
actttgggtctaaattcaccgtacatcctcacatcccgtacaaaattgatttattttgggacgaagagagtatttcgttgtggtgacatgtatttgcagacattattgctaatatacgtccttttcataatcattctagatataaatcagtgtgattgaaatcttgatcattttggttctccgtaacttctagaatcctattcgaaccgatgcttcttgtcttcttgaccacaatactccctccgtgcaattcgtacacacaatttcacattatgttgcctatacaatattaggttggatcaacccaatatcgaaatgttagcatttgccatttagtttatcttaatagacacttcgatccatcttcacatacaaaaaaacacacaatcccatattaagatttctatacaacaaacgctattctagtcacaccaacaatatccgaatatcacacgagaaaatcccaaatttattcgtcacggaagacgcttggatccttcttcacacgcaaagccaccaaggcggcagcagcagcagcaaccattttcacatggataccgaaaatacccctacaaatacccctaggtccacctcgactcaactgtcatggaagggcaagaccgtccattcccccaaaaaggccacgtcacccaccgtggatggtagagctgcttggtttttaacacaccaccaccaccaccaccaccaccgcaccgctacactactcggctcggctgcttcttcttctccttctcctcatcctccacatcgctgcggattcgagcggcgaggcttggattttctcccggcgagatctccccggcggccgtttcgcgatgcctgaggcaaatgcgggtgggcgggcggcgccggcggcggagcagcggagcaaggtgggtggtggccgtgggagaacactaaagatttcgctgctgcttcgttttgtttctctgggttcttggggttcgtcgccgtgttcatctgaacttggataggctggacgaattggtgtttttttttgttttttttgggggattgtgggttctgatccgaagaagtttggtgtcctgctcctgcgcgtgagcgtaaacggcgtcaggaaattgctcccggatttggagcggattcttgccttgtaggaagatcctatcctatcatatcctatcctacctgagctttgcgagcgtttcctgaaatctttcctgtgcatctgcaagaagccatttatctctttcccttaaaacgtagtctcctactacaaggctgattgacttgtataaacgctactattagcccgtaataacacggtaattcttgtttggttcaaaatcttggggtaatgggtaagtttatcctaatccaagcaagctgtattttctttccgggatatagcactgtagatatctttgcccacttaaaaaaaaggaggtatatttttacttataggtttgagccaaaggtgtatcttttccagactgatcattagacttgtcaagaattagggcgatcattagttcaccacagcgggagccnggagtagaggtcaggtcagtttttgtttggtcaggctgcagtgtatctgnangtttcgtaatccggttctgtgaattacttgttgcagaccttcagtctgtggtttccagtcgtcgagcatagactaggcaaaggttactgtttcattggtttttgtttttgcctttttggttgtgatgtctttggtgcaaggagtattattaggagttcaattgcaagctgtatgtaattggttaactttttttttttggcaaagcttcttagtatcccgataatgcgaaacccttggttttgtgattagttgtgttgcagctgcttagctcttggggaagatgtaactcagtgaatttgtgctttgttccaattcacatgccattgcctaaattatgtaattgttcttggatgccattgtgttttgagacagagtgctgaattttcaatcttgaattttgtccagaacacaacag

SEQ ID NO: 2154 - DNA, 2000 bp, Oryza sativa
  misc_feature (1575)..(1575): n = any nucleotide
  misc_feature (1580)..(1580): n = any nucleotide
  misc_feature (1660)..(1660): n = any nucleotide
  misc_feature (1662)..(1662): n = any nucleotide
  misc_feature (1673)..(1673): n = any nucleotide
  misc_feature (1683)..(1683): n = any nucleotide
  misc_feature (1713)..(1713): n = any nucleotide
cggcggcgcagccgtggaaggctgtgcacggtgacgcaggtggaggagctgaaggcgatcgtgcggatgctgccggtgtgggccaccgggatcgtctactgcatggtgctcgtccagcagccgctcttcccggtgcagggccgcgccatgcgccgccgcctcggggtcgcgttcgccgtcccggcggcgtcgctcaactccgtctacgccgctgccatgctcgtcctcgtgccgctctacgacgccgcggtggtgcccgcggcgcggcggctcaccggcagcgagagggggctgaccgagctgcagcgcatcggcgccggcatggcgctatccgtcgccgccatggccgccgcggcgaccgtcgagggcaggcgactggcggccgccggcgaggtgagcatcgcgtggcaggtgccgcaatacgtgctgctcggcgccagcgcggtgttggcccacatcgggcagctggagttcttctacaaccaggcgccggactccatgaggagcctctgctcggcgctcggccacatgacgtgctcgctcggcagctacctcagctccgtcgtcgtcaccgtcgtgtcccatgccaccgcgaggggcggctcgccggggtggatcgccgacgacatcgacgacggccacctcgaccgcttcttctggctcgtcgccggcctcagctcgatcaacctcgtcgtgttcatctgctgcgcaaagcgatacaagtacaaggattcaatcaattaattgagaattgctgatcgaattgtgaatctgtaaattgtaatcagctcatgtgttctttagtttctgtacacgggaaaatttatgttttctcattgttatttttggaatagaaatcaagagctctgtgaattcactgggagtaaagaattacagctcaaatggcgaccacgttgactgtagcaaaaccggcaaaattgcaagacagataacatgtaaataaagaaaagaaactaaaccaacgtgcatccgaatttcttatctcacatgactctcgatcaatcatttctctgtaatgcttttcgattaggatgccattaatttgaagagtaatagattcttccattatgtaaagatttgaagacaaaattgttagttcagtttggttctattgtaaacaagtgaaagagttgatctattgtttgctacttttatttttcagtacgagcgtgtacaagaaaacctgtacctttcagcaaaggagataaatttgagtttctgctcggtcatggatttgaatcaatcagtcattcgctgtagtgcttattgattaggatggcatttgggctgtgtacatccttttctgggtgtagaggccagtttaatccattatctaaaaaaaatcagtttgactctgaagaagctttatctgcatgaattaatgcatgattacatcattgcactggactcaattggtaatgcagagacaactcgtatgcagcaccaatgcactttaagcctcatctgaatcttttgataggccagatgaatttccccacattgcaaacatgccaccgttgccactacttaactgaacaagtgaacaatccactnatctnatcatgcttcagacatctgcaatacccaaatcaaacacgaaactgcgatcgatacgttaaaattccttctcagctggttngnacacccactancactttgganttgataccaaaaagctggttagcactaggnaacaaggatgctaagtgcagctccattacactagttagtgacttcaccattgcagagcagaaaggagaaccaggctccagtagccattttcagaaagtggaatatctggatagaaaactagttagcagcatcagaccagtgcatgcgcagccgcccactatcatgccgacttcgcctatcggaaatagtataattcatcgatctatcgctttaaccgcctataagaacatggcaagaaaacatggactgtgcaaccagcacaagagcagggcagtaacttctgtgag

SEQ ID NO: 2155 - DNA, 2000 bp, Oryza sativa
cctgtattgccatatgagagtttactgtattatactccctccgttccttaaaaacttgtcagttgtcaccatgcactattcacattttaacttgccactcgtctttttttttcccaaagaaaagataccgtgttatcaaagtatgtgtaggattctaacttatataagaattaatctttcgttcatcgtaatttaaccatttaggaggtgttaacggttaagtggaatagtaatagtcaaagacaagaatttagaaacggaggtagtagtattcaacccttgaaaatactggatttgaatagttttacagtggtctctagtctctaccactgaatactgatcagcacaactgcaagtctgaacttactttccttgtggttataggaattttatcgtccagcacacccctgaggtaccgcgcggtaccaacaaggtacaaaatttgcgccgttgatttgcacagatctaacggttaggaattcacggtaccacgcggtaccatttgcatcctttgcgcagtaccacctgaaaacgtttggtgcaagagcactgatgtcttttcacaatatctggatcgatgagtgctggagtgaaggggtaaccctagcaattagtcctaattgagccgccgcatcgcaagggcttctccgccggcgatgtacaccgcttaaggggaatggtggctgcttcagcgactcagacgacggcaactgctacggccgcagttgcttccggcaatgtgatttggggcggcagatgcttccggcggcgatgtgatttggggcggcagatgcttccggtggcgatgtgatttggggcggcagatgcttccggcggcgatgtgatttcgggcggcgacgtcggcgagatttggggcgcgatttagaaggtggacatttgttcggcggctagggtttatgatgtctggtcagcgggtctcacgtctgattcgggagagaagtcgcgcaaaatcaaaggatggagcggtgccttgcttctttgcctgttcctatcctacccccgtaaaatcaacggctggatgggttttggtaccacgctgtacatgtaccatgcggtacaaaatgcaggacgggagcagtgctcttgtggttaacatgggctttaaagtgcaagactttaacttgcattgtttgtataaggtcaaggatctttcaaaggaaatatatgttacatttctgaataattacatttgttggataactaatgtgttatgtgtcgaaattctcactaaatttggtcagtgtatatattagggtctcgtgagattttaaactttttgctctgtcatgcatgcataaatatacacgaaatgaaacagttaaaaattcctagttaccaaagctgtcctaatacactacttagtactaaagtgtagatgtgctttcttctcaagctctctcagttgtgttacaaggatcgatgtatttggagtagctacagctaattccaacattttcgatttatattaccagggattattttagagaagtaggttgaacaaatgccaacactttctgttcccaacatgtattattagaacaccaaaaatgcaaaaccatagcagtgaaaacctcaattatgtgtagtgccttacacaagaaagacatatatatagcccgattataaaattctcattgttcttgaagtggaaccaataataagagaccaaaagggtttaggcaggtcagtttagcatggcaaggcattatgagacatcagatagtggtaactgatacacaagacaaaagcagcctctaaatcaagcagtagagaatatcaggtacacccaaagcaactccatgcatgttcctttttcttaccacaacttagctagtggagtggatgaaatggaatgttgcagctgaaacaacatgagttctataacattttgagagttcttgagttctataaatacgaagtgaaattgcgagaactaatcaaaccacagattcacagcatctcactctccagaagctatc

SEQ ID NO: 2156 - DNA, 2000 bp, Oryza sativa
  misc_feature (540)..(540): n = any nucleotide
  misc_feature (580)..(580): n = any nucleotide
  misc_feature (583)..(583): n = any nucleotide
  misc_feature (621)..(622): n = any nucleotide
  misc_feature (1245)..(1245): n = any nucleotide
aggtagtggtctattgtggtgtgcgtgatttggatgcgtataggttaatggatggatttgatgcatgtgggttggatatgttgatgagatttgaccgttgactcgaccagcggctaccacgtcatcggtgctggtcgatctcgatccaaaactaactaatcgtgtcgtgctgtactccctccatctaaaaaaaccctggtttccgtgtctaacgtttgatcgtcctttttatttgaaaaaattataaaaaaattaaaaagataattcacgcataaagtattaatcatgttttatcatctaacaataataaaaatactaattataaaaaaatttcatataagacggacagtcaaacgttgtcacggaaatctagggtttgtctttttttttttaagacggagggagtatgtatgtactaggatgttgttcatacatcttgaagggcaacagctggatagcattctgcaaatattgcattgtcgtttgcgcaaggggcagggaattaggccactcatcttccttttgggtacttgtctatcncaaaagcgaattcccatgagtatgtttgtttttttttttnggngataacagggcaggagatgcatgcatgttagctagctnncctccgtgtgctgcgctgccggtatggtaaaatcagtgtgggaaaacagattcgtcacggaaaaacagagcagtactctgctttcaacagcttcgtttgttcgaaacagaggacgtaaaaaacagagcattattgctctctcttcatggcgcatgcatggatgcctggataagacgataagctaagacttgtcaatccgtttttccgcatgcagagacatcgcaaaagttggcctagaaagtgaccatcattgatcgatgccatataatggtataaggccttagtggattgtaggccgttcgattaagtttgaatggtggattggtgcatgcagtagtcagttagtagggtcaaaaaagataggtgaactatgtggttgactcctagcaaatcttaaatctggaggcctctagagtctactagactcttggtcccctgtctcttacatgtaaaaatataagagaagatagtaagtagcagaagaagataaaaatcctcatattttgttttataaacactgtcaaaccactttatatctatctacaatgttgagcactctatcactatataactttacaatattctgagttgtaaaaaaatctttacaatatcaacacaacatnattatggtgattcctatattatgagactgtcatattgttacgctttatcttaccaacatttttttcacaacagacccattacaatatctcattgatcttcgaaactatgtatgcctgccgattgttataagatcatctattatatctattcttatgtaaatgggtattcttgacagcatactcattcatagattataaattcaaatattttttatcaactattactgtactttttggtaaaattgtatatatgttatattttacattaaacgattattacagtttctgatggtcgcgtaacgcacgactcattggctagtcgactattaaagcagactagtcgcgggaaaacatgaggatgcaaaaacagagcggacagatggtacgaaacagaggacataaaaacagagcatttctcttcatgagaaatggttgattaattaaggcaaagactgacctgtaatgtttcatcccttgttttgcaggtgcaacccatcgatattccatagaacaaggctttagaatggtaccttcagaaacagaggattgatgaatgcagctgcaagcacagcacgcagtatatatccatgggtccaaaaaagcttgcaagttgctggctacaacgacacgcctaatgattcctgagcaaggccctacatacatctacatggatatgcatctctatatatacgaacttacctgcaactaatttctccaccccaaaacacaacagcactccacacacaattacacaa

SEQ ID NO: 2157 - DNA, 2000 bp, Oryza sativa
  misc_feature (158)..(158): n = any nucleotide
  misc_feature (383)..(383): n = any nucleotide
  misc_feature (417)..(417): n = any nucleotide
  misc_feature (1041)..(1041): n = any nucleotide
  misc_feature (1060)..(1060): n = any nucleotide
  misc_feature (1982)..(1982): n = any nucleotide
tcaactcctggagttatatttaggagttggagctgtaccaaacatgccctaagatgtactccctccgtttcaaaatatttgacaccgtttcaaaatatttgacaccattaactttttagtacgtgtttgaccattcgttttattcaaaaaatttaagnaattatttattcttttcatatcatttgatttattgttaaatatactttcatgtacacatatagttttacatatttcacaaatttttttaataagacgaacggtcaaacatgtgctaaaaagtcaacggtgttaaacattttgaaacggagagagtatgtgtattttaatagtcaactctttaaatatttaactaataaatattttattataaattatattttatntgatgaaaattatatcattggattgttatttaanttacctttaaatgattatgattctattgctaaaaaaatgtagtatataagaaatttaaatataaagattagttttaaagtctgtgttaagtttaatcgtgttttattgagttggagggatggagtacttgttaaaatactggtaagtcaatgctgtttttagctacatccaccagcctcgttgaatgttgatccaaacagttgttctgttccattttatatattactctctccgtccctcagtagatcggatcagagttgagatttcacaaaagaataccttacgattggggaaagtaggaagcggtttgggcatgcgctgcacatgtgagcagttgtcagttgagcaccatgtttatgatgataagctcggacgtactttcttagtcccaaaataaaaatcaataaagatgtaacatatttcagtactgagaatcttcacgtggagatgttaagcaccataaatctagacagatttgtgatagttgtacgagataatctcttatatgccactgaaaattggtctgattccttatatgccactgaaaattggctcttcccttatataccattggtctaaatttgtgcaccatctcatgccactaccatcagttgaccatgtgtngaccgttaactctcaagtnaaaaagacatatttgccctctctgagttgttaggcatgccttataattagacgggtaaatatgtcttttttccttgagaattaacggtcaacacatggtcaactgacgggagtggcatgagagggtgtgcaaatttggatcaacggcatataagggaagagccaattttctatggcatataagggatcaaactaattttcagtggcatataagagattctgcctagttgtatatagcagtgcggtagtattatctgttcagtaggcccgaactacaaaaaccacattgaatctagtcccatgaaagttttcatatttttttcaaaacttctcaagttgttgaatttttttattttcctgaaattttcaatacaacttttttctaaaaaagataatttctactacctccatattttaatgtatgacgccgttgactttttatctaatgtttgactattcgtcttatttaaaaaatttatgtaattattatttattttattatgatttgattcgtcatcaaatgttctttaagcatgacataaatattcatatttacacaaaatttttaaataaaacgaatggtcaaacattgatcgaaaagttaacggcttgatacattaaaaaatattgagggagtactatatctaaacggcgacgtggcagcgggtcgcgtgagcgtgaccaaagtgttttgttttaaaaataatttaatttttggaatgtttttcttaagaaaagttatcgatcgaagagttcgattttaaatcttaatggcataaaatttccaagatgttatcaccaatcatcccatggcataacggatctgaattaaggaatctactactaaaaaaaaaacttggccattagttaaccagtcgggtataaataggagcaagaaagcaaagagaagaggaaacagcagnagagaatgcagagcaacc

SEQ ID NO: 2158 - DNA, 2000 bp, Oryza sativa
  misc_feature (53)..(53): n = any nucleotide
  misc_feature (66)..(66): n = any nucleotide
  misc_feature (623)..(623): n = any nucleotide
gatcaatgtaatggtggagtatatatgacagatgggcacgcatggagagacanatcatatgtttgngtatcttgcgtcagcttccactgatatagtattatgtttaggagatggattttcattcatcgagagatatccctcgcttttttgtcataaaaacaatttttaaaaattgaactatatattttaacgtagagtcatatatatatatgtctcgttaatttatcttgtccattcttttttttttgactgaaaacatatttccatcatgtcatctaaatagtcataaaaaatttaaaaaatttaaagttacatgtgtacggagtgatatgtctcatactaatctatcttctcaattctttttaaattattttgatggaaaagctaaaaaccatcgatagtttttatcgatttcacacatatttcacgcaccacacgcctggaccaactaaggaatgaacattttctgatttgaattgaaattacactttaattaccttgtaattatactataattacatgcaagttatattgtaattatgtttgacaatttttttttaaaaaaaactatgggtataattttagatgcacccttttttggactgtctatgtagtatttgacnaaaagaacccctaaaaaatctcacaatttttcaaccgtcatattgctttaatatttgtgtgcacctacctaatgaaacataacctaccattcctcatctcctctcccccttagcggccccacgacacgagcttgagtacttgatgccgctgccgccacctagcctcaatggcttgcgggaaggcgtcaacggcgcggcgagccccaccggctggcttctcccccttacctccctccctttcctccctctcctactcaagctggtgtctccccgtcatcggatccatcacaacagctgcccataaactagctttgcccttgccaccaacaccggcccatcaccctcctccatccccatggctccagtgccgccgccaccacctcatcatctgcccgtgtccaccgcccaccgtcggcccgcgtcatccctctaagctcagtgatctccctcctcttcccctagccccccctctcctcatccaaccctcaccctaacacgggaccctaaaccttaactcttctaccttcgttggggttgctgaagctggcggagctagggaagaaggtgttgtcagagcttgaggaggagaactgggatcgccggagcatgaatcataaagcaagtatcaaggttagtaatttgtaagattttggctcccccaaatctatcgtcagctatttagctattttttattgattattttaaggtgacatgaggatatggtgagagggatgaaaatactttcccttaaatgtatcgatcgatggctaggaaatatgaagtattttctctatctcaaaataagttaatttagtatgggatgcgacatctgttagtactacttcctctgtcaaaactaacctcatattaggatgtaaacatttgtatgtccagatttgttgcactagtatgtatgacgttgactgtttttttaaggacggagggggtacgtactactagctagctagatgccgacggatgatgatggattggaaaggcaagtaagctggagtaggtggtactagctagctaggtgtgccacgcactcgcactgcacggagtagtactgctgctgcagagaggcgcacgacgactataaaaggagagtgcaggtatcttcctatagtagctagctaattgtattatactagcttgcttgttcaattcaatcgagcagtagctaattgcatagtgatcgatcgatctgtatagatggtggtggccggcaagaagcagggacggcattctttttctgcatcatcatcgtcgtcttcgtcttcttcttgttcagtagtgcagctgggtcatcatcagcgcccacagggtgaggaccctctcatcggcatcaaagcagcagcagcaggaggaggaggaata

SEQ ID NO: 2159 - DNA, 2000 bp, Oryza sativa
  misc_feature (844)..(846): n = any nucleotide
  misc_feature (1057)..(1057): n = any nucleotide
acttacattatgaaatggagggagttagaaagttatatacgggccaagctccatccatgcccaggcggtgtggcccatcttggtctgggccatgtgaaccttgcaaagaataagttcactttgactccctcaactaataatctaatctgattccggatatctcggaccccaactattaaaaccgatacaatttgactccctcggtggttttgttgacgtggcatctacgtggcggtactgacccggtctttcctatacgtggcattgacatgacacttatgtggcattagaatttaaaaagagtagatgatatctcgcgctttgctgtgagatatatgttagataatagagaaatgatgaaatgatttggatcgaaatattatgaaaatggtttgagaatgatgatttgagagagagggaggaggaagggaagaagagaaaggatgatatgtgggccccacatatcaatggccagcacaatatgttttgtgatatatacggagtactttttaattcaaaatgccacgtaaaacgccacgtgggaggaagattaggtcaacaccaccaagtaggcaccatgtcagtgaaacggatcttcaaaatcatagggagttaaattacaccagtgttagtagttggcggtcgacataaccgatactgcgattgaaggatatgaatcagacgcggcgagccaagaggacttattccaccctgcaatcgcaagcgccgagtgggcccaaattatactggatcggttggatgaatttttttattaaaatatttacaaaaatattttttttgtttcgaaaatttacaaatctaatcgcctaccgccctttgggannncgatatttaaaaatcgcccttccagagggcggcaagggacctaaatgcaaattttccagcacaacttgttagctctgtgattttacaatttaaaattatattatataaagtcatatgaaataaaactttatatcaaaattgtagagctcaaggagatctacaactttttcatttaagatgttttagatatccaaatattcgttacaaaatntaaaacacattttaaaaaatcttagatctatatttcaaacgacattggatggagataaattttatataaaagttgtagatcttgatgagatctataactttgtagtttatcacttttccatttaaaattatctagagtatcgaataagcattattagtttttaagcaattaaaaccggtggaaagggtttgaacacaaataaaaattttgcatttaggtctcttgccaccctctggaagggcgattttttaaaatcgccctcccaaatagcggcaggcaattagatttgtaaatttttgaaaaaaatatttttgtaaatattttaataagaaaatgtataaataaaaaaaattttggttggattgaatggcctcagcagtgaaaagtggacttgttccaccctgcaatcgcaagcgccgagtgggcccaaattatactgaatcggttggactgaacgcctcagcagtgggggaatttaactatttaccacttttatatttgtcaattatccaaatataccttttaggttcacacttaataatttgtcactggagagaggtgatttctttaactatttgccacttttaactacatggcgagccatcgtggcatgtccgcatgaaaaacgacatggcatgccagcagtgaggtcacccgttgcgacacaggtcgcgccagcgctgacttgtccacccacccatttcgaagggcgcaaaccccccaaacctccggattccggaacttgtccaccacaccacctcgttgctcgcatctcttcctgatcccccccgttggattcgattcggggcgtaaaatttcctgctctgcaatccgtcgcaatcaagcggccgctttccgaggccccgggctcccttcccttcgcatttatcctcgctgagactcgagaaacaccgcgaccaggagaaatttcagcaggagcagg

SEQ ID NO: 2160 - DNA, 2000 bp, Oryza sativa
  misc_feature (70)..(70): n = any nucleotide
aaaggatcaatctttgcctatttaaaaaataaaatctgcttccaacaaaatattagtccggccaaatctncctatccatctcggttctcggttctgattccgatcgcttgccccgccgcatgcgcgctccatccccacctgcggctctctcttccctgttgacgtacggacctcatccatgtcgtccctcctccctacttggcagccctcttctattagcacccctcttctcccctacactctatccctccttcctggcatccctctcctccccaaccctccttccctcctccccagcgtatctatgtgtaccgctaaaatttagttgaccgatcaacgccataaacaaattatgttaactctataccataaatcgattcaaaacttaaaaagaaattatcacttccatctacctgtgtcatttcctaaagggcgccaagcatgaataacaatggtgttatacacgaactgtcaaattaaattatgaaataaattctttttgccacatatgtcgtaaaaagagctgcttgtctactttggtgtttggagcagtatggctcctaattcatatcagtatacactttatcaatatacttcataaatttatattttcttgataccaaaaagaaaaatgaactttatgatagaaatttaacggtcaaataatagtcaactgatgaaaggggtatagaagggatccaaattgaaacttagggatatgaaagaaaataaacaaatctcaggagaatagaagggattgggtgaagtttcaagggtacatatggaattttctcaacttggagattcgtgcatacatctaccagtccatatctattgcaaccgttcattcattttctgtgttccgtattctttaggcctgattagatcttctggcaagttttttcaccctgtcatatcaaatgtttgaatgcatgtataaagtattaaatatagataaaaattaaaactaattacacagattgcgtgtaaattgcgatacgaatcttttaagcctaattgctatatatttaacaatatggtgctgcagtttatagacggattatgtatttttttttgttattagactacgtttaatacttctatgtgtccgtatcttcgatgtgacaaaggtataaacacggcctttgtaacctttgtaagactgtgtttagttcacgccaaaattgaaagtttggttgaaattgaaacggtgtgacggaaaagttggaagtttatgtatttaggaaagttttgatctgatgaaaaagttagaaatttaaaggaaaactttgaaactaaacacggcctaagtatagtcatgtcaactggacccacacctgtcctaatagctggtggggatagagtggcagtatatccatccccaaaccacacgcgctgtccccgtcatgcgtgttggtggtatagtactagtcagccacgttcagctaatctgatgcacaggaactcccctaaagccaagatttctcactttaaaacactgaaatgcacagtattcgattgaagttttataggttttcaatggtagtgcaccaccttagttttggtgctagctccgccccaataactagtacatcttttctagtaccaggatcttgtgttggtgatagagagggccagcacatccatccccaaaccacacgcactgtcgtcttctttccccaaccttcctctctactctccctccaaacatccatggcgtcttcgccgccggtgttgaagtgttgctgccgttttcctgtggcaatcaaaacctcacgcacggataggaatccaggccgtcgttacctcgtgtgcgctcgtgaggtgaatgcccatacatttgttagattttctttttcttggtttgttgcactaactgaagcagttgggaacagaaaagcggctaccagtctatacctgacgaaatcgcgtgcgcactccaggccaagatggtgcacgcacctgcgaaagaggcgatcccgctgctgacgccgtacaag

SEQ ID NO: 2161 - DNA, 2000 bp, Oryza sativa
  misc_feature (368)..(368): n = any nucleotide
tgctctagtaaatgctaagagtcgattctgagccgttgtcatgcataacaaccatactcctttctctttcctctatgtcaccaaatttacttgcatggcaatagagagagaacactaataaacaccgttgtacatgcccttatacatgacaacggcttaacaacgactcttacactataatatagaaatatggttgcatgaggataaaaatatggaaagaatattaacaaaaggaatattttttgagttaatgattagagtctttgtcgtctcaactattataaagacatggtctctaaatatcttgtattgtttaagagaccatacctgtctctaccattgaacatgcccttagagctaagctaganttgccctcgtatgagtcgatctttatttgttttctttctatctgctttcagccattcggtcaagttccagctttccaagatggcgatcttatccttttcggtaagatatctctaggggaaaacttgtacatactctagaactgaatagaacactacttaatataaagaatctaaacatgctgttttgtcatgattcgttgtaatatatggtgttctatctaatcctactgttagagatatttgtgtgcatgcatatcttattctgtttttgccgtttatctctcacaatctattccgattttgtttctataagtcggttgagatattgtggagaggtagaggctatatgtacacatgttgcgcgatgaatctttttatcgtgttgagctatccctgctttcacctacattgatatattataggacggagagagtaaatgttataactttgatgaaataatcaaaagttcaaaacataagcatacttgtagggtattttggtaagttttagtctagactttggtactttccaatacctaagtcaatgagaaatatcaaaatttgtattaaaaaatatgataaccttttaagagatagggagaatacgaaaaatgagatacttagggtatctacttatataatccactcgtatatttttacgcctcgtaacaatacaaatgaatgtgaatacgtaaatttaactaagctgttgtcttctctgccatcgttaccaagttgtcactttcttttgtcgattgacagagtctcgtgcaattgcaaaatatatactccacttcgcaaaagcgcatcagacttgctgaaggaaagcaacctctcgcagtctgcaataatggtcgatgtgtggctcgaagttgagtcccaaactttcgacactgccatgtcagcaatcactttccaatgcttaacaatacccactttcatgggcggaattgctgacgacaaaatcgtggaggagaatttggggaaactgaagaaagcccttgaggtttacgaggcacgctcgtgcaggttcaggtacttggccggtgatttcatcagcctggcagatctcagccattttcctatgacgcactacttgttagctactcctcatgcatcagtgctcgatgcatacccacatgtgaagtcttggatcaatgatttgatgaagaggccggctgtgaagagggtgagagagcttatggaggcatgatgagaaaaaggagatatccatcaattaatcatcagtctgtaggtatgaaatgtttgtcatttctggtggggctgttagttaattataatggcttaatccagagaaaggaaggaacgacattcattatcttaattaaaaccaaaaaatgtcacgcctccatgtgtccacgtagcttattatgcagctttgagttgagagacttaattccaagttgtttcatgatttgatcagattatttaaaaaaaaaaatctctgctgttgagatatgcatctccggatctccccatgagttgaccactacagtgctctgatcaactcgctataaaagcgaccaaccccttgccttcgcctcaagtcacacgacgccatcaatcaccatctacacctctagagagctaattaagctaaggaaagagaaaa

SEQ ID NO: 2162 - DNA, 441 bp, Oryza sativa
  misc_feature (113)..(113): n = any nucleotide
  misc_feature (270)..(270): n = any nucleotide
  misc_feature (280)..(280): n = any nucleotide
ttaaagtgaaccggtaactttcggtgctataaaaccaaaaacgtgaactttcgatgctatataaccaattttgcctaaaaaaaagattgttaagttgaatgaacagatttgcnaaatctcaaccatgaaagtaacatttatatatggtcgtcgatcatgaaacgtttgatggtttctcgttgacaacatataggcatataacgtttttccgagttgaaccaatgtgccctacatccatataccggcacgaggtatatctttccgtaaganccatagagcnaaaatgaattattgtattagagacattgcatccatgcatgcagagcaaactcatttagtataaatactgcctaatgcaagcgttaatcatcacctctgcatacagtctcagatagctagccaagctgagcaggactaagatcactcgtgaattcggagata

SEQ ID NO: 2163 - DNA, 2000 bp, Oryza sativa
aaaatactttaagcacaacttttcgttttttatatttgcacaaattttttgaataagacgagtgatcaaacagtgcaagcaaaaactcaaaattccttatattataggacggagggagtattagacacgttgtaacaatctgttgcgtggattgttttgcttttacttgacatcaaacttatttatgtgagaagggatttttttttaccaaccaatatatgcatcttttttaaaatggaaactaaacccctcaaacaacctaaaataaaactaaaccatatgaaattcgctcatataaatatttgaactcagaattttaggatgctactcaggtcacgacaaccgctaacaacatatcatttagctaatgacatcaaacttgttgacttaaatatagatggtagacaatataccgtcaacacgtgacttggtggatcttaaaatatgtcggtccataattcaaaagtgcttatagagacagaatatgcatatgtacgttcctatataagtgagtgtgtatgtatatatataagtacctacacctatctttcgtttaaaataaatagataactatttccccttaacttaatcgtcggcgaagagctattttcgctagcgggttttaacccccatctctccttacaattttgcaaacgaagggcgtatgtcaccgccagcagaaaaaaacaatgtgtattaaaaattatttttctagtagcagtagaaagatctgcatgcttctcactccaacagtccaactcgaaagccaatcactgcagcagtcaaccaattcccgagaacttcactggaattaagacatccatgagacgtacatgtccattcgtgatcgtgtcggttcttcctcccgtcaaacacgacttgacctgcaataatttcaactaagctggatagctagtacacatattgcatccaccgtttgctattcatcagccgcgcgcagtccaattttaaagtttcaaatttatcgtagtttattttttaatattaattttatataaaaaagcatatataaaagtttttgtttataaattattttttaagtcgttaataaatactccctccttccctaaatgtttgacacctttgacttttttaaacatgtttgaccgttcgttttattcaaaaacttttgtgatatgtgtaaaactatatgtatacataaaagtatatttaacaataaatcaaatgatagaaaaagaattaataattacttaaattttttgaataagacgaacggtcaaacatttttaaaaaagtcaacggtgtcaaacattttgggatgaaggtagtattatgtcttataatcaactggtagtcgaaacggtaggttgtttcagtttctaactatgaacctctaaacataaacaatacttgtcaaagtgtatggaaataaaattttagtttggaacgaaggtagtagttacttgtatgcataacaatgcttactcatccgtccccatcacgtgaaaaaaaatcttttcttcacataaaaaagaaaaactcatccatccccaatctatatcatatctatcacatacagtcatacagatatgcagcaatgcaagctcagctagtcagctctcacagacaagtcgaaacttctatcacagatttctggtcgatggatcgagttagcctaacttctccgattgtacaagagatatgcatttgttcgcccaaaattgcggctgaatttgtatgcaatcagtgaatatatatccacgcaatttgtcaacttgaacacacaattggttttccttggatacatgtgtggaaatttcaccgaagttgattttcagaagcaagtgaaagagtcagccatgacttagacgcgtttacctccttctggctctatttaagcttgtggaatcgaagcaacctccatttcactagcatctagcaagtgcacaacacatctataaatcgtagtaaccaccttaggtgagatgatggtcatggcgatgatgagaagggtggtg

SEQ ID NO: 2164 - DNA, 897 bp, Oryza sativa
tttttttttgggcagctgacaagtgacgacgttgagaaatttgctgagtgtggcacgaaatacactaaaaagatccatctgtataatggaaaatgtttatttatataataagagtaccagaaggatctcagtgtaaaagttccagaactgcaaaactgtgaggtttattaggtctatgatattaagaaatactagaaggatcaagatgtacaaattccacaactgcaaaaaccgtgagatttatatatttattgattagaaacatctatagtcagggaccaatctgttaagatgaggacgaacaacagtgacatctgactagttacgtgcctgtgcattacaacggatccagagatatatatacctgtttttcatgcgttttttatgagtgattttttttaaaggggggagggagcagtttttctgggaaaaggagggatgagaacaatggtgcttctaagaaaaagaagggaaaatccgtggtatttgaagataacctcgtgttaattaccccggtgtcactttcagtcaccatcaccactttcgtccagttgcacacgcgcgacgcgatgcttcttccccttttctctttcgaattgtatccaatttgaccacgaaatttactcactcggaattcagaagatgagtagcctgcaagcgtagtagagacgaagaaccttggtgaccaaggcagcagcagcagcagctagctagctgagtcaacgaaaggaaaccacctgagcagttcagtcgtcgtcttcctcctcctaacctccagctataaaaccagctcgccccagatcaatctgatcatagcaaaactagcaagcaagcaagtgagcaacaacgaacacgtacatacatacgattgagaggaggatcaattggagtagtaag

SEQ ID NO: 2165 - DNA, 2000 bp, Oryza sativa
tctcgcggtttccaggcgagttatgaaattagttttttcattcttgtccgaaaacttcttccgacatccggtcaaatatccgatgtgacacccaaaaatgttcttcgcgaactaaaaagggcctcattagcacttgatcggtaaatttgaaacattagcactgcaagaaggcgatcgatttgaagcagtcaaattctgatcacacagtaatttaaataaatctatatgccaagacacatgcgacggcagcaatatattttccttttttgctaaagtaagtacgtagttaaattaagcagagatctgcaaatgcctctcttttgctacggtaaaactaagcagagaagatctgtaatttcagtttctttttgtcagaacacagctactgcactttgtattgaaatgatcgtgtcagcgtgtctctgcactcatcccaatctccgcatgcatcgcgtgttcttgcttgtttcctgtgtggtcgatccaatggtcggatctccacttatcacggcgtatgaattcgtcaaagtcagctgctgccatggatcgagagcttcgaggtcgcctctacaatgtcaatttctctcttgatatatataattatattcatcagtagattcttgttctgattttgcataagtcaaagtcaattaaacagttagtaattctgctaggtatagcagtgtgagtcatcagtcatggagtgtaatcgagttggtggtttgtttactatagtttcctgctgtgttcaattaaatggtcgatctttcatacacgatctcgatcttgatatatgcacacatggctagcgtaatcatgctgatgtttgcactattaacaaaaaagaagaacaacgttatattttggagctgtatgaaggtcttttgatttgcattttcagttatatatatgaagaatgtttttagaaatacttgtttaacctaaacatttttaagaacatatataggagtgctataatgggctatattttgaatccaagtgatttcacggtttgagaagttattggggaggtatatatataatttatatatatgaagtatcatagtaacaaaactacagtataaatatggacatctctgtatccctttaaggactacaaaagaaatctctctaagttgcattttacatggttcaattctatgatgaagatgattgtacgttcacaactagttacctccatcccaaaaaataacctctagaacgaatctagacaagtgcttgctcggatttatccccagtagttgattctttctatgacgaatattggtgtaactttctagtgcaaattacacaactatagattgaattatacttgaaagtataactgtgtcagatatatacatttttaacatcaatatatatggttaactgtaatcaggacctaccctgaccagattgtgatgaagatgtttctctctctttataacttggttacttccagactgatgtcattttctgtagtagtgtaagccttcaaagcaaatatggtggctctttttagcctgatctaaataatataatataatagtttatatataacaatatactccctccgtcccaaaaaaaagccaaccaagtacttggttggcttttttttgggatggagagagtaggttatagcaacatgagtttgtgacagaaagaagtataatagttagcgaggttagatatatttatatgttcgagactcagtacataacagtaccaacaaataataaaattgtgattcacacagttatatagattgcttcttcaagtaaacgagatctttgctagtacaattttttcagcccaacttgacacctaattattacctacagaggtttgctaacccaaaaggccaaagtggctctattaagataataagtaacaagtgttgcatatggcctcgtcaagcactataaatactacccatgcaatccatcacccatcacccaaaagtattcatctattctttcactactcagaataatctcaca

SEQ ID NO: 2166 - DNA, 1717 bp, Oryza sativa
agagaaaatttctagtttggagaggcaactagaagaggctagagtaagctgcaggacgagatcattaagctacaaggagaaaaggaacgagcacttgataatttgcagcagtcaaacacttcaattaagacatttgaagaggaattagagaaacagagagaacataattctattcttcagcttgctaatgacgatctgcacaagagcatcgctaacctggagaaggaacttgaagacaccaaggttagttctcatgctgaaattttagcactacaagaacagaagaacaaagcactgtcagacttgcagcagtctgaaatctctatcgagaacttcagaatggagttagagcaaggaagagagaaaatttcaatcttggatctatctaatgaagaaatgaaggataacaattatagactgaaccagcaattggaggagataaggactagtctgcatgctgagattgcagctctacatgaagagaaggatgcagctcaattagagttacagcaatctctggcttctgcgaggaacttggagacggtgctagaaaagcaaacagagaacctttcaactctacagcacgctaatgataacttaaagaagaacaattgtaccttgactgagcaattcgaagtaatcaagattgagctgcaggaggaggttaagatggcacatgaagagaaggatgccacactaacacaactagagaagtcagaggattctatcaagaatcttgaaagtgagttggcacagctgaaggaggaactatcagttcagatggaaagcaattccagcttgaacaagcaattggaggaggcaatattgaaagtgtcaaacttaactgaggagctcgagacagttcaagctgagactgccagtaaaattaatgacatggaaactaacacaaaagatttggtaaatacaattgttctattatcttctcagaagaacaaagtggaggagcatatgaaaattattaccgaagcatgcatggagaaaatgtcatttatgaaagatttcgaagatcaagtaaagcaaaaaattacagatcgtgagatagcaattgcttgcctccagcagagcctcagaggaattattggcagctgccagagactccagtatgcatatggagaggtatccacaaaggcatcacaccttgaggtacttaggaggaatcacctcgtgcagatagatacattggagaacaaacacacagaaattatggagaaacatcgtcatttaggggaggaaaatacatctgcaaacaaagagaacagaaagctacaaaatcatgtccaagaacttgaagctcagctccagctagccaggcagaagcttagagttactgaggcagaaagcaaaagcaaagaagacagctatgtgatggcagtggaaaaatcacatagagagatccagtatcttgaacagaaaatacagaaatattctggacagatcaactcactggaagaaactctcgtacaaataaaaggaaatgctgagtccggaacctccacactggttgatcaattggatcagctagaatcacatttcaataagagtttttcccacttctctgcccgttcatttgcatgcagtgaagagctcaagctcttaaggaacaggttacagcaccatcttgctgaacagaaagaattggtcaagaagaatgatgtgctaggtatgaggttgagagagaaagaaaacgttttgtcag

SEQ ID NO: 2167 - DNA, 2000 bp, Oryza sativa
acctattctttgagacgggctggtgtcatttataacatacagaaatctgtctcaatcgaaggttgtttatctttcagtttcaatacaaatatcttgtcaagtcaaaataaaatgtggcttcattaataagaagatgatagtactagtggagcacagtagaatactggactaaggagaagtcaacttatgcaggtcaatttttttaattgtcaagaacatggcccaagacatcaatgacataacttaaggacgaggatgcaaatataggtacaaagttttcagctcttcagcatgcatataccatatcaccgctcttcctctactgaacccttctatcagtcgtgctgttcttcttactggcatgccacagggggagatctttaaatcctcttatgcttctggctagctagatcagaagaatcactttaaatggtattttttctttccctcgtgttatttttgtccataagagatttcgatatcatgactaacatggataggttgtcacagttaatgcattcttttatacattctagctggagtacttcaatcttttgtatgcagtttgctattttcttcagttctgctctatggatatatctattacctctatgatcactggttgcggcgctgtaaacttatgcttcaaactatgttatttaaaaaaaatatttagtaaatatatatttagatgccatctttatatagttaaaaaatttgctccctcgctctccataaacacaatggccagtatctttgaaagctcaaagctttatcttgactgctattatttccagctaatctaatatgtcaagtttcagatgtgaacaaattaattttagtttcgcagttgcttattatttggatggagtatttggtgaatctaaggtctgatttggaatgtacaaatttaggacaacttctgtggaaattgaactaatttacacgaaactcttgaaaaattcctaccttttctaaaggaggcctaaaaattttggactcaaccacctcctccccaaagagataacattaccttgatttttacaaccattgctttctcaaaatttcccagttttttatttcatattttactcccatgtttatatttctgggtcatgtgcagcccattagggctgaaagcagcaggcgacctccctagggccagcagcactgcaggttaacagtaccattgtggttatcattcatgcgtggttactgtttacagtcggtgttcaaattaaaggtagaaatgagatcgattagttagctacttcctctgttccgtattataagtcattttaggtttgtcctaagtcaaacttctttaagtttggtcaagtactaatattttcaacacagaacagatgtactacaataatatattcaatggttgattcaatttgaggttgtagatgttgctacatttttctataaaattcgttaaacttgaagaagtttgacttaggacgaacccaatatggaatggagggagtgtttccttaaacttagcgatatgtgccttaagagtcaagttatcccatctgtatgaagataggggttatatcctctttctcccttgcccttgtggtgcactgcctcaatggcattttcatgatacttgggtccagggacaccttacttggactgagggttctagtcccagcatgctcattatattatatataaacgttgtacaagtagcaacgatcatgaatacacaacataactttatatatggttgtaagtaaagcatgcaataaacttgtaaccattatctgttaagtttcgttgtaaataattggactggtgcatgagaagttccaccattagaattgaatatatatcatttcacatttagtttcagggtcaggcactatgtacccaactacccattttatagttcattatgttgagatttcagcagtatgccaagctaatctccaaatttattcagcaggtgaggtgaagaacacaattagatagcacttcccattgagaaa

SEQ ID NO: 2168 - DNA, 2000 bp, Oryza sativa
  misc_feature (90)..(90): n = any nucleotide
  misc_feature (260)..(260): n = any nucleotide
  misc_feature (271)..(271): n = any nucleotide
  misc_feature (275)..(276): n = any nucleotide
  misc_feature (282)..(282): n = any nucleotide
  misc_feature (913)..(913): n = any nucleotide
  misc_feature (1004)..(1004): n = any nucleotide
aaaatggaaagcaggttgaaaatgggcacatggaaaagcgcagctggactgttgagatcgaagtcaatactcctccgtccttaaaaaaangataaaccgcagttttctgtgccaacgtttgactgtccgtcttatatgaaaattttttataattagtattttcattgttgttagatgataaaacatgattatactttatgcatgacttatttttttaatttttttcataattttttttaaataagatggacggttaaacnttggatacggnaatnngggttngtcttttttttttaaggacggagggagtactacttacgcaactactactaccgctggtactagtagcgttagatttgatatatatcgagcagcaaccaaccggcgagttccaaaagcctccgatcatccaacgccggccacacgcgagcgtacgtgcgagaagactctgaccgactcaaacaacggatcctgaaatcatctattgtggacctcatcatcactgacccccgacaattagtactaggagaagaggggggaaaaaaagatccaaccgtcccgctgacttgcggtgtgtggatagcagaaagcgtacgtacgttacgtagcagcagcagcagcagcagcagcagtgggcgtgagccgtgaggtgagccacggcccacgcccacgcgcgcgccgtgctgaagcaggagcagtcgggatgctcgcgttggcgcggcgcccacgtgaaccgagggcgccacggctctctacagtctagtacaccccagccacacccgcggctgcggctgcacggccgatcgattcggtcacccaaactgcgtggcagcgtggggggcgcgcgcggatggacaccgcgtgagtgcgtggccgcgggcgcggcgcggcgcgacgatcggctacgcgggcnttggggttggggacttggggtaaacggggaacgcgtccagtggcggctacgcacgcatggaggagtcctcttcggcgccgcggctcgcgantcgcgacgcccacgtacagtaggccactacgacccgttctccaggctgatgtctccggcgccgagcaacttgtgccgttggggagtaatggggtgtaaatggcgcaacgtaatactgctacttgcgagttgcgatttcacaaaactatagctacattatggattattgtcgttttgtaacaaaactataaatttaagttgccacatgatcactgtagcctattgagttaataattccctgggacatactcccttcgtctcttaaaaaaaaccttctagcaatatgtagatagagtatgtacagattcatgatagaaattcgtttttattcctatgtctaaattcgtagtcagaaaatcatttttatatgacagagggtgtacaatgctatatagatagaaatactctagaatatgtatttttcatgatactattttggtgttaatatgtggttttacgatattataataattttgacgctaaattcttagttttgttactatatgtaattttacaaaacaatttttattttttttcaaattacttcgattgctaggttttgcttctataaatttattactttcacaaactatagctatatatagattgtttctactcaaacgtactcctttctgcgaaagaaaaataaaatccttttttaagctgtaaagttgattttttttatcaatataaatttacggtaagctcttcttcaccttttcttataggcacctttatattttctatattataagatttgtcaaagcacatgaatgcatcacggtgaagaagaaaataaaacaaaattacatccatatataaacataatatagtggccaaattgctttccattggtgcgtacaaatttagtcaaactatctgcattattattacaacataaaagactattttaaaaggtatagaaaacaaaaggtgaaaaagaagaacatgctattttctttctcgatggttgacaaaggaaaccaaccgatccaag

SEQ ID NO: 2169 - DNA, 2000 bp, Oryza sativa
tttaactaattaatacaaaatgaccaataattaggaagctaaatgattataattcttaagttatgtcatatttttagtttattagaatttttgttttatttataattaaatcaataatttaagatccatattacctatatttcactgtataaaaataaaaatatgttatttgaacatagacacatatcctttgcatagtaacaaaaaagaaaaaaaaagtataacactaaaaaatgacaataagtattatatcaccctaaagcattgtacgttcttagcagttcacttaagacgtcacatgttatgtcttaaataaaaataaaaccttataagttggaagaaagaaacatctaaccatcagtttccacttaaataggtgatccattattttttagccaataggtatactattaaaaaaatcttaagccatcatgtattatgtcttaaaaattaggaaaagaagagatattagaaaatatgagaaaaaaaatcagatcatcgattttcactttaaaccatttagaaaaatagaaaaaaaaacacccctccacttcgtcctcccccacacatgcacaacacagcactacccatcccctttcctctcggcttgaactgtccactcttcctgttttttagcatgaaataataaaaaatattaaaacatgcataacttttaagatacgtatctaacctctaatctaactattgttgtattcatagttaaaccaacaatctaaaaatccataacgcctatattttgaactggtataaaataaaacaagaaatagaaaatgtcaatagggactaattaaattcaacaatttggagaaaatgtaacaagttggtaaaaaaatggttattacaaaattgatgttccattttcataacaatttttgaatgcttatatattaattttttttaggtaatggaatataatatcccggcctttactcaaaagagctacatccaattattacatagaagcgttcaagaatatagtgtaaatctaaatgaatagaacacatcgtaaagaaaaacaaagaatctagcctaacataaggagatcacaattattgaagtctatttgtaaatctccaaccataattggtaaaaagttgcataaccgtagtctctaacttccggcatgcaactttcagaaactcttcatcttcatcacacctttgtagttgtgtccaaaaccggaactaatgaattgctttgaaaatgacctgcatataggaaaatgatggtgatttatcaaaaatcatatcgttcctactcagctatattgcccaacaaatggcagaagctccaacaagtatcagtttactcattttcttatcaactcccaaatgccacgcatcaagaatatgagatatgctaactggaagattaaaaccaaaagagaactggactactctccatataaacttcgcaaaatgacaatctatatatattatatatattaatggccttacatctatcttgtatcgtagtattaccggtttctctgcatattattgcatataagtcacactaaggttgaaaagttatatttgttattattaaagttattttttttgattcatcagaactagctattttcttttaaaaaagatagtataaataacacatattacaaaggaaggagtaattgctaaacccaatacggtgataggccgcccctcttgtggtctctgagactgagtcacttgcaatatctacatgtttcatgtggagtaagtcaaatcacctcgctcgctttgcttcgacgaaacttcgacgacgcgttctcaccttcttccacgatgaaacggcgggaaccatttacgcgccacaatcgcgccaattatataagctgagccacaccgccatagaccaagcaacggtaaacaagcacacatccacacacaagcacacatccacacaacggcaattaatcattgcagagagctagcagctaggttagttaggtgagcagtggctgcaaggggcaagcc

SEQ ID NO: 2170 - DNA, 2000 bp, Oryza sativa
  misc_feature (666)..(666): n = any nucleotide
  misc_feature (733)..(733): n = any nucleotide
  misc_feature (743)..(743): n = any nucleotide
  misc_feature (1849)..(1849): n = any nucleotide
ttttttaataatgtattaaaacccgggcaatacacaaatatgggtgtacattaccaacaacattcagagagtgtaaagatacactccttacacagagttcactcaattaaccagcacctaaaaagcacttaggctcaaacccctaacaaaacaaaccccaaaattattgcaacaagcatcccaaagcctaagaacatcgcaaagaagtgcatcactcttcatcgtatcaccatcctccttaagcaacaaagatcactgatgagcccaatttgttcctctgaaaattaattacctgcaaacatgaattaaaattgaaatcttaaacatcacatcatatctacaaagctaaaccgcctaacacaaagctgcaattctaacaaaaaattggtactttagcctaggttgtaaatccataagctaactttcaaacatattagcaactttttcacattatctgaccaaacgggttgatgcggcttgacgcgtatgtcaattgtcccacacctacgtgtatattaggaaaccggtgaacatccgcccatttattgtgtgctaaatgaatgattatgaaaaaaatagcattgtgaaaaacatgatgtaatatatcactccacaaacataataatttaaattcaacttttacaagttgtaatagaatacaaattnaaatccttaaagttgaattaatcttacatgtttggtgtagagatatattttaatatatcttattaanttttttagcnaaaaatattatagttatgtagttaatatgtagacatgtttggtaggcctccaaactccaaatcctagctctaaacttccactccagtgggagctggcttctgttggagttgtagaacagctgaaaagtgtttggctagcatccagctccagatctgaaattgaaaaaaaaatggaaaaaaagcaatccccaatctggacaccgtcccgcgtgcgctgccctgccgccaaccgcgtgccgtccacccacgcactgcccgccgcgcgccatccccgactgcgccgttggctgccgctagggcgtcgtccccccactgccgcgcgccgcccgcatgctgtccatgcacacgctgcctgccaccggccgcgcccccccaagccgtcgatcccaccgcctgtttgcctaccgtccggtgggtaatgggaggaaaaaagagagagagagagaggtgaggaggtgagtttggggtagttcagtggtatttttgtataagtgtagtggtttttttaggttggagtagagctgtagggcagcaaaaatctagctttaccccatagtttattttttaaagtagctctgctaacttcactcccaaaaacggaggatctagaccgtatggtacaactctggctccagataagtaggagataagtatgagttgggagcgagagttgtgccaattggggcctaaattattaggagtccagacggatgactagaatccctctccttccaactccctccgccgtggtctgtctgtaattatctactcacgttcatgacctggaacgcgttaattaagttggcgctgttacactgttgggcaacatcagcacagcagtgcatgagcagttgagcacgatgagcaaaacaaacgaacacgactccacagtgcctgcacacggaagtcctgaacattttggccttcttccatcgtccagtctttcccttttccctggtcaatgtccgtcatctccatgcccaagaatccagccagccttcatggcattgcggttcattcaagttgccctgcattttgtcaactaaacgaggacatattttatttccccgagaggtcttccacagattccatcatataaatattgntggtcatgagtaattaagcttaaggtcggagagatgctgaggattactataagttttcaggacgcagcatcttttttcgtttccccatgtcgatcccgtttgttaattagccagcaagaagggaatccgcgtccgaggtttctgagctttg

SEQ ID NO: 2171 - DNA, 552 bp, Oryza sativa
  misc_feature (2)..(3): n = any nucleotide
  misc_feature (6)..(6): n = any nucleotide
  misc_feature (14)..(15): n = any nucleotide
  misc_feature (17)..(17): n = any nucleotide
  misc_feature (19)..(19): n = any nucleotide
  misc_feature (26)..(26): n = any nucleotide
  misc_feature (36)..(36): n = any nucleotide
  misc_feature (44)..(44): n = any nucleotide
  misc_feature (51)..(51): n = any nucleotide
  misc_feature (55)..(55): n = any nucleotide
  misc_feature (60)..(60): n = any nucleotide
  misc_feature (63)..(63): n = any nucleotide
  misc_feature (68)..(68): n = any nucleotide
  misc_feature (71)..(72): n = any nucleotide
  misc_feature (80)..(80): n = any nucleotide
  misc_feature (82)..(82): n = any nucleotide
  misc_feature (84)..(84): n = any nucleotide
  misc_feature (86)..(86): n = any nucleotide
  misc_feature (90)..(90): n = any nucleotide
  misc_feature (92)..(92): n = any nucleotide
  misc_feature (99)..(99): n = any nucleotide
  misc_feature (104)..(106): n = any nucleotide
gnnttnaagcatcnntnantcgtatncagtcatgtnacttcaanaaacgcnaacnatcancanatgcnatnnccttacantnantnaagnancaagttncaaannnttaccccaactacaagctctaaatcatatatagtcaatataatagccaattcatacaataattgcttactatactattaatacctggccctacctgtcatacacacattaatgtcttggagtccgtgctgcagctggctacagatctgtagctcgctgctcttctctctcttcctttatctttttaaaatatgtttatagctagcttatagcatgctattgtttatatttttaaaatatatttatagctggcttatagcctgctattgtatctgctctaatccatgcatggttaatggttatcgaatctcctttaatttgatcgtcgcacatggcgccaagtcgatctcatgaagaggaaattaaatctcccgccatccgccgctcgctataaatacccgcgcaaacctatccgctgatcaccaccacctctctctctcgatcgcc

SEQ ID NO: 2172 - DNA, 2000 bp, Oryza sativa
  misc_feature (1023)..(1024): n = any nucleotide
  misc_feature (1026)..(1026): n = any nucleotide
  misc_feature (1028)..(1028): n = any nucleotide
  misc_feature (1031)..(1032): n = any nucleotide
  misc_feature (1034)..(1034): n = any nucleotide
  misc_feature (1037)..(1038): n = any nucleotide
  misc_feature (1040)..(1042): n = any nucleotide
  misc_feature (1050)..(1050): n = any nucleotide
  misc_feature (1053)..(1053): n = any nucleotide
  misc_feature (1060)..(1060): n = any nucleotide
  misc_feature (1199)..(1199): n = any nucleotide
  misc_feature (1201)..(1203): n = any nucleotide
  misc_feature (1208)..(1209): n = any nucleotide
  misc_feature (1213)..(1214): n = any nucleotide
  misc_feature (1220)..(1222): n = any nucleotide
  misc_feature (1225)..(1227): n = any nucleotide
  misc_feature (1229)..(1229): n = any nucleotide
  misc_feature (1231)..(1231): n = any nucleotide
  misc_feature (1234)..(1234): n = any nucleotide
  misc_feature (1236)..(1236): n = any nucleotide
  misc_feature (1239)..(1240): n = any nucleotide
  misc_feature (1242)..(1242): n = any nucleotide
  misc_feature (1244)..(1245): n = any nucleotide
  misc_feature (1251)..(1251): n = any nucleotide
  misc_feature (1253)..(1253): n = any nucleotide
  misc_feature (1256)..(1257): n = any nucleotide
  misc_feature (1259)..(1259): n = any nucleotide
  misc_feature (1266)..(1266): n = any nucleotide
  misc_feature (1268)..(1269): n = any nucleotide
  misc_feature (1273)..(1275): n = any nucleotide
  misc_feature (1277)..(1277): n = any nucleotide
  misc_feature (1279)..(1282): n = any nucleotide
  misc_feature (1284)..(1284): n = any nucleotide
  misc_feature (1287)..(1290): n = any nucleotide
  misc_feature (1293)..(1293): n = any nucleotide
  misc_feature (1299)..(1299): n = any nucleotide
  misc_feature (1301)..(1301): n = any nucleotide
  misc_feature (1311)..(1312): n = any nucleotide
  misc_feature (1315)..(1315): n = any nucleotide
  misc_feature (1317)..(1317): n = any nucleotide
  misc_feature (1319)..(1319): n = any nucleotide
  misc_feature (1321)..(1322): n = any nucleotide
  misc_feature (1324)..(1324): n = any nucleotide
  misc_feature (1326)..(1326): n = any nucleotide
  misc_feature (1335)..(1337): n = any nucleotide
  misc_feature (1339)..(1340): n = any nucleotide
  misc_feature (1343)..(1343): n = any nucleotide
  misc_feature (1346)..(1346): n = any nucleotide
  misc_feature (1351)..(1351): n = any nucleotide
  misc_feature (1354)..(1354): n = any nucleotide
  misc_feature (1361)..(1361): n = any nucleotide
  misc_feature (1363)..(1363): n = any nucleotide
  misc_feature (1366)..(1366): n = any nucleotide
  misc_feature (1371)..(1371): n = any nucleotide
  misc_feature (1379)..(1380): n = any nucleotide
  misc_feature (1383)..(1384): n = any nucleotide
  misc_feature (1386)..(1386): n = any nucleotide
  misc_feature (1405)..(1405): n = any nucleotide
  misc_feature (1407)..(1407): n = any nucleotide
  misc_feature (1411)..(1411): n = any nucleotide
  misc_feature (1419)..(1419): n = any nucleotide
  misc_feature (1422)..(1422): n = any nucleotide
  misc_feature (1430)..(1430): n = any nucleotide
  misc_feature (1439)..(1440): n = any nucleotide
  misc_feature (1458)..(1459): n = any nucleotide
  misc_feature (1580)..(1580): n = any nucleotide
  misc_feature (1619)..(1619): n = any nucleotide
  misc_feature (1635)..(1635): n = any nucleotide
  misc_feature (1646)..(1646): n = any nucleotide
  misc_feature (1649)..(1650): n = any nucleotide
  misc_feature (1652)..(1652): n = any nucleotide
  misc_feature (1657)..(1658): n = any nucleotide
  misc_feature (1662)..(1663): n = any nucleotide
  misc_feature (1665)..(1665): n = any nucleotide
  misc_feature (1670)..(1670): n = any nucleotide
  misc_feature (1673)..(1673): n = any nucleotide
  misc_feature (1675)..(1677): n = any nucleotide
  misc_feature (1683)..(1683): n = any nucleotide
  misc_feature (1688)..(1688): n = any nucleotide
  misc_feature (1694)..(1694): n = any nucleotide
  misc_feature (1698)..(1698): n = any nucleotide
  misc_feature (1700)..(1700): n = any nucleotide
  misc_feature (1704)..(1704): n = any nucleotide
  misc_feature (1708)..(1709): n = any nucleotide
  misc_feature (1712)..(1712): n = any nucleotide
  misc_feature (1714)..(1714): n = any nucleotide
  misc_feature (1717)..(1717): n = any nucleotide
  misc_feature (1722)..(1722): n = any nucleotide
  misc_feature (1726)..(1726): n = any nucleotide
  misc_feature (1728)..(1729): n = any nucleotide
  misc_feature (1734)..(1738): n = any nucleotide
  misc_feature (1748)..(1748): n = any nucleotide
  misc_feature (1750)..(1751): n = any nucleotide
  misc_feature (1753)..(1755): n = any nucleotide
  misc_feature (1759)..(1761): n = any nucleotide
  misc_feature (1768)..(1768): n = any nucleotide
  misc_feature (1771)..(1771): n = any nucleotide
  misc_feature (1783)..(1783): n = any nucleotide
  misc_feature (1785)..(1786): n = any nucleotide
  misc_feature (1792)..(1794): n = any nucleotide
  misc_feature (1801)..(1802): n = any nucleotide
  misc_feature (1804)..(1804): n = any nucleotide
  misc_feature (1811)..(1811): n = any nucleotide
  misc_feature (1814)..(1814): n = any nucleotide
  misc_feature (1823)..(1825): n = any nucleotide
  misc_feature (1827)..(1829): n = any nucleotide
  misc_feature (1831)..(1833): n = any nucleotide
  misc_feature (1840)..(1840): n = any nucleotide
  misc_feature (1842)..(1843): n = any nucleotide
  misc_feature (1848)..(1848): n = any nucleotide
  misc_feature (1855)..(1855): n = any nucleotide
  misc_feature (1857)..(1857): n = any nucleotide
  misc_feature (1860)..(1861): n = any nucleotide
  misc_feature (1863)..(1865): n = any nucleotide
  misc_feature (1868)..(1869): n = any nucleotide
atccatattttgaaatccagttgtctttaaattgtactatcttcatctcaaaatataaaagattttaataatgtagatgcataaccaaaatttaaagacttttaggatggaggtaatacatgttacttgtcattgtcttttttcttttcttggttgtgtacatcttgactataagagaccgaaagtatcatgatataattattttaattttaataaaggaatttatttgcctctcttctaatctaagtcatctaagtatattttttgttgatatggatggccatatttttttatcctattgatgtagaattaaaaggaattttaaagtagtaaatctactatctagcactattaatgtacaatccaagttttcccattccttcaaattgacatgttatatatcagacacattactgacatgtcctaaaattaaactatttggagagggtaaattctaaaatccccttactaccagcgccacgattatggggtgtgagggtgatgatgtggtcaatggattaactttgggaaactctttttaatcacttaggtggacgtacactcatttattacatgtcaactaaatgattacgaaaaaaatctaaaaaaattgacaaaacatattaatatataatatattacttcacaaacatatatatttaaatttgacttctacaagttatgaatatatgtatatatgctagttagagtttgatttgttatttttgttacaactgcgaaagtccaatttaaacttacatatttgtagagtgatatattacataacaatctatcttttattgtttcaaagatttctttcataaccatttagttaatatgtaattaataaatgagtaaacatacattcaaatgattaaatcatgtccgctaatttctctttgtcaaattcctattagattagtagttttccacgggacttttgtaatacctgtacgttctaattaagtagacctaagagctactaatatatatcagttatgctgagaggaacttagctttcanncntntgnntnctnngnnnactgcganganatatcantgttatatatgtgtgtgtaatgtgtggtgagtacttataccaaggtactatgtagacatacctatcacgtattaaccatacagaaaaacatcaaaatgtgatacgtgtgaggaacagactgagtccgctacgaactgtnannntgaanngcgnnaatctnnnagnnngnanaancncgnnanannaaaaanantcnnanactacgnanncagnnngnannnncngannnnaanacgcgnanaaactcgctnngananananntnangagccgtcnnngnnccnctntctangcncaacacncntcnagctngcatgggnnagnncncgcgccactgttcgcggantngctntctcgcgnacnggagcacnggagagagnnaacagacacagtcaacanntacttcttgcacatcggttaatcaagcaaccggtcgagatgcaaaatctagccttcgtcatagtcacattgcttgcagcgcttgccatttctcgctgcaatgctgcggcgaccgtccggangcagctcacgcacgccgacgccgggcgcggacggcctgnccgcgcgggagctgangcagcgtcatngcnntncagcnncaanntntccgngcngnnnggcggntttcnagctcngcgngngcgncggnntcncncgngaccnacgncnncgggnnnnntacgacggantnncnnntgcnnntggcgcntcngcaagccgccgnannccgatnnncgcgtgnngntcgcacnccngcacgcgannncnnntnnncgcagtncnngcacntaagccncncanncnnngannaggctctcccttacttcgacccgtcgacatcctccacgctcatccgctgacttcctgcgactctcacgctgtgccaggagcctgccggttgcgtcgtgcggacagcccaaagttcatggcctgaacatcag

SEQ ID NO: 2173 - DNA, 2000 bp, Oryza sativa
  misc_feature (1660)..(1660): n = any nucleotide
  misc_feature (1679)..(1679): n = any nucleotide
atcgctcattggggcgccgaggttgccattgctgcctccatgtgcgagagccatcgacgccactggatccatctgcgggagacatcgccggatccgctcatgggagcccatgcttgtcgtcatctgaaccaatggatccggccacgggagccatcgtcgttgcaactgacaaatccgagcgcgggagccaccgccgccgcagcctatggatctgcacagtctccgccgtcgccaccgacagatctgcccatgggagccatcgttgtcccagctagcagagcagcccgccggagtcaccaccgttgagggggaggatgccacgatgccgcagcggtggagaggggagtaggaggggctgcgggtggcggtggtatagagacagagaggatatggagggtgtgggaaagagacggagagtagatcgaagtaaaataataaacatgggacatgtggaatgggagagaggctcgagctcagcggattatttcttccaccccgttcggctcaacgttgttttctcgatatgtgtcagtttaataaaaaaaacgcaccggtggctatttcataggtaccagttaaattgtgtgattgaaaaaacatgcactgaaacttatatttggcggttttttattaaacaacaccaataatgtgttgtaagtgccgattttagtttagactcatatgagagattagaaggatggggagaaagatcacatgtgccggttttatattaatcgacgtctcatatcactttttttatagtgaaaatttctttaaaaattaaataaatctattttattcatttataataaaaaatacttaattaattataccctatccctcgtcttgttttaagtgacggtgaaaagctaaagcaacttgcacattagaactaagctcaagtatttgagtgaagccatggatacaagttgttctaaccgatgacatctacacccttcatctaaaataaatcaaatcttaatgtctagattagaacttgtctagattcataagaaaaactaatttattttgtgatagaaggagtatgccaatataaaaggcatgtgttttatactcctccgtcccattttaagtgcaaacataagttttcacgctcaactttgatcgtccgtcttatttgaaatttttttacaattagtatttttattgttatgagatgataaaacatgaataatattttattcgttacttatgtttttaatttttttcaaaaatttttcaaataagacaggcatttaaagttgtgcacggaaaatcatggctgcatttaaaatgggacatacgaagtattaatttgtcctaattaaactgactgcatatattccaaaacacaagtgaatttgtcaatgtaatcattcgtattttaggacaaatatacaattaaagtttaactaaatttgtagaataacatgatcaacatctataataccttattaggctacgatcttcacttattcctcacaaaaaaaaaactctttccactacaatagcatctagaggaaatccctgttctagccagctctaagcaatatatactactaccagctgtatcatatattaatcatccacataactcccttctgaattttcataccccatcttagtggagtaacatgcatctatgaccttcgcctatatnaaaaaaatgtaagtacaangaaacaaaaacgcttcccaaaaaaaaaagcccaggactacacctttttgtccccattttttttgtaatgatccttccgaacattttctccatagaccatttggaaatagctggcgcagtgatattttctattcgtcgtccaaaccctcctctccgtctcatctctccctgcgtgcggcggtgtgtgtatgtggccaacccaataaatacccgcgaaagggttgaggcgttgagccgcgagctacgactcaggaatccggcgccgcaggccgaggcgatcgagccgggcgtatctatcttgtacacacagtaaagctgccag

SEQ ID NO: 2174 - DNA, 2000 bp, Oryza sativa
  misc_feature (456)..(456): n = any nucleotide
  misc_feature (1910)..(1910): n = any nucleotide
atgtgtgacttgtctttttaatttttttcataatttttttaaataagacggacacgttaagtacggaaaccaagtttatctttttttttttttttacggggggagtatgtacttactagtattgcatttatgacgcggcgcaacctccgattcgttcacctccctccctttctgtttactcggcagcagatatatacgccatcttgcagaagctttccctcctccaacttccatcacaatcccaccaaatccttgtcctcacgtcaacgatcgcaagccatagctccgatggatccatcgtaccctccctccgccaccgcccgccgcgccgccgccatcgcccgccacctcgccggcctctcccctcgcgacgccgccgccgttgctgcagcgctggagccctccgcgtgcctgagctacgcgcccccggagtcgtcggagcccgcccctgcgttntcgccgctggagctccgctcgctcctcgacgggcaccacctccgggagcgcgactgggcgttccgcgcgatggaggagagcccgctcttctgccagcgccgcagcggcggaaaggtgttcgtgtctccggactacaacgagggcaaggaggggcagcgggaggccacgatgcggcgggtcggctacctggcgcggcggggcgtgttccggggctggctcacggagccggggcccgacgccgagctccgcaagctcgcgctgctcgagtgcctcggcatgtatgaccactccctcgccatcaagatcggcgtccacttcttcctctggtacgttcccctcgcccccaattttgtctcaaattcgccaattcctagctcacattatattgccaatccccaatttcgcgctcaattcccagttttgagctctgctatggcagtctttctggtgcgatgaatttaggatcagccacggcattgtacgaccaaagacttggcaaaggcttggtttagttcccaactttttctttgaacttctaacttttacatcatatcaaaactttcctatacacataaacttttaacttttttctttaaacttttcaattttaatcaaacttttaattttgacgtgaaactaaacacagctagtctggtcatggtgtccttccgtgtctgcataatactgaacttactgcaagttactagtagcaagtaaattattaggatttctaggtgtgcaagcaatccatgagaaaagtaaacggaagagaaatatttgaggatggatcagatctaaagtttggatccaaacttcagtccttttccatcatattaacctgtcatacacacacaacttttcagtcacatcatctctaatttgaaccaaaattcaaactttgcgctaaactaaacacagctgtagcgcggcagcaggagtggggtcgtttatccgtgagcagaattgcagagtacctgcatcctgcaacacatgcttccatagtggcaacacataccctatccctgtagtctcgaattcgtgtatagcgtgcaggccacaaagtggcaacacacacagctaagcaaccaaccagttataaagcgaaactattataatcaatttaattaaagtcttgtttgatgaggcccaaaccagcccaaggaggatgagccaggaaatcgaactcgtttcatgcttggggagggttttgagacttgagagtaagtggctttgagagattcacatgtccagtacggtagttttcaagtttgttctgtgctcaggccaagcatgtctcacgtgtcagttttttttttctgcgtttcaatatttttcttcgtttgtcgaaggttcttcttaaaaagtatatttttttttggtccatttgcttgagacttgagagcatctcccgattcgatatatgtttgtcaacttcgaagctgctccggtgtctnatctccgctccgcaccgcaacgactccgacggtccgacctcttcttcctcgcttgatctcctctggacaccgaagactccgatggaaccc

SEQ ID NO: 2175 - DNA, 2000 bp, Oryza sativa
gcgacatggccggatcggtgacctatacctaccaaaattagtgtcactgttgtctctagactgtcatatatatcgccattttgtgttcgcgttttaatttagtagtcaataaagttggagctgctttttgaggccaagaacaaaactgtcactgctcagcattgacctagctgtatcagccgctgaatcgtctgaaccctggagctagtgctattcatgtaggtaggcgaaagccattaatctgaatgagattggcgaccctagctagttctaatagcgttgtgaatgtgtgattacgacttgagctagctgcaaactttgtgctgttagtagtcagcccaagagctagacttttgtgggggagaaaatggcgaactgggactgtgagtgaataataatctacctaccactctctaatgatttgagagatgttagcattgcttttctttcttcctctccctgatgatatatgcatatgtcctctctttttcccttttttcagtttctctgctctgctttaggtacagtacacacatgtagcttggatatatgcagggtggttggttgcatgcaaatgcagctagcgaccttagtgtggaccaatataatcaagctagcatgcgcaacagaaaaaaaaagccatgaatatatgcatgccgatcgatcagggcaatcagtgtccgacgagtagttgcgttccattccatgcatacacgtacgtacgattgattgttgcttctgagcaactcaagctagatcagaatggtgatgatcatcttttcattcatttggtttggtacgtcatgctgaaaacttcagcaacaaaaaatgaaacacaccggatgctgacttgctgtccgtgttgcattgtagcaagatgggggaaaccaagcaaatcgataaatcgacaatggacgcgattaacacgatcaattgtcgttgtgagcagcatcgtgcaggtcgttttcgtctgtcctgtctagtcttgatcatgctgatcgattccacatttccacgcccatagattgtctagtggaaaatgctagtagctaatttgttgatgcatatggacgtgtgcaaagtaactggatttgataccaaattcgacgtcaatatccttagtgcgtctagctacttacatgtactcctatatagctttcaccaatagtgcaaggaatgtaaacaggttggatattacatacatatatccaatctgattggacaagatatgataaggggacaagatatgataagctcttttcccctctgtatttccgtggttgtggatgcatatttttatgattccacccatttcatattataagttattttggatttatcccaagttataaatttaatttatagtaaaatataacaatatttctaacacaaaatattttagataatggatatgagtccaacgcctacatccacatacgtatgtacacaatagtagtaagttatcgtaatagaggaacaccaaatcacaaaaaaaataaaatactaaaagaagatagctccaaatccttttcggactattcaaacttgctcctttattatgtaccatcaatctagcatatcactcgcctatttacactactacagaacaataataggtgtcagttgggaaccccacataagtaccaaattttccatcaacacctcttaggtggtactgatgaggtaaaattaaaggtgtcgattctgaaaccgatacatttaaggttccatgaataaaaagaaaaacttagcacccacagaccatgccacattgaagaacaccttcatgatttatccacatagcatcattgatccatccaacaacaatatccccgcacaaatcacacaacacaaatcaccatcaatccatccaacaagaacacccccaccaaaataaagaatcatacatcacaattcacataaattgattacaaattttggcacaaatgaatagttccatcactccaattagaagtctacctgatctccgccatggagtc

SEQ ID NO: 2176 - DNA, 2000 bp, Oryza sativa
  misc_feature (573)..(573): n = any nucleotide
  misc_feature (600)..(600): n = any nucleotide
  misc_feature (1711)..(1711): n = any nucleotide
  misc_feature (1929)..(1929): n = any nucleotide
  misc_feature (1941)..(1941): n = any nucleotide
  misc_feature (1960)..(1960): n = any nucleotide
  misc_feature (1968)..(1968): n = any nucleotide
  misc_feature (1991)..(1991): n = any nucleotide
  misc_feature (1994)..(1994): n = any nucleotide
  misc_feature (1999)..(1999): n = any nucleotide
ctgccaaaacttatttcaaatctgacccttttgctcaactccaaatcgtgtggcgctgaatttagacacctcagcgccaaatagcatggcgctgaatgtacgttggcacgctgacttagtcttccatccaccgtggcacagcattcagcgccaactgacgtggtgctgaggtgtctaagttcagcaccacatgatttggcgttgagcaaaagggttagatttgaaatagcttttggcagcggtttatttgtaaaaatagtttttttttgtaaagagtcaaattgtcaaaatttgtgccaatgaagtattaactgttcaccgatccgtttgcagatttttctcatctgaaaaagaaaaaaaaaggaaaaggtagagagagatgttggcgagtaacattcgggagccgccaagtacaccaaagtactagtcgcaatatccattttccaccacctttaacagctttgacatgcaaagatatgcgcccacggggcccaaaatccgcgtcaccaccgcgcgcgctactctatttcctcgttcggtctccgtagtggaaacctcctccgcgtccgccgnaccggccggcatctcgggccggacttngcgcccttctccttcgcctctcacacgtacgcacgcacgtacaccccgcacaaaaaccccgagaatttccgtgtcaaatcacatgcggccgcgatcccgatcgacgcctacgacgacacatcatagttttttaaccggcgaatccactgccactaccccatcgatcgatccatggatccatcgccgtcgcgtcgcagaaattctcacacacggacggtcacacgtccgtccgatcggtcgatcagtgcgcgcgccgcgcggtgcacgcaattagctagcgagcgacaagacgacgtacgggttaattaacccagcaaatattctaacatggactaatcatatcaattcgtgtcgactagtcgatcattcgcaggggagacgtacggagaagccgtatagggctgagttctttcccgagtcatctcgatcgtattctacgtacaattttttttaaactactaaacgataccccataaaaaaatactaaacgatatgttttttttaaaaaagtttatgtacgaaaattatttaaaaaatcatattaatctattttttaaaaaataaataatacttaattaactataagaaaatacgttgctccgtttgcgtgtgtcgaaggtgacctcacctctcgagcacagcctacatcgactccgagacgtccaaatgggagggaggcatatattctcagcccaagccagtggctggctctagctggtaggggcgaatctacattagtatgagcggtgtcaggcgacaccaacgactttcggtaaaatctatagcggaactgcttatctatatactataatactatgatctaagcataattaacatactcctccatcccacaatataagggattttcagtttttgcttacaacgtttgaccactcgtcttattcaatttttttttgcaaatataaaaaacgaaaagttgtgcttaaagtaccgtagataataaagtaactcacaaataaaataattaataatttcaaaaaattttgaataatacgagtgatcaaacgttgtaagtaaaaactcaaaatcccttatattatggacggagggagtactactgcttgctggcggtgcttgctccggccaccgngcctagctagctgtggagcacataacatgcacgtcggcctctgccgcgtacgtagtatcttctcctcccctgtatactgcaaaacgctcccttccaacgcctcacctccctctcgccgtcgccgtcgccgtcctcctcgttgtcgttgtcgtcgtcttcctttgactccccttataatacaaggagagcgcgcgcccattgcatccatttgcttcatncccccatccccngggcctttttagtttggantccgtcgntcgctcgcttgcttcgggcggcngcnaagtna

SEQ ID NO: 2177 - DNA, 2000 bp, Oryza sativa
caagaacagttaggtttcaccagctgtggagaggtgatactgtaagcgattaacaatcagacgggtcgagcagacagacagaacagattgttctgaaatccacatgtcacacgccagcacgaatgacaaacgctagtgcgagtagaatattgcgagggggaaaagtgatcgctactggcgaggagcttcctagccggctctgcatcctgacagcaaaatggggattgttcttttgttcctgtgcagcatcaccatggataaccaaaatagtgtaccccaccaccaccactactctcatgctgcatggagcagaaaatgcttcaccaaacacacatggaaaacaatggttttttcctttactttttttttcttcttctgatggagttaaaccatcgctgtagccctgcatctagctggcctgaactcccccgttaacgtcgcaatccagaagtcatcagtcagtctgtactggacagatcccaatggcacctccaacgaaaatcagtttaaaaaaaggcggctcgaattgatggcatagcgtcacaaaggaagcaggcgaaccgagtataaacatgcagtctttcagatataggctgtgtttagggcctgtttggtacagctctaactcctaaatattgctctaggagttgagtctagagtggagttgtggggctgcctaaacccagctccacaactctagtacattttgtgagagagctccacttaactccactcacagttttggtggagctgaaactgtttgtctgacctccacctccaagctggagctgtgccaaacaggcccttagatccaaacttctaacttttttcatcacatcaacctgccatacacacacaacttttcaatcatatcatatcaatttcaatccaaacttccaactttggaaggaactaaacacagccatatccccgttccaattatagaatcggtttgattttttttctagttaattttttaaaattcaatcaaatttatagaaaaatctaacgatatttttaacacaaaacagacataatatgacaaaaatattcaatgttacgtatgatgaaactaaatttgtgttgtagatattgctaatcttttcaataaacctgatcaaatttctttgaaaggtttgactaagaaaaaagtcaaagtaacttacatttgaaaacttgcatttactttggtttgatctgttcatctaactatttgcaaaaacatttccacatccaaaaaaagtgttactccctccgtctcatattattagtcattttaaattttttttctaatcattttttatgtttgattaaatatgtagaaaaatatagtaatttttttaacacaaaaccaatatttcatcaaagtatatttaatgttgaatttgatgaaaataatttgatgttatatatgctgctaatttttttctctaaacctaattaaagttaaaatagtttgattaagaaacaaaaattatactacctccatattttaatgtatgacgccattgactttttatttaacgtttgactattcgtcttattcaaaaaatttatataattattatttattttattgtgacttgattcgtcatcaaatgttcattgatcatgacataaattttttcatatttacacaaaaattttgaataaaacgaatggtcaaatattggtcgaaaaatcaacggcgtcgtacgttaaaaatggtgagagtaatatatatgaaacggagggatactttcactagagctaccgcgccacccgctcacaacggcacagtgtcacgcgcgcgcgccagtccgggtgcgccacccaagtcaaccaccgcccgctctctctcccccttcaaaacgcccccacccaaagccaccgcacctcgccaccaccgccccaagaatagcacccgcgtttcatgcgctgatcgaccgatcgacccaccagctaagccacccgcagccgcggggcgagccaagcccaccgccgcagccgcagccacagcc

SEQ ID NO: 2178 - DNA, 2000 bp, Oryza sativa
  misc_feature (704)..(705): n = any nucleotide
  misc_feature (722)..(722): n = any nucleotide
  misc_feature (741)..(741): n = any nucleotide
  misc_feature (751)..(751): n = any nucleotide
  misc_feature (757)..(757): n = any nucleotide
  misc_feature (764)..(764): n = any nucleotide
  misc_feature (770)..(770): n = any nucleotide
  misc_feature (775)..(775): n = any nucleotide
  misc_feature (779)..(779): n = any nucleotide
  misc_feature (786)..(786): n = any nucleotide
  misc_feature (795)..(795): n = any nucleotide
  misc_feature (991)..(991): n = any nucleotide
  misc_feature (1157)..(1157): n = any nucleotide
  misc_feature (1353)..(1353): n = any nucleotide
gtaccactttttctattgtaaatttggtacctcttagtacctaggtactatgaggtatcaaaggtactatgagatattaaattttacactaaatttttgatacctgatggtacctcttcaagaaccgtagaattgtttctgttgacgactctgaatccgatttcataataggctgtgtttagttctcctccaactacccctaacttccaactttccattacatcacatcacatccaaaactttctaacacacataaagcttccaacttttcccaaacttttaactttttttagtaactaaacacagcgatagtttctctggaattcaaaaagtaattaatgtgattgatggttttgtcgtcgccgcctttcagacctcaccccgcgcgcgcgtgcgcacttacgggctacgtacggcggccgatggtgccaactgaacggtgcaaatggaaaacacaccatctccaagcaccaagctagccatcgtaatgcgaataccttcatggtttacgcacaaaccggtccaacccgtcaaccaaaccatcccgatcccctttttgcggctgtacagttgtacgtggggaggccatatgtgtggatcctgtgcataatcaccccgttgaatccacccccttcgtttctcgaaagaaatttgaaaatatactttattttttcatatattgcatttatatacctggctgtganntaatttacaagatatanacccaatccacggaacggnttgacgacgnggaganaagaacntgatgnatcanccgnttcccgntaaccgggnatacggtaccacgccggtccgcgggcgtggtgagcgcggcaacgctcccgcatgccagatgtgtgggaccggcgctcccacatgccgcccccatctcggtttcccgaattggatccgatatcctctgcacgaaaaacggagcagactattaacatataattaattaagtattagttattttttttttcaaaaatgnattaatatgatttttttaaacaactttcgtatagaaactttttataaaaaatacaccgtttaggagtttgaaaagcgtgcgcgcggatgagttggaaaaattaggggaagaacacatctctaagaacacgcgacctgttcggttccgcgcgttggaaccgcgcganagcgtcggtcccgcgccgccattctgcggcaccgccgcgttcactcatcctaccatgggctccatggctcccgtgcatcggctccgcggtaccgactcggtcccgcagccagttgtgcgggaccggctcggtcgcgcatctcggttccgcgcgaaccggctcgggtttccgctcccgcaatccccagtctgcggtnttcgtcatggctccgcgcatccgttcagcggattgggtatatttttgtaaattaatcgcagccaggtatataaatgcaaaatatgaaaaaataaagtatattttcaaatttctttcttcgtttctctccctcttccttcacggctgcgcgtgacgtgcggcgtatagtacgagtctccgccgttagaggccgtgattcccattccccgcacgcgccgccacgcgacgagtccactcgtggcccgcgcgcgtccctgtcaccccctgtgcgctcgacgagccgcatccataacccgtcggttcaatctgatggaggccggcgtcccgcgcacttgcgttttcccgcaaacgcgatcgctctgttcgtttgctccagtatggctgcgttgctgctcctatgctctgcttctctctcgtgtacagaggagcaaagcggtaaacggtctaatccgtgaagtcagtggtacgtctacggccgtcgactccaataagcaccgaatagtgagtaaacaacaatcttagctgcgagaaacagccaacgacttgaatggtcggacgaccaaaagtttactctcattaacaaaaccgagctcgatacaagtacaagtgtacagaccacccgttcatccgttccaccgtgcagtcacg

SEQ ID NO: 2179 - DNA, 2000 bp, Oryza sativa
ctcaattaacattggttatgcagaaaataaagctgcagttaacggaatcagattaaagaaggaaacaactgctcattttctgtaagacagcatcacggccttcagatctataaataggattaggcaaggtgattagtgatacattatgtgctgtacctgtttcaagaacacaatgatgagctgtaccatcatcaattgtgaaataattaattaaattatcattaagccccaaaccgagccaagccaagccaaatgaatgattgctgtggtgaagggcgacgactagtcagggatgagtcggatggatatgctctttatgtgatgcggtgcccaggaaacgcggcccaaccaaatcagggtcattaacgtcaaatcattctctgctaataatgcaaggcaccattgtttcttctccaactctctccctggcggctgcctcctctcctcttcttgctcggttccccctgtataaaagagaaccccgtcttctcgctctcctcgcatccactccacatactaccactcaaaaactctctctctctacccaaacaggttttgagaaagaagtggaggacagatccaaaaagttcaccttttgattatccaaacaagtttggagtttgttacctgaatctcctcttcttcctgtcaccggaaggtatgcagttcctctctccatatcatcttctagcgtttctttctacagattcttgattgctcgcttttttccattattctcttttgctccaacgtaggggtagggccacatcagttggacaagtagaaattgatggcacatcaattgagtagatgcggaaatttctggtttttagttaaagtttagaccatgccgatgccaaagtgctgccgtttaatcgaatacaacgatatatactcttgcaatggcatgtgtcatgaggtgtttgggtttggcgaggctcagttttcattgaatttcccctccttcccatgtggccgtatcaagcctaatctttgaaaaatattcacttcatgtggatgcggaatcactagatgcagcttgactccatgcaaatcctaactcctgccatgtgcccatgtgcctgtcccttatcctgatttgcatctgaattcatttgctcagtaatttgcttgttcagtgcctaatccgatagacgtccaaacaaagttttaattaggagcagaagatccagcaatgttattttttctgaatttgtaatgtcttggtttctgaattcgtaattgactatttttattaatcacctttctgaacctgaacgaaagatgcataatgattcacatcggttgcaaatttactgaatatttcctcttatttctagtgtgttattcatagagttccgaaactcaatttcccttttttaaaaaagcttctgatttaccattccagatttctgataagtacttagttaaagttccttattatattaattatctatattatctattacacaacacgttgaactcatgtaagttctgattgattatagggaacacttatattatataagtagtaggtataattatataaaaatgcagttagtactacaataagctttcaaaattcttcgtagtgacttttgtttggttaaagttcttacagacttccagattattatacgtaccttgttagcgacattcaattactgaatctgatgcctggttttgtttgtgcagggaaattgataaaaaaaaagcagtgaaagcctcaaggaatgctgaaagatgtgcttgcatagaagaaattttccgtgtgagataaagcagattgctggttcactagtgctactgatctgctcaagtcttgatgtgagtgatcaactttcctgcactaattctacaccatttagactccgaaacgacgatgatataagaatgttgttctccattcatgatcatgaccttggggaggatggctaaagaattgcagtccatctgattggtggtcaaaacatagtgctgagatttatatctttgtgggc

SEQ ID NO: 2180 - DNA, 2000 bp, Oryza sativa
  misc_feature (1236)..(1236): n = any nucleotide
  misc_feature (1253)..(1253): n = any nucleotide
  misc_feature (1292)..(1292): n = any nucleotide
  misc_feature (1294)..(1294): n = any nucleotide
  misc_feature (1297)..(1297): n = any nucleotide
  misc_feature (1501)..(1501): n = any nucleotide
  misc_feature (1904)..(1904): n = any nucleotide
acccatacgtaattaagtactccattcatatattttaatatatgacgcgttgacttttaacaaacgtttaacctttcaaaaaaaattatgtaattataatttattttattgtgacttgatttatcatcaaatgttttttaagcatgacacaagtatatttttatatttgcataaaaattttgaataagacgagtggtcaaatgttagttataaagtcaataacgtcatacattgaaaatacggagggagtagctaggacgtatatatgcgcgatattctcttgatgcagatagtcgcgtacacaacacacgtactacgtagagatctcggtcgatctcctctcaactctcaagtctcaagtcgtctcagcaactctctcagccttcatttccatcatgtttccttgtctttaccattccaccgatcgtttaccaagaatatacttttctactgatggagtatatatatttgtagtttactgtacattatttgtagttttgtaccattaatttgtactactagttaacagtctcgactagattactccatctgtaccataaaaaaagggcagatttttctttgccttgtgctactagtatgcgtgtctttattgactcccagggcaatagattagtactactatacttctaattaagcttgcatgattgctagattacggtcataatggctagcgaaagtacgtacgtacgtgtgccaaacctgcctgcctgcctatatatctgaacagagtttcaacaaaagtactcctccaaatgatgcactacggacgtagtattattctatagcagtacagaactttacatgtgttggaaaaaaatctaaacaagataataatatttacttgttccgtaacatttcgatcaaaactcaagagctgctagttgttattatgggcggcacaaaagcgaaaatgagctggttgtgggctccaatgtggttgacgatgatatataccagcccatgggcttacttttgggccttcttatttggagtgtacaagaacaatttaggcccttattagttctcaaaagtttaggcttaattagttcacctgcgtttttctcttctatcttcgtcttagctgtgaagtaaagtagtaaaccatatatgaaatggatatatactgccaggaaaaaaaaacacgtgaaggataataattatgtctctctggaaattaagtactccagttcctctcgcatgtgcagtttgcttcanatgcatgcctgcctganacttgttcagggcttgcttctagatgataatccgggaananganttttgatcactcgaaggggatatcctctcgttgtttgcatatcactcaaatgattataaaaaaatttgaaaaaaattaagaagatgtattaatatgtgatatatcactccacaaacatgcaagtaaaaattcaacttctacatctcgcaacgaaaaaaaacaaatttggctctgaatatacgttaactagctgcggttcaattngtttttttcgttacgagatgtagaagttgaatttgaacttatatgtttgtggagtgttatatcacatgttaatacacctttccaattttttttaaatttttttataaccatttaagtgacatacaaaaaacgaggggatatcccctcgagagattaaaacagtttccctgatgctccatataatactactactactacaagagtaagcgcccagcgttcatatcatatgcatgcttaaaagcaaagtctagttcttcagataccaaatcatccaagatgctaaccatgtcttaaagctctcgcatggttcatataaccttcaacatgtagcacacgcagttgatctatcgatcgatcgatcgtgtctttgctttcaagcaaaattaacaatcgatctaagaangaaagaaaagctaagctatatatacacatgcattctctcatctctaccatgcacagcagcagcagcttgtatcatcctactagtagtagcttgcaa

SEQ ID NO: 2181 - DNA, 2000 bp, Oryza sativa
aaataagagaggtgatgaggtggcatcctaatacgtggggcccacgtgggtcccacgctgactcaaccgccacgtagactaaaaccagggtcaaaaccgccgaaggacctcgggtgactggttttgtatagttaagggaccccgaatatctggttttgtggtttgaggacgttttttatcccgatgacaagttgagggaccttcggtgtacttttccccaatagaaaaatctgcgttgaatgggctagtgtaagcctaatttcactcgaaggaaaagagatgcacttgggcctagactctgggcttgcgagccaaggttagcaaaaaggtgggccggctggcgtcttggcgagcagctccggtcgaagtcctaccctcctgtgagctgtcgatcgtgattcgtgcaccaaaccattcgtcggattgtcggaaggtagcaaaaggaggcacagaccacaggtagctactccctccgtcccataatataacaatctaggatcgtatgtgatgtatcatagtactataaatttggacatgtctcctgtccagatttgtagtactgggatacgtcccatccgattctaagttgctatattttggaacggagggagtacagtgaacggataggttgccctccgtacgcccatgtggcagtcacgaagcgtacagggtgttactctttcccgttgcaagaacgaaaaattgctgtcaatttttgggaccagcaatccctttctcaaataatatgcacgagcaactctaagcgagatctttcattagcttatgcaggcaaaattgctgcgtccgcataggttagccggtgtgaggttgtgctgattggcaattgaccaacgcagcattcacagattcactatcatcatggcacaccgaacatcacatctcagcgaacgggtgctccaccaatgcaccaactaatgcacgcacaaatgcatagcgcaccaatgcaccaactaatgccggtagtttgatcagatatcccagatgtgatcttgccgatgggttatccccaccagtatagaagtgtttagtcacactgaagtttggatgtttggttgaaattagaatgatgtgactgaaaaattatgtgtatgaaaagtttgatgtgatggaaagttggaagtttggaaaaaaactttagaactaaataggacctatgactacaactatctctcggttgtcacgaagaccccgacgtgttgtcacgaagatcccaacgtgaacgtgacggagaagagtataaaaaaaaacacgatccgcgctgaccgccgcgccgccaaccggcaactctcgcactcgcacgccgggcacgcgtttcacgtgtcgaagcgaagcgactgcacctgcacgacgacgacggaccggtctcgcggtctcctccggtcgcgccaccccgttccgactcccgtcctcaccgtccccgaccctccgcccaccactccctcggtcacttcccccaccccacccacccaccacgccgccgcgactcccccaccgttccacgcgcacgcgaccacaccactgctctgcacgcgacccgggattacactacacggtacacagccgcgcgcgcggactactggccagataacgcatcgcagattcgcgggaacacccctcgtggcgcacgacaactattcagtagtcaagtactagcgccagccaaagccaacacgagtttgcacgggcacgactccgcgccgcggcggccgtctcgtcctctctccacatcatccccgttccctcgcacaccacagcgcgcgcccgcccgccagccatcccgctgccgtgccgtctccatcttctatccctcctcctgctgctgctgctgctgctacttaccccgcgatttctcttcctcttattactcttcctctcggctctcgctcgctcgctccccgcgcgatttctccacgccgcacgccgctcgcgagttagggatcgatctcgtcgggggcgggcgggagagggagagggaggag

SEQ ID NO: 2182 - DNA, 2000 bp, Oryza sativa
ggatttcaatcttattgaaaaatttcctaagaagccctttgaaacaaaggattgaatcctatccaatcctttgaaattcctatggaatggacaatcagattttggaggaaatttatcaagaacttcaacctcttggtaactttcctttaagtctatctctctcattcaatttctgcatttttcctatggttcaatcaaacggtcattcctgtgattttccttcgtttttgtaatcctctattttacacttacattcccatcaaaatcctacgtttttcctattcctatgttttctcagtcatgcgattcaaaagggccctaattatacgttatacgttaattggggaggatttttactgtccttgatagtggccggtaccaaatcgtggtcgttcgatgagcaagatcaaacggtcgagcatgagcggtaccgctactttgcacgggggtaccgctcctccttccgcgtgcaggagtaaattgaaagagtaaatatgtactttcgcgtttatcctcttccatgatgctctcgcctctcgtttttgcatcgtcaaagccccaggcggcacggcgccgtcaggagatcggcgatgcccaaggcggcgctaggagctccagccaggctctcgacggtggcgcttatatcagggtgatgctcttgccagcggcagttaggatcttaatgaaatctcaagaggcaaagatcaggggtccggcgaagctctcggcggtggtggtcagaagctcggtgatgccccccagctgcgctcatgggctactgggctagaagatgctgccagttgcacagctgacttcccgtcctttaatttcagcgaagctcaatagctcacccacctatttctttcgtggtacaaatatactggtgttgatttttggtggaaaaaaacttcgttgttactcttgcttactatggttattggatcgattaattactgttatattccattaagcaataagcatctagccaatagccggctcaagatggcggcaggcacagcggcctcgatgagagggcggcgggctgaatgcggcggcgcccgcggcggcctcgatgcgccggcggccgcggcggcctcgttgcggcggcagccgcgccggggtcgatgcgatggcgccgcggcgggagaacaggcttgatacggcggcgccggggaagcttagatgcaacggcgaggaacggatcattagcccgggcacctcattttcattagacgatcctacccccattaaatcaatgattagattagattggtatctcgtacgttatgacaccccataatatctctttaaggatgagaaagatgcttttaattgggtgtcttctcggacaagtcaacctgtcaaacgaagggggattctaattctaacaggtgatctgttgacgtggccagtctctggtcagacgcagcctccatccccagaccccagccgccgccgcccctctcctctccggtgaagttgggttgcttcgtcatcgtccaaccacaccatcccaaagccgccgctcggctgccgccgccattacgtcactactggaacttccttccaggcaacccaccacccgccaccgcacctgcccataaaacccggccacatccatcaagcagcaacagcaactaccagtttggaactaccatcccccgtgaccacctgcccgctttcccgcacaaagttcactagtagttactgctccaatatggagtagtactaatcctccgtatactcgaatcccaggatctctcccggtcggatgctcactcgtcttccccaccactcgtcgccccttgtcttcccctgccgcctctccgccgccgccgccgcccggacgctctccaccgccaccggcagcaactccaccaccgtcaaggttagacgcttcactcctcactggcaaagctctcgcgatagtatgtttcttggatgatggatccgtgatctgatcagtgctctggagagtggtctctgtgggtgttgggcgc

SEQ ID NO: 2183 - DNA, 2000 bp, Oryza sativa
  misc_feature (146)..(146): n = any nucleotide
tgtatagttaaggaatcccgcatatctggttttgcggttcgaggacgttttttatctcgctgataagttgagggacctttggttcactttttcctccggtaaatataagttttttatgctacctgtgcatgccgcacagttttttngttttcttacggtgaacctgtgcctcaattaatttcccctacttcgtgtcctcactcactcaactttccatgtggtattactctattctttttggttaccaaaaggcaaatgcatttctcagtgttctattccaactccttttgggcctattaagtatttacgagtcgaaacgagacccactacagaatccggagtatcgatccaatgggcctatacagatttcagcccataaaagcctagtcgctaggccacctcgggttcggcggccagttgggcccacagctaaaaggcccaaaggaggtgggacccacacgaccggcgtgccccacacgtcgccacgtcaccgcccccacgtctacgcgctcttgtcttggacttggacgccatcgccgccgcttctcctataaaacccccggccccgtggtcgctgcggccggatccatttcccagaatttttttttcttctaattttcttcttcccgtttcccgactcaagtcagcggttagggttccgagatctccgcctcgcacggcagccatggcggtgagcatcctgctctctgtttttttttctctctctttctcttgattgtattgttcgtgtcttcatgaatctcgtttggggccggatggtggtggctttggcatttccgatccgagcattttgttgtgctttggtatcggagcttgaacagatttggggtttatgctacgggttcttgatttgggtataagcttagtgtcggccgcatctggttgactacacgggaaagtagcgattcgtggctggctccgcctaatggtgtttggtagaaatgaaatggactggcattggtttggcagattgccaggaagcagccattaccccattagttatcacttgccaagtgctacccggccaaatctcgattgtactactttagccagcattttagtcctgtatgagctatatggaattactgccgcagcaaatctcactgtagattgttctctgggtgctggaaatgtttaaaagatgcggtctcctagttgattcctacagatggcactgctgataagccatcagtatgatttatctagcttgcttgtttagttgatatatagccttattctgtctttatgcctacttgcttatgccctaggaggctaggactgataaagaaggccatttaaactttggttcgttacttgtcctccttgcagcttaattagtcactagtgactcaagtatgtaaggagacaaacattatagtggcttccttgctggtgggcaaaacaataccaactatgctggattgctggcttataatgtatggtgatattgaagtattgaactgtatgctatactgactagaaagcaagttgcaactataataagatttaatagtacacacatactatgcacataagcatataggcattgaaaagcttcatacagatggtcaatattgtccccaaaaggttgtctggcgttaccctatttaaaaccgtttgaaaagaactgggagcagaggccttgcttacgtcacaggatggaagcactgattcctttgtgtagattgggactgcatgccgtttattagttaggtctatgcagcaattgttcccattggatgtgagaatggttagttgcttacagctcctggcaaactacaatgattttataagtacaattggaccatttggtatgattcaaactgtctgtaagaaattgggcatttggacatgcaaagtttgagggatgaaacaaagttcacatttgcattaacctttttaagatcttataaacatttacggtgttatttgtatatattagcacaccaccatcagatcactgattagaatttttttcc

SEQ ID NO: 2184 - DNA, 2000 bp, Oryza sativa
gtgtctacaataatcgacccacattttcgcacatggctatttaagaggcccacatgcaaaaatctatttcgcagacatacctcttagggagccgtatacgaaaatagagctatttttttccaaacaggcctcttaagtggccgcacgggaaaatatattttcgcaagcggacctcttaaaggttcacctagaagtttgagttacctcctctgtccctcttagcactttaattttttttcaagtcatccttatcaccaatcctctctctcacctcctttccccatactcctctctctctcatgactcccctcctaggcggcagcggccgacaggcgggctcatggcgacgggcagcagtggctagtgggctcgcgacagtgggaatcagtcggacgaaaggtgcgcggtggcggtccggcgactgtggatctagcgtggggcagcgggagttgaagccagcgaggggcggtggctgtcccccatccagatccggcggtgatggccatcccccgcatagatccgcgcggatgcggcggcggtggctggaggagcagggcggcggcgacgaaggcgtgaggagcacgatgtcggcgggtggacgggctctacccggatccggcggcaagctggcaacaactgtccccgctcggatccgtgcggatccatcggcggtggcgggagaagcacagtggcagcgggcggcgagcgcgcatcgacgggcgttttgattttttgcgattttttcctggattttggtttttgtgtgcagacgacataagcacccgcacacgaaaattgtgccacccgtataaaaaaaatatgattttcacatacacttccgagcagatgggctggaggcccacacacgaaaatctcttttggccgtctgaaaaaattgtttatgtactagtgacacacaagcatgcgtggacttatctgcacgattttgcgactatgcaatatgaagaaaaggttacatgggaaaacaaagtttttgggtattcacgtgaaaacctgaaaaattctgaataaaattttatatacgtaggtatattatatatgtatatatttaactggggctaatacttcattctcagcttttctttcctcaataagttcacttatccggcgggcacttttcctgctgcattatctttatatattttttgatgaattttatctatatttgctgagcgaattactcagccctaaaatcctgcgtccactacgagtcgcatgggggcctatatatgcagagcgatgccacgacgtttgaaatggtgcgtagctctatagtttttcagtctcgttaagcagtactttctccgtcccaaaatataacttgtagccctcaagatttatctcaaaatataaccaatttatccaccaacattctcttcccaaccaatcacaaccctccaccattaactttttcccacctaccttcactattcatccaattacaacgccctccaccactcatttctatactttcttaataaccgtgttctgaacggagggagtagttgataattaggttgtgtattgcctaattaattttatgcgcctttaatttactgcgtcctttggtaagtcgatcacaggggatgtttcgtccggtgaggcgtcgctgcaggcggccggcggccgaaccaaccgccggccaagcacgtgcaccggcggcgcacagcccatagccgccaatggataaaaaaaattcagaggaaaaacaacacagggaaaggtcacaagctagtatgggaatatatatggattaggtttggattggggatcatttgtatgtttctttggaaagagatttgattaattgcttttctttctttaatttggaccaggcagtgacgtttgcagtaatcgcaatctgttggttccatcttatctcatcacctgtcctatatctaggggagctgttcatcagctgagattcccatcatctcgcaaaactacaagcagctcagctcgcaaattaactgtcggcc

SEQ ID NO: 2185 - DNA, 163 bp, Oryza sativa
tctcttctcctctcttctctattatcatcatcatcatcatcatcatcatcacttgcatatcgaattattaataatatcggtactgtatctagccattatttttactcccttattgctactatactccttacttacttataattagctcttctcctaccctaga

SEQ ID NO: 2186 - DNA, 2000 bp, Oryza sativa
  misc_feature (710)..(710): n = any nucleotide
  misc_feature (719)..(719): n = any nucleotide
  misc_feature (724)..(724): n = any nucleotide
tgcattacatttacaccagttttatgcgaagtgagagcaacgctagatgcaaataaccaaacaccgagtctacgtgcatctacacggtgacacgagctgttcgactcgattgggctatatatgatgatcctcttgggttcacctcatcaggccaaatgcccatgcaaagaagtcgcccggtgagtcaaaacctctgaaacaattggtccagagatggcgagacttaaaacattttgtttactccctccatttactttgataatcatattccctctatctacttttgataatcatatttttaaatctgaaaaatttattttgatagatatattttaatccaatagcctatcctctcaataaatttctcagatttaatgtagatctctccattttttcacataaaattagctacatgggtatggagaaatgtaaatatttatgaatcgtttgtttaccgagaaatgactagtactagtatgtttaaataaatgataagtagaattagttatctttggcctatgtgataagatgaaatatgattattaaaaattgacggaaggagtaaaaaaaagcttcacctactaccgcaaatcatcattaactaccaccgctaatccggggagcagataccggaaccgaactggatcctgtcaccagggttggttgttggagcctttggaccaatcacgcacatccaaatcggaaaaacnaaaaaaaancaaancaaaacaaaacggcgagctagcacgcgaggccacatatgattggtggatcgccacataataataccatcccctcctccctctcgtctcttcctcctcctcgcgccgtcgctctcgccttgcctcgctgtcgctcgctcctcccaatccgcgctgcccccgtccctcccttcccacacgctctgccctccaaataaagtaaacccgcgcgagccgccaccggtgaggctcccgtcgccgtccgtaccccggctcccggcgaccgccgccaccaccacccagggtccccgcttcgtaggcgaggggggaggaggagacgacgccatggggttctgggaagccttcctcaactggctccgcaggtacgctcgtcgaagctcgctcttgcttggggcattgacgggggaggggatcgatcgatcgatcgatgcgtcggggatctgggttaggattagatagttttactggattggatggttttgcggcgcgcgaataagtatggtattgagataattttttccttttgcaacgttgactaacgggaaatgttgtttttgatgggtcgatacacgcatacccgcgtttattcccgatatacgtaggggaatttggcttcttgtggtccttttctgtttttccaagttcagatttggccccttttgctacttacaagtacgctgtaggaacattgtatggcagaagcttttttatctgttgaacaacactatcaaatggagtatcgtataagccaatcgaagtattatcagggcgcgtcaatcactgtattaattgaacgtgcctgcccaactgtattcattcaacgtgtcaatcaaaaattcaagggaggtgaggggatacagaatttgcagagtgattttgtatgtaacagaggggtctactctgttaattgtcatgaatattcacattacaaagttcttgtatcatggactgtagaattaggacgatgttggccatgcttgcactgaatttcaatcattggtatgaaaaagagttgtggtaggctatgattagttccacatctacctaccggcggtggccaagtaagttagtatgaaaacaaaggagctctcatcacatgcactgattgggtagtggagaacttcctttgtttctttgaggcactacttcgacgtaatgacatgtgggccaacttctggtttatattagcgagtaaaatggatatgctttgttactaatattgcttgatgaggattcaacatatattcctttatatgcagtctttttttcaagcaagag

SEQ ID NO: 2187 - DNA, 2000 bp, Oryza sativa
  misc_feature (868)..(868): n = any nucleotide
ggacctcactaaaatggatgaaattctctggatttcagacatttcagtccaaatctatggaagatgagttatcggccggtattgaaccaacaattgctgacgatttataactggttttaatactgggttttgaaccagcgatgagtacccatcactgcgatgacaatgttttaaagataaaaagttaaatatacaatgttacgaagatagcatcgaccctgagaggatgtcaaagattcataactggtccttgctgctggttttgaaccaacattgaggcccttgtttaggtcctaaatttttttttccaaaaacgtcacatcaaacatcttagacatatctatatagtattaaatataaataaaatgaaaaactaataagttcatcattagccataagtgctacagtaacacacatgtgctaatgatggattaattacgcttaataaattcgtctcacggtttccatgcaagttatgaaattagtttgttcattcgtattcgaaaaccccttccaatatccggtcaaacatccgatgtaacataaaaattttctttccgcgaactaaacaaggcctgagtatatgttactacagtaatatcgatttggaggggaaaaatgtaaaatgggcaatggcaacaaatttctcttgattgatttgatctaacaacagaaattaagtgcaaagtttagcagaccctggtccaatatgcaattaaggtgagaaaaggggcgcaaagtgcaattccactagaaaaaaaaggaaaaaagaattaccagttggccaactgcacacaagcgaagactcgatccagggtctctcaggcctacaagcccacgattaagcccccatcccgtaatcccccangctccatcgatcgtcgccgcagccgattccttccaaatctcttcacccgattgaggatacatctaatctgagctctctagtctgcaggtaatcttcagtttctttccaaatctttcctggtccattcaaagtgtactagttcttgttctgtttagttctctttttttttcttcgttttgaacgttggttgagttcttggcgacgcacgccatgattgaatagaagtagcttgtttgcttaagattacttggggttgtgtagccatcgcaagattagaaagatttggtcatcttggggtcggggttgacttggggatgaacgaggagaaagaattaattgcgcattccttctgctgaaatttcagatgagtttggtgtttgagctgtagggccttgctctgaccagtgatctgtcacaatcgagtagattcttaaacaggaaatgtgaaattggatttgctacttggggaaaggagggaaggtgattttaattttaggcaagttggtggttttggtttcttggtgaaacagacaggttgtgggacgccggtgggcgttttactgaagaatgtcaatcaacacaaatatgtcaatgatttgaaaattttacttaacctatatcagtgtagtttgtaatctgagtaagttaattataactctgtgttttgataaccttaatcaagaaattgttttgctaagctgtatgatgatagcactatggatgcaacctacttggatactgaagtaatcagcttgtgcttcacttgactattccatctggttgtagtctgttgtttgtgtcatcttatataatatggcattgtgatctgtttattaatattaagcgacaaaaagaataaagtggcatacaaaaattgagtgaactcctacaaacttttagtgagagttgagacccatgctatgcagacaacaaggaatttctcttgagtacatagactgtagtaattacttagtagtcatatccagattctgaaactataattcagtacttctgaaaattttgtatgaggagatccatcttatcaaattcaagctgaaagaaggtgcaatatattcatattggtgtgcattattgccttaatcattatattctgtgttccacttacccagat

SEQ ID NO: 2188 - DNA, 2000 bp, Oryza sativa
  misc_feature (635)..(635): n = any nucleotide
  misc_feature (1442)..(1442): n = any nucleotide
atgtttgaccgttcgtcttattcaaaaaatttaagtaattattaattcttttcatatcatttgatttattgttaaatatacttttatgtatacatatagttttacatattccacaaaagtttttaataagacgaacggtcaaacatatttaaaaaagtcaacgacgtcaaatatttagggacggagggagtataaaagtctcatgtttatcctctacctgctttttatgtacttgcacgaaaccttttgatgcttctaatgaagaaatcagctcgcccttgtatttccatctgttattggttatagtcagactcacagatgacacctgcttagcactaccaccatacctataccaatcaaagctgaactgtgatttttatgaaaattgtgtaaaacgtatacctctgttttatggcagtacactaaccatctgctgtaacacaagataacgatagcaggggcttaacttggtcatatttcttgcaattgtaaagatcaaactgtgcattttcagtcttacttccgatgattctgactgctgattttcttttgccaggctctaacaaggttatcgcagttaggccgtcctccgtcacctctgtacagcttcttatgcaatgtggaaggctttctgnttactgatatagcttagatccatattgaaccttttagatggctgattagcttcagtcatcttactctagatgttcagatttgtactgagtaatttaggcctctccagttttgcaccttcttagagctagttgtatgtagatgattctgttgcagcattacccgtgaactctaatggcttgtttgttaacctggctggatgttccattttttgcgcctggaaaatcaaagtgcaattgccctccttctgaaggttcacctttgggtgtcatttctctcatttcctgggaagatgttggaatgatgctgcctggtggtgttagccaacgttggcctgaaagatttgcctcattggcagaatgcagcgagtattctatcgtctgtaactgtaagcacaaatgcttcgaagtattgctttaaatgaaaattagtagaggcacaattggtgcttcgatgggcaaccttggactttcggtgcagcttggtgccttggtcgagcataataacaacacgtaaggtacgggtttaggttgattgcccttcccttgcacgcaaagatgctaataagagttaatgatggctatgaagataagtttatctgatggatgcttttagaagtgatgctcgaaaactctattcgaaagtgtcgtcctatcatatccaactcgaatcaaataatcacatcattattcgcgagatgagcgtagctcagtttgtttttatccggtggaacataactgctctttccatctcattttaaccataagtttctgtatctaattttgattattcgtcatatctattattgntattagtagtgcttatgtgtagacttatgtttttaatataaataaaacggacgattaaagtttggcacgaaaaattatggctgcacttaaaatgagatggataaaggagtatttatatcgagttattgataggtctaatatttcaacgatgctcatgtacacggtggcgtatgtgagtgtcttttttttaatttttttaataacaaatactcagggttattccctaaataactactactctactcaggggcatagtagcatagcatagggtatcactcatggcggccaaattcccaccgaactgaacctcttccttttttttttcttgaccttttggcaaaggagaagcggataatactccttttgatccatcctactggacccggtaatgatagcgtctggttttaacaagtcaccgccgcgcgcgtcgctagtggtggcctcctcctcgatcgcctattaaattctctccccgcctcatctagggtttggccctccgtgtaatcctattcctatctctatccattactactctccagtgttcttttttccgtaccc

SEQ ID NO: 2189 - DNA, 2000 bp, Oryza sativa
cgccgccgcagctgtggccgtggccgtggccgtggccgtggtggtgatcatcgtggggcttgtcgtgggcgtggaaggggcaggaggaggagccctcgtggccgccgccgccggcgacggccgcggtgaggaggagcaggacgaggaggcccccgcgcattagggctagcgaccgcggcggaatcaggaggaggagcggcgcttgcagacgccctcgatggtgacgacgaggacgagcacgaagaggaggacgagtatacccactaccacaccgaatgttaccacgtccatctctctctcctctcccctaattatatattaccgcccctcaattaactccaaaaaaaatactgaaaaaataataattaaccagcgttaactgcctctgctgaaaattttcggatcgcggctcggatgatcctcgagtcgatcgaatcggaagcttctgccgtacgcttttgtgtcagtggagaacaaagtgagtgttcttggagcactctgtagcatagcagacgagacgaggagatcacgcgaaattcagaggagatatctggtttggtttgatggtgagattgtacggactacggagtatgactgaattggacggttgattggagaacgatgcagggttgcaggattgcagttgatggaggtcatcagggaagcgagatgttgcaagaggagggcgtcagtgaggcagtgaaacgagcaacgcaaggcacaaaatccatgttcatttctatagagttcaggaaaagctataaagttcagagactggtcgatcatggcgaggacgcccgggatgcattcgagtactaaattacttatagccacaaagttccagcgacagcggtggtagtgcggatggccggtcgatcttttggacttccggagcaaaagttctccgagcaacattcgatcctttcgtgtcattctgactaagatttagttccaaactttttcatcacatcaaaatttttctatacacataaacttttaacttttttattacatcattccaatttcaatcaaacttttaattttgacgtgatctaaacacacggccttagcgaaaggtgcagccggccgggctctctcgaacacgtaccgtagctgctgacgaactgagattagctgattagccccatcctctgttcttcgtaaccaggagacatggcaccgcttcaccgacgctgcccatgaattatggagcttcctgtctgtgataggcggtatcatgtgatgagaaaccgataaaagccttgactggtacgtggaaccgatcaagtaatcctcgaagtaaacagatccaggacttatgttgccattctagaggagtagtagacatgttcaggcttgatcactgtgaatcactgaactctccaagcacaggacattctagtacgttgttcgatcgccaggtgctttgcctcgaatggactgggcgaaacgaaagaatggacaaaagtcacaacactcataagctcagaacttccttctctcaatcccggcccatggtcgatggataaggtaggggagcttcttccgtcggtactggggttcccatgtgctgacacgagtgccgccctccctcagcacacgtgtcggcagggccctccacgtggcacccagccccaatggtgcctgccagagaccacaagtcaagcccctccgagaaccgtaaagcaatccggtcgatttaactctcgactctttcgcactacagactacagtcactgtcacgttgatctgcgagcaaagaaatccatggacgccacgtacaagcttggcaccagatgccactgccacctagctagtacacgcctgtataaaagcagcgtatctctcgcgatgtcaagttgatgttggtggatccagagtagtagcactttgcttctccctgaggtctcgtcttcttttcagctcagaaacaagccacaggcttcagagaagacatccaattggtgctgattccatcgatcgatcgggagaggagagag

SEQ ID NO: 2190 - DNA, 2000 bp, Oryza sativa
  misc_feature (1005)..(1005): n = any nucleotide
  misc_feature (1026)..(1026): n = any nucleotide
tgtaggcacaacggaggcagcagctccccacaagagttcttggagttcctgaccaagtttcagactgcctccaggaacttctcaaagaggcagatgacatggttccgcaacgagaagatttaccagtgggttgatgcctcgcagcctttcgacgccattgcgcagtttatctgtgatgcttaccatgaccgtgctgcaaggctggttcctgattcactggaaatgaagagggagagttgcaggcacgagagccgtgatctcaagacctaccgttctgagaacagggtgttccgtggggatgatgattgttgccacgttttggattggatcacaaggacacagaggaagtgacctctactgctctctcttgttatctcttttttttcttccccctcttttcccgccaggaaactatcctgctgctgtgtttggagatgttacaataggaaatttcagcctttttttgtcagaaaaatacagatacttgttttgcaaatgttataccaaaagtgttttcaactttggaattcaatgaaaattcactagtgtttcttcagcatatttctgtctgtattaactctatgaaaagaagatatatgacattacagcttagagggtgttttgcttgtgaatgtgagcatggagtttgcatggtctgaaactgaagttggaagcatcacaaattttgtgagattcagagtactaaacagatgggagacttcacttcacttcacttgccgtgttacctgtatcactcttgctcggttgtggacgctgtttgtcaaccttcttgtacttgtgctgcagcacggcaatgtggttaatactaatatttttgtatctgaaatctcccgtagtgcttagtgctgtatttgtcaaagcattgtacccattactgaagaagatgtgcaaaaccaaaatgtgttgctgtctgcggtcgcattatcttcctgctttcccccaatcaaacactatctgcaatttgcaatggataagagataaaancaaaacatagcaaaaggaagnaaaagaaaacggccgggagattgaaagatgacttgttgggctaccagccatgtctgatactctgatgcatcatgcatatggtactctcaagcaaccaacgcacaagtggcagcagagtacatataattctatccccttgtgtaaggcaaccgttggcatctgatctgagtatactactgcctccgtattttaatgtatgacgccgttgacttttcgacaacgtttgaccattcgttttattcaaaaattttatgtaaatatgaaaatatttatgtcatgcttaaagaacatttgatgatgaatcaagtcataataaaataaataataattacagtaaagtttttcgaataagacgaatggatcaaacattgggaaaaaaagtcaacggcgtcatacattaaaatatggagttagtacaacatattgtgccagaagaagttcctctaattacccaaactgacatggcatatgttgccctgaaacatgttgtaaggcaaggtcaatggattcaactggaagtcagattaaggattaagtagttagcacaactgcaattgaaggaccagaatatatacaaggttgaatgattgcacgtgctctggactagctttctggtcagctctttggacggtcacaagctctgaatataacaactggtgcactgcgttttattttcttgctgatcgatcattagtcagggatccaacgttgccaatgatctgtagcacaactaaggagatcatcatcatatatatgatggtgcggtagtaaccgcgtctgcacctaactaaggaaaaagaaacatgtcgttttcggctgtagcagagaaagttgcagggcaacccaaaatatgtatagccaacagaaatactgttccaaatcttatggttatatgcaatgatacccaccaaacattttggagggatgcactcgacataatttgctctccatgaaaaaggaaggagagaaggaaa

SEQ ID NO: 2191 - DNA, 2000 bp, Oryza sativa
  misc_feature (153)..(153): n = any nucleotide
  misc_feature (251)..(251): n = any nucleotide
  misc_feature (257)..(257): n = any nucleotide
  misc_feature (1041)..(1041): n = any nucleotide
  misc_feature (1724)..(1724): n = any nucleotide
cgccacaacgagatggtggcgtcgggcgccgtgacgagcgcggcggcgacggcggcgctgctggccttgctggaagcggcggcgccgctgggcttgctggacgacagcaagctcgagagggcgtacatggagaagtacctgccgctggtggcntcgggcatgtcggaagacgacgcggacgcgctggtacgcgacatgatcgacgctgaattcgtcctcaggttcacgtcgccggcgtgggggcggcggcngccgcngtcttcgtcctcctcgtcgttctaccacatctcgtctgcgactgcagcaccagcgacagggtcgtgatgtgtgtcgccgtggccttcctcgtgctgataatggcgtacaaggccttgtaccatctccgggagcgcgcgagggcacacgacgccctcgccaagtcactggccatcttccgggaggtgacgtcgcggccaccgttgccaatgccacctgtttgatgaaagccccggcacctgaagtcacctcctctaatttttttatattagtttttttttctaatgccacccgtttagttaggtacgttttttacactcgactataacatgcggaacagctaaatttccgtcgacagaaatcagagagcaaaacttactaattttccacttttagattagattagatctgagatgacgtcagttggagagagaaaaagtagcaacgcatagcgataccattttttcctaggttacaatgtaattatttttttatattacaattgcatgtgataatatttttctaagttacaatgtaattatattttatttatatattactattacgtgtggtaatataattatgagtgaagatgtagttatattactaatatattatagttgaatttgtaagttttctaattctttagtctctctggtttttagctatgccgtaaaatttaggcaaaattggttatagcatcaaaagttcactttaatagcatctaaagttcacctccctcccattttaacacttccattaattcttgatcgttttctgtccgcnttgaatgttattgacctagccacgcacgcgatataatgtttctaccccttcacaagtccaagttaaatgtttccgtgattttttttcaccatatataactcaatgtttcaccagtggtcaattgcaacatttgaccgatcgatttttttttaagatcggctgcccgattcaaagattctttcggtaatcgcatgttgttttagttaggaaaaaaattaggtttgattatcatatcggatatacagacacatatttcaagtattaaacgtagtataataacaaaaaaatatagattccgccagaaaactgcgagatgaatttattaaacccaattaattcgtcattagcaaatgtttactgtagcactacattatcaaatcatggcgcaattaggcttaaaagatttgtctcgcaatttacacgtaaactgtgtcattgattttgttttgggaactaaagaagtcctttcttagtgtaagtacaatagcaggctatgagccagctataaacatattttaaagagataaaaaaaagagagaaaagcagcgggctacatatctgtagccagctgcagtatggactccaagacataatgtgtgtatgacaggtgggaccaagtattaatagtatagtaagcaactattatatgaattggctataatattggttatagatgatttggngccagtagtagactgtccttttaaacttgctcttaaaaaaaaccattgataaacctgccacgtcaggccgaccatagttttctccgtgtcgaccccattggcggcgacgcgatgcgtgtcgaccgaccgacctaccttaaccccccggggcccccacctcgccgacctgacccgggcccggacggacgccgtcctcgccattccatctctcctcctctcctccgctccgcccaccaaccctcccctcctctcgcctactactaaaatccaccatcg

SEQ ID NO: 2192 - DNA, 2000 bp, Oryza sativa
  misc_feature (284)..(284): n = any nucleotide
  misc_feature (333)..(333): n = any nucleotide
  misc_feature (336)..(336): n = any nucleotide
  misc_feature (390)..(390): n = any nucleotide
  misc_feature (468)..(468): n = any nucleotide
cgggtctcaagttatggcccgtcacaaatgaccatcatctgtgacgtgcaccaacttgaggcccgtttgagataacaactaggcccgtcacagatgactcatcagtgacgggctatatacttaatctactcatcgggcattaactaaagcccgtcaccgatgactatttttccatttttcatatgaaatgttatatttgtaagttgactatagcaaaataattaagtgcagtataataattcattgtattagagaaaataattttacgggtagtaaatgatttnaaatggaaaaaatgtcaacaacaaagttgtataacttatcaagatttanaanttttagtttggtcatttttctatataacatttttttttgaacagtttgaatttnaatttgaaaatatgacaacttcaaacaacattttcaaatactaaatgatttcaattgaaaaagtcatcaacaacaaanttgaataactcatcaagatctaaaacttttatttttgttatttcttcatccgacgaaatgttagtaatattattcacaaattttacatatatgtgttatagtttataaaaccagataagagatatgtcaattttgtgaacaatgttactatcactttgtcgtatgaagaaatgaccaaaataaaagttttagatcttgatgagttattcaactttgttgttgatgactttttcagttgatatcatttagtatttgaaaatgttgtttgaagttgtcatattttcaaattcaaattcaaacggttcaaaaaatgttatatagaaaaatgatccaaaataaaagttatagatcttgatgagttatacaactttgttgtgtgatgactttttcagttgaagtcgttcactgatctaaaattctatttgaacttttcaaacttgaatttcaaatttcaaattgtttaaatagagtcagatggagaaatgaccaaaatgaaaattttgcacctcgatgagttctacaactttggttttggtgacttttccatttgaaatcatttaataaccccaatttaacatcctggcctagggcataataggattaatagaatactcgtactcttccggaagccaatctctaaagaactttgacattaagtgtgcttggtctggagtaattttgggatgggtgaccgaccgggaagtttgaacttccgcgtgggtgcacacgagtgagggctagccaaaaaataaaatttatttatttttggaatatactcatatgtgacgggcattaactctagcataagttaatgcccgtcacagatgactcatctgtgacgggttatagttgtggcccgattgagataggtcatctgtgaggggctatagtttgattggtcgtctgggtcaaagctatcggtgacgggctttacttagggcccgattgagatagaatcatctgtgacgaccgtttgcccgattgagatagctcatcacatcagtgacttctagcctgtgatggacgccatgcccgattgagatggggcttaccgcccgattgagatgagggtatccattctagtggattaaaggtgccgttttttgacatattaaaggtttcggttttttaataaaaaccagcacctatagaataagtgttggtttttatttagaaccggcacctataattgtttaaagatgtcgttttttttgcaatttcaacccacatgtgcgaaaaggcctatatgtgtcagatttagcacttctggcacctatagtgtcgagaccaatttgatgttttgtagtaatgtgagtaagaagctattgatggttaaagttttacaagtttcactaaatctgatcctaaacattaaatattcagaggaagtatattaattaattagccctgcaagttggcactgtctatttaagcattgccccggggtctccagacggtagcaagcgaccaaggttagaataactcaaggatcaagtttgcaactgatcgaatttgctagctagctggtttca

SEQ ID NO: 2193 - DNA, 2000 bp, Oryza sativa
ccgctcatgtcgttgaactccgagttgaggatggtgtcgaactccacggcgaagaggtggttggtcgcgttgccgttgttggcggagttgacgagccccatgaactgccccggcagcgccgaggtgaggttcttgctcttggcgatgatgaacgccatgccgtggctgctcaggtcctcgaacgcgccgatgatgccgatgacgaaggccgtggagaaggactgcatcgccgtgctgttgggccccctctggaactggagcggcgacgggaagaaggcgtggcccttgagctggttcgtgccgttggtcagcatgagcagcccgttcgaggtcaccgttgccatgccgtcgaagctgaggttggcgccggtgaacccgttgaagacgaaccgctcgtcggtcgccgccgccgggcggaggcagccgaggccgaggaagaggagcaggacaaagaacggcatttctggtttgggaagcaccatgccctgcacttcgcctagtgctgagcttcaatcagtgcctcaccaaatgcccaagctttgctgcttctattgtgtcagtcaagtcacggccccggtgtttaactcaggttactctcagccacctgttcctttttccttctgttggtgcgtgtgaagcggaccaaatgtaaaacccagtagtctagatacggtctgggcgcgattgcaactttcagtctcgtacagattggtgatgtgtcgtgagaacgaggggagtaaaaattctcccctctctctcgagtaagatcaccaacccttcattcactcattgcgcgatcatcataaacgacggctgaaacggggtgtggaatggagtggacgctatgtgtattgccgtgatgcggatgccaattagcctcaacgagacagtgaccgccgatcatgcgggtcaaaggtcagcggtctcaagcgtccggtcctcctttccggccgcgtctccgctgccggcttccctgcccccacaaaacacgcacaaagtcgccgagaacgccataactatcgacgcggcgggcgctcgcctctcaactactcgtaccttgtgaatgtgatccagcatcccagcacacagcacgcataggcacagcccgtgcagacctgcagttgcagctacagcccggcggccgcgtccgcacgaagcttcgtcatccggctaatcactgccatttcatcagcccggctgatatatcctgtgggtcacctcgtttgtccgttccactcgcctcattttctagggtcgttgaggtgtttggaatcgcgagtcggcaccaccaagctacctagcgagattatttaaacatgacattttcatttgactatgttcagtgatgggggtcctttttctttatgctgcactgagatgagataccccgacgagatatttttcctcggaaggaagaaaaaagaagggcgaaatggctgcggatgagtcaaaagagtgggcgtcagtgcgtcaccaacccaatttcgtcgtagtttgctgcctagtgtgtcctcatttcgctgtgctgtactgtactgtgacgcattgacgcttaaccgctcactcctatcaaactcagcttaattgttgcttatgatatgatactattttatctgtatttccttgactacgattcgcaggatcgtcgaaatctgaattgtttaatgcacgccccttgtggcctcatctgtaaccaatttgagtagaactactaccatatgccctgtgttagttgcaactccctctcgagcacgatatttctaaggccggtgcagtctgtctgtctgtgtagtgtagcgaggagtgtgaacgatgtgatgccactgccagtatgccacacacaaccagtaaacctgggataatggttggtgtccggtgttcatgcattgactcgaatagcgagtcttctgttcagacatttgatgctatgactcgaatagcggtgactacacatcatatgccctgtgctaattgcaactcccaaacggaagcaaatctcc

SEQ ID NO: 2194 - DNA, 716 bp, Oryza sativa
  misc_feature (32)..(32): n = any nucleotide
  misc_feature (93)..(93): n = any nucleotide
ccccaaaacgcacgacatcccggctccgccancgctccaccttcccaaaaataccctcaccgagatgcccctccgtctcccgtctcagctgcngatttctcccaaccatccgcgtaattatccgcagcgtcgagggcatatatggaaaccggcacgccatttcgaaatatttcgccaagtggcgcacggcttggtagtttcccacataccaccctaccctattcacaaatcccacaaaaactccctatacacagagtctctctctccccaacgccccagattatatgtaataataatatcattattatctgaggggttaagtgaaaaagcgcactttttcctatatcatccctagctagccctttcgtgggagtaaagaaaggaagagaagaggaaaaaaaaaatctcgctttcgtccgcgtcgcgtcagggggtaggagaggaggaagccgaggctccgcgagctcgcgaaaggtaagggtttccgccttatccgaatcccgaatccgcccccaaattcctccgcttcccgcgcggatttcgccgccgggcggcgagatccgcacgattcgcgccccgatctgctctgacccggcgctcgcctcgccggattcggcccccgttttgcagggtttccgccgccggggtcgcgcgggcgttcgagcggagcggaaggggaggagacaggagagggagagggagagggagagagagcg

SEQ ID NO: 2195 - DNA, 2000 bp, Oryza sativa
tgtgctgtccagggtccaggctccaggctcgcttgcaactgtgggcaaatctcgtggtatttcgtggccgctactccaccatttcatgctaagcagctaatgcctgtcgggctaatggcatcacgcatttcattagctactgacaaaaaatgatattctctcctcctgatgatggttgccagcagtgagcgttacagttaagcttgttctccaaaaatatcatattgttctactacttgcagatctcccattctacatggcaccaaatttcaggtgaactgctcctttccaatggagccttggcacgaaagcgacctggatttttcgaggctgccactacgtgacaacaattgtgataggcagtttggtggtggccgcatgcagctgcttgccttgactgaaaattgattttccagcttgtgaccactgtttctggctgtcagcttgctccggagatacataccatgtgaccccatggatcagtggcatggaattcctttggtgttttcaggttgcttgaatttctgggaagcttcctgttaggctacaacgttaacagtgtttgagccagttcgtttttagtactccgtacatttcaatccgtggtaagacctgaaaaaatttcacgtgtgtagccatgctctgatttaagcctgttcggtcgctttgtacagcagtacaggccaggtcatctgcattggttgctgggtgtccgtatacgattttacctgtgcctggtcacctggccttgctgccttgcatatgataagctgtatcccagtgaggcttgactcggagtaaactagtgccattctgaaacgggcgcagccgcggaaattacgctgttatggtggttgcagacttgcagctcatggcagagcgctacgcggttcacatcttaatcaatcgaggaagccatgttccccactgacgagcagcagccagctaccgagcatggtgcgctgttacccttggacattggatactttggggtatcattacgaaattgttactgacgcagcaacgttgtagggctagccgggcagcggcatctgtttcccgattgcagtaaatgcaagtgacgagatcgaggcaaacatgagccggaactcttatcttttcgtctatgcttatactccctccgtacttagagagtcgtttagaacaatgtttaagtcaaatcttaagaatataaatcatgaataactcttaagttgttgagtttgaaaatataaaaattatatgtatagatttgtcttgaaaaatactctcataaaagtatacatatatcacttttcaataaatacttttatagaaataagaaatcaaagttgtgttttggagactgtgtcgctgtcctaaacgacttcctttacgagtatggagggagtacttatcaaccaaaatttaaattttcaaccttaaatttaaagatgtttttaaagtttttttattgaagtttattttttcagcctttgcttttagatcgctaagaatacatatataaaagttctatttacaaattactactttctccatttcacagcatcaatatggatgtgagaaatgttagaatgacttacatcattttacaaatatagcgtttggtggggccgctggattctggaagtaaccgagaatgatcaaggaaaactcgtcaagttctggcacttgtcagagtgaaatttcggaatactatcctcctgataattcgattactagattcctgataattacccggacgggcaaaccgtgtcagggaattcggtttgtgcatccaaggcacgaaacgggtgaagtgaacagagcggcacgtcggggcgacaagggccccaccgttcagtttcagtggcacgaagcgacgcgacgcgtgttcgcatgacccgccgcattccgcggccgtgccgaaagtgtgaacggtgaacctctcccctggcccgcgggccccaacccccaatcatcttctcctggccttcagcctccagctgatgccaactgcc

SEQ ID NO: 2196 - DNA, 2000 bp, Oryza sativa
tccagcaagtgggtgagctcggcccggcccggcatgtaggttgggccaagcccagtcatgcctgagccgtgcgtggccaaacgacccgttttgccatctataatcatggatcatcttacttttgatatcagaaagtcatcaataatggtacacatttacccaaggcatatgtgcggtcacgggtcatcaggggcagagctagagtattgaggggtgcccaggaacccagtaaagaaaaaattgtagctatacctgacatattttcaccatgtgtgcatcccccacaatacaaatttagacacccgcattagcttaaatttgatataaatcagagtaaattaagcaagtggcaccctccctccatctcgctccagctccgatccgccttgagtcgtagttccgtaccagtgctttggagtgacatgcatgtcattgccacatgacttgccagcgttcgatcagtacgtagttgccggaacgtacgcatccatgcactgatgcacacaaactggagaaggctagctgtatcgtacctttgcaccactgtcactactagagaaacaattttttcatttatacggtcaaaaccgattttcacgagcacttggatggtctgtctgtacccaagtgtcttctaaaatcagtacttctacatgtgggtagaacaaagctgcatgcgaaacttcatgtgggtgcttaagccgtctgactgcaaaaaaaaattcccacaaaaaataatccaaaatcctagcagctcccgtgccggtggctgtcaccgctctcgtgctcagggtttgtcctcgctgtcgcaaatgccctcccccactcccatcgccgcctctgatccatgcgtatgggagggggagagcccatcggatccacctccactgagctccgcatcaccggatccactgctgatgtgcttcccatcggggctcgttggtggtgagctctggtttgatgtgttggatgtatactccaggcctcagctcattttgcacgtgagccagcttaagctagcttgttatttcgaacaagctaaaacaccagctcggcttgttagaaaaacgcaacgagccaagtcgagcctagtcgagttggtcacgagtcaagccaagtcaagttggtcacgagtcgagtgagctaacaagccacgagtttttccgtccacccctacccaccgttggatccaccgcggcagccgccgctccctactgccggatccgttgccgctgtgctccccaccactggatcccccatctccgagcaaccttttgtcagatcctccgccaccaagctcatgccccttcctgttcctgcctactgtcagatgaagtggtcatcggctgctcccgtccactgccggatccctccagcattgatcgcactcgcgtgccaccggcggagaggaggaggagaggagaggtggagagtaagtggaggatggagagaatgaggagagagaggggagacttgataatttaaggatgggcttgatcttgtgggccggtggcatatggacctcttactaagaagtcatcttaagagacctacaatgcaattcttgaaccgcgttcgggaaagtgatttttcaagtgagagcaattttggcttgcctacaccttaaaggggtcttgtctgagaattttgattttgtagtagtgtgctataagtacatgtgtctagctttttcgttccaaaataaataaacttagtatggatatatcacatcttaatttttttaaaaacggatgaagtagtctgtactctgtactctgtacacctacttctatcagctgatcagagtcgatcagagagacaacgcaaccaaaattccaacttgtcatccatgcatgcatcctccacgtagctagccctatactctaccttaaactctccactggataaatacccctacaagcctaagctgccatggccaaccccagagagatcagctagctagctagccagcactctgcacagcacacaacgaaacgcaa

SEQ ID NO: 2197 - DNA, 2000 bp, Oryza sativa
ttataatatctatatatatatttagatttgtcttgagaatagttatatatataatatataattcacatgttgttaaattatgctaatatctatataaaagttaatggtcaaaggtagacattttaatttaagacaaacctaaacaatttgaaaaggaggaataacatctacctaaatagtagacgagacactatttttttctctcgtgaacttcactccaaatgcgggtgctttcgttgcaactttcatggatacgatgacaatctaagccgtcgataacactatcagaactatcaaaactgtctttaatttggaacacacactactaaaaatcatagttaagagatgtagaaggtatttccaaataatccacctgcctctaatacaatacatacatatgtagaataaccatataaaaatagaccatacatataaatagatgaccgtgcgcgaatgacttaatatattcctgtgaaaaccttttcaccagcggatgacttaacatattcctgtgaaaaatttttttcgtaggtggaccactcggtgtagctgcctataaaagtatttttcccagtcaagcgtgttaaggatcatccctcctgcaaaaatcgattcctcatgcgggagtactgcctcacgaaacattttttagaggtggtcgacttgatttagtggtccacctgccgaaattatttttgcagtagtgatgtattgagtgctttcttaataaaattgaagggttagattagatagaatcacacattgcattgccatgaaaccttgcaataaagaagccacatatggttgtagatatagcattggaccactgaacagggctgccttgatatacatgaaacagcaactcacagtaggggcgtttttctaagttcctttcccatgtttgcatccacttgaattccaatggtcctagctaagggcactgtgccagtacttgacacgtacggtgtgctatacatgtatagcgattggaggacttattagtcgtgttaattatccatccagattcggtgatggttatgcacatcaatatagagcaggtcgaacctaagagagagttcaataaaaacttgtccaattttcatgcatttccgtgagtttagattatacactactaaaaatccggatacctttatacttttctcataacttctcgattttatctctgtttaagtattttgacgtaatttgtcctggtttttacatgaaaattttcacatgtcaagttaaaaagaagataagggtgagcataatttgcctctatttttatatgaattttcacaccgttaagtcctcttaataaatgaggcagagcaagctttagtttaaaaaagtgggggtaaatcataacattgaaaaggtcaggataaaattattacgtactggagttgaaaacagaagaatgtaatttactattactgttaagactaactctcattcacatacagccgaactgttgaagtagaccgtaaagtgcatcaattcttcatttgagtacgatttgagaattggcccaactttaaaacaacttaaatgaagatttgaggattaagtgaacttaaatgaagattgatgcacatgaatatttgatgaactatccaatttgttttaaagttacttttgcgtgttgttaggtaaaaaaataaaagaactgttagagatattgtatttgtatccggttcggtttctctcaatcctatcccgattctgtttctatgagtcaggtatagagataaggatgtaccgtccctatatgtactcgtgtccgtgatcaatctaagttatcgcgttgactttatacgctctcatggtatcagattaatctccaaattcgcttccgcctctctctctctcgacatgcgtcgcaactcctcttcgcacccccgcgccgccgtgtctcccacgccgccgcgcaccaccgcgccgcctaccgccgcaaccttgccgcgccgccttcttcctcctcgccgcgccgcctcacg

SEQ ID NO: 2198 - DNA, 1525 bp, Oryza sativa
  misc_feature (21)..(21): n = any nucleotide
  misc_feature (30)..(30): n = any nucleotide
  misc_feature (45)..(45): n = any nucleotide
  misc_feature (1320)..(1320): n = any nucleotide
ttgattcagattgactgaccngtctagtgngtattcagaaattcngacatcagggacgtataatatgaatagacatgtgtagtactgacttagaccaccgtcatttctaatgccctagcaaacaaagaagctatataccagttgctttcgatgtacatcatgtacatgttgaaacttgcagctacaagctatcggagaattcatcagttgggttgggtaaagaagcaaatattgtttaaagctaagtaaaattatttttgtaaacataaagtgctttcaataagattttgtgctagcttttacgtcccacccttttgtgattagtctactcgatgaccggcatgattacattgctatttccaaatgacaagctagctagcgctatcttttcttgattagtctactcgattagcggcagcatcacttgcaaatgataagctatctgcacgcaacacttcattcatggtaagtgtgcatgatgcatgtatatgctttgaaggttagtataagttgtgcagattaaaattatgtgcaatcaaacactaatctccaaaaattccgtgttagtggtcaaacatttttaggtttttccataaatctcctaacatatatatacaaaatttaatctggtatttagcatacttcccatgagatataaacagcaatataaaatttaagaagtcaaatgtttttactttttagtaggcagaaacagaatgtagaaaatgatgtattagaatgattatttgatctcaagttgtacatcagtgataatgaatagaaaatgaatttaacatttaggagtagcagaagaaaaatatcctaactggtcaataattgaagtatatatgttacactaattataaatcaccgaggaattaaataatagatagggttgaaaacacagctcctttgtcttgtcaactttacctcccaaaaagcaacgtcactaattaactgatcagttaccaaccctgtacttttatcatagacaaaaaccagccaaaaacactaccacaccaccggccgctagctccaattggcatcaaaagtctaacatgattaaagataaggtacacatatatctactaacaaagcattacggagcacataatggaaaattaaaagttaaaaaaaccgctgttaatattatacgcataaacaaagtcatcagccgcctcactggccaagccaatggcatctctagttgcctctcaactttggtcacatgctttgaattccaactcatcatcgacccttatgttgcaatgtgatgcagtgtgcaccctcatcatgcatgcaaagccaacaagacaaggngaaggaaaaaaaaagcatgcgtgtgttagtgatatgttactactatataaacccctagcatagagtgccaaaggccattgccgcagcagcagcagcacaaatcaagtgatccgtagttgctgcttcttcgaattctcctctcaattcaacctgcctcgatctcgctctcgctctcgctctctacccgagtgcaccattaaggagg

SEQ ID NO: 2199 - DNA, 1930 bp, Oryza sativa
tttttttacccgggggcacttagggcttatcatttgcatttacgtgtagcaattggcagttatcttaactgcaagagggggaaaaaaggttagcacaaatcttttagccgtcatgctattgccatgtagtggtatgaactgtttgtgatttatatcacccttgttatttaaccccaagaaatgatctggatggtagactcattccaaaagaaattattcaaggtgagatgatataggtagttctgggacaacatctctgggtagcccttaaagttcatatcatatcaagagcatgaagttataagagtagttcttctcatctgactgatgtgtgatatggtgacgattgagtttttgcttgtggtctcacaattatgggcaattttagggaagtaggcaggtgatgttgtctccgggacaatttaatttcccggatataattcatggcacattgaattcaataattcaagtagtaccttcttgtggtatgaccttggtccagttaggtgtgctctcaggatacagctcacagccacaccgaatggtagtatttttttttattttttagataatggaagctttattgaactcagtcaatagtatatcaggcatagttgttgtcctgtgagagactgtaatggagcatgcaaatagaatggacttttggacaaacactgatcaagttaatgataatgccagttgcattcaggacagtatttccgctgtaggatggatgcaatttggatagattaagtttcctttggtcacgttgctcgtctttggtctatgctaatatgttttaggatagatttcactgggtaggtattgaagtttctataagctggttccattgacttaattgcaagttctgtatgccaggtaacactggtagatacattttggtatcaaaggtaacattatactatagttatatgcctatatttatgattggctagaacttagaaggggaaatgattagattgcatgttgtttgtgtcatgctaatggaaggtggtggtccttgaattcgtacttttgtgttattttggtaggagagtgtggttcaatgttcttaaatgatgtttggagtggatatttgtggtcctaaacaagaagtagatgtgcttcattttggatctttggagagctcattgtcatgaaaaaaaaaatgagatgtttccatttacagtgaaagaacagtttacatgtcggcacatcttttcccctggagcaaataagccatttgacacaataagtaaattgtgattagcagtctctttattctttatcacctatacatccagtggagaattttgttccatgtgctctcttgtgggaactaattttattttggtgttcaaacataaattccctgaaaattgactaggcagttttgtgagcttccatgcaactattgagaatggatagcagttatgtataaagttagtttttcaacttagataaattgacctgcacaactggcagtgtgctctaggctctaacatactacatagatttttttttgaaaggatactacatagattttttatccttcaaaatccaaaattcgacttaaaaatacatcttaagaagcttttatggttatgtttgccttgtaacactcaatggttccagctttgttgtaattaggatccaccatattgaggcttgtttttaaaaaggaattcttttttggtctctgttttgatagtctatatcacgtgtcatagttttgtgatatataattaatattttagttaaccaaataatttacatagaaatgagcttactagtgtttctgcgttcgataaaataactatggcttcatcataatatttttgtaatttaatgcccctgctagaacatgtatttatttcaaaggactaaaatgtattctttgatgttttctttgttgcaaaaggttgtggaa

SEQ ID NO: 2200 - DNA, 2000 bp, Oryza sativa
acgaagtttatagaaatacatagcaatttttaacacaaatatactagcaaaatatatttaatgttagattaaacaaaactaatttgatattatatatgttgctatattttcatataaagttgagatatttaaagaagtttaattttgaaaaaagttaaagcgttggagcgagtagaaaatttttggacaaattatactctaaaagtgtgccacaaaacgatctacaaataatcgtggcctggtaatctacagatacttaaataatcttgagtgaggatgataattgtgggccctactaactgccatccaaagtagaggcaaatgactggctcgtttcaaaatatcaaggacaaaatcgtaaaccctactttaaaatcacaattagaactaaaagtgagggcaaaaatgtgattgtccccccccccccaaacaaaaaaaaataatgtgtgagctagagggtttacatgccaatatccctccctaattctgttggaaaaaaaaagtaatgtgtggagctagagggctacatgtcaataaccttaactgccaacattttatctttacttttttttcctttaagaaaaatgacagtaggtaacaaatatatttcagaattcaggaaatgatatatgcagaaaataatgctaataataaattaatgataattttctttaatacaaatccgttgcatcacacgagtcatatgctagtctaatccttaaaaatcctagaaacattatctaagtcaacaaatcaacaaataactaatattcttacatcagctactataattcttcgatgttgaatagatgaataattacgaattaattaaattgtaaagttgaaaaatcgattttttctaagaaattcacatatagaaagtttatataaaatcacaatgttcaatagctcggaaatcgtgcaaatctgctcactaaaaaaaatgctgactctataccgaatacacatccctatacgtataagtctataggtaagaatttttatatatagagaaaataacccgcataagtttatagagcatatggtaattgtgcatcatatgatattaggataaaatgaagaaaatataaaggtgagagtagagttttggataagcaaaaaatccatccatccatcctttaaagccgttggcggcgttggccggcccaacgacatcgacggccaaatcccccaatcccaccttccggaaaaccaccaacccggcagcggttttccggcagccactgccgccggacagccagccaccaccgttgctggctactcactctcacagccacagtgaccgactcggctcgcctcgcttgcagctgcacccaacccaacctcctcgccttcctcctctccttcctcttctcctcttctctactccactctgtcccacgcgcgcacacacgcacgcagcttcctcggccttggaggggtgaaggggggagggaggaggagcagaacgaaggatcttggggctcgggttggtcggggtatggatcggctcggcgcgggtgtcctaatgccgagctttcttggcaagatccatggccgccgcgcgagaaccctcgtctcgtagacagccctaaagccctcgcggcaggatggtcggagcgcgtaggtcagccttctcttcttctccttcttcttctccctggaatttcggtttcttggatttgcggttgcttcctccagggtttcgagctccgattttggggggatttgatttttttttctttttgtcgatctcatcttttgtgattaggggagttttcacatccagatcttgcttcgtgttactgaaaaaagaataaacatggttcgttcgtttgtttgatttgcaggcaaatcgacggggaggaatcaagaatcggggccttcgatcgctgcagaaaccgccatggacagctccagcaagctcgcgcgaatgcgcctgtgatagaagacttgtagttggagagcttgcagagccagattgtggaggagaagcagcg

SEQ ID NO: 2201 - DNA, 990 bp, Oryza sativa
  misc_feature (1)..(1): n = any nucleotide
  misc_feature (8)..(8): n = any nucleotide
  misc_feature (14)..(14): n = any nucleotide
  misc_feature (41)..(41): n = any nucleotide
  misc_feature (81)..(81): n = any nucleotide
nggggttnggaaangttcgttgtaactccttcatcatcggnttggccggttaaaacgctgggaacttggggacagcatttnccggcggccgcccgccgacgatgaccgaggcgacgactgctggccagagttggctcgccgcacggcggcgccgccgtgccggtgttggattcgacgatcctgtacatggagagagagtcggatatgggatgccttctttctggcctcgaagcacaaaatgggccttgtgctccgaagtggacctaatagggcccttgaataactggaccctgtccagattaactgggccgagccacgaaaggcctgagccattcagccgtattcagcgatgccgcttaagatgatcccagtagattcctagttagacactacgatgtaaacctgagaatgaaatcactaattactgattcaaccctttaaatcttcatgcaatcagtaagttctgattcaacactctcacatctaaaacaaaagattaaacccttttaccacttcaaaggaaagagcacgtaagttgacagctactttccgttgcaggacatggtcgcgataaggagatggatgatgcatatgcttgtttctttaattaaggatcttacatatggttgagaaattgattgatcataagtaacatagccaactgagcttcagcatgggtgctccaaccatatgtaatcagggaaaaaaaaaagaatactccagcaataagtcagcgtagttacagttacatgaaccggtctaaggaaaacggatgcgctcgtcacatgaacgacaaacaaacccaaatgtaaactttgaaattaccgtatctatgaagctaatcaaatggaaagaacaagagaacgggaaaataacaggtgcactcggggaagaactcaacctccagacacctacaaatactagtcgacgagattgcacgaaatggtgaagagcctgtgagagtagagtagagtcactctagtatatgcg

SEQ ID NO: 2202 - DNA, 2000 bp, Oryza sativa
  misc_feature (1308)..(1308): n = any nucleotide
acaaactttgtacgcataaattttatggtgccaaaactttatgtaaaaagtaatttttgaatcggattgtaaaaaaaaaaagtcgaaaaaaaatatccttgtgggctatgagctccatttgacttggttgttcgacaacataacattgattcggagtccaccatctccactattccgacatgtataccagttatgttatgtaaaaggaagtgtttgggctaaagcctaggaaatccacctcttgtctctatcccaactccaaaccctaaccgctcaacatcgcatgcgtagttattggaattcaccgagatcatgaaagttcagagatggagaagaagctcaatggtgtatgaaccatgaaccaaaccgagatatcaggaacttgtaatattatatccttactttcattcaaagtgtcatggtaacaaatccatttgtgtggtatatagtagaatagcacataggtaatacatggtacttataggtctgaactataaacatttaatggctaaataagacgtgaagaaagataatgtaaccttcacacctctctgtaatgtgagtgcatatatatccgctgggttatcattcacattctaaacttgtgcataactaaaaataggagaaaacacaatttgacagtttaaaaacaatgtgacctcacactatttggtaatgcgagaatgtgagcacacgtctgtcgggctaccactcacatttacatccgtgcataacagaaataggataaaatgtaacctgacagcttaaaaaactaaaaaaaaggcactccatcctatttttgagttttaatatatgacaccgttatgtaaaagtataagttaagatcatagtattgatgataaaacaagttagaataaaacaaatgatatttatataattgttgtgtataagacgaatagtcaaatatcacatccaaaatcaacggcattatacatccaaaatcagagggactaatggttaaaaacctaaattaagtagggtcatcaagctcaaatttgatacgcgtaactcgaaaaatttccatcttcgtcaagagtgagtgtggacctgtttagttcgtgaacgaaattttttggtatgtcacatcggatatacgaatacacatttgaagtattaaatttagactaataacaaagattccgtctggaaactgcgagatgaatttattaagtctaattaatccgtcattagcaaatattaactgtagcaccatattgtcaaatcatgacgtaattaggcttaaaagatttgtctcgcaattagacttaaaccgtatcacagtaatangattaaaaatgttttcacccgttgaaacatacaaacatatttccctagtaagaaattataaattaaagattagttttgaagaccgtgccaactttaatcaactttaatcacgtcttataggatagaaggagtaatatttatatgattgttttgcataagacgaatagtccaatattacatccaagagcgagtgagtgaaagaaaaggaaggtacacgcatggcacgtggcctttaaaaatagataaaacgtgacgcgtacaggtcagtgagtcactccctgacagggtgggtcccactccaagttagccaaaagccgtacgtacaccccaccatccgacgtcgccggagggagagaagaagggagggccgagggagggagagccgtcgggaactcgctcactctctcactctcactgcctcaccaaccagtcaccgcccttatcctttttccctctaaggtctaaaccacccccaatcacgcgggacccccattcgccgcgcgcgcccactcctccgcgtcgcgtcacccatggcctcccgcctcctcctcctcccccgccgccgcagccgccatggcggcgccagcctcctcctcgcgcggctcctctcctcatcctcctccgaggctggcggtggtggggcggtggagaaggtgcttgtggcgaacaggggggagatcgcgtgcagggtg

SEQ ID NO: 2203 - DNA, 2000 bp, Oryza sativa
  misc_feature (1315)..(1315): n = any nucleotide
aacacaactttgactatttctataaaaatatttattgaaaagtgatatatgtatacttttatgaaagtatttttcaagacaaatctatacatataatttctacattttcaaacgcaacaacttaagagttattcatgatttatatttttaaggtttgacttaaacattttcctaaacgacttttatgattatggagtagtatgaatttgcacacctatgcgaattatgagccatagaaacacgagcagccaaacgaaaggagagccgaatagttgggccaaacctcccgaacgaggcccacaggaaaaccaagcataaacagcccggttacggcccatataacaaaccggcatgcagcccacacccaccgcttgtacaatcggtacaggtacaaacgtactcctccacgaccgcgtaactctcgttgccacacgctcgccgtcgccgatttggcacgcgcgacacggggagatttggcacacgctgtgcgcctgtgcggtctgtcgcgtctcgtagcggttggggcaggggccgttcggtttcgcggtcaagcgcgtgacgtgaggtcgcccaagccaagccaagccaatccaatccacgccaatgagacgcgactccacttgccgcgcccgaggcccacggcgacgccgacgtaacaaccgggaggagccgaggaggaggaggaggaggcgtcgtcgcggcaacatcccatcccatcccccacacctcccacacgcggacacgccaaacaactccggtttggactcgtctgaaatcccttcgcaaaaggtgtgttaaaaatttagttaaaattaaaacgatgtgatgaaaaaattaaaagtttatatgtgtagaataattttaacgtgatgaaaaaattgaaaagtttggaatcggcctcgcataccgccccaaccccaagtcgtcgcctcctcaaattattggcgaatatacaaagcggcaagtggtgtactgaccgtacaatcctactactcgtacgcctcggctgtactttgatcccaccaccaccaccaccaccactgagatgacgcgaggttcgcagttccacgcatcccaccatcaccacaccacgacgacgacgacgatgccgcagcgcgcgtgagcgatcacaaaaacgcctccgtcttccggcctttttcccgtgagtgagagagctcgcgcgcgcgcgcgtgcgttcgcctactacattctttcccctccaaccttttcgaggtagtatatttttcctcgtcctccccgtgctcttgattctctgcctcggtttggtattttggcctttttgatcgggagggcngggggccaatttgatttgccgttcatttcgatttgatttgatccgatctgatctgtagaatagacatcacatcaggggtatggaggttggcgtgagcgaagctttgaatcccgggtagccgccggagagattgcgtcctctcgccttccctccctttgattcctgctcgcccgccgctcgtctttccgctctcgccgagacacggtgttcggcggccgcgcttgtttggtcgctgcctttttatgccaaacccatccgctttgagagattggcctgtcgttttcctgttgtttggtgtaagattccgtcgctcttgaaagctcacgatgcgaaaagaggggcgatttttttatgtttttgatttatggtattgagggttttttttttttgcttgctttgttgatggattcaggaggaggaggaggcggtggcgattgatggaatctgatcgaatgccgcttcaggctgggtcaatcgagctggctgcaacgatcggaggtttcctatcccctcgtgaaggtgtcaaatcagtatccttgtgccggatggtttggggataattttcgtagtgagttcataatagcgtctcatttgggattcctctggttgattcagttccctttgcaagtttgcgggtttgttcacggatttggttggcttgagatcgatcttcattcattgggag

SEQ ID NO: 2204 - DNA, 738 bp, Oryza sativa
aatcatttgctccttccttaaccacctctcctactcgtggatttctttttgttcctttctttctcctctcctctcttcgtaccccctgtcacgtagttcttgtttactctttccattaggtgtcacaggtttcttctcctcttatccttcctttccatcggttcttgtacttggtggtatacccctagctgctcgcctttgtgttaatttggttggattgggagtttcttgttctctctttagccttgagcgatcttggtttcttgcaattagcctttgactgcttcttcttcttccacttgccgccggcagctagaagtggtccatcgtaccaaccctttcgtcctcattgaaccattccgcctcgctcccagctccattactagaagcactagagctagcgtgaatgcgtgatccttgatgcgtagttagcagctagctcctgcccccaatctgccatctccgcattgcgattttgagtttttgagattgtaatttgcgaacgatctcggttgtgctgagagcttagcgttgacttcgatgggtgcatcgcgttcgatcgccgattctgatttggtcgcgtgatccgggggtgatcggtgattactccgagcgggaggggagatcgtctcttggcgcggttgcgcttcgccgcgcggagggagagacattcgcggcgtaatccgaaggtgtttgttggatcgaggcgtggtgtccgagaaagattcggagcggcgg

SEQ ID NO: 2205 - DNA, 2000 bp, Oryza sativa
  misc_feature (152)..(152): n = any nucleotide
  misc_feature (798)..(798): n = any nucleotide
  misc_feature (1478)..(1478): n = any nucleotide
  misc_feature (1511)..(1511): n = any nucleotide
gtctcgccggccggcggagataacgacggcttggagaggcgcagcctcctccacttccgccccctcgggcctattgccggcagccgctgggaaagaagcagcacacgagcgtcagccggagggaggagaggagcggtgcgcaggcgcgggcntgggcgccggccggagggaggagaggaccggcgcgtgcactcggccggcggaaggagaggagacgcgggcggaggccgaggggagcgggagaaatccgcgacgcgctccgcgtccacatgctctctcacggcgccccacgcccccaccgattcaccacctacctcgtcacgtgcgtcaaccaccgcctcctccactcgccaccaacgccttctcatcctcgagggcgatggcggggtcgagaggctcctcgacctcctcgacgcggctgacgccgccgtcgatgcgcgggcagcgcttgagcgcgaggatggcgcggtcgtcgaggccgtagagatggacacggagcgcggcggtggtgcggcggaggcggggcgtgaggaaggaggagaggcggaggtgcgcggcggagacggggcgcgaggaaggagaggcgacggtgcgcggcggcgtcggggaggcggagcttgatctcgacctccatcacggggggcagggaggagaggggaggctagggtttggggttgcaattgggattggtagggaggccgatgcggtgggacttggagggcgcggcgccgggcggtgggtggaggaggaggttggagttggagggcggcggggtcgtggtcggagtggatgaggcgntgggggtgctggccgccgccgcggtggcggtggcaacgcagaggtggtcttcgagctcgtcacgatcgaaggtggtcttcgcgcgccgccgctccagccgccgtctccccacttcgcccgctgccccagtgcacatcgtgaaaaagagagagaggataacgggaagaagatgagggatgggaggatgacatgtggggcccacgtgggtcccaccattttttttattattattttgtatgtgaaacagacatgtgggtcccacagggtttattattttttcggatcaaattgccacgtaagtgccatgtcatatgaagaccgagtcgaatttgccacgtaggcgccacgtcagccaaaaccgccatctaaaccgccgagggaccttatctgcaccggttttaatagttgagggacctgttgtatctggttttccggttgaaggatgaaaatcggattcgttgacaagttaagggacctcagacgaacttattcctatccgaaatttctctctttgttgtatgttactagtaggttggatgaatattggtaagagaggagacccatatttctcacctactactttcgctggccggttatacgaaacaacattggtgcgctgcctgcgctgcttctagggaaacacttgacgaaaatgattggtaaaagtatgggcaaccttntccctagtttgcaccaacagcaagacgaaaggnaaaacagagacttatatcaagatgatacacgcactgaattttctgcgccgaaaccagtccgcgatagtccaataccgaggacgctcctcgctttctgttgcaatgtttgcccaaaaaaaaaaaagagaagagagcaccaaacacaatttgtttatctactggagtgaacaacagaacaacgtcgctaaatttcttgttaggaagaatggccaagaaggcaagaagtatgaacaagagcaatgaattttatttccccttgttgaattcaaaaacttgagagacttaaacttgggccgacaagggaagcaacgccacacggctcgtgtgaagtgcacatatatatacacgatggcgccaaacacatttctcaactcaccaggcgcaccgcaccatttctaaatcacatagtgctaaacccgccccctcttaattatatctccacttagcaaggtgtgtggttgcgagcttaaaacgcacccacgcagggcc

SEQ ID NO: 2206 - DNA, 2000 bp, Oryza sativa
caagggatgagttcatcttcttctctcttattcctcctcctcatcaacctgtttctataggatgactaggagtttgtgggtggctagtagcttgcagttatggtaggacagagtgtctatgtcccgctgtagagctgtggtgacaggccacacataacagtgataggctcggcgttagttcttttctcaagttggtggttgggagtcgttagtttcatgctggtgagtttttcttttctttcctaattgtagcctcctagagttgtaatattgtatattttttcatgctatattaatatgaagcctcgcagctatctcatgtggtttgttcaaaaaaaataacatgatcaattgttgtttgttgtgtagtggtctctccggtgtcactatcggtgatttgacaaagacactcccaatgttgaatggtgtaaagatagtcatgtctccagtctttgcacatatatataatacatagagtcaaagtttaagatcaaaggtaaccttaataagcgattgaatgctctatgtgatggaaatgtgcatgacgtctatagtcctttctaagactctaagagtgagttacaaaccgcctttgctacctgtacgttgattgagttttagaaaaatcgtagttgattgatcaatcatcaatctgttgttgatctaagggctatagctctatcttgtacctcgagccaagagggagacatgataaggagagggatatgtcagagaggactcgcgacaacgtcctggtggagatgggcgggcggtgggtgggggtgagatcatgtggttaggttgcaagggtgatagatctagcagcgtgagccaccccgagatgaaggagaaaacacatatggatttgttgatgaagagggtgatggcagtgatgtggagggaaagaggacagggataggaaaggcttgtccagcctcgccggtgtcagcgctggcagtgcaaagaggaatgccatcacacgcgagtcaaagttgggacttagaacgttggtggcacaagagacgggatcaggagagggggaggctatgttaaaattagattgttacacaaataacaatgtaatctgagctatttaataaactatatataaaacatcaggcaactaatgaatggtcaagccgttatcaattattctggatggtaactccctgccttcgatgcaggacggagtgtagcgggggcccctgtccgaccatcccttgcgataagagtttttttctttctcagtaacttatatttcctgtatttgtgttttttgtttcttttttttccttgacccctagcaacggccctctgaccgtttgcgttgtgtaaccaaactctgttgtcttcttctaatatatttgactgtgcaatcatttagcgcgttcgcgagaaaaaaattggtttggatggttaaatcttactagaaaccagaacaagataggctacgcaattagcaatggatggttggcattaggtcatctaaggtcaaaccgacggagatacatttgctgcataaatagcaactagcgtaatatgtgatgtgatgtacttcctacgtcttataataagtttattttttagctacttatatttgtctagaaataagttaatttttagaataattatttgtatcggagtttatgaaagtaaaaagtaattgtatttggagtacataaagtgaggaagtattgagatttgataaagtagaggtattttagtttttttttattggtacgtatgagattagtgaaaaataaatttatttgggaagggatgtagtacctagctactcttgtaccagctagattaagtataaaccaaaaacaacgggagtagtagtagtaagaatgtaaaacggttccaacataacgcaacaacggaacggttggatattcggttgggaggagaagggagattccgtttgagtaggttataaatagcaaggaatacatacgtacgttccaaatcatcacaaagcaagcaattaagctggc

SEQ ID NO: 2207 - DNA, 2000 bp, Oryza sativa
gaggccgcaccggtcgatccacacgtgcccgcgacccgggcttcaccgccacggcgtcggcgtcgtggccgcggcacccttccacctccaggttgcagacgatcacatgctcgcactcccgcagctggagccccttgccggacagtgtcacacgctgcccgcggccgtcgatggtcttgtacgacgacacgcgcagtcccgtcgagaggtggatggtgcccgacacgtcgaagacgatccatagcggctcgcgcctccggcaaccctcccggagcgacccgtccccgtcgtctggagatcgagacccatttgctacgttgttagatgcagggagatggaatatgaataggcttgtgtgtgttagtgtacgtgccctcgagggtcgtgacgtggtagacgtcgccgtggaggccgccgatggcgtggcggccgaagccctcggcctgaccggccatgacgcgcagcgaggagtccgcggtggcgtacggcatgaacacgactccctccacggatgccggtggctcgcccccgcactggccgtcgagttgaggaggctccatggctaccgactacgaggaggttttcgcgtcgctatttgttgagtcgcgcgcggggaaacgcctgctgtagtgctgtttactgctggaatttgttgcgaccgggccgtttggcccgtttccgcttttgcagcggcgcgcgcgtttcgggccggcccagacaagccgccaaccggaagtccggaagggattaacacaggtcaaacagagcgttttaggagtttgcagggtcgttgcattgcatccagcacgagctcgttactatctgcatgacgttacgagcattcgatttcaaactatcattcaatctcgatcgtgatgtttttacctcccattgcccggaaacgtcagtgcatttaagcttgtccctaacataagttttcgctgttagatcgtttaatgttcataacatcacatgagactaatcttgaatgaaaaatcagttgggaaactctccccctttgatcaatcttagctaaaaacatcacatcggaatatcctctttgcctgaaaaccctctctaatcttctaggccaaaaaggcaaaaaatcggtcatggcccttcccatttttgtactgtttgatgaaagttttaagtaatatcatcgtgcgagacatccgacagtgcgaagtttggtgtgtcgttgtcacgtaaccttccctcgtttcctcatattcctaccgccggttgcgggtcgtctttttctcgcccgtttcatgggctccctttcatgtcagcatcggattgcgtccgaacaaagtccactcaaactctcaaaggaagatcctgaatggtctccgatcgaagctgtattggctatctgcgaagtgtcattgccggctcagtggatacacacacaggacacgaatgtacaatcactaaccacgcagcaggtacgcaataaccagcgttagtttaagcaaaaaaagggtcgtcgattacgtataatttccgctcgatagagccaaaaccgaacgtgcccataatccccccgtgcgtggatttacgtgacgcgcgacagcgcaattctctcccacttccgatctcttcttccgcttggactcatcgccgtgacgtcgacgttccacgaggaaaaggacggcgtcgaagccaccgggcaacttctcactcccgctcgcgtctctgacaagtgggccccacgcctcgctttcttccccccacctcccgcccggctgatggcccaaaccccaacaaaacctcctccgcgaaagctacaatccaaagggagtcgttaccgtctcgccattgtcctcctcctcctccgcccccacctctctttcctcgtgccttcctctttcgccgccggccgtgcgcctcttaaagccgctccccgcccgaaaccctacctcgggaaccctaccgcgcggctttgacccagggataatcccactactggctactgcattcgcttatctcgctcg

SEQ ID NO: 2208 - DNA, 2000 bp, Oryza sativa
  misc_feature (1389)..(1389): n = any nucleotide
taattgcccccttttcggtgcaaactatctcgtcagattagtcgcatgcatgttccttcgttgaattttgcaaagttagttgtagagagaagttcttgggagggtggatgctacggtctcatcttctctcttttcccccaacaagcgagctagcgaaggggaaaatggggggagcagaagaatatccatgttaggttcgcgtgcttgcctctcggctgagctctagctgttacggcgttcgtcaggatggctaatccgtctcgccaattagaagatggataggtcgtagcgttagatggattacttgatggttgatgcgctgcccatttattgttcgtagcaggttctgtcttctcagtccgtgtgagtgtttcatcatattggctaccaagatgatcactcttcgtttatcaagagagtagggtgagatctcaatccgttgcaactgatgagtacttccttcgtctcagaatgtaagtatttttgagttagacacagatattaaaaaagtaggtagagatgattggaggagagttgtgattgatggggaagagaaagtaggtgaaaaaaatggttgtgattggttaagaggagagagtaggtgaataaatagcttcattttgggacaagttactgtactaaaaatagatacattttgagacggagatagtagtatacttcacttactaccgagtacggctttagttttgctacctccgtcctaaaatatagtaacctaggatcggatgtagcatgttactactaatctagataggcagcatgtctaaattaatagtaatatgatgtgactcgtttagtacaatattgatatattttaggatggaagaaatatataaatactgtttttttattcgaagtagttggcccatcatttctgaaatagatgattgatgccatgacgccgcttgctttctagaactactagtaattttaggtgagagctagtactgatgcgtcagtctaagataatggacaaaaaagggctacaggctactattgattatcacattaaaactctgtacgacagatttttctgattaaatgatagccatatgcccaacgtgctgcttgtctaaactgaaacctgacatcactcacagtatgcccagttgttgggtggtctattattatttataaattataactctggcatttttttattgtagggcaatatgttttccattattttccattaaaacctctaatctgcacttccactatctgctcaaaatctcaggctactttctttcctcttcctcaggacattaacctggtttacttgtaagaaagtaaagccatggactcctcataccagcatgacaagcctctgctggatgaagagaactcctcgcaagtggtttgttcctntctctctctctactctcatagcgagatttgtctgatttttttctcttaaagagaaaaaaatatttggccaaatttgaggtgccttttctgctttcatcaaatggtgtgaaaatactgctttcagctgatgttttgtttctgtttaatgctctagttctagagtgttgcgaaagtaaaaaagaaatatagagtgaagttcagtcggaaaattttctcttacttaaaattattttatatggttgcactagtatggggcatggccgactggggcatgcaatccaagataaactttcaaatgttctgtctaaatatatcatccttacaataaggacataaagtggtagcaatatattactaatgtgaccataagaatggctaggcccttgcatactaataatgtttttagttagtgatactttgcagtttttttggatgatcagttaatttgcttccaatgtatataatataattttgttcttaggataaattttcctggaaatatatagaataattccatctacattaggaaaatgcacaattctctattgaaacatctataccagtgatggatgacactggcattaaaggctatttgtgttttttacttggaa

SEQ ID NO: 2209 - DNA, 2000 bp, Oryza sativa
  misc_feature (763)..(763): n = any nucleotide
  misc_feature (1015)..(1015): n = any nucleotide
  misc_feature (1017)..(1017): n = any nucleotide
  misc_feature (1037)..(1038): n = any nucleotide
  misc_feature (1057)..(1057): n = any nucleotide
  misc_feature (1067)..(1067): n = any nucleotide
taaacatgtgctaaaaaatcaacggtgtcaaacatttcgaaacggagagagtactactatactgtgtacaattccaaagttttcagtttgacatgtacactgtaattgattttcgtctctgttcgtaaatatttattagcaggcactatttacatttcaactttgatcgtccgccgtttttaagagaaaatctatacttaccatattatcaaaatgaaggtgtattacgcctgaaatataagtagtaatctttcgttcatcgtagtctaaaccatttaaattattaagcgaccaaaaattgaaatagtgatattcaatagtgacaagtatctcgaaacaaagagagtaacatacataatcatcctctgtaatggtgtgtaagctcagaatcactaagtggacttataattttgctccagttaaatctgttgggcaaatatacctggaaccatggagagaaatcagagcaagggagattggagaaggtagttttggtttggtggcacacagatctccatgtcggcctatgccgcctatcatcatcattccactagtagcaaaacggacggccctggaagctggaacaaacagaagaaaacagcaaacaaattgcccctacgcgacgtaggcaaagccagccaaggcagcccaccaattattggtgggccccactaatcagggacagtaaaccggccttttttacccgccgcaccaacggcaggcgggcgctccaggaggtttcgcttcgcagtgaaaaaaaaangaaaaaaagaagaaacggaagcgaatatcctacggcacttgggcttggctataaaaaggagccgtctttgacgcctgaacgaattgctgcgccgtgctcgaacagatctcgatctcgatctcgatctccgcacgcaccaaggcgaagccaattccactaccaccgctcttccttcttctcactccttctcgcgactgcggcgagggtgagtctcctgtcgtgagaatttcggtctaccggcggcggaggtgntnttcgcgtcgtcagacgtcgnngatcataggtaaaggttgntcttggctcnggttctcttatctctggttgttgataatctatatggatctatggtttgttgattcgtctgtatgtgaaaaacatcatcttgggttagcgaggggtgggtttcagattctcaggtcgagtctccagtacactggttgagtgctcgtttctagatctgtatttgttctgcaacgcgaggtgttgtggttgatgcgattcatgcgaaaacttaatctgtcatacatacttggaagggtaaaaaaagaaaaaaataatctcctttctactggagatgcatagcgtgggaattataattagcctcttgttatctgctagcctggttgttgagcgaagctttcggatccaaccttttaattcagggtagctttatgtagtacagaaaactgtgtaactgtattgtgtttcctgttactttcttttaaaacaagttctggttgaaaagcgtagaaacagtcttaactggcatgtcttgttttcatgcatatgtgctgtgcagtagattaatccttttacctagaacttctcaattgagttttatgttagttgattccaactagtagttgtccatgactgaccttattgcatcttcttcttttggcagaattactagacttccaataagaaggaaacaccttagggaatgcagaaagatgtgcttgcatgctagagagctaccttgtgagggaattggcagggtagcaagccatatttctccttccacaactcttcatgacattggaacacaagagtatatacagcgcttgctccatgtgctctcgcactatggggttcgacgtggcaactcaaccatcttcttagatcaccatcttggtggagacggttgaagtcacctatcatttctaggctcctggttaccacactttgagctttgggattactgctttctttggcgtgatggcggagcagagaggaa

SEQ ID NO: 2210 - DNA, 2000 bp, Oryza sativa
  misc_feature (924)..(924): n = any nucleotide
  misc_feature (1766)..(1766): n = any nucleotide
attaatcaaactaattagtagattatgtagttaaacaaattcaggcaaattcaggcaagtaacaagcacatgtcgataattaggtttaacttagagcaggtacaatagcaggctataagccagctgcaaacatatttcaagaagataaatgaggagagagaagggtagtgggctacagatttgtagccagctatatcacggattccaagatgcagtgtgtgtatgacaggcgggaccaaatattaatagtgtagtatgtaactattgtataaatgagttattagattggctatagatgaattggagctagtagttggctatactattaaacttgctcttacctgttagacgcaatgattagcatatgaacctgttaaggaataaatctcgtgcatcaattttctttgtgttgccacatcttccatcagaaaaagacaattctcataatctacaagttggtgggctcatgttactgaacatgaagggactactttagtgctaaaaaaatttcctactcattaagtatggtaatgtttaactacataatctgctaattaatttgattacttgtatgccaattaatctatagccattgatttagtttggatggtctggattcaagaatgtcacaccgtgacattagtgtgtaatgtcagaggatacggttccgggctcgactagataataaaattcatcatcgtcaacctgtttgaagtattcagcatttgatcaaggtaaaggaatcctcttaatcatcatatagcaaaagaacatactcttatagccattaatgcgtctcatgcaccatatgttgttaatcatttggcctctctttcagagtttatctgttagcatgtacaatatgatgatcgatgtgcgttgtgaaagcaattgacatacatattgtgttccttgtattatatngccgtcgttctttcgccttttccctatccctctctcaatgtgaatgcccatatatttgacatacatactgatttggtttttcatattttccagcgaagaagctggagagctaaaccaaacactgcttgagaacgaggacgagagccgcacaatcagtgagatgggtgatttgctataccacgcgatggtgctgcttagggtcaagggcgtgaggatggaacaggtcttggaggtcctcaggaagcgattctcgcagtctggtattgaggagaaggccagtcgcaacaaatcttaggatattactcacagagtggatgggtttaccagtttgcttatgtcgtatcggcattggtgccaagtgtgtaccattgagtagtttggtcttcttaattagaccgaaggttgtgaattgtgattatgctttaattgttctccaataagacactgagcaaatacatgtctggaatttgcagtgctgttcttgctgtcgccaataaaataataaaatcagctcataagtaaagcatcttcctgatttgatgatctttttttagctatgttgtgaaaccgctgctcttatttcaacgccgtgcaaagttcaatctcaacaggaatctggggaaaatgctacacatacaagtcgttagtatactacacttttattaactgtattagttaagcagggttcacaaatttgttcgaattttgtcatccgaaatctgaagctctcctaagcagatcggtttgcgctgaatttcatttgaaattcaacgaatttgttacatcgcctctgagatgttcacagccaagtagtagcaaattaaaggaaaaggacaaaaatnaaaaacagcgtgcaaacaaattccctgcaatagattaaaaaaaaaatcgagcagtcagttccataagaaagaaaatgcccgtaaatttgagaaatttcgcgcgaatttacacaaacgcgtgagccgcccgaaaataccccgagaactctgaccccggtcggactcccgactccgagacgagacagagaaatccccaaatccccacgtctcctcctcctccgccgccgccgccgc

SEQ ID NO: 2211 - DNA, 1520 bp, Oryza sativa
  misc_feature (6)..(6): n = any nucleotide
  misc_feature (20)..(20): n = any nucleotide
atccantttttcaaggtttntaataattaaaactcaattaattacacgttattaccaccttttttgcgtgaaacacttacaaacaccacctaaaggtgtgttggagaatactacctccgtttcaggttataagactttctagcatttgcccatatttatatagatgttatatgtctagattcattaatatctatatgaatgtgggtaatagtagaaagtcttataatatgaaaaggaggaagtagcagtaatgggcatggaggattgcgctctagtttgtcttcgtcgagaagaaatatcacttcagcgaggaagtgagtgtgaacataacttttgttcgactcaactaaaaattgtctgatcggcttaagtaaaagtaaaaaacacttggttaaagatagcaaatatattattatattctgacatgtttaacttataggtctatctttatcttgcgacttatacattatgatactatctccgtcccataatataaggatttttagaatagtgctaaatcaaacattttttttaactttgactattactagtgaaaacataaaaaaatcaatcatataaaattgataaaattgatgttactagatttatcattgaacacaactagattccgtaattctatttcaaaaaagagtgagactcaatctccttatgccatcccaaaattgatgctactagatttatcattgaacaaactatcataatatgcaactctttttatttaaaacatctcacttttatatatattgttagttaaagtatacctcgaaaatcgtttcaaaatttaaaaatacttatattttgagacgaactaagtacatttcaaatttttacgatcacccggaagatttccctactccaaaatcttacaaaattttaaccatcagattggaatccaacgtcccacatccatccgccgccactcgtctcgtccgtctctctctctctctctacgaaccacgcagctcgactcgcgagctctcgccgccgccgccgcctcttcccccaccgcacgcgcttccactccgccgccgccgccgccgccgccgaggctccagcactgccgttctccgcctccagttcttccctcccccgtcatcttcgtcgtctcgggtgtccggtgccaccgcgccgccctcctgctccatctccggcggctcctgctgcccgccgcctccaccgactaccccctcctccgccctcccgatctccgttccccgcgccaccgcccaccgcggggcctccgccgccccggccgcttccgtctaaccctggatccccaccacgaaacctaactagtaagcgccggagcccgccgcctcctccgcctaagttcgctacactcgctggagatggagaatgttactggagaaggaatctcggatcagatagagaggttagcgattattaagattttgccaccattttttttcagtcgaatgttgtgtagcaaaccgattgattttcctcttttttctttcagatttcaaacacagctacaa

SEQ ID NO: 2212 - DNA, 2000 bp, Oryza sativa
ggtggcatggtggataatttttcacccaataatctagaaaaagctcatctaatgagcttatcaaattataataagttgggctccagattataataagcgaaacatggcctaaagttaattgttttgagaccacttttctttttgaaatctgaaattaaatattgtcctgataggctgataccctacatgtcagacagcaacaaaggcagctcccagtcaggtttgggcgattgctcgagctccgccgctagctgccaccttcactacaaattaccaatttgccatcgatgtataaaaaatagtaaatcaccgagaaacacaattaaccgtttaaacttgacgatgttgtttgctccgtcactaatattcagtggcacaatgggtggcatatttcaatcgtatacgagagaatttcactcactcttcccattatcgaaaagtagttgcaagtattactcgtatgatcgtatctcactgcaagttaactaggtacgaaataatgattgatggtaagatgcaaattgagctatgttggttgcatatatatattttgagcatacacatgtgcaacaggacggatgggcctcccagacacaaaattgtgcaattccacaagcttaggtggtagtatttaagggtgttttattggttaagatcattgaaacaatatttaatgctgtcttcctctagttttgatatgcaagcttcactttccatgttcatcgcacacgccattagacccatatatttacatctctttgtgagattcacaagtcatgattggggatttacatgaagcaggaatttctaatgtaactgaaagaaaaggaatgactgaaatagaagttgtcaaagtcaaaaagataaaacctcaaaggctattcacgtttttccttctcatacctctccaccatctacaggagtcatctcttctttctttctcctctagtccttccatagtgcgtcatccatactcctatagaaaccttgtgatcaactaactattcatgtaccagtcagtagaaccaaccaatgactataaacgtaattactaattataggaagctcgagagtatagaaaacaaataaattaataaactttcagatttttcaccttatttagttgttagttgaaaaaaacacacgttagcaatatcaagtattttgttatatgtttgatgtggttgtaggcttgacacaccatagttaaaatcatagatttggaatcaatgtattttaattttagaagtacggtgaatatatacacacacttacttatggtttgggagatatttgatacatatgggaatattttaagcctacgtgagattcatatacatgcaaatatagtgattcgatacaaaggagcgaaattttaggatttttgattcctctctctcgctggttttgatggttttggagtccatctttcacaaaggccaactctatcattggctggcgccgcttcgtttggggacctgttaggattatagtagggtttcctccgctccaaatctccctcttgtaggagcaacaggtacaactttcctttttcatagttttttcccttcacagttcctttgcctgtccccggtaatggtcttttcgtccgttgtgttgtgtaatatattaacatataatttttttacgcttttgcgtttttttagtgatgtgacgatgatgtatatggaccgtgtgttctcaattgtatactttcaaaggaactagtaccattcgtattgttgagaggataaacacacaagcgtttaaagtttttaacattgatgaaggggtagtaaacacgcgctgcaaaaaggtgagacaaggtaaagccgagagacgagtggtattaagttcgctcaaaaataaagttataaaaccagggaagcaaaggcggcccgggaaaaaaaagaacccatcgcggccacccgcctcgttcgcttccatcctctccgcagtccgcacccgcgcgcgcgcgctcgactcccgcaccagccgcg

SEQ ID NO: 2213 - DNA, 2000 bp, Oryza sativa
  misc_feature (1635)..(1635): n = any nucleotide
  misc_feature (1647)..(1647): n = any nucleotide
  misc_feature (1762)..(1762): n = any nucleotide
ctttgttctagtcctccagaccaaagatggtgaattggcttaattcttaatctgaattccactaggcaaaagctgaataaggacgcctctggttgagctcctctcgaaccacttcccactacaaaacccctctttttccaaaaagctgagaaaggaagaaaaaaaaaatgaaaacgtggccagttagcaaatagcccctccaggtttcagggttagcaaatagcaatacctacaaaagggatcagtgcaggctgatggaaccatatggtcattttagatgtgcattttggagcttgatcagagtgttctaaacttcgtagtgctagtagtttccactttccagtgttcttggtagtgccaaagatattgtgcataaaatgaagagacaaacttaccatcttttagtaaaaatatattttttacaggatgcatttcacctttcttcagctcctgtattgttttattttgtattttaaacctaactatttcaatacaccaatcgtcggttggttagaaaatttatatagaaaatcaatatggtagagttaaagccaaaacaagcgacaatcatcacaaacaatagacactaggccatttgtctatcgacctaagtgtgtacaataaaacatcacaatcgcataatttttcattcgcctctttgaaactacaagtttcaaaacacaggcaattctataatatgttacttatatgtcacattaccgtatattgttcaaggatctaggctgaggagtaggagtaacttctagtttatttacgagtgcaaacaatagatcccatgagttatttccagcaatcatggctactaaataaaaacattaaattgaagggacaaaatgagaacataaggaagaaaaaaaatatcacaggtagatagtgaagaaaccataagacaattacgggcctgttcactttgatgccaaaaaaaaccttaacaaattttggcatagttgtcaaaattttggtaacttgccaaaattttgggaggattttttatatagttaccaaaatttggcagcaaactaaatgtagccacttggcaactttatcaaaatttgataaggttgaaaatgtcatcaaaatgaataggccctacatatcactgaagatctataaagataaagccatcttaccagtatagtcaatttgcatatgagcgtttgatggaactcatcacatattcgaaacctttgtgtccgtctcacaatgtttttcggagtgaaatatgcaaatatgaagttgaaaagcatgcatcgatacaacatttttggagatttaaaaaaacaagtgcacgctttactagccgcaaaatcatgggtaggctaaccaacgtggttctccaacctcgttaaaaatagacagtgggcgattccaggatagaacgccatggatcaacgaccgcatatactcctttctattcaaagatttttcacctcctgtttcgcaagcataaaaaaaaacgagaatcacatgcggcaaaaaccaagaacatgaggacctggtgataaatatgcgtatttgcgagcgccaacgcttaacccaccgaaaaagcacaggacagtagtggtgctttacgcgcaaccttccattatagccccaaaaatacagacacacacnaaaaaaaaagcngagaatttgtgtgcaagcatccccttatcgccttcccccttgtgtctcctatccttcgccgatcgaatcatttgagcttgtgggtctcctcaaccatattcgattcgtgagggangggatcgagctctgttgcggtgttgtagatcattatcactcttggtttgtgattctcggaagtcggaagtgttcttcgcaagctcgattttcttttttttgcgatatttttttgtatcgttaaatctcgaatcccgacgggggaggtggttgagtccgagttcgatgctccggggcctcaagatccagtctcgacgccgttcttgagctctccgtgttgatctctgcgccgcgaaggg

SEQ ID NO: 2214 - DNA, 2000 bp, Oryza sativa
  misc_feature (1919)..(1919): n = any nucleotide
atggagcaaggaaaggccgtagaaattcaagaccaagagaagaaattcagaaggcggaggaagaaaaccacagagaataaagtcctcgatcgcaaccatgcgacccaggacaggctggggttcagtacctcctgcttctctctccatggttccgcgactgggaagggcgccatcctcctgcagcttcttcagcgatgcgctggtagaggtagacttgtcgagatccattgctgccggggatcgccggagaaaggaccgagatgagctagctagggtttttgtgggagcggagaagacgagggacacttggaggctggagagttttttcacaacaggcggacttcaaattggatccccaaaactcccttaaatagacgcacttccgacggtgtgaattctaaggaaaggagagagatggccgccggaaatttctgggtctgttacgcgcggcagtttttcggacttcaatttaattcactcatgaccgttgagcttcacctggcgttgtcgatcactccttgtctctcggtcctcacaccgagaacgatgacaacctcgacatcagaagtcgcgatcggttttgcgagttcatttaagtagaagtcgggggctactgtcagggttacgggtaaggtataccctctacccttcgatatacgtcacatatcgatatggtatacttacgcgtatatggacgttttcggcatacgttaaggaaattcattatggagtttacagatggaaggagtcctactcggatataaatgggtcgtcattgtatcgtaccgggtccgatgtctccgagttctacttggagaccagttgacatgcggtataaaagggaccccccgggaggacctaaagcatcgaatcttaccgccaacacatccaccacagcctacgaagccggagcctacaggagccaagtcgccgggtgatctagtcgaatcaactcgactacgatctcattggtatcgtcgagttccactatttcctttgtaatatgtggtttccatcatataatcccatatcaactggattagggctattacctatcaaggggcctgaaccagtataatctttgttttctgcctactcgatgtcgtattacgtagatccttgtaccagcgtactccaataccctctatatccggtttacggatatcccccgtcgacaccctccgtcccacattatatgggattaggggttaaaagcgtgtctcataatataagggatcgggtaggcagagtactaatccaaaccgacatataagaattgtttttttaaaaaaatatatttcaacatcgtattgcaataccttcgaaagaattgctcaggatatattgagattgacgaagtcaccatagacatcttgctatcgacgggtgcattgccttatcactaaaaaaaataattagccgtaaattcgagcacccgtgttaaatctagaatttaaacctggagggccagttcgaccacaagaaacctaaagttgagttacgctcacttcgcaatccacagtaatacataccaagcttgctctgtgtaagcacagttttttgaacaccctacacgatggtctttaaaaaaacgctaccttcatcaaaattttgacatcaattaatgatcatgtattaccaaaattttgacaatgctaatttttgaccgaattttaagttaacaacatttcgctaaattcacataggaaaaaatacaagttacaaaagtccaaaaggagaccgtggatgacgactacctggcacgacattgggccaccaccccaaccctcccaaccactgccagatgggacgccaatacacagctcagcacccaaccccaaaagtcccaaaaaacccagccaattcgctcatttccattggacgcagccaaatccgcgtccgcaaagaaactagtctangccgccgcctcgccaacctccccaagccggccaccgccgcacgggctccggcgacgaacgagggcgctgctctcgagcgcg

SEQ ID NO: 2215 - DNA, 2000 bp, Oryza sativa
  misc_feature (1475)..(1475): n = any nucleotide
  misc_feature (1501)..(1501): n = any nucleotide
  misc_feature (1508)..(1508): n = any nucleotide
  misc_feature (1510)..(1510): n = any nucleotide
  misc_feature (1827)..(1827): n = any nucleotide
aacaagagctcatgaagagtcatcttttcttttccttgggcagtacctcctaacaagattgatctgtttagataggtccatgatggcctttttattgattttgacaacatagatataatatatggattaccttcttatgtgcacctattctgtcatttctgtgctaagtcgtgctatcttgctatagaattttgcattcatctgaattctctgattattattgacaggtacctcatgcagcagtccatgaaaaataccagacaaggctgacttctattaaaaagccatttggagtatcgccaaagatgtcctttccactccagaaaaatcaagagatctattgacaactcgtggaactgaacattccattagcatatgtaatgctatcagtgcttttctagcaagagttatggtacaattatacatgaatttgctgtaaggctctgattagacattaaggagaaacgatggtactgatcattttgctatccaaatctatcagatgatctgtagaaacaagcgatccctgtgtgatggttttgctatttgccgcccaaatctgcgttgaaaatgaaatgtacagtttttagactactttctccagggaggcacttgtgcatgtcgatgtcttacatctgcctctcttctgggcagcttccaatctttacaggtgggtcgtggcctcgtgggtgcaggtttaagcggtgtgctaaaacttttgtgcttatgtttttgtctacttatggcgtcttttagcacatagttgctgtgatattatgcttgcagacctgcctctgcctggccacgaattgttatgtggcggtggaggttggccggtcaccgcgctgcacctttcaagtgtgatctgtccatcacttcagcatacacgttgacccagctgctgcatcaagccgaattccattcgattgtccaatagtactcctttgcaataagctcggcttgtgtcattttaacggtcaatcacgctcacaatatgccgttcatgtcattgtcatcatcacagagtgtgccgtctgcctaatgtatccgtacataaaaataacatatccatgcatacttgccgttgttaatttagtactaatgtacacggagaaaactatgttaagacaccagataaaaaaaattataataacgtgttaaaagagggattaggaacgcgaacaacacagagagaggaaagggaagtctttgaaagtctgagaaggaagcaacaactgaccaacacagtaggtggcaccaaagaaaaccgcaactccaaggcaccgtcgacacgaacttcacaagaactccaccgagaggagaggagaggagaggaaacgacgacacctcctccggcgcggcgagacgaatctacgcgtaccgagtaccgacgcggcgaccgcctcgctccgtccctatcctcgccgctccggctgattccgtcgcggaggtatatccaccatctctcgcccctngcctgcgcgtctcaaccctctctcanatcccgngntccctcctccgtttccgatctgcagcgcgcgcggccggcgaggagtcctgggagggcgaccgacgcagtcggcctccttccatctcggttcgaatcgaatcgaattgaaggtattcctgattgttagtatcttttgtaaccctaattcccccgggccgcttgatgaggagttttggcgtagattggaaatccatccgaagttggattggtttttttttctccaattaaccccatctagtttttgcgttcagattttttttttgacgcgtggtgtagtactaataaattattagtaccggtgttttcatagggaaagnaaaaattgggggttcaaccatgccccacgttagttctgcccttggcgcttactgttcaattttgaccttcagagggtagcttttgtactttttacgtcgacttgtgtcgtaatctaagactaacttctcaattgttttttttttttgtgatgattttgttagcctgccagtga

SEQ ID NO: 2216 - DNA, 2000 bp, Oryza sativa
  misc_feature (1090)..(1090): n = any nucleotide
  misc_feature (1121)..(1121): n = any nucleotide
gagggatttgtcggcccatagaataaggaaagggaaatatacaggttttttctttaaaaaaactggaaatatacagttcaacctttgttgttactgtacgctgataaacagtgaaaaaaaacgaagcaatcaaaagcattttgtaggtgaaaccctttcaccctttgcccgtttgtgttgtgcgcttgtgccacctcctaccagacacatcatacacagaaaaactggcttattgtctgcttagatcaacttgctgcggtaaattttttggtataagttttgatggaaaaagatttagcattgcaattttataagttagtatttagatgcatggtaaagttttgccattaattgctgccgcctctcttatgcacggggcctgatttttttttcttcagattactatcaaatgacaaatgccaacttgcctactttttacatttattttgctaaaaaatgttctaaaacggtaaaattttaatcattttagaggatctaaaccggcccttagctcaatgctaaaccaagcacgcacgtgtagtgtaaagcaccacgaacgcggtcgatgtgatctcccatcgtcccatgcctgatgctgatgcctccctccatcacacgcttccgctgaatcgcactctgatcgcgccccgtccacaaccacgagccgtgtcccgtgtacgtgcatccgcgtggagcgggatgcgggagcgcaacgtcgtaacgcgcaaagaacggggcgcacgcacgccctggtgcaccggtgcgcgggcgcacagctgccgcggggttggcacgcatcaacgggccggggagtcgtcgtcgtcctcgcaaagaaaaaaaaatccccaatcatttcgaggtgatcacctaccaaatcatcatcacgggcctgtgcagtctgtgtcgcggtgtatgtgcgcgttactaccggtttcccctccgctagtaatcaccgattttccccattgtgtcacatgggccttttgctttgtgatacggtcaggtcatagacaaattcacaagagccaaaaaaaaaataaaataaaataagagagagaaagatgggatagtgaaagacgagatggatatnggtgcggtttgaaaaaaaaattaactgcctngcagcttctcctaaaattaaaaactctctaaatgatttagtttttgtctatattctgataaaatgtaatggtagaatctaaaaaattatatagaaaaaaaaggtggaaaacacagtatttcgctaccaatcagctgcttatcataattttaaactatctaaacaggccgtatgatcatgtatcctcgactgcagatagggcaaacacacatttgcataactccatcagcaagtgattagattagcttaattaataccattttcattagtaggaaagttgattagcttccttaaccaccactgctaagctcagtcacctggctatagaaaaagccaataccggcagctgcctctgactcgtctcctcgttgctcctccctaccctagtcgatctccccttcgcctcgtctccccgtctcctcctcgcgagctcgcccgcccgccgcctgcgccgagcaccgccgatctccaccccggcgagcagtagcggcggccggcgtcctgctgcatcccgccggtgagctcacgtcctcttcctcatttctctccacccgcgccatttctctttgcacttgaccttagcttctcttgtagatgtggaagcttttgtttcggccttaagcttggtactaatggcggtttgtttgcagagaaatttgggggttcagctgaaccctctatgcgcgacgatagatccgcccttggggagtagggaagggaggtgaggtgaggtgaggagataggaggagttgagaaggcgctgattgttgggaggaggaggaggaggaggatggtggaaggccccaagttcgccggcatgatgggcggcgtcgtcggcggcgccggcggccatgacgacattggtgggaatttctgcgac

SEQ ID NO: 2217 - DNA, 2000 bp, Oryza sativa
  misc_feature (1939)..(1939): n = any nucleotide
agaaggcatgtgcatgtacacgtccactatgttatcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacccatcaggtttttggattgttggaaatatagtcattaatcggcatattttaatccaaaaagttaaagcaatgatcatggcataagcagtgtagggtgatcttaacataaccagtagcatactatgcgcatcatgaatgtcaggaacaggaacataccagtaacgcgataacatgctagaggcatcatgtagaacaggaacaagaacattagcgcacatagtatagcatcatgtagaacaggaacaagaacatagcgcacatagtatagcatcatgtagaacaggaacaagaacatagcgcccatagtatagcaatagcgctaacaatgggaacaggaatagcgctatggtgaggcagaattgcctccgttgttgttgtcgttcacgggacctcctgacgcaccagctcctgtcggcggcgtaccacctccgccagcagtggcggcgacaactccagacatggcgatgagcaatcgtgcgggaggcactccccaaaaacctgatcatccacctacccggtgcagatctcaggcgaaggtgtggtttcggaggcactgctccttccaaacgccgccagccagtcacgccacgcccacgcccacgccccggcgcgcgcgcgcgcgtgtggcattccgacccccacctcaactggtcaacagggagcctccaataactccctatttaggttgagatatttctcgcttaaatcctgaggtggtattattatcctcaacatttattatgggcctttgagatttaatattataagttgggcctagcccaattattctaacattcttaaggctaaagctaagacctagtcaaattgtttcagcttaatctaaagtgggagtgaagctggctaaagcgctattacaaaatgaattataaaaatggagctgtgtttaaactgctctagaatttaactccaaatttaaattttaaaattaaatttagaagttggaattctatcaaacgaacgaatgtaggctgtgtttagtttctgaaattaggaagaagtttagaaagttgatagtttggaaaaaaaagttaagagtttatatgtgtgtaataaagttttggatatgatggaaagttaggagttgaggaggaaagttaagtgtgacctaaacacagccatattagttccaagtaatgctccgcggcctccgcctccgcaactccgcgttagcatatcaccggcgaccgtggaagaaccaccaaccaacgccacacaatgcctccacgcactgaccactcgtgctacgacaatatctggcgctcgcccggtcaaacaccacaaggccaccctcccgccaagcaattaaccaaccagtacaactagtattccgcattccactcgatgcacccgtccaaaccacgggggtaggtgagtggtcactcaccaacttttttctctctctctctctggagaattgagcgcgagagccggtcagccgttcgatcggccgggtcacccaccaacacacgcaacggcgtaatcacacgcttataagtagcggtggttgacgcctgcgctcggtagcgggtgagcaagcaagccgatcggcagccacaccgcatatcatacactcatacacatttcgctcgaccgatccgcgcgcgcacggagaagatgtgggtgacgtcgatgccgcaggtgtgggacgaggagggggtngcgaagggcagcgtggtgacgccggcgccggcgacggcgctgctggggtcgctcgcgggat

SEQ ID NO: 2218 - DNA, 2000 bp, Oryza sativa
caaatttaacagggtctaaatcatggtattgttgtctaataatattactactacttcatccagtcatgcctggccacaaattttgcaaggattgcatttagatatgctactgttagtaacaactagcctattctttgatgtggtatttctgatctgtattctgatattgttttgtaggaaaaacagaatacattgctcaggaaaaaggttgctggattgaaataaggacagtgatttgttctcagcaacaacaaggtatatgcttgctgacttaccctgttacttactctgataagattaaggcaataaggttctgtttgttcattccaaattgccaaactattttggctgctcattttgttgcactatttccttattatagtgattattccttgactgtaagtgtaattatttgatagaatcagccattttgataaactcccatctttgttgtactatctgtatgcatgcgattgtttaaaatgcattataagggcattgtctttgctgataattatttttgctgttaagcaatacacacaatagtggagcttgaactaataaatctcaagaggggccaaaataagattgcggttctttggaatttatagacattggagttatacaaaacacatgactaagcaatacatgagtacagcagctctaaaacaaaagcatctatactaaattacaacattaccgcatacttatgtttcttcattatatattcttgatttctacactctaatcgcagcgacttgtttcacaattaaatatctctaaaaataataaaatcaattaagtagatggaggaattaacaagagaatgcacccaattatgtactatatatgaagtactaatcataaaaatcttcaaacattggggtgggggtcgggtgagagcatacggatcttgctagcctagtagaagctctatccctgcgtaggctgtatatatctctttaggaattctcattgtgagcaagttactttgtattatgtatgaaatggtaatttgtaaggttccattgtgctgccaacattaccaaaggtgttcgtgaatcgttactagtactagtagtagtacagttcaattcttcaatgttttaaagctagctatcagtctatcactgcacgctgaccacttctcaccttctttgctagtgtgcattggttataagaaaagttgggagctatgagccttgagtataatctcgagccgaagaagctgctttcagggctgacaatcctgttctcgctcctcgttgtaaacagattcgatggtagacaccaagaaagaaattgtggaaacatttgtgtaaatctaaaaagacgaggcgcacacgttatcgtttttgaaactgccatcttaatggctgaagtatactacactcctgtattatcttttgtggcattcagcgaatcaaattcgttccatattctacttgttctctctgctattattatctaacaaaagcccaaatttgctaccttcagacctcagtctccaactgatagttgatgataggcgttaggttagtttactggaatattggatggattgagtggcaattgatcgatacattcgctgaaccaaaaaaataatattccagcaagcacgcaagcaatagtttacctctcatctcttccattgctcaacttatgttctgcaagttgatacgcatttatgtgttttttgccgattaaattattacgggatatataaatatagattggccttttgatgggcccatttggcagggactcctcgtcattattcttgtgaaagaagtctaacttcgaaatgcaattctccaaatacaaaaatctccaagggattagaccgcaaaaaacaactcgagtacacatctccgccttccctttctcctcctctctcctcttcccctctccaagtctcccggtctccttcctcctctcttcccggccgcctcgcctcgcctccgccttcccgatcgcaattcgcctcctcctcctcccac

SEQ ID NO: 2219 - DNA, 2000 bp, Oryza sativa
  misc_feature (476)..(476): n = any nucleotide
taaaacaacgtatttcagttgccttttgctttatttgtttaattaaatcattgtgttaaacttattacttaccatgggttaactcaagtactccttttccttactgtagctttacccttcaaagtgcattgcattcattatcatatttgagcatgttttatgttgtcaaggacattctgcattggcggcattgctaatctacacatgttccctactgttaaactgtcatgattcatgactgtaaatgatcaattacttcaagctgcatgcacatgcctatacatgatttaagtgtgatcttattcagtcagtcgatttccaatggattttgctgttgttgtgacaaaatttactgcactgaggctaacctctcaaaagactccaataaatgaatccaaaccacttcctaagtgtcgcactttagcatgcccttgttagctgcacaactatctatgggtgcattgaaatttcaaacnaaagagctgaggtgcatatttggaacataattatggttcaccaggtgcatgtattgcatgtttttttgtgaaggaatatgtagttgcgtgattccgcaaagttgaacatcattcaacattgagtcacttttgaacctccttgtgtgccccctttcatttgttgtaaatagtactctggtgacacaatgtatgcatttggctaagcctgaaatgccattccataatctcccatggacagctcatgctgtggtacactttttttttttgaggatgtaatttacatgttttgtcatttaagagattgtgaaatgtgactggttaatggatagatttttcttacttctcttctaaaagtattgctgtccgttttaggtggtcagcctttgttgacgatgggaagatcaaggctttcaatgttgaggtagctccttctgacttcaaggtttctggtgccgaggtgatcttggaccaaatctgatccgagtaacgaaattctgtcgttgtttgttttctcatgcagcatgcatgcttttgctgtagtaaataaacgaaaactcgactactcgagtatccatgtaaagatgtttgtagtctgccttgctacgcccagaatatttgttttcctgttacaaatcagcttgccgggcaacatgtttgtcagcattgacgtgagctctaacttcaactggattaccaaattggttggttgagctctgtccttgactatcattttagctggtcagaaatatgaggataggaaaaaagaagggagcaggtgaagaactgatgatgaagttggctattgggtttgtcatgggagccgaactgattgatcattttccatcttgactgaatggagaattctactagtaccaagttactctcaccagtaaatacattcgatatgatatagtatattatattacaacaaatctgaataagtaggttttaatataataccatgttgctatattttggtattatgggaggagtatatgctagtagtattaaactgtctccagtcacctaggccttgtctaggctgtgtttagttcgacccaaagtttgaaatttggttgaaattggagacgatgtgactgaaaagttgcgtgtgtatgaaaggtttgatgtgatggatagttggaagtttggaaaaaaaactttggaactaaacacacccctagttcccaactttttcttcaaaatttttgtgattggtgagaggccttccaaatttgtaactttccaactgctcccacaccgagggctccacttgtccatgggccccacttgtcagtgacacttgtccggtgcggcagtgcctacaaggaatataagccgccaagctccatgtcgtcagtgtgatgaacacagcaccagcattcacctgcagcacgactggtcactctctataaagtataaacaaacgtgccccgcctgcgcagccacctcagcacgcgcgcgaattcggagcagccgccgccgcccgccgcagtcgtcgtcgtcgccgccgcctcgccggaa

SEQ ID NO: 2220 - DNA, 2000 bp, Oryza sativa
  misc_feature (871)..(871): n = any nucleotide
  misc_feature (1761)..(1761): n = any nucleotide
  misc_feature (1770)..(1770): n = any nucleotide
  misc_feature (1831)..(1832): n = any nucleotide
  misc_feature (1839)..(1839): n = any nucleotide
  misc_feature (1845)..(1845): n = any nucleotide
  misc_feature (1848)..(1848): n = any nucleotide
  misc_feature (1857)..(1859): n = any nucleotide
atgattcggaaaacgtgctttcagataacgatggaatagaagttggtaaacaagagtgaaaacaagctcttacgaaatgaccctatttagaaaaacgcaaaatctaaaccgagaacgctctcgatttagtgttaaagagcgacgtactcattcgtgagagaaggtcaagcgctaatagtgcgtgagagaaggtcatgtgctgctagtacagctacgtgagaaaaggtcctcttgttactagtgcacacaatgcatgtctattttttttctttttaagaattttctctcaaattacttatccgatctacaatctgattacaccattacgtttgttgcaattaaatctttacaataagatcttacatgattatattatgatgaaaaactatttatatttataaattacttttattatatacataagttacttttatcatatatataagttactttgagatttgactaaattacttctatacattcataatactctaagttgattatgtttattattgtttttagttaattttatattttgtggactttataaatcttctctacattttacttgcgaatttactctacatagtttcttatttcagctcactcaaaatataattatttctactacagagagttactccccccatttcataatgtaagtcattttagcattgcccacattcatatagatgttaatgaatctagatatagttctaaattaaagtttctttttgttataagttacttctataatatatgtaaattacttttaagctttactgaatttacttttatatatctaagaagtaacttactgaaatctgagtaagtagacttcctagacatatcaataaaagtaatttttganttttcatcaaaatataatccatgtgagatcttgttgtaaatatttaattgttacgaatacaatagtgtaatcggattataaatcggatgagtaatttaagagaaacttctaaaagaagaaaaaaaaacatagatattgagtgtactagtagttttttttgggaaagaagggtgtctctctttaccactattcagctagcactctcgacgtagttgtgtccttagaaaaaccactgaaaggaccttagttagaaaatgctaataacacgaggaccgaagtgcacacaattaattcttttctgaaagctcataaaattgattcaaaaatttaagcaaagagtacatatagaaggaaaaaaatattcccagtacattgccttacaaaaggatatagagttccatcgtttcgtttcgtttcgcttagcgtatccttattcttacggtttattcgcaactaaaagttttttataactataatttttatatatgagtcagtaaaaaataagctttgataaacttaaaataccacaaaatatttcaaaattataaggagaagtaaaaacgaaacgagataagtttgagtagcacttgcaatcccaaagcttatgctgctgacctagttagaaaatgctatttgcacaaggacccgaatgcacaaaacggactagagaactcttttaaagcgaagtcagcagcagtagtcagttccactcctactagtacttctctccaccgtacgcgagccgagccgatcccgatcccgagcctgagccgagccgaggagctaaagcctccaaaactcgcccagtctccaaagcgagagacagctcatcgcccattcgccctcgcgccgcgccgcgccgcccgccgccgcctcgccttgcctcctcngccgccacnggcgctagagccgacgctgctgcagcggagaattcggtgccctcctcctcctccttccccnngcgcgcncgccgncgncgccggggnnntccggagttaatgcgcccgtgaagaggcggccgcgtcggcgtcggcggagagagggagagggagagcgagtcttttgtgcgggtggttggggcgtgggcggtggcgtgttcaaggcggggagctacgtttcctgccggagg

SEQ ID NO: 2221 - DNA, 2000 bp, Oryza sativa
  misc_feature (82)..(82): n = any nucleotide
aagcggtttggtgattttatctaacgtggctgcttacgtcgcatttcattttagaaaaagaataaacaaagctattggtggnacccaacatttcaacaacactcatctctctcctcccttctttctttcactttccattttctgatttcaatggcgacacacattttctttcagacataggatagggcattataagttctgcaccgtttctcttagtacgtgtattcattcatgagagttaagatgtgttattttcgcaacggctattattggaaaaagaaatcaagtgtactatagtattttctattgtttattggtaatccaatgtactaaacaaagagattaagtaaatacaccatatctttttactaatacaaaaagatttatatgttcggcttttggacgtacatctttacatgtaaggataaaaatagtcataaaaattctcgatcgatctagaattgttttcgtatgagtggtaccgtttctgaccattactattttaaacctaaaaaaattggtttttctaagagtgaattacaccttgagccacctttgattaccattgttacaatttggactaggctaaagccaaacttttcactttgggccaggtatctttacatgatgtttcaatttggactcccttcttcttcctccaactctcttccccctctctccccttcaatctgtaaagtcttccaaagaattcaaagggtagtttgcattttcaatcatcgactacctagtgcttgtggcttaatttcaaggacagcggagggtgcacaacaagtattcctactggtagcaactagcatacgaagaagctggccggcaatgacagacagttgctgctactttctgaactgacgataagaactaagtcaagtagcagatagccatgctcaagctcatgctcgacctccgctagtgctacatgttatgctgcacgcctgcgctaaatttccacatgtgtcgctcgagcttcaacaagttttgcaacgctcaagctccgccttcgtagtgccgcctgcatttgagctcgaaatcaacttcggcgggtggctaccctatgaagaagggttttgcttcttgccttttcatgcactacacctgatcgagaaagagaccttgagctgtacagagaaaagagagtaagaaagggagttggaggaagaagaagagagtctaaattgaaaccttgtgtaaatatacccggtccaaagtgaaaagtttactttttcactggttcaagttacaacacaggtaagaaaaaatagtccaagatgcaatttactctttttctaatttcgttcggtgtcgcattaatctcgatacttaatattttaattgataaatattatcaattattaaacagataagcgtcgttttcgaagatacgttaccgattccaaatgttctcatccttattcttatcgacttttgtttttctccatttgaccaaagcgttttgagacggagggctttgttgttcagccagcaaataggggagtgtttccagtgtttttccaccgaagaaaggcgaaaaaaaaaagagaaggcagcgaagatttctctagaaagagagacgattgtcccatatccaccgatgccggattagatccggtggactccaccgatccacgggccgggggcccattccaacttgcccagccactggtgggcccaccggccacctcatttccctcaccccccaaccaaaaagataaaaaataaacaaaaagtttaattcgccgccacgcgctttgccggaaagccccaaaagcccgaccaccactgccgccgcgccgcctcctcctcctccgcctccgccgccgccgccgcccgccggccatctccgtcgatccaccgtccggcgagcagacagcagcccggcagatctgcccccaccacgggatcgaatcggcggggggaaccgaatcggggagcgcgggaggcggggagcttagtttgagctcggtcggcggcggcggcggcgg

SEQ ID NO: 2222 - DNA, 2000 bp, Oryza sativa
tttaaagtgatccgaatctaatgcatgaccctcgaccgcaaaaccagataggatgactccctgaacaatttgacagcggttttggacggcggttttattgacgtggtgatgttgacctagtattttttttgaatgacgaatggggcccacatagttttttattttaatgcctcctaagcgtgacgtcaacaccacagaccaagtcaacatcgccacgtcagtgccatgtcagcaaaaccgtcgtccaaaaccgctaaggaattcaaattgcactggtttgaatagttcggggggtcataccggttgtgcggttgagggtcacggattaaattcaggtcactttttaagggagttaaagtgggactggttcctttacggacacgggacataggcgagttttgggccatatagatggcccgcataggatctctatcggtaccaggctgacttctccagcccgtacggtcaagaagcggcccaagtaaccagggtcacgtaggcggcaggccagctggccattccagatagacaccgacggtgaaaagaacggcttgactcggttgcgttgcagcctgcgtttttccactttgaaccttcgtgctctcgcccgtcgcgtctgactggttactattactcgtatatacgtaatacctccgtattttaatatatgatgccgttgacttttcgactaaaccattcgttttattcaaaaattttatgtaaatataaaaatatttatgtcatgcttaaaaaatatttgatgacaaattaagtcataataaaataaatgataattacataaattttttaaataagacgaatagtcaaacgttagacaaaaaatcaacggcgtcatacattaaaattaaaatatggaggtatatacgtcatacgtatattgtacctgctggattggtcattggcaacgcgttactacatcttaccacatgattacttataccccgtgccgccgtgcgtacgtgcgtgccgttgaaccgttccggttaatcgatcagctgcttctcacaatcaaaattctccgcggtctagttgtctatagttataatcgccgtgtcgccggctcacacgtactatgcgcacaagtagcacaagtacaacgacacggtctttgcgacgagcgaattggctgcaggatgcagggggtatcctccgccgctcgtggcgttgacggcggctcgctcgcgggtgaggatttgttacctcttcccagaaatcgcctgacccacccgcaccgacaacacatggaacgtgcgtgatcagcaacccctttttttctgggaggaggtagagaacgtgaccagcaatcttgggagtgagaactggatgctgtgtactagtactaatctcggatacttggccttgtgaacaggctagctaattggtctcgattgcgctttggttagactggttaaaacggttgacacttacactaacccgtaaacatacaataatttcagaacattctaacggaattcaccatgagaagagaaacagagggaggcgggggtttgaattgaaaaaacacggtcgcatttgggagcgggcgttcgcgtcggctcggctcggccgcatccacggaatcaaatcaatccaacgagcgagcgagcgaacgaaccaaccccttcttcgcctcggcttcgcttccccgtcttttccttccgcctcaccaacctcgtctcgtctcgtctcgtctcgcctctcgatccttccaccccacgccgccctctgccatcatcgtcgtcatcccatccggattgccacccaaccaatcgccatttgcttctcgctttccctctcctcccccaaccactccatcatcattcgcaatccaatctcgctcttggttggcgtcgattttgacgcggtctggttcgtgaatccgacggagccgggtgatctgcggcgggacttgcagatccgagcgggcggggcggggcgggttcgctcgtcggatgtgtggatcctggtgaggtgaggcg

SEQ ID NO: 2223 - DNA, 2000 bp, Oryza sativa
  misc_feature (1439)..(1439): n = any nucleotide
  misc_feature (1465)..(1465): n = any nucleotide
gaaaaaggaaaataagatttcaactaggaatacaatttatatataactaaaattggtgtaaaaaataaagactattaaaagaaaagaccatctaaaacacatgacgagattaattaagtaacagacttataaaggagtagagtggtggcggttgatgggacatctaaaaactattaataaaacaccaaatagaatactaaagatgattaaaaggaaggacgataggcaggtcatgaaacaatcggtcaaggcggttgccgggacttttagaaagtaaaagaaaaaccaatgataatcatatttgatttttaaaatctcaatgacaataaaaattagaggcaatgggcagatcgtataggagtacaatggcagtgccgtcgatggttggtgggacttctagaaagtaaaaaatgaattccaacgatagttatgttcaactttgacaatcctaatgataataaagagtaggcggcggatgggtcatagaggagtatagtggcagcgtttgacgggatttctcaaattatataaaatgaaacccaacgagacaataaactctaaaaactataatgtccaatttttaaaggttcgagcttctaaaaagtgaaaagataaacaccaacgataatcatttttattttaaaatctcaatgataataacaaagagaggcagcaggcgagccgcagaggagtacaatgacaaagtcgctgacgttttagcggaacttctaaaaagtaaaaaaaataaacctaaacgataattatgttcgatttttaaaatatcaatgaaaagagaagaggcagtggacgaccatagaggagtataatggtagtatttgatgggacttctagaaattataaaaacaaaaccaaggataataaactctaaaaactataagatcaaaattttaaaggttccaagaagaataaatagaaacaatagtagaccgagcaagcaaataaataaggatatgacagaagtaaggggtagtagctggtgtaactttttaaactataaaattagaattacaaggatggtaaggtttggtctttcaaagtcttaagacaatgagataaatatttaataaattttaagtaaaatcatattaaaaaaatatataattttgtatgggtgctagccgcgcaattgcgcgggccacccagctagttataaaaattgaagatgtttttgccggaattttggtacgtcatcagtatttaagtcggtttttaagctcgttcgtttttggaaatacaaatccatgtttgagtcggattttaagttcgtttgcttttggaaatataaaaaggagtcgcataagaaatttctttaaaaaaactcacatgctaacttgagatggaagtcggactcctaattgtagctcatgattttataaaaaaatatccaagcgaattcccacagcgaatttcatcggagntaatccacataacaatattaaggttnaaataacattcacccattgcagcgcacgggtattttttctagttaatatacaaagcaaagcttttgcgctcctttttttaaaaaaaactataggttcttaagctgcaatttctgggtccgtgactcagtgttgaaggtctgaatttctctgccaaagacagcaccaggaacgtccagaaacgattaataaaatgcatgggagaagaataatttgatgcacctgatcttctctgaacatttttccaagattggtgaacctgaagccaccaaacactgctactactgcagagagagagagagagagagcctttgacccattagtttccatatcataatactctttactttctgcttgcttactctaccaaccacatcagagttagttcatctcctccttgaccgcgtttccatcactgatcaccatggaggcctcgcctcactttgctataaagcccatgcagagtgtgagaatctacccacaacaacatctggatcatccaaagaaaggaacagctgcaacttttttggtcagaaa

SEQ ID NO: 2224 - DNA, 2000 bp, Oryza sativa
acggttctcttcattcaaatcgtgcatctaacggttcatatttatttgatgacgtggctcttcctggtgggatcatgggatacccttttcactaatgtagattggtgcgtaattaaataagagatttcaagaggcctagtacgaggttgccttttttttttttacggagggagtatattagccgtgtacttttgaggagttgggaacccctttcctttcgcacacaaaacatagcaacagataaacgcatagttaattatgtgttagcttaaaaaattgaaaactgaattaaaatgatttttatatcattttttctattttttcaaaagaatacactgtttagtcacacatagagtactattcatgttttatcatctaatagcaataaaaatactaatcataaaaaattttcaaataagacggacggtcaaacgttgaacgtgaatagtgtaaaactacacttattttgggacggagggagtagtttaggaaatatgcgcgtactaaactagggagtgaggttgggaacctcaaatcaagaacacaggtcttaaaaaatgcaaaggttccggatctgtagttctgtactttttttcctgtactgtgaataatgattagcaggttgtattgggaacgaagcgatttgccatcaaggtacttttctctgaaaggtttagttccaggtgtactgtgtaattaaccaagctgattttttgcctatttgaagttgaaggcttgatcgttgcattcgacctgtcaatcatactttaatgcctttagtcccagcaaattgaccatctgtttgtacacagttttgaaccaagcttggatggttaaggtggtggttgacaggttgttgtactctaccctggtttgacgtcttgtgtgtcacattgatacaacgaattctttcagaggttcagggtatatatgtggaaaaaaatgtttatagtgactgttaatcttaaaatctgattatgtaatctatttattcattggttttcatatggagtggtcgagtgtcccgtgtctaaactgactttatattcgttttaggaaaaaggaactgcttgtatgtttttattggtttaaatagttaatctcaatattctgtagaatacatcatagtaacacgaatctaaacaatcaatatttaattatacttcctctagattttttatatgacgttggctaattcaaatttataccagctaacgtcatacatatacgtatggagatagtatttttagaacggatatattatagctcaaatggcacggcagaattctcctaaatcggaacttgattatgcatttttgagtttatgacagacactttgacaaattcaaccaatgtgaaacaaagaaacagtcttccagtcccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttgggtaaaatggcaaccgatgggagccttccatcgggcagctgctgcgttgggtcagctataccgtttgtgaaagtagtatagggtagtaaaaattcaacgaaacgatattttttttcctcccttacccgacaaaacggccaaacccaaccgcctaccataaaagaaagccccccgatcccccgcaacatccatccgtccatccccgatccaacggccgatccagcttcacgcgctttcgatcgccataattacgcaggccgccatcgtcgtcgtcgtcttcgtcgtcgccattatccccatttctcccgtatcctctctctcctctcctctcttctcgagcgcggcggcggtggtggggaggaggagggccagcggcagcaagcggcggcggcgacgcgatgatgatgacgcgggcgtcgatgggggcg

SEQ ID NO: 2225 - DNA, 2000 bp, Oryza sativa
  misc_feature (121)..(121): n = any nucleotide
  misc_feature (163)..(163): n = any nucleotide
  misc_feature (186)..(186): n = any nucleotide
  misc_feature (189)..(189): n = any nucleotide
  misc_feature (193)..(193): n = any nucleotide
  misc_feature (361)..(361): n = any nucleotide
  misc_feature (865)..(865): n = any nucleotide
  misc_feature (987)..(987): n = any nucleotide
  misc_feature (989)..(989): n = any nucleotide
  misc_feature (1014)..(1014): n = any nucleotide
  misc_feature (1110)..(1110): n = any nucleotide
  misc_feature (1116)..(1116): n = any nucleotide
cagagagcttagctagctgcgacgcacgcacggtttgtacaaggtacagtatagtatgacaccgaccgtcgcgaccaccaacccggccgccgcggcggcgacgacggcggcggcggccgangtgaagccggcgaagcgctccgtcggcctcggcctccccggnttccgccattattgcccggcctngcntccnacggccagccccgtgtcgcgtccttctgtgagtcaccaccgacgaccagtagtacagctgcttgctcactgctgatagtaggcacagcgtcgttgtgctgatacgtccgaagtggcgttttaatttgcaggcaagaggctggcgaggaacgtggtggccatggcggcnggggaagcgccggcggcgccgctcgccgcaaacgcggagatcaccgagttcatcaacgccctcaaacaagaggtagatatacacaaacacactctcagctgaaattacgtgtcaccaatcgctttgtatataccattgttgcgtgcagtgggacaggattgaggacaagtacgcggtgacgacgctggcggtcgctgcgtcgctcgggatgtggagcgccggcggagttgtatcggtcggcactcaaaaacatgctcacacttgcatttctttctttctttcttaattgtgaattgtgtaggtatacagtgattaacttgggtttttgcttgattgccttgcaggcaattgacaggcttcctatcgttcctggtctcatggaagctgttggcattggctacagcggggtaagaactactccctccatcccctaatacaagagattttgatattttgtttgtattgtttgaccactcgttttattcaaaaaatttgtaccaaatntaaaaaaaaaacaaaaggttatatttaaagtactttggataataaatctaaattttttttaataagatgaatggtcaaacagtaaaagccaaatgtaaaaatcggacggagggagttagatncncgtcagagccaaaaactttgtttcnagaagtttgattactgctgcattataccaactgctttgggaactgttcaagtctgaattttcttacttagttcattgctgtcatttttccgtcganttccanctccttgataatatgttgcttctgatgcagtggtttgcataccggaacctgctgttcaagcctgacaggtacgtcatcaagcacaactattttatccaacctgcaaagtgcaaaggcttgacagatgtgagtcctaactcaaactattgtgttgaattgcagggaagctttctttgcaaaggttagggaggtctacgaggatataatcagcggttaacagagatactacttatatacaacttcagttcaagggaggctgctactggattaattatctgtactgtatcacagcatagcatctaatttaattgctcttactcaatgtatgtctatataagttggacattactgctaaataacatttttcagaatgtttactcagagttgaaattctttgtcaattgtccttttttttttcctgtcaagctagtagcatatctctttccctttttttttagagagagggaaagggacagagccatagccatgggcatgttaccctgttccatcatgattggaccaaagaaatgcagattcaaacactcaacaatttacacggaagcacgtccaaaccgacagagagttagcgtcactaatcaattttattatcattcgcggccagttcacagttacacaatctcacgtcggattcaaggacaaagttgccactatttcctcttgacttaatcgacctcgctcccattaacttacacatgattagtcaaatcacgcatatatacgtgctcgcctcaaatgcaaacatgatcgatcacctcgcatatatatatataccgctcgagctgttcgtcgttgcaccagccagcggcgagaaaatcacatttgcattcgcatcaatcaatcacaagctacctagccgagcgcgg

SEQ ID NO: 2226 - DNA, 2000 bp, Oryza sativa
  misc_feature (939)..(939): n = any nucleotide
gcaaggtatgctctagacacccttcttttagaatcattcttgtaccaattctcagactcgatcagaatctttatgtgctgcttcatatcgctacacttactttggttgttatggcaatgctgtgcaacacattggtttacagtaagatgaaatctgaaaccaatggtttccattgcagttacagtgatgttcttctgatcttaggaaggcaactcgtacgctcttgtgaagtatcaatcaatttgcaagacttggctcttcgtgatatcagcctcaagatttgatcaagcgctttctcttctccacagatcagcagcagtagtgatgctgtaaggtgagcctgctatgcctgaggtccagatgtctcatcacagtctttgtacaaatgtacatacttcctgcaacggtgttccagcttaagcctgacaactgctaatcagtcctgctgtggatgccaactaattcatcttcaacaacgtcgttaccgtacatccaattggtactccctaggattttgtccttgaagaagggaactcaaattggtacaattcatatgaattgcacaattcatggtatcagagttggttcgacatttacctgctgcttctctcaatctctcttgagagtgaagatctggatgttgttttgcttcatccatatcatggtttctgtatcagtcattgctctctgacggagcctgggtgtcagattggctctgtggtcctgcccacaacttgtgcagcaaaaagagatgaacatgctggtgctcaatgaccactcatcaatacaggatttttgttgatccaatccaatccaccgaaaagttgtgtcgacttggaggagtatgaacacccccccttcaggcttcagtatccatccttatttttttgttggaagtctggttcccttgcgtgataggtttcatttcagctgttcttngtgtttcattgtgatccagattttttccgaatgtacctgcatcatctgttacggccaccaaaaattgcttgatgtgattaagcttcaatgaatccatacagaaatattggtgtttttgtgatgcttctttcttgagaacatcttctggaaagaaaaaaaaattatgggggatatcagtcaccattttgccagacgacttgtctcactcgaatcctgaagtcccatggttgtttcagttcttgggagaacttccattttcatcagaatatgaaaccaaaatatgaatgcttggggttcttgaaagctccggtctagatgatgctagttggtctattagcatgaaccatccaatgcttgaattttgatatctctacattagtctgttgatcggagttgtttactggatccaatgtaccagacccctccaaagagatgatggaaactgctttatgagtaagacctagggtttgcaggtaaagatttgacctcaggtgctaacatgccaaccgttgacgaattgagatgagatgctttctgaagcaaagcaccatcttgcacgtcccaaaagtacaggaataatttgcagcatatattatgtaggggatttcgcgcaaactgctagtaataaactgatgaaaaccaatgaaatccatacaaatcttgttaaaaatatattaacattcaattcatttcattttaaacttgacaaaaaaccgagcaatttgtattttcgacctagtaatccggacctgtttccatcggttttaggaaccctgcttacaaatcactaaatttgaaccaaaattgcaacattcatttagaacccctttaacaaattctaaaaaaaattacaaaaagtaataaaatcaggtcaacctaaaccaacagtaaataacaaacaaataaataaataaataaattgaagaacatgaaacgagagcaagtgaagaagacgcaaagtcatattcattccactggttggtggacctgccgaaccgaaccgaagctcaccggagaccagaggccgcggccgctggagttcgccggcggcgagcgagggc

SEQ ID NO: 2227 - DNA, 2000 bp, Oryza sativa
  misc_feature (216)..(216): n = any nucleotide
ctttcataggtcacacatcttttctgcacactttgtcctcactcgtgtgcacccggaaagaatttcccggtcggtcccccatcccaaattgctccaggccaagcacgcttaaccctggaattctttggagattggcttccagaaaagaagttgcaacttgttgatatgagtattctattaatcctattaagccctagaccgggatgttacaccctnacccccttaagagagatcgacgcccccgtcgatcaaccctaggccaggaacgtcatctcttggccacgtccatgtgtgataccattttgtaacgtcccgccttcccccaggccgggcccgcttacatctgatagctttcataggtcatagactgccctcacagaccaacacatatcttttctgcacactttgtcctcactcgtgtgcacccgggaagaatttcccggtcggtcacccatcccaaattgctccaggccaagcacgcttaaaccctagagttctttggagattggcttccggaaaagaagttgcaacttgttgatatgagtattctattaatcctattaagctctagaccgggatgttacacaaagggctagcatcaaccctttaaacagaccaggttgccaatcatgtaagactgtgtattacgcacaccatagcctcagcaaaagaaaaggcttctcacggagtggattctaatctctcgagaggatatcctctcatgtatcttttactttcaaatttgatacaaatagttgtgaaaaattctaaaaaaatatttggcaatgtagagtatagtgatatctactaatcccaaaaaatcaaattcaaattcgatttacacattgagaaacccaaagaaaaggcttctatcatcactgtcagtcaagtaacttaaccagaataaaacagagggaaatatgaatttgtcagctatttctgtcactgcagctctcaccattcaaatctagaggtttgaccatatgatctatcatggccaccaatagataaagtgaggtcttacaaactaattaaaaaatgcagtacatcactacatccacaaccagttgccctaatagtccaatggagggcctcggtgacagttgacttacaagcaagcaatagtttcttttcgtagatccccatcaaccaaacaaaaaacaacaaatctgagcactgggagagctccactacccccatcatctgaaacaaaaattaatcacctatttgcactgctaaattccctagcttccagacctagctaactgatacctaccagtggggaccacctgcaattccaagaatcaaactgtcatgggcgcaactagtggtggtgatttgtctgaggggagccgggggttggattaacgcgcgtcaaccgcctaaatccaagggggtgcaacatgattaccgacgcttctcgatccaatgaccctaggtaatcacgcgacctccccggccgtaatcccatgtgctccaggcagccgagtctcgtgacctcacgtgacgcttccgcctctagctctcgatcgatcgatcccaccactaattatccactcccaaatgattgtttagtggcccgtatcataagaccggccacgtcgtgcagctagtgtgacttgggagagacagtgtaccggccatttgccagatttgcttcctcagaaaaatagcagagtcggccgggtttgcagacttgcagagatcggaagaatctttctctttcgaaatgttgaggatttttggaaggaaaacaaaagggaaatggagatataggaatcgtggcatttaaggcggcacggtgcagcgtcgtctgtgggttgcaacatgcatcggcatgtgagtctgcctcgggaggcgcgcgctcgtcgatctcgtggccgccgcacttcctatttaagcaccgccgcgggtgacaccgtcccctcctcctcagtactcagatacattacccgcaccgcctaattaagcgctcgcatctgaagccatttcgagggacg

SEQ ID NO: 2228 - DNA, 2000 bp, Oryza sativa
gtgaagacggctggtcggtttatatagagaagggtcgcttgatcagggcgcccgcacgatctctactgtgcgtaaccaaaccggataagtcacgtgtaacttatccggactccacgccgttttcacgcaccggatttttcggaacgtttcgaaaacaaaaacgaatccgaatttgcagcaaaacaaaactgcaaaaggaggctgcatctgcgcaaggtgaggaaccaatttttggcggaccattcgacgcgtacgtcgtgcacacgcgccgcctgccctgcgaggcgaggcgagcgagcgcgcgcgtgtgttccccctcttctctccaccacacatgcttcaagtggctaggagggcatcctcccttttaaggaggtccccctctcttagaataagcaaggtggtactaaactccacatgcatgccatcccatgaggtgggcttttgtgattttccaaagaattaatcttcgagtgggctaaggcccatccattaattccaacagaaggcgtagacctaataagaagaaaaattagtatggcaattcttttaaaacttttatagccatgtaagcttctttaagtcaaaattttaggtaattactaattttaaatgttttaagatgctttattaatatagcatgatacacttttggtctattctattatctatacttgcatggtatatattaccatcgttagatttagtatgtttagaaaaaaaaaattaggtcggaccacccatattctaaatcctagatccgccactgtcggtggacccaatattttaggctattatttcggccgaaatttttcatttttttaatttttcatgaattttggtaatatttgtttaaattcaactaaattttgttcaaatttttggaaatttcagactgaaattttggtatttcggtgatgccgatcaaatcgtctaaaccgaaaagtttaaccctgtgtacaatacatccccggctaccttcctagatctatataatacctgaggtgatacaccaaaactttatgccgcttgtaacacaccctcggctctctagcttgtgccctgaaagcggcgattgctgtacacatgtgctgcatgctagagcccaagaaagtcttagctaaaaaaaattatgaaaatttgtaaaataatctttctataatttttttaaaaggcacaccttttatcagttagaaaaacatgcttctgcaaaatgagatagtagaagatggaatgaggtagatccaaacaccatcttaggttgagttctaaactacaactccaaatcacaatttcctcgtttttcgttagaacgtttcccaaattgttagtgttagggttacggataaggtataccctctaccattggatgtacgctatacggcaatatggtacatctgcgcgtgtacggacgttctctgtatacgctaaggaaattcatcacgaagtccaccaatggaaaggttcctacccgtataggactaggtcgtcactgtatcgtgcagggtctgatgtctccgagtcctacttagagagacctgcgatataaaagggaccccccgggaggacctaaggcatcgaatctgatagccaagacaaccaccatagcctaagaagtcggagcctgcaggagccaagtcgccgggtgatctagtcgaactaactcgaccacgatctcgtcggtatcatcgagttctgttattccctttgtaatttgtggtttccactatataatcccataccaactggattagggctattacctatcaagggggcctgaaccagtataatatttgtctcctgttttcttgatgtcgtactacgtagatcctcataccagcgtatcccaataccctctatatccggtctacgggtaacccccgtcgacagtggcgcgccaggtagggggccttggtgctcaaggttctactactatgacatcaagcttcatcgacaacagcgtcaacaccggccccatccaaggagtccctacttcaaca

SEQ ID NO: 2229 - DNA, 2000 bp, Oryza sativa
acaacgccccggtgatcggctcctaccccaaccacgccttcacccacatcgtcgacgaccacgccctcgccttcttccacgacgacaacgtccacgcctgctccatcatgtgacctaaaatataatcttatttaaaatcctacatgccagcgacagatacatatctgaccaaatcgaacaagctaagtgacctaattagtggtgcaaaataagagatgaaaaaccaaatctaacttcgtcgatcatctagtaatggtcaagtagttgctcagcaatccaacgtgcaaagagtgtggtgatatgatagacaaattaacgaataggaattaaggtcgaactaagcttatcaatcgacaagttgttcttaattaattgcactatgcgaccctttttcttatgaacatgaattaaaaggaagggagcagtagaactggattgctaattaacccgctatccttttgaattgactattcgacgggcatctgcatggtatcgatgcttgctgttgacagcacaaggggaagaaaagggtggccctgaaaattttcaactgttgatgctagctagcggctgatctcgctgaggtatctgtgccagtaatttttgtctgcggataggacaacatggagaggatgactaggaaaaggagcactgttcaaactatccaaatgtctccaaccaaaagtgatgacccatccttgcatatgtgcgcatcagtgcatatgttcttatgctggtgtggggtgaagattctggtgtgaggggcaaacggtgacaacggaaaagaaggttcgaatataccctgttccctgattacaaatacagttatgagttctgaccattggattgtatacatatgacaaaaagagagtaaacttcagttcacacatcagaccaaattgagtacaggtgctaccagtatttggctttcgaagatattttacattgggacagcgagaggagtaagttcagttcacacatcagaccaagtttgatgcagctgctcaatgctctgtttgttcgttttgtcagggaatatgggctaacagtgacccaatctggattggattcctatcaataaataaacaaataaatctggattggattgtggaaatgataagaacacgcgtgcaatttgatccactttttatgcgatcaatttgggaggaaatgctctttcgtttcgctctcacaaacctgtgaacaatttccaccctctgaactttcagcattgttcttgtattccccacttcctgaagttcttaattctgtcaccaaacgacttggcatgcagaacaattcagtccctcacgagatacagaacaagaagatatattatcttataccccatgggccaggtaggtacaccagcaacaatgcaaatgccgtcgcatcgcatctcagatacttatgcccactaagcttgaaccattatgttaacttggattaggggtaggctagagattgcattggggcttatatgataacactacatatacacataaaccacaaaatcaagctatcaacattcctcatctcgttgatgccgacttatatctgccctgatagcgcctaattaacccgtgaacaacgtgtcttttcatcgtccaagtgcccaaccaacacatgacaaaagcaaaacgagtaaataaatttatttagctgccaataaacaaaggaaactggacctgcccgtgtcgaatcaaatgctaataactcgaatctggaacaaaattaacgccaaaaacaacacaaaaaacgactctttttttttctccaaactcgactcggctttgagagttctaatcttagccaggctccaccccaacctgtgctgccctgttcgagcgaagaacgaaagcgacacgagccgtccatataaatccacgccgtcgccgccgaatctcgcgaaaaagctcgcaaatttctactcggggaagaagaagagccctctccaaaggatctcctcgcccggccggcggcgatggcggccgcggcgc

SEQ ID NO: 2230 - DNA, 2000 bp, Oryza sativa
  misc_feature (695)..(695): n = any nucleotide
  misc_feature (1713)..(1713): n = any nucleotide
atagcccacagatgattcagcaggcagataacacaggtagcagaccaacaccagttacagaccgtggtccaagagtaagccttcattttttccacatatgatttgttctcgtttcctagaaagagttgttttttcaatcaaaattcgctctaagatgatatatgcaaatagtttcgtaccaacggtgcataataactttctactacatagaattcaatcacaaaaaagatgcttctcatttgtttcttgaaatcaagcttctaataacatgttattcatttctgcggtgatattatcaataaacattcctaaattcccatcatttttttttgcagagagatctaaggcgcaggtaacaagcaggatgtgtatctatcccttgaaaattttactgtgtgtagattgcagtaaatgaaggtacttgtgatctgtatctcactagctagaagccaactgcgtttccccaatttgttgtgtgtgtaccaaaattttataggactaataacatttgacatggttttgtttttgaagaagcgaagatagtaagatacatcaattatctgtcacaaaagggagattcctcatgtattctggatggatgtaacttatgtgatgtatttttactatttctggcataacctaaatttcctgactttattcgagttatgatttcattttatgcttgctattttttnatctttttagatgctctccttttgtgatttatatgttgacattctatttcagattcataatcagatcagatgatttttttttctaatttgggtgattgaatccacttacagtttgagttatgatcaccaattatagtggaactaccgggcaagtaaccctgtatattggagcacaaaacttctcatacacttgctcgtttttaggatgcagttttgttaacatattattcttatcgtcatgtgtcagtttggtcagctccagattgggcaagaactggtaccttctcactgtaaatttgtgataccgggatgccagaagttgtgctcggtttgtctgtaaatctataattgatacggagtacaaagtgttttctgaggttactgcacatgagttcattctacagcaactaccattgaaaacgacggggatacttgattgttctttgttcatgcagctgcaggccagcagccgtcactcgatatcatattcatgaaaaatttatgcgcattttactgtgtttttgtcaatcgatcgagagagatgtttcgtccggtgaggcagtggcgactgcaccagctgccggccaagcacatatatgcatcgtgaaatttccgagaaagaaaacaacacgggagaaaggtaacaagaagtaggctgtgtttagttcaaaccaaaattggaagtttggttgaaattgggacgatgaacggaaaagttcgaagtttatgtatgtagaaaaattttgatgtgatagaaaagttggaagttcgaagaataattttggaactaaacacggcgctagtggaggactagctctggcatctcactggaccaggataggattaggttgagaaaggtcacaagaactagtggaggactagctctggcatctcactggactagtattaggttctggttgggatcgatttcttcttcccctttgttgctttgaaaagggattactttattttctttggtccaacgtagtgacgcttgcagtgtttacagtttgtttgntttttgccgagatgacggaaggaggtcatccgaatgttattaagatagtggaaaaaaagttagagtttttcatcgacagccgaaaggtcttgcacccaaaagcgcacgttcctaaatcacgcgccaactgctcgaacacaaactaggaagaagggaccaagcaacaatttgtttattccatctgatgactgcctctcctatatctaaggagagctagctgttcatcagctgagactcccatcatctcgcaaaactacaagcagctcacctcgcaaattaactgtcgg

SEQ ID NO: 2231 - DNA, 2000 bp, Oryza sativa
tcttataagctttattgacatgttaaatctgccctttatgttaagatcttgttgcatgtaagtatattaggctttctgtttgatatattttactcgctttactatcttagtatagagtggtatcagagtattagccgatacatgctagatcttcctgatcggatatgctatgaacatatatagtcttgttattaatatatatttcgatataaactgtctcggcatggcgaccgatctatcctaatcacttgatttaagtatatatcgatataaggactatatatcgttaatatctacagccgatcgagtagatttagttctttcttatttattaatgactgtcgatcgatgcatatatgacatcggctcaaagataaatgatatgtcatcggcacctagccgatcggctatcgtttatggatttaaccgcggtttctttgtctttatttcttattgattgcaagatcaaatcaactagcacgctcatacacctaaaggcaagcttttggacctgcactggagttaagcagatctcccagacctcgtgtttttacatcaacacacttatactgggtatcagtcaacacctactaggtatcaggcgataccgcagaggtatcatcatgttcgaacacctactaagtatcaggcgatacctcatatgtatcatcatgtttgaacacgaggtatccgccgatacctagcaggtatcaagcgatatctcagaggtaccatcctgtacgaacgggacaccgtcacgtagaatttccctttatatttagcaaatatttgttatcatatttgttccgtttcatattcatttcgtatctatattcgattctattttcttattcgggttttcaaatccgattttgagaaaaaattataaaaaacgaacgtgataaaactagtttccgatttcgaaaaagaatagtgcctttatcctaaaatataacaatttatatctctcaagatttgtctcaaaatataacaacttcttcaccagcattctcttcccaaccaatcacaatcctttaccattcacttttcccacctacctccactacttatccaatcacaaccctccaccatttaggccctgtttagttcccaaaataaaaattttcacgctgtcacatcgaatgtttggacacatgcatggagtattaaatgtaggaaaaaaactcaattacacagattgcatgtaaattgcgagacatatattttaagcctaattgcgccatgatttgataatatggtgctacagtaaacatttgctaatgacggattaattaggcttaataaagtcgtctgaatatgtaatttgttttgttattagactacgtttaatacttcaaatatgtgtttgtatatccgatgtgacaactaaatccaaaaagtttccccaactaaattaggccttacttctacctactttattactcactccacccctaaatataagggattttggttgaacttatatatcctgtctagattttgtctagattcgcatacttagggcatgctcactttaatgaaaaaaaaaaccttaccaaatttttggcatagttgccaaaattttggtaacttgttaaaattttggtaggatttcttatatagtcatcaaaatttagcagtaaactaaatatagtcatatttttagtaactttatggttaaaaaatggcattaaagtaaacatgccctcagagggagtaataaccgtttccgtccgttttcatgcgtctagcctggttccgggtccggtcccaccgggaccatccccgtgtgcgatgcgaactcaaaaaacggctcgacccagcgacctggggcgtccgtgtccgggtccgggtccgggtcggaccgcgctgcgcctcctccctttatttatcccgtgcaccgtgcccgccgcagaagtagtagagactagagaggccacaggcggcggcggcagcagcggaagtctctcgtctcgtccgtggagaaagggggaagacga

SEQ ID NO: 2232 - DNA, 2000 bp, Oryza sativa
gaaggtttgcactttcagttatatagatgtatgagcccccacaaagttctgaattcagaatttctttttcaggagagaatttgttgctatccccaaacaacagaattatatgttgacacatatcaaagaccttttaatctactatgtcgagcaaactgtacttgtgagttgtgactcatcatagaaacaatgtgcttctttttaagctcatcattttttaaaaaagaaaaaacaagaacaaacaaactcactcactccagattcatccccatctccaaccctcagctaactaacaagggcacctttctagaactgctaccactttatattgatacatattgtaagatataaaaacctactttatgttcatgtcaggatgtattttcgacgaggaaacatcattttcatggacaaggtactctcttccacagaatgccttgtcaatgtattcctctcaagttcaagctgtagttttttcagtgagtacttatgccatttcctgtgggccaaaagggaaatttgccaagggtgatagagatgaaaaccttgtgagagcactaacaagtgagggatttaaaatggcagagaatcatttgggattgcaaattgttgggtaaagatgctttgtgcagcaaaagagagaggggaggagaaaaagaggggttattgacatgacaccaaatgggcatcatgttttaattaagctagcaaagctagccatctttttaacaagacaaatggtcgtaaagcaaaatggaggaggaattttgtagccattaggcacccaatttcagttttatttgtgcggccataaagccaacaaaatcacaataccaaggcgcccctggctcttatctcaattttcttttgtttcaagttctttaatttcttatcttaatctaagcttcaccagaacattaggtgccaagatttattttatctccgcatttaggtaatagatttagctgatttctcgcattaagaagacctaatttgcatgcaactcctgagcctgaacatttattcaggaattgaactacattactgaccagttacccatcagatgctagcacataattaagctataaccaacttgttaacatcaaattaatcagccaatcacaatctctcaaactacacggactcaatgattgggctgctaactagttagttaaacacctggtcctggtgcacaacacaaaagagcataaatgatgtgtttctgaatccaattacacacatgatatgcaggggaccatcagaagttgcagtcatctcatctgaactgaaaccttttcagtgaacgatgctgtcatctgaaaccttggatcccaattcccagcttgtatgcatgtctgtaaatgaatatgcatcttgacctgatgagctatttgctagatgttcccatccacacgtcccgtccaatggacggaccagatcggatgatttttagccatcaggaaagcagcatgatgcacgcatggttgttatgcaaatgtgcaaatgcaaaagttggccgcaagaacagcacatacatatatactactactccagttccctagctagatatcgccaagtgtaaagctagaaatatatgcgtgcatcgtcccgacaaaaaacaaataatattctccatttccctggacagagaaagagagagagagaattctagtgtgagttgagtgagatagtgtgtggagcatctgctatataaaagggagagttgtagtgtgagttgtggtaagcaagagatagggataaggggaagaggaggaagaaggaggaggtgtagggagaaaccggagcaacctcgaagctagtccaaactagtgggaggttgtctttccggcaagccggagcccggagctatcgatcatcaagctttctaccccgaccgacgaggaagaagacgactgatcaattgatcaaaccgatctctccatagctaggtagacaggaggagaggaggaagaagagggggagaggagacttatcttgat

SEQ ID NO: 2233 - DNA, 2000 bp, Oryza sativa
ttgaatggaactcttatccaagttaaaagagcactccccgcgtcgctacaggatgattatatatggataaatggctttaaaaatacatgcaagttaaagaaaaaaagagtacgaacaaaagaaaattgaagaacatgaactcttcaatcacttgggagattctttctactaaaagttaaaactgcataaatgcatcataattacaaagataaataacatgtatatagaaaagaattaaaggattttagcatcagtttcacatcaattggggccttcttatggctctctaacaatgatccttgtttgagtgatgtagatcaatgatgttgagctattagttcttactatatataatatataggattctttcagccatatgaacacactgctctttattccaaatctcatatatactactctgtttcataaagaaccaaacccaagtgttcagattcaaacccgggtttgaattatttttttttggacggagaggatggattctttcagtcatatgaatacagatccctttattccaaatcatgttactgcaaggaagaaactcactcgctgttccatctgaaaattaataaactactggatttgctttccataccgagctatgaggtgtcctgcccaatcactgaaaacccccaactccttcgaccgtgacagtggaagtttcagagaagcatccaagctaaccacatgtagaaataggtcagcattagccatattcttttaggtgcaggaggcgattatttcagtggcgttaagctgcttgtgctgtcgcaaaccacaggggatgaacggagacggttccacggcgtcgttcgatggcaacagcaggcagggacacagctcgtccattttgacttttttgattgctttggagtacggtcttgttttctcaatcgatagatcaaataaaatccctatcaggccagcggcggtgtttttaacctaattgcattctgaagtcagtctctaggctccagtccaccgcagggtttacaatattgatgataactgcttagttgttgcggttatttcgagttatgaacgtataaacaaaaaattgatagtattaaaaatggtaaaatatcttaatatgtgtggtaaatatcagtttacagtactaatgatagccacgtgtttattgcggttattctgacctgttgaccgaaaacgtatgggtaaaaatttgatagtattcaatagaattattatgtaaagatatcttattgtcgttggtaaatatttattgtcccactctttacctttaagcgcaactcatttttaaataaaattttggtaaaaaggatgtagctatgcaccacactcttcggcttgcgtcaatattctacatttcacctaaatttattgtgcatactcaacgtctcccttctcatacgcccctcttaaccgtaaccccgttttcgtagggcattgatggtactccaatctatcatccaaattacttcatgacacatgaaactaacagaagcaccttatcgtattcacttcgtttttttacaagccaaccacagtgccatcaccactcaactaatttatctttattctgttttttttattttcaaaaattatccggtaaatccatttccaattttctcgaatatgtaaaagaactccaaaatcatttctccaaagttcaagggcctctggcctccacctcaccaaacgccgaaacggtgaggtgaacaaccacgcgtctataaaaaacacttgtctcctccgcctcccaccttctctcttctgtactcgctttcgcagctcctcttccccgcctcctccgttgaccgccaccgttgacctccccgccggcgaggtctccctcgccggaaacccccccgcctcccaccttgtcttcgcggcggcgttctcccgtcatctgatcggccggcgcctttggtctccgcctgcttccgggggctactcgattcgtctcctctcgatcccgctacggctcctctgcttgctcg

SEQ ID NO: 2234 - DNA, 2000 bp, Oryza sativa
  misc_feature (1965)..(1965): n = any nucleotide
aagttactttgactttgttttattttggatcacctaaaacaacttttctcaagcacatcaattacaattactttaagcacatcgacacccataaaccggcatgtcttcacaacttacacataagtattcattgcaagattagaaagtagatgtggctagacaagtaatttggggtaatccaaagtacaacaaaggtaatctatctaatctaaaataaaaatattactagttagagagtagtccaaagtgaattttgataataaagagaaacacctaagcgtcttccggttaactccgaaaggttgtgagctagccaacatgggttcggagcctcaccccttctatttatttgatattaggttcttccctaatattcaccttttttatttttgataataaaagatggatttaaagtgcaattacatttaattttctgtatcttttggtctgctaccactctaccagtaccatattaggttattccttaatattcgtgttttttaattttgataataataaatgaaataaagtgcaattaaatttaattttccgtccccttctccctcctctctgcccgctcgagctcgccgccgcctccccttcttcggtcacattgtcgacgaggcgtggcccgcccagttcatggtggtgaagagatctccgacgtcgagctccatgtggcagagggcgacgggatcggcggcgcttgagctctctggcgtggatccgacatcatgcttgctggatctagcagagctcgagcgccaaacaggtccacagatctggcatcatgctcgtcggatctagccgagctgccgctgtcgtcggcatcttcccggagatggcgtcgatatgttcagagctgttgtcatcaatgcgaatcgagttggcttcctccttggctaccgccgccgggctccctctcctccttccctggcagcgtgggccacagcgaggtgtgggctggctatggcgacgacaacctctagctcgttgtctcgtcggtagcctccagttcctcctttttctcctctacaacttcccggaccatacaaatcgtcttctctctctcctagaaccaccattcaaccactgttttctctgcatgaacctctgtcaccctgtgagaccactccaaacctttagcgtggtatctgaatctaagtgtaacttaaaaccacgggtgtgagacaccgcattgtaggtgtgtttggttgggtggatgaactcggatgggagatggccacccgatttttttgtggtgtttggttggaggtcagggtggatggggcagcccaaaatagggaatattccctcaatatactggatgagtgcatccggccgatttggctggatgaagccatccagttttggtctgggtgatgtgtcatgttctgattggctgtggttggtttgattttctgttaagcaagctccaaatgactttttctcctaaaccgttttatctaatttatgatttgattacaccattatatttgttacaattaaatctttaaaacaagatctcggatgattatatcttgataaaaaaattatatgataaatgggtctcactaacttttggttgttttcatccatgctatatctctccaaccaaacaagaaattagatcgccatatccatacaaaccaaattaaaaaaataaatcgtcatattcaataaaatatggatggctatatgctatccatacgtgaccgtaaacatagaatggtcttatgggacggagggaccagggagtactcctcgggggtcaggtcatcggcggggtgcgtggattgcgccacttgtagaccgggccccacatgccagacgcatcgatgcttcgctttgtttacgcggcgcgcctctctttttccttagccaccaaggctcagaaaccgcctacaaaacggcgcccggcgtcccacggatcaagcgaccccctaaaaaaccaaccgaaaaagnaaaaaaaaagaagcagagaaaaaagctctcgcggc

SEQ ID NO: 2235 - DNA, 2000 bp, Oryza sativa
  misc_feature (1734)..(1734): n = any nucleotide
atgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacatgcgagcgaagaggaaggcgagccgtcgtgaacgaacagggagcagtcacgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaattttttcggaccattcgacgcgtacgtcgtgcacgcgcgccgcctgccctgccctgccaggccaggngagcgcgagcgcgcgcgtgtgtttcccctcttctctccaccacacatgcttcaagtggctaggagggcatcctcccttttaaggaggtccccctctcctagaataagcaaggtggtactaaactccacatgcatgccattccatgaggtgggcttttgtgattttccaaagaattaatcttcgagtgggctaaggcccattcattaattccaacaactgtcgccaccctgacggatggtacatgtccaggcggggggttgtgagcg

SEQ ID NO: 2236 - DNA, 2000 bp, Oryza sativa
  misc_feature (223)..(223): n = any nucleotide
  misc_feature (257)..(257): n = any nucleotide
  misc_feature (886)..(886): n = any nucleotide
atgaagaaaagtctacattgcagagctgaagaatttgctgtacaacttttaacaggtgcctagtatgcatatgcattttttttaaacacaggttggtttgcttgcaagatacgcggctttggcccatctttcaactaaaagttatatttcaatggaaaataacatgaagttaacgaataagtgaagataatttcgtctgaaaaactgaaaacaatttgaaagncacaaaaagagaaagatatcctgaaaatgactangacaggaaggaaaatttcccaaaaacaagtcattggaatgggaacaggctaggagattccactacttcagctaggtgtcaagcaattatcatggccattagaatggaaccggcaaaatgtcacaagctgtacttggctccactacctctacctctacttggctagtgctcaaagtgtcaagtaggcatgatggcattacaccagaacagaggaatgcataaagctgtacttggctccactacttatggaaatatagaaagtttttttaatggctcaattaaggagaacatatgatctttaaacattgaaatgacatctgagcactagacagcacccctacacattgaagtggtggcagcactgcgttcccttcctttattctcttccatggtgttttgccatagtcctccaaagaagagaataaacagataataatggtaatccaagtagtatcacagtttggggaaagaatctaacagcaattaaactcatcaaattctcttttccttatcagaaaaagaggacgctgaatggggcttacctaaataaacaaggtgtgcaaagatgaacatttgagggcgcagacacttccacgcaggtggtgaagcatttttttctgctagataacnaaaagaataattagaaaataagaagataagaatatcaagcaaggcaagctttaatgtttaacaagtaatcaccaaatcgaacacgcaaaaaatgaattgatagttttggcaaataagaatcacttgaaagtgctaagattccttttttttttcttttgccctataagggcatggttcccaatttttcacaaaaaaactccatcaagatgttacatttcatattaaatttttttaattgccctctccaaaaactagatgttactgtaatgccattataaatgttacagagtaatttctgtttttcatttagaaaaccataggatgatacataaaaataatcataacatgctaaagagtatattgtcatgcagactctgcagatcggcagacaggaggacgaacactgtttattgaccgataagattgctcagcaacgtaatcttcatagatccacttgcctcaaggtttcttatgtttcagaggaatagcataaatctagtgatctataatattttttgagtaaactactgtggacaaactatcaaactatcagcttgaaagaaaaaatcatatcatgaaaaaaaataatggtcttctactgacaaaatgtttgtattaataaccaaaaagaaaggacctgaaaagaggtgtattaacacctccagagagttcaatagcactggtgacttgcatctttcccacgcaaacagttcttttaagggggaaaaaaacaaatgcagagggattatccttagaacttgatggaagatacatgaagtacagcgtcagcgtgtatagattctattgcaaactgtttatagaagaaaataagacccttggttggttatgctgcaaaagttgttagctactttctgtagccttttcagttattttccacggcatacctgactaaaaaacacacatactactcatgtctcacattgtccattgaggttgcaagacacttgaccagcaggctgctggccactataaatagaggctcgtactaccattgccaagcaatcagcccacagctcaccgaagtgcattagctcaccacgactagctagagcactcattggtgtgcaaaatattactgtctgctcctctaaac

SEQ ID NO: 2237 - DNA, 1891 bp, Oryza sativa
  misc_feature (474)..(474): n = any nucleotide
  misc_feature (979)..(979): n = any nucleotide
aacaccagcaaagctaggatatcattatctacgatctccagttcgtagttttcatccttgcaagaatctggatctggaaagcaaacagatgctcgatttgacgtccattgcaatggcatggttagtgtgccaaattttttttaagtatacggacacacatttaaagtattaaacatagactactaataaaacaaattacagattccgtgtgtaaactgcgagacgaatttattaagcctaattaatccgttattagcaaatgtttactgtagcatcacattgtcacatcatgacataattaggatcaaaagattcgtctcacgattgcaaactgtgtaattagtttttttcttctatatttaataatctatacatatgtctaaatatttaatgtgataaaaaagttaaaagtttgatgtaaaaattttgaatctaaccacggccgaggtatccattgcatatagtgacatgtcnttctcactgtctctcacacacacatactgacacactgacagtggggcccactgaatgcagcacgtggtttccgaggccggccctgatgatgaaccaaccgccagctgaagcctcagctccagaagaggagcagtacgtgcagggataacgtactctctctcactcaccggcctctgcagccactccatgcttaaccgcaacaactaccccctctcttccaaaatacgtatactccatctatatcaaaataaactaaatttagcataggatatgaaatattctaatactttatttaaatttatagtgcgatgtatatattacatattatgtttgtttactttaaaataaatatagtaattagatatatgtctatttataatagtatgatgtgtcttatccgattttaaattactatattttgagacttatagtagtactcccttggtccgaaaaaggataacttctgatgatgaattgtttgtctaatttatctctaaattttatntttttaaagaggatgtaatggagatcgagaattgcatatactgctcatctactgcttcatctgtatgcatgcactgcacaatagtactagtactactagtagtagtagcactgtctctcacttagctgttgctagctgtcccctttccccccatcatgtgacttccatccttgttcctagctgcatgcaataccttttcccattaaaaaaaaatagtactaacaaactcttcttctctaactaactatgtgactaattacaggttaaaccatctcatctcttatatcacccaaagcccttccacatgccatcaattatcacacattgcaacttacaccttaacagcttgcaacaggtaataatactgtgtgtagttagtttgcttagcaaagttggtgatgacttaaaaaaaaagaatcaggctagacatggattaagctttttgtgtatgagtgtattgtcatgcatgcatgggtaggtatactatggtagtagtcctaattactaactaccaaatctcttggatcttgatacacttgttgcatgcatggctctaatcacatgcatgatgctaattaatatgctagctagctttatatgatagcttgcactcacacacacacacacacaaatgcattgcatatatatgcccccacaattgcatacttgcatgtgccatctatctttccacaatatatactcaccttcaccacctatactcaccttacacattctctctttgctatctctacttgcacatgtcatacatctagacaaggacactagcttagctatagctagctactagcctactactagtagtagcctagctaggaggaggaggagctaggatggcgcagttgccgccgagggcgccgagcgcggcggcggcggcggggcaggagtggtcgg

SEQ ID NO: 2238 - DNA, 2000 bp, Oryza sativa
  misc_feature (347)..(347): n = any nucleotide
  misc_feature (399)..(399): n = any nucleotide
  misc_feature (517)..(517): n = any nucleotide
  misc_feature (537)..(537): n = any nucleotide
  misc_feature (697)..(697): n = any nucleotide
  misc_feature (701)..(701): n = any nucleotide
  misc_feature (724)..(724): n = any nucleotide
  misc_feature (1507)..(1507): n = any nucleotide
  misc_feature (1512)..(1512): n = any nucleotide
actgctctcatgttgaatggttccaagccaagctaacatttttgcttacaagctaagctaacccttttgcagtaagcaaattcaggcgccatcaccgtattcgaacgtcgtaggcggcaccgcggccgtcaactccgacgagctggccgcccattgcaattcaaaactaggctgccgggggccaggtcgtcgtggagccatagggtaacacacacgaacgcgtaacatttgcatttgcagatggtgaggagaaagagaataaaaacggggggagagagagaggcaaaggcaacacgtccgcacgcccgccgaccacctcaccacgacgcctttccgctcgcctttcntccccaaaaacgcggcacgaagcgatccttccttccttgtttccgaaaattngccacgaagaaacacgtacgaaatccgcagggcagcttagcgttttcttcttctccgatccgatcggattcccctgcccccgatcgcgggagctgccatggcagaaggcgacgcctangccgcctcggccgcggcctncgcggcgtcgccgcggacccccgcgccgccggagacgccgtcgacgcagaagaggaggcagcgcgggctcgtgtcgcgggtgtggaaggggatattcgggcggcgcgaggacgtcgagaagctgctccaggcgctctccaaggaggaggaggccgtgcgntccngcttccgccgccgcgcccgcgcntcccgccagtccgcccacaacgtcctcgccatcgccgccgcgctcgaggtatccctagttcccaactcccccgccgttccccatccggctaatcccattccgctctgcttcctttattgtagcaaatataaatgtcatgttcgtccagacgaatcgatcgcttgtaggttgggtcgataaaatcgaggattgataaaatccagttccatatgaaaatcctgatgtgatacagctttgggaagctaattaggcatcgattatcatgacatacagcctgctaagataaattatgccgtattattctgcaattttcatgtcgtgtcagagattgtatgatgcattgcattgctctagttctagtgacaccattaggcatatgcctgttgttagattagatcagggcgaactgtgttttttcacagggttgtatgtgtaaggaaatgcttatttctcctttttggaacagattgcggctgttggatatgcgattatgactacaagatcaccggacctcagctggcagatgagagcaacccgggtgctgcccatgttcctgattcctgctttagctgctctcatttactcaactattacaagcgtcacgaaaatgcgtaaggaatacttgcatctgcattgtgctgtatcttactgctgtgtatgttctgttgtgttcaggtgttaatgcagcattaggctctactcccttcgtcccataatataagggattttggagggatgtgacactcccctgtccagattcgtagtcctaggaaatgtcacatncctcnaaaaacccttatattatgggacaaagggagtagctatttttcctatccctagaagttcagggagacaaaaaaaaactatgagactgccatgtttcctgccagattctccagatgtttttgagttgaccatgttacttccacactttatttttttgtcatttgccgaatggttttgtggaacaaccgagttacgtctagtaaactgctccaattaatacaccctatcctttatgcctaaactgcaatactgattctatcttgcagttgacaacagagatcaacatactcttgaaaacctccgtgctgaaagacaggctaagattgatgagttgaaggagagaacgaattactacactactcaacaacttatacaggtgggcttgttgcctacttgctctatgttatggccacccaagtgtgctatttttttactcttcccctttgaaaggtttacatcttctaactattgctgaaacttcgttttggtc

SEQ ID NO: 2239 - DNA, 2000 bp, Oryza sativa
gtacaattcatgtcatgctagtatactactctgttaaaaaaaacacattcatcccaacatgtttgtccagattaggattggtttttttttatggaggggtatgtgttttgcatggatgtaaatgcactgtattgttctaaaatctaaaatcttaagtgtacaaaaatattgcatacattcttagatagatagaaatattgcataccacttacatctcttgaaaggaagatatatattggttcaacctaaaaggccacgcatagatcgaacaatcatcacaacatagctatatttttaggaaattttattttgtgaaagttagaaataagtcataatcaacctgggactcaatccaccaattcttgtatgtggctcatattaatcacatactcaagcaagtatattcatgctaaagtttccacatattcacacttcatgttttagggaaaaaaataatcacctttcttttactaaaaaaaaatcacccataacctttgtcaagtcgatgtactagcacgtctacatatgccatattgtacttctcttccaacacatggacactcagctcaacaataggatttaacaagcatgttctcattttaattttgtttggtaaatcggccaagttaaaaaaaagggtaagttgaagtacctattggacctactgttgcagttaggggtgataatgggcctaatattattttctacgaaatttgagggttagattttgaaagtggagtggactgaatttctatatattttctttactcaaaaatatattgagattgagttcttttcttctctttttcaactcacctctctcgttttccacgtgcacacttttcaaactactaaacggtgtattttttaaaaaaaaatatacgaaagttattttaaaaaattatattaattcattttcaagttattcttatctaatacttaattaatgatacattaataaaccaccacgtttttcatgcagggaggtccacctcacgaacacagcctgagtaggattgtgaaaggacccattacaaccctgtagtacatgccacaccgtttgacacctatttaccggaaacaacacatttgtagtgatatggatctaattaaccttaccatatttagtttcaaagtgcaaaccttaaaaattagagttatttaagtttcaaaattcatacccttaaataaaagtgattttaaggccttaaggaggaggcacctcatcttaattgtattatttatttattttgtaggagcactgctacacgtactaaatttcttactaaatttgtgtagtatatatttatacatcaacactagattagagaaataccgagagatgcaatactctgttcgtactaaaaagtgtgtaccccggtccatcctaccgtaagaaaaatttgtaactactatcacatatatacttggttgattgagtttttgagtgtgattaaaaggaatcattttgcaaattgtagcgatctggccctccaggagaaatagctgcctagctacaaagtaggaaacatggttggttttgtccttgtcgtggctactccaagcaacaccaaaaaaaacgcatgcagctaagctaggcagaggcagcgctttcggcaggaaatcctacggtaagtcggtaatccatcatcatatcagcggagacaaagtgcggaaaaaaggtttatcaaaattacccgcgacaccgatcgaatcaccgcgggggcatttccggaaaccccgtgctcctccgaaagcagtagtggcagtgggatgcccctgacagcgacatggcctgggccgtggtgatgagtgatgacccggagaatgagagaggcgactgtgcggatatatatgcagcgatagctcactcggttgttgcatcgatcgcttcatcactcgctagctcatcactgcgagcggagacagctcaggagggaggaagcaaaagaagagagagagagatcaagagatagacgaagagatttgtctgtgtaaat

SEQ ID NO: 2240 - DNA, 713 bp, Oryza sativa
ccgaatttcagttatttttaattgtatttctatatggactctagtctcttcttctaatattccttattttttaattccgaatttcagttatttcctaattgtatttctatatggactctagtctcctcttctaatattccttattttttaattccgaatttcagctatttctaaattgtatttctatatggactctgctttttctttttctccgattaatgtgagaatttctaagccatgagagcgaatgtggaagctcctttttctattcctttaattatataatagataatttgtatataggaaacttttgcatcaaatacaccatttactagctaaaaatgagttggtccctctttaagaaacgaaaacgcagctccagcattaaacaaatggaagagcaataaatcttagaatgactatcagaaagaacagtctaatctattatgatgtaatacggcatttttattattgaaccaaccagagagaaagatgtgaaggtgcatcagtagtgattaacactgaatagttacggggggaaaaagtccattttaaattgggcctaacatttcatcgctccacgattaattaaatagtggtgatattagggttctattgaacaattaatcatagtgctaattactattgactagacattattagtgacatgttagttgaggaaattgacaaaataatgaatgaaaaataaaaaa

SEQ ID NO: 2241 - DNA, 2000 bp, Oryza sativa
ccccatcaaattggaaacatttcatctcaacatcagcacggatcttaagtggctgtggtgtcatcctcctccttatattcttaactagggcatccttaacctcaggggtgacagcaggcaccaccttagtcacctgccagtaaatttaagcatattgtaaggaaaaaaatacttaaaatgtaatcatgccaaagttagttttagaatgcatttcaacaacacagtattgttatgatgttagttcaaatacaattgcaaaaatagttagaacacaagtcagtgcgccaattttttcttgtcatgtataatgcgtgaacagctattaaccacatttaccaactctaaactatacaaccacatattgtctcctgtaaactctagagagtgtaagccaatataaaatgcttgaactacatacacaatgtaaaaggtataaaaatcgcccaaccatcaaactacataggcatgatcaataaaacaagacccaccaagacaggattaaccactccacattatatactataagccactaactacttactatatcccacagcaaataagttccatatggggcaaattcaataatgccaaataaagttcatctaaaaaaggaagtactacctaattaccccagaaagattactgtagactagtagtacagatgcataaacacataagatttaagtgaattcagcacaagatatcagcctaagccgtctagacacacaaactactacttctcatatctatggttcatggtatagcacaaaaaaaattacacatttaagcaagcgcaggcatgagcagcaagtctttgatggtttgagaagaaaacgaacacaacctcctgtccgtcagcgccggtctccttctcctcgtaggtgagtgagtcgaggatggcatcggggtcggcgacgatgagcttgaaggcctcgaaggcatggccgtacttgcggtacagcggccatccgatgcgctggtagagcggctcgaggtcgatcccgagggtctcggcgacgtggcgcatgatcgagtggacgagcttggacttgttgtacctgtcctcgcaggcgtgcgcctcctcctcggagaccctgcgcttggagaggtcgatgtagcccttgtcgcggtcgacgcggagcacgatggcgggctcctggcggccgaccttgatgagggaggagatggagcggatgcggcggcgggagagctcggagaagaggatcatgccctcgatgttgttgtactcgaggagggagacgtaggcgcccatgtcggcgatgtgcttcacctggatcatcaccgccgcgtccacctccgggaaccgcggctcgtacatccggcactcgaggttcggcatcgtggccgcgcgggcgtcgccggagtcggagacggaggagcggggaggcggcggatctagggtttggttgggtttttgggtgttttcagacggagagaggcggcggcggcggcgggggaaaaggagagatggcttttgttgcgcctctcgagctcgggaggaaaaacctgatgacgaacgacggatcggacggttcacgcgggtggtctggtctctctctcgtatcgtatcgtatcacgtctcatctcgaatctcgatacgcctttcccttgacataatacgtaactagagatcgtttgcgtatttctataatacgtaatagctttacgtttggcgtaatgcagtgtccggcaccggcaaaggcggcagctcgtgcgtgtcacgcgagggcatcacaccgatccgaatctccttcctctcccatgccgccgcctcttgccttggaagggaggaaagaagcgaagagaagagagagctagcggcggcggcggcggcggcggcgaggcagctggttgtttgttgttggttccctctccacggcgacctcattgcctctccatctctctcgagaaccctccgcgcggcgacctagctccaccgtcatcgcagaggaggggggattaggctgtagtagtgtgag

SEQ ID NO: 2242 - DNA, 2000 bp, Oryza sativa
  misc_feature (199)..(199): n = any nucleotide
  misc_feature (236)..(236): n = any nucleotide
  misc_feature (241)..(241): n = any nucleotide
  misc_feature (253)..(253): n = any nucleotide
  misc_feature (267)..(267): n = any nucleotide
  misc_feature (276)..(276): n = any nucleotide
  misc_feature (285)..(285): n = any nucleotide
  misc_feature (336)..(336): n = any nucleotide
  misc_feature (347)..(347): n = any nucleotide
  misc_feature (356)..(356): n = any nucleotide
  misc_feature (377)..(377): n = any nucleotide
  misc_feature (660)..(660): n = any nucleotide
  misc_feature (1389)..(1390): n = any nucleotide
gtgataaaatacatttatgaggtgtgtgtcttttttgccgattagggtttagtattaacctatgggttgactgttttgacctaattatttggggtaacaaatgtacatattaatttacaccaaaatttcagtgacttatatatattaaatagtacctccatgaatttcctcatgattttatattgcaccaattattttnaaatattcaatgagttcacctacccttaagtattctnatttngaatatatattnaaatggtagaaaanttatatttnagtttagantcaaccagaaatgttatgtttaggcttaactttcattaacatttctatttnggactcaaaantaaattttnattatttatctgaagtaaaanttcgaaattcgaattttgggtatgttacaatgtgtttatgaaaatgggctatgggaatggtgatggatatggagtgtggtgaagtatgatgatgatggtgatgatgttgcccagtgtgggctgatatgatggtgctggtgatgacttgggtatcggagatgagagtatgtatatgaggttgagatggtgaatattatggtttacttacgttactgttttattaattgaattgtgaactcctttacaaatgattgtgaactaaaatttgctttatactaaaatnagctacaaatagcctttctttgatttatgtcatgcatgatgtagtatgttaggattgtcttgtgcttgccggtacattaacttgtttaatgtactgactcttgtacgactggaatatccattttgcaggttgattgcttagtcttctgagtgatttgtggaaatcgttgcttcttctaggatcggatccaaaaggagtattctccttgtcggccgcttgtggatttgggtagccaagctttcgcggatcagtaaatatctggccgtttggcctaactatttagataagaatgtagagtaaagtttacttatgtttactccctatttattctgattgtcatcgcttagatgaaagtgtggaactagagcttttcctgggatctagttctgcaccggtatgagttttgagcatttgggatgtcgtagagctttagcgaattttgtcgagtctcctgagatgtgtaacacatctggtcgccatcttcgtgtggtttgacgagcatgtctcaggctgaaattgactagcatgctaaagtcccagcaatatcccctatgctctctactcggcgcttcaggttctatattaagtaggtcatttgacttgataggggagcgatgaggttggatggttactgttttacttgattattattagaccccatccaactaaatattccgcgctatcattttaaataacttacataatattaacctgggggtgccccacaanngagctgtcaataattaatgaagtacagttcctagctccaggctgttacctcccaatggtggcaaagaaaaataatattgtctttcataaggcaatgtcgcaagcaagaatggatctgcagacaatcaaagcaagaaaaggataaataataaagaagtaaagtgttgaatgtcagtgatccaaaagagaattaatcaaaggaatatcattatagaacaaaaaagagagaatatttcataatttctttaagactaaggcaagctgcgaaaagcgaaatattccataaatttcagcaacaagcatggaattttgcatggaaccagcagctcaaggggtagcgtgcatatgcaatagtgccggtctgcaagaggaattaaccaaaccatttgttgattggtcatgcaagcaccccacacccccatgcacgcatgcactaaggccttagcttagcttagcttgttctagctaggtaggtatttgatccagccggccagccagcttgttgccggcaagcgggggagcgatccgatggctgagggtgcggcgagtgccgtggcgaggcgcagttgctaggacgtgtgaagaaggacgtgcagttcatcaaggaggag

SEQ ID NO: 2243 - DNA, 1713 bp, Oryza sativa
  misc_feature (921)..(921): n = any nucleotide
  misc_feature (933)..(933): n = any nucleotide
  misc_feature (999)..(999): n = any nucleotide
  misc_feature (1026)..(1026): n = any nucleotide
  misc_feature (1028)..(1028): n = any nucleotide
  misc_feature (1163)..(1163): n = any nucleotide
cactacatagagcttgtgtccaatggaaccagtgaagtactgtagtactacttgaaggatatttttggtaatgagaattggatcatgtaccatttccttctctcactatatagggaaagaacagggtaggtacactttagccaagtgctaatcacacatgctttgagatctggacatgcatatggatggtctggattgctggtgcatatgcaccaaggttcatattatccaactcctatatatatatatatatagacacacacatatacactataagtacttttaagatattttttaatgctgaatggaatgtaaatgatatatttagacaacatagcgttatagatgatgctgttgacactactagaaaaagcatttcaccaatgttgggtatttattttcacaggcgaacatgaccctcagagctaaatagtcgcctacaaaaatacaaaccagggggaagcttgctgtcggaccacttaagcggtccgcctgcaaaaatacccttcatttttgcaggcggaactcttatatggtccgtctccgaaaatagacttggaatataaatagagtcaacctagagcgattttttctaagtcctctttctccctcactactcccccatcccctcccctcacctctcctctccccggccggaggtggcagcggctctcggtggcgggtggcggcgggtctcattggcgggcggcggcgggtctcattggcgggcggtggcggctcccggcccctccctccctcccagatttggccggaggggggcagtggtagggtggagtggcggtagggcggccggcggtggctccccttccttcctccctccctcccagatctggccggaggggggaggggggaggccggcggaccggagacggggcactgcgtcgcgtgcgcgtggcgcgnagcggccggcancggctccccttccttcctcctagatctggccggagggggtagggggaggcccggtggccggcggcntggggcggacggcagcggagtgtgtcntncgaacatttgtgatgcgtttgatttgattgtgaatcaatatgatgcttctatgttaatctgtgatgcttttgtgcatttgatttggttcgatggtgaatctggatggtgaatggaaggagatgggaaactgctgntactggccgaaacagcggtgggcggtggctgccctttttttaatgctgggagctattttcacaggcggaccagttgtccgcctaagaaaaccaactatttttacaggcgttcatttgcaggcggaccagttgtcctcccgaaaaacatgtttagtccgcctgaaaaaaatgtttttttgtagcagtgtgagctcaactataaatacaacacttaagcgtatactcccgctaacgacgacaccactgacttttgaacatagttttgactattcatagaggttaaaatccactctcacatttactctcttttgtctgcctccgagatcgatgtcacgtgaaccatcactgtttccagtcgccgccaccactcgcactccacagccaccatagttgacacttctccccgttgatcacctcaagagcagtaacgtgtcgctccccacgtatacgcctcccatggctctctaatcaatatacacatttctctccctagttagctcaactgacgctacatgtacacggcgccggccggtacgcctccatgaccgcc

SEQ ID NO: 2244 - DNA, 2000 bp, Oryza sativa
  misc_feature (659)..(659): n = any nucleotide
  misc_feature (726)..(726): n = any nucleotide
atatatgttaatgaatctagacatatatatgtgcctagattaattaacatcttagatgaatgtaggaaatgtcagaaagtcttataatctaaaacggaggcagtacatgtagtaactaaatggcaaaacatctcttatcacaatggttgcaactatagcaaataacacgcaggggcattttgtgccatttagtgaaagtagcctgaattcagaaatggcaagcgccattgactgaatatgcacaatccttgtagggataatttttagaagctcaatattatgaatcggcgatacatattcatttagtgtttgcctattagacatggtgagttggcagtaactagaacatcagttggtcgatcccaaggccaatacagaagaacatatcatttgttcttatcttgccaccacgaaacaaagactggtcaaactgtaagcattgatttgagacagcttcttgtctagggatggcaatttcctccgcgggatcgggggtgggtgtgattttcaacccgcggggttattggggacggagggtccgtatttgggtggggaggggacaggagaaaacatttcacccccgagggtgacccgtagggccccggggtatatataaacacttaaaatatagctcatagaagaccaaaaagcctaacctnaaaaaaaaactgggatatataatatatataatccatggcgaagacgagctagctgcacgtggcagtncaagtttgggggagattataaagagtgatgaagacttgcaattgaggaggatttggacccggcgtccatggcaaagttgcaagatacagaacagattcggtggacgtagagtcgtagactcttgccagcccttggaacaattaaacgattgatttccactgtgataatgaagacaagtctcttactgtctgatgatgacttgcgtagaaaggtatactccctccctctcatttcaaacgtatccatcagtttttgtgttcaattttaatcttttgtcatatttaaagaaaaactgaaaaaattaaaaacataagtcatgtataaaatgttattcatttttttaaatattaagaattatgtattgaaagtaaccaacccacaaatattttgtttagctagcctgcacatgggcatgaattaagtgaaattagatttaataatcgtttatctgaagccatataatttctatcttgttataattatcatatattatatgaagttctaaaagacactagaaaataaaatatgtgtttcaaatatcagataaattattcgaaagatttttgcatttgtagcatcgaatttgtttggtcactgtacaatccacttgcactggcctttactcaatatgccctatggtgacaaatagtaaggcctagcggactcctctcatcctctatcaatgcattattcttatctcattaagaccggtttactcactctctacttgctttgctttccctcttattctagtttgtgcaagaaaatttttgggttccaaagtataaataaatactacctccgtcccaaattagttgtcattttgactttttggttgcaatatttgaccatccattttatttaaaaaattagtgcaaatataaaaaataataagtcatacttaaagtacttttgataataaagcaagtcacaaacaaaataaataataataaacattacaaacaaaaactcaaagcgccaagtattttgggatggagttagtacattgtaaaatttgtctatctctagtagatgaaaattgtttggtgataatggttttcttgcacctccaagtcatcatgttgcatggttgtaaaacttgtatatatgctgggacatggaggttgccatatgatccattgtagtagtgtttacagtttcgatcaagtttagttaatctttctttttatgtctcagtgtatcgtaacatataaatagattccaaacttaattcttcaagtgaatatgtacatggtgacatgtttatagcaagt

SEQ ID NO: 2245 - DNA, 2000 bp, Oryza sativa
  misc_feature (1663)..(1663): n = any nucleotide
aacccttatcgatctaaacccctactttaacgtatttaatttgtccaaaataaccataatcgtgaggatgtatctagataccgtattagtattaccctgtagatacatttttaggattaaatttttatagaccggatggagtaggcttgatctccttgtgtgcatttgcagggacgaatctaaagtagaagtgtcggtgttaggcgacaccgatgactttctataaaatctatagcaaaactgtttaactatgttataacaccataatctaaataaatttagtatactatgatagcgatagacacgttatgtcacatacgaatcgattttctggatcagtcactgtgcgtttggttggcgtacattgtgttcatgtgggtcgatttattcgtgttttatttaattagcgtcctcataatctcattgtgtcattgagttgcgtgccctatggcaccatgggatgacgcgaaatgaggaagccttggtgcccagtatgtgcttttgtggctcgacgatcgtggcgtgcattctggccaaactagtttgcacggtttcgttcttcactttcaattgtaaactcgctctcttgattgcccatgaaatattttgagttcgtgtgtgttcagggctaaccacttagaccactaattagaatatatttatgccttgtctagtagggttgtttcagctccatttatcttagattccaactaaacggtttaacctctataaaaaaagagcataatggggtttagaccacttcactccatactttgttttcgaagttacgacggccacatcaaacagactcttaatttttttccataataaactattggagtaccagtaattaataagtatccattaacttttcatccaaatctcctccaagaaaaacctgaccttcccaagttcaagccaacaaccctgacagccgcatggacatacctagaggtggtaataaatccaatattttagcctatgaaatatgagggttgaataaaaagagttaaactaagattttttttagagaggggcatttttatcttgcctctatatccaatcggatatatgcatcctcattaagaaacttagcctaacgaacaggtaacttagtcctcaaataacccaatctaaaaggaacttagctttcaaataacccaatctgaaattcgctcctagtgaggttaccgcaaccactaggcttcatgccctttcacaatcattaggtcttgtacgtttaatccctcctataagaaaattgagggatttttagagggaatttatttcatatctattggggtaaaattataccccttcaattttcttcgttctcttaaactgaggattaacgaacaaggcattacggtctagatgggttgtttaacaggggttcatggcccctaatccattactgcccctactcccaggcataccgtatacgctcgccgcgccggcacgccattcccttctcgtcaggtcacgcgtccgaaaccgaccacagctggaagccgatccgatcgagattcagcgtgctcgcgatcggctccccatcggcttaaacccaccacaccgaccggccgctcgcggcaaaagaaaaaacgtatcgcgcattcgcacgcaacgtgccattttttgcacacggcccgcggttaataagggnaatgggctgtagtgtactcctccaaccttttcgcgccggctgtggaccacccgcggacgcgatccccgcctcgcgtcgtcgtcgtcctcgccgccgtcgctctcaccaccaccacactatattagcatttgatatttgctcacgtgtttcaggcgtctgcactgctactgctcgtaggtagcctcgcttgccccgcccgtcacgacgagcgaggcggagacaaacgagagggatttttaaagggccccgggtccaacggggaagagagagagagagacaaccagacgggagcttgtcggggaggagagagagagagagtggtggtggtggtggtgag

SEQ ID NO: 2246 - DNA, 2000 bp, Oryza sativa
  misc_feature (354)..(354): n = any nucleotide
  misc_feature (548)..(548): n = any nucleotide
  misc_feature (558)..(558): n = any nucleotide
  misc_feature (568)..(568): n = any nucleotide
  misc_feature (570)..(570): n = any nucleotide
  misc_feature (1205)..(1205): n = any nucleotide
  misc_feature (1226)..(1226): n = any nucleotide
  misc_feature (1283)..(1283): n = any nucleotide
  misc_feature (1352)..(1352): n = any nucleotide
  misc_feature (1451)..(1451): n = any nucleotide
  misc_feature (1649)..(1649): n = any nucleotide
  misc_feature (1803)..(1803): n = any nucleotide
tgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaagagttctacagtgaagcctgatggtgtggaggattaggtgtagccctggtcaagctgcctgtggagtggagccgtctgcgccgtttatcttatctttccggctgcttagatctttattgattgagaggaactatctacctctgtaatgacattttattcgcttattaattagagtaataattgtactctattatcaatttgttattgtgtgcctcggntgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgattctcctccccttctcttttaattaaaccaaactaatngcacatgcanttcataatantnttttagtggttctcattcaaaatttattccagtgttattagtactgtacatctattactgtactaatggctcatttaccagcaaaagttttacaatattgttttatttaatcttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgtcataggatttgggactgcccctttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatacngttggccgacactgagtatcnctactcatcctcgccaaccgacagggaagtgaccgtggcagctaccttgagactganggaattgagaatgatgctaccacaaggcatttggttgagatgctgtgggctatggatgaaacccgtgcngagactgtgttagcagctcaagatcgtgaagaccggaatcgtggtaagatttgcaagctagaggacaaggtggatcgtttggagaaggaactagccgcnttgaagggagaagcaccaccgcagaaggccagggttcgtcttaccgcaaggaagagagctctatttgtccctcgctaccaattggcgccaaaggtccgtgtggtggagaaagaagttaccccagccctagcggatcctccggtcgtcaacgtaagtgatgatgaaggagaagaatccaagcgcacccattccaagatngagtggggagccactcaagatgatgaagacgagccgaacgagccttcaatcaactccgatgcccggaagacctagaatgccttgtcaaaccgttgtcttagatcgttgtgttagtttgcttgttttaagtttggttgtgtgtgtgcgtcttgcntgtgatttacatcagtggtgggatgtaagtgcatgcgtttgtttgctttcgagtgttaggtagttggtgagtttagtggtgtgagagtcttcagttttgtaataatgaaactcacttaagatcaataaaagttaaattaattctctgtcctaagtagttttccccggtttctcttcttgtgctcctgcccatgccag

SEQ ID NO: 2247 - DNA, 2000 bp, Oryza sativa
  misc_feature (44)..(44): n = any nucleotide
  misc_feature (194)..(194): n = any nucleotide
  misc_feature (417)..(417): n = any nucleotide
  misc_feature (441)..(441): n = any nucleotide
  misc_feature (1549)..(1550): n = any nucleotide
  misc_feature (1600)..(1600): n = any nucleotide
  misc_feature (1854)..(1854): n = any nucleotide
gcttcaaatgtgccatacctcatctcaatgatcttttgtttggntctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctncaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccntcaattacctcgttctccttatantcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattatacggattttttccccttcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggnngcaagggggccgcctgcaaaattccatgccccctcgccgcccatttgcangcggccccccgcacagtacaaaatcgccctagcgaagggcggcaagggggccgcctgcaaatttcgttaacagccgtcgcccgaaagcgaacggccgtctgccacgtcattttcgccgccctctgggatggtgatttttaaaaatcgccctcccagagggcggtaggcgactacttccgtcaattttcaaaatggaaaactatttttgtaaaacttttaataaaaaaatttaaaattaaaaaaattcccaaaangcgcgtcccccgcggctggttggtgggccggcccagtatatacagcgtcgcgtgggctctcgcaagccgtgggctctctctctctctctagtccgcttcttccctgagttcttcgtcttccccaacctcacgcgctctagcgcgca

SEQ ID NO: 2248 - DNA, 1527 bp, Oryza sativa
  misc_feature (79)..(79): n = any nucleotide
  misc_feature (121)..(121): n = any nucleotide
  misc_feature (130)..(130): n = any nucleotide
  misc_feature (176)..(176): n = any nucleotide
  misc_feature (189)..(189): n = any nucleotide
  misc_feature (219)..(219): n = any nucleotide
  misc_feature (223)..(223): n = any nucleotide
  misc_feature (225)..(225): n = any nucleotide
  misc_feature (237)..(239): n = any nucleotide
  misc_feature (243)..(243): n = any nucleotide
  misc_feature (245)..(245): n = any nucleotide
  misc_feature (248)..(248): n = any nucleotide
  misc_feature (257)..(257): n = any nucleotide
  misc_feature (259)..(259): n = any nucleotide
  misc_feature (261)..(261): n = any nucleotide
  misc_feature (264)..(264): n = any nucleotide
  misc_feature (270)..(270): n = any nucleotide
  misc_feature (282)..(282): n = any nucleotide
  misc_feature (303)..(303): n = any nucleotide
  misc_feature (306)..(306): n = any nucleotide
  misc_feature (308)..(309): n = any nucleotide
  misc_feature (312)..(312): n = any nucleotide
  misc_feature (325)..(325): n = any nucleotide
  misc_feature (330)..(330): n = any nucleotide
  misc_feature (345)..(345): n = any nucleotide
  misc_feature (347)..(347): n = any nucleotide
  misc_feature (354)..(354): n = any nucleotide
  misc_feature (447)..(447): n = any nucleotide
  misc_feature (460)..(460): n = any nucleotide
agctgcctgggtggttgctggatgctgtaggctgcgagtgatagagagcaatgctccaaatctttccagtttaagcttnagcggaaatgttaaactctcacttggagacccattgcaagtnaagagattnagcatgatccatccaaaggttgtctgttatgcccgtggcgagctgncatccgcgtatgncaaatcttgagactcttgccatttactccnatgntnaggtactccaannntgangnatnaggcgtttnanantgngcgttnagagtagttgtnaagagtaggggtatattatangantnnaantgagacatgacanacatngggcaggtggtcaananggccatnctccccaatgctgcctacaaaattcctctaccttaagcacctcaccatttccgttagctcagcagcctcctttaacacgtcgtatgattattnttctcttgtttcnttccttgacgcgtctccttccttggagacattgatcttgaatgtaaggcactcttcgctcattccatcctgcaaagatatactcctctatctgatcactgatctcttggatatgtatactttatttgacttatcttttatcattatcaggtatcacaagagcatatgaagcatgaatcggttcttggagattcctcgcctttgaggcagatgccggaacaccgccattgctacctcaagagtgtgaagatgacagggttcagctccgcgaagaacttgattgagctaacatgttatatcctcaagaacgcggtgtcactcgagtgccttacattggacaccctttatgaaagggcatgtagcctagtggttacagtgacctgagtagtaccccaaggttctgagttcaaatcttctatggagcgaattttagattgggttgtttccggggctaagttccctatttcaatggccgtatatatccggttggatgtagatgccgggtaaaaaaaatacccttatctaaaaaagaaaaaaaaaacggtgttaggtgttctgaaaatttctagaaggtgttatcccatgggcaaaagtgttgtcagggaagcccatagggcggtcagggctgttacaacttacatccaggataaagttcctgatacagttaagttcactgttcagagttacttcctcgtgcttttcacgtgtttttaatggatgaaactgctaactcttaaacatatacttaatcattcgtcttgtttaaaatttaatacaaacatatgaaaatataagtcatacattaagtaatctagtgataagccaagtcacgtcataaataataattacttatttttttaaaaaaataaggagagatgatggagatgaataaaaggtgttttctatggctgaattatcctttttgggggttattcccgactcgacagtataatatcatgtaaaatctataaattctttctgtcttaataaaatttggtcggtgtacttgcgccgacccggcaaaaaatggctgaattaccagccggcagcaaggatcttctagttgga

SEQ ID NO: 2249 - DNA, 2000 bp, Oryza sativa
aatgatcgaagaaaccatcaacatcactactcacgggtaattcagtacccgttgcgtccacttttgtttggcatgcatgttgatcgtcgtgttcaaaccaacatgcacattccttcttgaaacctctcataataagatgtgactttttcatatgcatctacccatgctaccttgttcttgaaatcaatgaataggcaatgtatactctagttcattttgatatggcatatttctttgcggctgaaataaatctgtcgagctctttgaagaatatgttgccatgtctcataacttcatatatccaagatctctctatgtaaagcatctatggaaaaaaacaagaagtgacaaacgttaattcataaatgacttaaatgtgatcgcatatttctcattacatcaaataataaaacttgacaattaaattatatttctttacagtggaaggaattgatatttatcacaacaatgaacaaaactggctaaaggaaataaaacctcttgacatatgtgaagaaaactagaagtgctaactttctttctctctcctccatcctcattgatcactatatctctcttaatattaataaaaaaacagaattgtccaaacctatctaactataaagttgatgcccactaactactaaagcaaaacatgcaagtgtgccacatcattcactcggtagcaattattatctaaagtattttaaatcagatgcaagtgtaccatatcatcacttagtagcaacaggtgtactggtgcaagttgttagcatgctcgacttaaaaaagtgagctttcctcctcccatttcccgtaaaccgtagaattagcaaaaaaaattgtttatatttagttgaatgtagtgcaactataaactcccaatctactaaatgtgtctatagattattgtattaataatgagcttaaattgttatgattattttaagaaacacagtatgaacacatgcgcccacaatgtacgcacactcacccgcgcccacaatgtacgcacactcaccctacgcctatgagcaccggatgttctacactgaactagcatatcttcagattgacaaagtcaccacgagcgcctcgttgtcgcctatcattaaaagaataattagccgtaaatgcgagaacttgtgtcaaatctaagatttgaacccggattaagctgattccaccataagaaacctaaccagttggacatgcccaacatcttttagataggtgcaaagctgatagtcacattagtatatcacacatatatatactcatcactaatatatataactttgaacgatgtaaaatcatatgaatctttattaaaagatgaggtttatttgtaaaccatttttatttatagtgtgattataaaattttatgcacgacattactacatttcctcattttattctttaatttgttgttggatattttttaaatataagtcaatgatctatttgtaaatattttttcccaaagaaaagttacgtacatagaataaaagggtctatttataaaatagttttttttaattgaaggtatacagtgtaaaattatatccacaactttactatctttttctttgtaggccgaggaagcttctaaataaagaattactactttctctatccaatggctcatatttcttctgacaattttgtcttcatatgaatccaaaggctattattttattaattatgaggtttatcctagttgatttttagattcacttatagatatgtgcaagatttgaaggttgtgaacatgcactaaaggcgaggaagatgtcgactgctctgattttattatagtcataccccaatccagatattaaaaatgttatacatactgtttggagctttaacttatctggtgatctggtcgtaacaaggacccaaagccaaggctacaagccaaattatcacacatacaaaagggttggaagcagcttagctctccttactcccagcagagcaaacaccactccatgt

SEQ ID NO: 2250 - DNA, 1722 bp, Oryza sativa
  misc_feature (22)..(22): n = any nucleotide
  misc_feature (1066)..(1066): n = any nucleotide
ttccataaaatacttgcggcantttttagatagtcccttaaattgattgtggagggtaaaacacatgctctatatatcgttatcaatagtgacgggtctggttaaccagcgcgtgcaattagttgaccggtattttgcacgtgcatatactctacatattatacgaatatataggaggtcgtgtacgtctttaacaagccacgcagtgttaaaaaagaaaaaacaaagccacgcagtgttgtttcagcagagagagagagagagagagagagatgcgttcttccagaggtgtcattcgccattccgtgtggtgtctggtgtttgtatggtcatggcgggttgcaacagctcaggatcaacaagcaccaaaaactgatccagtcgaaggtaagcaagccagcaatcatgtacggtgtgtattgacgcaccacgtatgtctatcttctttcgttttttgacatttacatatttaagatgtgaaatttaataaattatcatctatagtcgatgacatgtgagcactcatatatcaataacctaaaagtgacgaatagttaaatgtctcttggttttcctccatgcgtatagttagattgcaggagtagtaatttgtggttgtgctcgatatatgatgtccctcgcactactacagaacacctgttagagcacctgttagagcatccccagtagatactctctcccgtcctccttacatgaaatagcgtatggtgggagaaaatccacctctgtagcggatacgccgtttgggcatccaaagatagctcatgcgctatcccgaagagagaaacgccggatatggtctttctctctcctcacgcaattccacaaatggtgctcccaccctcatcagatcgagctatggaggggtgaaggaatgaatgtagagaagagagagaggatgcgctagtggccaccttagtcggccggtcctgagcgtcgccccatgatcatatgagccggccactcccgacatcggtcacatgcgcctgccctgcacccaccgtcggccaaagcgccacgcgcccacatatccgactctgccctnccccctccttctatagactcctctaagtaggcagacgcccgtggcatctcccctgccgtcctcactgctcctgcgcttgtgacttctccccccgccacccgtgccgaccctccgcacgcctgctcgcgccgctcctccgcccatgccgccaagccacttctctccccatcgcgcgccctgttactcccacccattgaactacccgtcggtggtcagccctcctcgtatgtccttcccatcctctcaggctctcagcattggatatagaagagagagaaaggtgaggaagtttttttagaggttgaattatcaaatttctcaacagttcttctcatacattgtctatttttgatttttgggagtgttgaaaggtagttgaaagatattagtaaaatataggtttttggtacatggagaatgtaatatgaatgatctattggaatcaaaaggaaaatggagtaggaaacatttttgaatggccatccaaatgggaatatggaggatgaaatttggataagctggggatgctattagggaatgatacatgtataggtgccggtttctattgagaaagagttagaggaatttgatttcattaatgacctagctatcatccatatgattattagtggtgagttaattagtaaacatcatcc

SEQ ID NO: 2251 - DNA, 2000 bp, Oryza sativa
  misc_feature (329)..(329): n = any nucleotide
  misc_feature (344)..(344): n = any nucleotide
aaagctcacgcagacttgctaaatggcgagctgctctttttctgccttgcatgttcttattacatagtagtcctataagattttataacattaatggaaatatatgtgcttgatcgcatctctgcaaaacattagatggaaaacttctgctgtctgcaaaaacattagatgaaaaacttctgccctgatgctgcagtagtacaagcgctattgcaaatcgtcagcgctataaagatgatcagattcccctctcgacgtcaatcagctggtccagccggcatgagcaatggccatgtcaggcgatcaacagttgaattaacccaaatttnacccccccccccccnttgaactgttctgtctgcacgctaaacgatagagagtttgtaataaaccatgatgcgttttccaggcaatcactcgactctaaatgaattaagtctgcatcccagctagagccatgcattagaggcaaacattctggtttgcactccactgcatacagacgatcatcatatcgatcctcttcttcaatcaatgccgtgcccatttctcgcgcattgccttttcagagtttcagttcctaggacggagcaattctggacacaggcttggacgtaaaacctctactcagatccgtccgagaaaacgttcgctttcagatgatctggtggcgaggccatatcgtctttccgaaacggtgcaatggcagcggagcggatgggcttaactcaccttcctattgcagactagacacaggttagctcatactacatactactagctacgtactaatggcgtcgatctacttcagtaggcaattgaagttttttgcctactgctactgatgcatggctaattaaacaccggtgccagtgccaaatcaccgcagcacgtactgtgcgttccactgttcaggacttaatttgatcgatactactagcatgcatatctaagtatatacccatcgtagctagccgtagaatagtaacagcagcatctatctgcaacccaacgtaggccatggaaatacgaaatcaaacaaaagcaaagcatcgattaagtctcgttgagagccatgccatcgatcaagctagtacagtaaataagcaactggcaggtgcctataattttatgccgtgatgtgacatactgacattcacagcaagttctaaagtctgaaggatgtgatggtgcaagtgaagacagtgggaatcgtctgaagtatattgtatctacattagctatcgctgacacgtgggatcgggttcacctgttagccaatactactgtaagtataataccgtagaggatccgtgtccgaagtagcgaagctaattttgctttacagtttacagtgatggtggtaaaaagaacacggtgaattcttggggaagacgcacatgcggctgtgtttcgatcgaatgattcccctcacctcacagcggtggtccttctgtactactgttgcgattgggcaccgggaacagcggaataaatggcaaaagccatccctgcgctcaggccttgcaattgcaggttggcggaattttacagagtgttccattagtctctctaccccgtacatcatcatcacccttcactgccagtactgttcctttttctcagcctcccgtacaatgttcgcagcagtaagctgttgatctggtgggtagtaagttggactaggacttgatggcgtgataaacagtactggattagtacgtgattaaggatggcgagatcagagattcagaaaatggattggagacttccgtttgtcctccttggaaactgacaaacatttttccaggagagcaaaagctttactgagaaatgggaacgctaggaatagagtacctaccacaaacgagcaaccagctaatttcagagatcactttagccgcgactcgtagcaacacatacagggcccaacaaacagcaaattaaatctgggacgatcgcctgcacaatctgcagggggagagatccacaaatcggcc

SEQ ID NO: 2252 - DNA, 548 bp, Oryza sativa
  misc_feature (9)..(9): n = any nucleotide
gggggtttnacccccccccccccccctgtgactctgaagctgcctctcatctcctctccaatctccatccacatcgcatccatcataaatcccccacacccttctccccaaccaagcacctaccaccattcccaatccccctcttccaatcgccatatgcaagagccccaaatccgctattgcatttgtttcatttcatcggctgccgctcctgagaaacagcaatctggataggataggtggtcgcctgtatttagatccggacttttgctagtggggggagagaggatttaggtgaacgagcatcttgattttgaccaatctttgcctgtctcactgattgaccctcctcctgtgtgcttggttctttaaatcccgcgtggtgggtgtggggaagaggagaggagggaggcaaaggcacgagcaagaacagctgcttccgtcttcttgctcgctggtattcaaaaggtgagctgttgttcttgccatgttctttatcagagatttttgatgtatgtgggagcagattcttgagctccttgaagtga

SEQ ID NO: 2253 - DNA, 2000 bp, Oryza sativa
tggatgcgtgttagatcggttgctttaccgcgaacatttgtgaggtgagtatttctggtggagagctgcatcaaaatgctgcctgcccgtttctgacactccggtaggtttctgaacttccctggtctgcctgccctccttgttgtctgttgcaatgggtgaaacgagcaggatgactttggatggcggcatgcatgcatgatagagcaaacgacaactaggggtttatcttccctcttatgtattgatcaatctggttttggcataattgtctcagtactgaccttatagtggataacggtaagttgtaaatatagttgaaaccgctatacgaattcaggcaactttgacgtgaaatgtggattcaagtcaagtttgctactccctccattgaattacttgtcatcttgggccaaacacacaggctagggtgatgttcaattgtgttacttgagactgtcttacccctaattaatatactttaatttctactgagctgtccacattactatgctagtccagcttgttcaatttcatcacaagtagacatggtgcgtggctgaacaggattgtgctagtggtcgtgttacagccaagccaagctctagacgaaatatgctagtggttagaaataaatgagttcattggagcaatatacctactacttttattaggggtaatttgggaacataatacctacaaaacataaaaagctattcaaaaacaaaaccaataccctaaaacatcatctaaataaggatggaggggggtacatctcatgcttggcacccaagaaacttgatactccctccgttccatattataaatcgctttgacttttttcctaatcaaacttctttacatctgaccaagtttataggaaaatgtagcagcatctacaacaccaaattagtttattaaatgtaacattgaatatattttgataatatgtttgcttttgtgttggaaatgttgctatatttttctacaaacttggtcaaactttaaaaaagtttgacaaaggaaaaagtcaaagcgacttataatatgaaatggaaggagtatttaatactccctccatctacttttgatagtcatatttcatcttggcacacagaccaaggataagtaattctacttatcatctatttaaacatgctactagtcattcctcgtaaacaagcgattcattaatatttacattttttgatacccatgcagcccaatcttgtgtggaagaatggagagtcatgcattaaatccgagaaagttattaagatgataggttgttggataaattttcagatttggaaatatgactatcaaaagtagatggagggagtaattttgtgggagaaatagttttttttttagtctgactatatgatttggatgtacatcactgccaattaataagatggtaccatatgcatatgttctatctggtaccagtgaaacttttttaatgcttgaggaaatgtttcatctcaacatgggggaaggtccgatcttttgagttgcatgcactagctagttgaactaaaagcttaatctgatggagtagggcaccaggcaatttactctttacttcaacactccccctcatgtctagattcgaaatcaagacctttggccttgataccatgctatgaattgcgcttgtattcattacagcccaatggtgcagtatatataaatatggtgtatacacaataaaacccctaatcccccaatacaaagaggaaaacacaagtactaattatgttaaatacaatccaggtgccatagacaatggggaatgacagtccaatttagctcttgggtaggtgtatgctatttttgatttatgttgtttgtgaaaagagtaaaaaaaaaacagtttcatattagatccctctctgtgcttaatgttttaccaagccttgctttctccaagttttcttctatcaagtacacactaagattcttctttcttgtgcaggatttttgatacatttgag

SEQ ID NO: 2254 - DNA, 2000 bp, Oryza sativa
  misc_feature (1775)..(1775): n = any nucleotide
  misc_feature (1793)..(1793): n = any nucleotide
  misc_feature (1914)..(1914): n = any nucleotide
ccaaatagggtctcgcaagggaggttgaggccttagcaagaagaaccagccatacgttgtatttctagcactggagccaatgagggttggagtagaaacaaatggctgggacaacttattcttgggaagacttagatactattataagaagacattggagtagtacctggtaggctttgagtataaaggaaacttcagagcgaaaaccgatgatttctctcaaccttcatagcgaaaacttcatagaaaacttcagagcaacgggatgggggtggttcccttgatctttacaatactactagactagctcgagataccgctggccatcacccttgcctcgttgctagcacatgatgcatctccaacagtgctagtgcacgctaggcgctacattagccagctcgacggctcgcctagtgttctgcccgttggttatagcccttatcatgctcattactgccatcccaccgcttgcctacgatggctctgccgcttcagttatccatcgcttggtcgcataacgagcgggggagtgaggagggagccaactagagtcacttagcagcccaacaacataagaaaaagcccaatgagcctaaggccacgttctaaacagctagttaagcttagctattcatcattttccgttaacatgcttttcaaactactaaacagtttatttcgtgcgaaaactttctatataaaagatgctttaaaaaaatcaaataaattcatttttcaaatttgtaataattaatacttaattaatcatatgctaatcgtatttctcgttttatgtgtagctaatcatccaaacccaatagccgaaaagaacgcggcctaaaaacttaattaactcatgtcacaaactccaaagtccatatccattactcggtgtcctttgctatcaggttaagggcagggcaggggcggagctagaataaaatgaagagggtttcactcgcttgctttactctggtttgaattaaatttagcttgatacaagtgcctaagtttaaactgacaagaaatatatatggtgaaaatagataaattatagctaaaatttttttaaaccggattcctgacaccccgtagctatacatagctccgccgctggggcaggggatgagggaaggacggatcgtacaatcatcgagagcgagatatggcttacacaatccttcgtcctaccaaacgcatcgatcctgcatgtagcacgatgaacaaatcaacccaaataacgtaccgtcgattttactagactcgtgttatcgttgccacatgaccaagccccaccaacaccacatcccccgttgtcatttctaattccagcctttcgaaaagaaaactaacaaaatcgtgtgcaaaaactcgaaacaaacaggccggcggccccatgattgcagccagcaaggaacctttgaactcacactatcgagcaacgacacctcagatcccctcttgtcctcctcccccaacggcaccaaccggtcggttcacttcactagcgcaaagtagttcatttcaacccacccaccaaaaaccaaaaaaaccatttcaattttcaaatttcctcctcctcctcctcaaacccccaccacccagcccagccatccccaaaccctaaatccgccgcccgccgccgccctcgccgttgcgccattccggctgcgatggggttcgtggatccggcggcgccgctgctggccacgtgcggcggcgacaccgtcaagctgttcgacgtcacggtcgagtccggcgacccctgcgtnctcgcctaaaaccccggngccggcacaccccgtcaacgccgtccgctggaaccacaccagtgagtacccccagcctcgcctcgccggctccaccgcgtgcccgctcgtcccgcctccggctctcctttcccctcccccntccccttcccagatctcccgagttgggtttacttttggcgtcgttcgcgcgaggatctctcggtgggcagccggagcctcccggcc

SEQ ID NO: 2255 - DNA, 2000 bp, Oryza sativa
tattaaaaaataatatatgcatactcatatgaaagtatttttcaagacaaatctattcatataatttttacattttcaaactcaacaacttgagagttattcatgatttatatttctaaggtttgacttaaacattgtcctaaacgagtacggaggaagtacaaatttactcaaatgtgcgtgcgtacgtagttagtattacctccgttcagaaacaaatgtcggtttttactttgaattaccaatctctcaccaactgtatttttataaaataatctgattatagtatcaaaattgtatcattagtttgtaatcataaccactttactaatagttaaagtttactactgcttgatcagatcaaaactaacaaagatcaaagaagtacaaaagtgatacggagtgctatataaaatgcgcaaacaaacttatcgtgtgccttatgcgacaactcggagacgtaatgcgatcgatacaccttccctaggaatgagctgaggttgacaaggcatcctcactctctcttctctataatatttttaaaatcctgattaggtgtccagttagaatcattaacctaatactacgaaagagctgaaagtagtgtgaatcttagaattctgggccttttggaattgtgtttagctagccatatctcgaatcatagaaagcgactgaactatttagctaacaccgacaggcagacaactgaagaatggtgtccagatagctaccagaacaatagcatttttttttgtcataacccagatgagtttggttaagctaacggattaatttttggtacggttgatacgcatgcagtgatgtagatgatgcgtgtgctctgagaattcttgatacatcagcaaaagttctcccgctgttaaatggaatagtagtatttgttggtgtgtatatgttcaggttcttgtttctgaataaggtaaacaatgacatgtttttgtcatgaaatcagaaaagatagtactgctgattgaaccccacgcgtgtagcgtgcttattttccaacgaggaacaaattgagaaatgttggagataaaaggttagaacagttaggggttggtaagtttgcttttttcccaactacctcttgttccatcttccatacatgatgcatgcttcaccgccaatatgtcaatcttctgatagcagctcgcattttcatttataacaaacttgtttaactatgaaaaaattaagtagctaagaatgtaagcacagattcataaccttattcagttctgttgtctgatctgaaaattcagactacaaaatgaccagaaaaaccaaagatcagcattatattcggatcgcataaatgctgagaattaaggtagataaaccaaaacataacatatactatagattgctcatccttccccaccatgtgtcattaagaggactcatcatcactgacatcagatgaacttgttggtcaagtctcccccagatgattatttatctccgatgttcgtggccctgataaccaattaagttttaacctacaggtatgttttcttaatgctggtgctactaattaaccatctttgagcatttaagggtgccattaatttgaaaaatacaactaggtaagctagcttggtggtgtattaagacatgttcatatgctattatactataaacatcattaatgggtatgtagacagctctgtttaagaaacattacggtagtgggctttattttgcagggtcaaggcatatccatctatgttcatgggatattcctagtatagaagcatccattttagtcaacggtgtgtataaatacggcatgtctcccgtacgtgattcatgttggcgacctcttctcgctcgcaactaattaatcaattatccgcggttttaaattaatttgcgtcctagtacttactactcagagattcagagtctagcttgttaataactgaacaacctagttgatgcgtttggtaactaactagctagcagggttaggagga

SEQ ID NO: 2256 - DNA, 2000 bp, Oryza sativa
  misc_feature (1723)..(1723): n = any nucleotide
  misc_feature (1843)..(1843): n = any nucleotide
  misc_feature (1856)..(1856): n = any nucleotide
cattacttgccaacaaaaattatcacaccttgactaaggtgaggtgatcaaattgttagccacaacttactaagcctaagggaatcttgccacacttttttgagccattgacacgtgggacccaatttgttggaggggaatcttgtcacaactgtggctacaaccaaacacctgtcaaatttgcctaaccttaggcgtgacaaactatggcaaagtgtggcttgcaaccaaacacaccctttctctagagttaggcaatgcaataccctttctctagagttcatcagaccagtcaaagatgcttagtttcagaccgcggaccaacgtcccggccatatcggcccaattttgtctccggatcgaccaaatcaagcaaggcccagatgaaagaaaaggatcggggatgttgagcccgtttcaatttacccagcctattagctagccaataatgagtttcccttttatccttatgaaaactactcactccgtcctaaatatttaacgccgttgagtttttaaatatatttgaccgtttattttattcaaaaatttttgcgaaatatgtaaaactatatgtatatataaaagtatatttaacaatgaatcaaatgataggaaaataattaataattacttaattttttttaataagacgaacggtcaaatatgtttaaaaaagtcaacggcgtcaaacatttagggacgaagggagtattatgccggtgtagctatggaagacaaattttgagccattctttctaagaaaaaactgcataccattatagtatgggtgtttcgctatagagaaaaaaacagaaagactgggtggcattttctgaactaaaaaaattgggtgccgtatctaaaaccgggcgacctcttttcgtgtggcatattattatattttaccggagaaagaacattataaatcctcctttaggaactgatgaaatttgtgtaatttccacaagaattaaattaattcctgtaagaaatacggtatcttgtactaccttgtatcttgtactacctttgtttttaatagataacgccgttaactttttctcacatgtttgaccattcgtcttatttaaaaaatttaggtaattataatttattttgttatgagttgttttattactcatagtattttaagtgtgatttatatcttatacaattgcataaaatttttgaataaaacgaatggttaaacatgtgagaaaaagttaacggcgtcatctattaaaaaacggaggagggagtacgtagttgtaccactagaattgatgctttgagaaaagacgtacttgacgacggagaaaccatgtgctctaattacgcattaaccaccatacggagtcggaccaacggttgtagtactgtagaacggcggtttactattattgcgtgccatcaacagcccacaggccaactccccgagcccaatttaaccgcacgggcccacctggttgtgacccgacagagaaacgccgggcccacgggcagtctcgttaaaaaccgctttgcttttttccttttcttgctctcgccgtcaccctcacccacatcacaagagcgcttcgcttcttctcctcttccgcatcgcatctcatctccttcctccaacccaacccaacccaccgtactagtattgactttggtttattttgccctcccttccattgattctactcctactcctactactttttttttggttttngtgttttggtttgcttctactagactactactactccactcgtctttgcttgccttttgtcacccactgtttaacctcaattctcgtgctctgggaaagagtctactactaggttaaatnagttttaaatttncctttctccccaaaattggaattggtttcggtttttttttgggggaagcaattcggccaattggcttggcggatttcgatttggtgatagggttccatggttgctgcggcctgattcgaattcctgcttgtttttcgtgtgtag

SEQ ID NO: 2257 - DNA, 2000 bp, Oryza sativa
  misc_feature (1705)..(1705): n = any nucleotide
  misc_feature (1748)..(1748): n = any nucleotide
cttatagtaaacttaatagccaattcatacaatagttacctataaaaatatattacactattaatatatggtcccacatgtcatacatacattatgccttggagttcgtggtacagttggctacaaatctgtagcccgctgctcctttgtcttctctttttatctcctcaatatgtgtttatagctggcttacattatgctattgtacctgctctaagcagcttatgtaagtaaagcgataaacatttataaatacccggctctaatttaaatcctaactccacgtaaaattgcgcgggaaattaagtagtaatttctcacaagacataagaaaataatagcatgatgatatatagggctggatggaaaagtttggtgactcttagctcaggcggctcgttatgtttctgaaacgagccaagcttgctattttagctgttttgacataacgagctaggctgatacactcatacacacgagtccccagactgtcagtaagcaaagatacaggagcaaaagaaaacgtctgatgaatggtccataggaagagaggagaggagaggagcgaggaggaggctgtatccagtagaggacagcttttgccatttagagcccatcactgccaacaaaatccttcccttcagcttctcttctagtcttctcttcaccttcttctcatcctcttcttctcctcctcggtcaaaccgccttttcttctctcccctatcctccgctccgagggagaaaaaaaaccaagaaagaaagaaagaaagaaaaagagtactagtagcacccggagagttgaggaaagggagtaggcggagccaaatctcgtttctctttagttgttgttagtacccttagtggaagaatctctccccttttcttgtgtttcttgggttttgaagttttttgttgttgggaggtatgaggaatgaaggcctaacctgaggcaagatcttcgttttccttcatttgtgggggtgtttgttggtggaaacggatcaagaaaagccggaatttcggttctgaaatcgtcggttttgatatcggtttctctctgttgattggagagagagggagagagcaaacgcatgatctgtgtctgattctgacgggccttgtcgcggtccgtatcagttcatccatcccaacttgctgttcgttttgtgtggtggtgtttcgcttttttgggaagagaggagaggaagcaatcattcggcggcgacggccccgcccacttgaggtaccagttggaaatttccccccttttctttgtgcttttgtttttgctggtttgtgcttatctcttactacttgaggtacatctttttgaccaggtttttttttgtggtaacggcgatttttggggataaagtttgcatcttaggtcgggattttttcttgtttcagtggtggaatgtctccattttgagcgaaattgcgtcttttgtgggttcatgtttggggatttgggggaaatcgtgcggcctggtttgctgtggtggggaatttttttcttgtttcagttgattggtttctccatttcatatcaaaccgtgtcttttgagtttctcgtgcatatatggagaggatatccatggttatctagaaaaaaaatgcaaagttttcaacttgctctgtaatggactcttccaacgttttgcattcatttcttgagctcctcaccttggttttcttcatnattgtgttcaaacctactctgatcttggttctgaacttctgangtttgtctggttactggtcatgtaggattgatggctttgtggtctggtctcttgctaacttcttgtgcttctgtgattctgataagcttttcttcgtgttttgtgtagagataacagtttttttctcttatcaattatgctatgagatattccatgtttaatcaggactaactaatgctgtattacctgatactcgtttcagttaaacttgattgctctgtcgcatggccagcagtagcgaccatggatccc

SEQ ID NO: 2258 - DNA, 2000 bp, Oryza sativa
  misc_feature (406)..(406): n = any nucleotide
  misc_feature (428)..(428): n = any nucleotide
  misc_feature (430)..(430): n = any nucleotide
  misc_feature (501)..(501): n = any nucleotide
tcttttaatatttctattttttatttttaattttagttgtttcaaaattgtattcctacttgaactctcttttaatttttctaattttggatattatttttgttattctgaattttaattaatctcgtattgggttcttatatggattcttctttcaatattgcttatttttaattccgaatttcagctaattttaaattgtattcctaactcttcttttgttcttttgctaattttggattttttttattttgaattttgaattttaattaatcttgtattgggtttttatatggactcttcttttaatattcctaatttttgattccgaatttaagctatttttaaattgtatttctacttggactctccttttcttttctaatatttaatttatgttatttgnaattgattatctcgtatgggtncntatatggaaacttctttcaatatgctaattttaattccgaatttaagctatttttaaatgtatttctactnggactctcttttccctttttttttctttttctccgattaatgtaggaatttctagccccacagcgaatgtggtgcctccttttaaagctgttttaataatataatagatagaaatgggacatgcaacattttgaatccctgcacggtcttttaatgctaaaagggcataaactatgctattttcgtgttgccaaacattgtccaggcattccttgtggctgtggtgccaactgttaaaagttttaagatatcttcatcagcatctaatgcaggatgcttagttctaactacattgttctgagagaagcaactactatttatattcttaagcaacatctttgacatgttaaagctgtcaaggtccattatatgctgatggtgtcaactgtgcttctgatccaagagaagattcgggaaggctagctacaaaccgctgtggaatcaaatgaattgagttctgttctgtcaacactgcttattaattactggaaaaacagtgcaaaaccaccttgaaatcataaggcgtgatcttatggcaatctgaagtcattgtcgtatttttctaagataataaaagctttattaaactatattaaaactacattgagatgatacaattaccgtatacatgcaaacacgattgattattcaacaaattgagcctaatacctcctcctatacgctataattggcatgtgtcacgtatccagtttggtatggcagttgagagctgtggaaggagtgatcggcatgttcaccagctctgattggtagtacgattttacgacacgttgatcagccagcgacgccgagaaaaccggttgatcgaaagagatagcagcggagacatcgccgatgggccgtgagttgggccgtgagatcagatggtagcgcggcccacaacgattctaccgagagcgagctgtaataataacttctacccgtagagtaggcaggcagccaccgggtaaattttgtagagtcgtcagtcgtcgcctcatcgggacagcctttttaccgtttccggcgtgcgcgctgacgtggcgcgctgtcttcccgcaccgcagcgacaaaacctcgccgcgtgcttcccgtttccattctctctctctctctctctccccgaccgcttcccgaatttttctgcctattctttctttgtttcttcttccccctttcgccttccccctctttcctgattccccacctcctccctcgccgccgccgccgccgctgactcccaccgcgaccgcctcccccgccggcgcggtttcggaggaggcccggcgcctgcaggaggaggagggagggagggaaggagggcctggcccgcctccgccgccgctgcctcgtgcggttcccgacgccggccgtactgcgcagcgctcgcccacgccgcgcgcgccgcggtggggcatggtggtgaggtgggagggagggagctgggggtgttgaggcggagggggaggaggaggaggaggaggtgtggttagtgcgac

SEQ ID NO: 2259 - DNA, 2000 bp, Oryza sativa
  misc_feature (247)..(247): n = any nucleotide
  misc_feature (280)..(280): n = any nucleotide
  misc_feature (364)..(364): n = any nucleotide
  misc_feature (410)..(410): n = any nucleotide
  misc_feature (862)..(862): n = any nucleotide
  misc_feature (875)..(875): n = any nucleotide
  misc_feature (879)..(879): n = any nucleotide
  misc_feature (881)..(881): n = any nucleotide
  misc_feature (951)..(951): n = any nucleotide
tcaaaccttgggaatataaatcatgaataactctcaagttgttgagtttaaaaatgtaaaaattatatatatagatttgtcttgaaaaatactttcataaaagtatacatatatcacttttcaataaatatttttatagaaataagaagtgaaagttgtgttttggagaccgtgtcactgtcctaaacgacttcctttacgagtatggagggagtactagatatctctttctgtgtaattaataatngatcgatctgacctactgttacgcttcgcaacnacgttcgcatatcttatggagtactagttttgcatgatgtatatctgaaatacaacactatgcaattcctagttattatatcgntgtcatatcggtgggtgtaactaaccaaactagaagtctacaagcntactgctaaactataaatgatcagtacactttggtgctttaggttgataattaataacgcttgtcttatcatgttcgatcaataattttcatcgtaagatcctaatgatatcttctgatcagtgtagtgtatatatactataaaatgggcaagataatgcatcttgctaagagctaatccactcatcaatgtcatagtaaaatacgacgcgttaggttgccagtcatattttgtcatagtttactatgtccaagattatataggtttcactaacttagcaactactccattcgtttcatcttatcaatcgttttgacattttatcaaatctatctataaaaataattagcaataatactaaattagtttcattaaatataacattgaatgtattttgatatacatcgttctcacgattgtcatcaatcataatacaatgagcaagataatancaccatctgctancatntncatggacaagatctccttctcagctacaacatctccttctcgctttgagtgatttcgtactaagttgatnaactggacgaaaggggagccctcaatgctccacacgccaccatcttgaagtccaagcaaatctacgagtacttgcatgaagaccgccaagacgaccaaaattggaaaataatttggaaaagtaaatctcctccgaagattcagttcttcatttggttattatccaaagaacgcctccccacaaagcagaacctgtaaaaaaagaaaattgtttcgtccgcgaactgcgatcttttggtgttttagaagaaactgcttttcatttctgtgttgattgttcttttgctcaggcgttctggtcgaccattcagattgtcccaggactgacaagctcagccaatctcgcaagtttaggccgcctagatggcattcccatcaagcacttcagagtcttcttctttctctgcttttgggttctgtggaaccacaggcatgatgttgttttcagggggctgcaaacatccttgcgtagactagtaactaaatgtatagatgatgcaactctttgagcagagcgtttcaattcggatgataggggcattgtttcctcgtggaaggaaacactagcgtctgcttttcaaaactctgtaatttaacatgtaactgcaagtcttccttcattttataaaattcaggtggggaaactcccccgctcccccctgaactttctaaaaaaaaattatacaatggacaagataataccctccgctaagagctaaatccatatgtcacggtaaatttaaccctccgaagcattaacaacttttttcaatctcaagttgagcatcacgtgcattaaagaaacaaaaagagataaaattaatctacataactagagatgctattgttcaacgaaatcttcaatgatctaaaaaagatgctaacacctagacataataacaagttaatactaattaatgtcaacttgaatactttattattacttccggactactctcctctccgagatagtactatatatttgcacttcatgctcccagtggatcaaaaaaaatacattggtcattggtgttctgctggattcattct

SEQ ID NO: 2260 - DNA, 2000 bp, Oryza sativa
  misc_feature (298)..(298): n = any nucleotide
tttcataggttgattatggcgcattggcacctagttgagccgtgaaggattaattacggggtgtgtggatacatatttagctgccacaaccactcgcctctcttggctcgactctagtcataatgggcattgtcgaagggcaaaacctatcttccttattttgctatgagggaaagcacatttaccggtgtaacacacagccatagtattggtacttttctccataaatctatctcaagttcatagatctggctgatcaacaaaggcatttttcctactttagctttggtgggtctanttttttcaaacgacatatctcatcctaccaccgagtagactaactcactgcttttcttagaagatttctcaatttttttctacattcgaagctgatggtaatcaagcagtattagctatgcggacaacccctgattccctaatgaaatcattctacgagaagcttcatagatgtgttaggtgggttgtaggacagtaagggagtaagctatcaaaatgatatatgatatgttcaagttgtcttagtttttttttctttgctgttcttttctttattagttatggtaatatattaatataggtgtagaggccgaatgtaatttatcttcttgataaagtatatgtattctaaatatatacatgacatatatatatacaccttggtttgtccacctcaaccaaaataggatgtaaacaaaagtattagaagcgagtaaaacagaagatatcgtgcacgggaagtccataagaaggtcaaaagatcaatgcatatcatatggcactagtactacccaaatataatcccaagctacctcgctagatgcaggatatgagaaacaacattatgggtgtctatcttgatagggatggatatatatagaaaatgccagtttatgagtgtaactaacttaaatggagtgatattgctttaaggcttctttgaaatgcatgatttcaaaaaacacatggataaaaaaaatacagaatgttgagtatgttgaatcccattggatctataatcatatgatttctcaaaacatgtgtttacatggctcaaaggaaaatatatgatttttgagattatgtattacttagattaagattaaaagaagacagaaatggagatgttgctttggaattctcttaaaatatgggttggagctcatgtttaaagttctttagaattggggtatatgaataaattgcaaaggaattttgcaagcccaaatcccacaaaccaagcaacctccttatgatttttttttcctaagaatctaatccttcaatccaaagaaacataaatattatcataacatctttggttgtatatagaatatatgataaaatcatgaaaaccagattaaagaaaatctataaatcgtttggaggatgttatgaaaatgagattctgtggtacgaagatagtgtagcgagttatgataatttgaacgtattgtactatagggactactcgaaaacattggctacaacagcatagcctacagccatgtagcttggctatcttcaaggcaaccatccagactggctacagtagtataagtgtagcagcattgttgtacaatctaatagttgtttaagattatcatatatatatatatatatgacaatcactatttatatatatgatatctattttcagtatctacgtaagttagatctttctatgatacacgatgagccgtttgtttttgggatccttggaacttgtattgtgtgatgtccactggagtatagctgggtggggtagtaacccattcggaaaaccccactaatccagtccccaactcccaagccgcggccaagccatttttcaccgttcaccgtggattcgagttgactcgcagcgtgccgcgtccgagtccaaagccaaactgtcatccatccgcatcacctcaccggtataaaggcgcgcccctcccctcgccgccccgcgtcggatgccgccgccgcgaccgcgaccg

SEQ ID NO: 2261 - DNA, 2000 bp, Oryza sativa
  misc_feature (1185)..(1185): n = any nucleotide
  misc_feature (1190)..(1190): n = any nucleotide
  misc_feature (1198)..(1198): n = any nucleotide
  misc_feature (1353)..(1353): n = any nucleotide
  misc_feature (1373)..(1373): n = any nucleotide
  misc_feature (1383)..(1383): n = any nucleotide
caaaatttaccgcgtttaagaggcgttgcttaacatacttgtgtgtattttctgagttctgaattgattctgcttgtttaggttccagtgttcttgaacaatgccagctatgttagtttttactccctccgtcccaaaatagttgtcattttaggattcaaattttgtccgaaaaagcttgccactttagtgtaacttttattgcatcaatcacctccgattcaaaattttctctattctacccccaattatcctcttactcccaaccttatatcatttaatattgggcactatagtcatttttgctaaaccttagtttttgctaaacaacttaaatgacaactattgtgggacggagggagtattttctagcaatgaacagtcaagtattgactattctttatattggtgtgattttttttattaatgttgaaatgcaaatatagtgataaatggaagtcatgttaaaactaaacatatacaagttgtattaatagaaactcatatccattttttgtgtagtaatagtatcatagtatttagctctgtttcctataaatacattgttataaatcttattcgtgttcattttgtttttactagcactgagatgagatgaattttctgcttgtgtgtaggaggtaggaacacttgttcatatgtcccatgattttgctggcagtcttgaatttctcaaaagtgctttattctgataccacactaccactcaccttattagaccgtggccgttggaaactttgacatcattggtgcatcttattttttcgactatgttataaatcacaaatttatgttattgctgagttgcttatattatccaatacaaaaaatgtttacagccatgcacttctttatttctatatccgcggcaagacaaagcatttaggtggaataaaatccaactagaaaagtaattgttgttaatgtcttttacaaacattccatcatcacaactttattttttcatgtgcaaaatctgctaccttttatttgctggggttattgcgagtatcaatataggtacatgaaattatctaattacttctttgttcttgtactcactttaatttgtttcctaattagaaatccttttggctatcttattagatttaaatcttagccatagagatgacccccccccttcccaacacacacacacacaanttcanaacttctngttcattttaatcctattattttatcggtcatataatttcaagagagtattaaaaggcagatatgattttcctggatagtggacagtctggtacctccgtttaaccttatttcatataatcaacattgcactacatactctacttgatttatganacttgcaatggattgaaaanttcttttagngtaacagtaccaaatttgcataatagtagcttactcaattttcagttattcatgtaatgttcatatttctggtttactattctggaaactggattttgtatacttctgattattaactgctaaatactagctttgaatgatatatcctaccttttggcaaatttttgactatttttcaaggctttcccctttcgcctggatgactttctgacaatatttacatgtctattggcagctgcggatcttgtggataccctctgaacctttcatcttctaaccgaagcacatctgacgtaggatcctcataccaaaagtctgtgaagaaaggtctgatttcattcattactgttgatctgagccgatttactcaggtagacgagatatcttgctttcccctcacctggcgtagctatcggccaaaaactaagcttctctgccgaaagtgtggggcatctattggctatgggtatggtgaaccagctgttctgtgcagctttgatccagccagttcatcatctagtacatcccaaaagtatttaataaaaatccaggctctccagccttcggatagtactcagtagtctgtcaacttcagccaaaatttggaaagagaggaa

SEQ ID NO: 2262 - DNA, 2000 bp, Oryza sativa
cggtcttgagccgagccgggtcgccaccgcccgtccgatcggccccgagggcgatctgggccgtcggtcccgtggaccggcggtggaccacccgcgtggtcccggtccacggtgaaccgccccccctgagccactgccgagtgggcccgcgtgccggcgccccttttcctccctctcccgagccgctggccagtggggcccgcatgtcggcgccgcgtcccccttgatgacgtcagccctgggatttattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatatttgccttgtatgtcgctagattccggttcttccgacgctccggtgtacttcaaaatagtcgccgaggttcctccagcagcagagcaaggcaagtcatgcttgtcacttgaacatgttgatcctatattgcaaatgctctattgtttttcttcaaatattgcattgttttataatgttactatggggtgtttacctattgttacagccatgctattttgatatcatgctcctttgttagcttgggttataacttgaatagattttggactaggaattgcttagccatgcttagttccactagcacacaatggggaaagctcactaaaatatagactttaggttcaattggtaaggttggtttagtaccaccattttggtgttggttaattaaaatgaatcacatggtgggctgtgggtgcatggttttgctagtcacacccatgacagttaaggaccggttcacgggatgccctggaagaacttatcgtacttaccacaagccagcgtgggcaacggctgggcttatagtgtagctttcctctagctgacgcatccaggcaagggtgggcgtgatggagcggggcgggccctgcgacggcctctgtcgcttccggattcacctaggcacgagaggggactgcccgctgccttgcgaggagtggggggtgaaacctgaggtgtggtgtgcttggttagatggggttatgcgaagggtcctgtcacggcctctttccggtatgtcgtggtggcatgtcggcgcacggaaacgtgtcgtggggctatgtcttgtgggtacagttgtacacctctgatcagagtaaaactattcgaatagccgtgcccgcggttatgggcggtcaaccagattcaccgtgattagtcttaccctagtttagtctaatgaaattggatagtataggtggatggttggccctgttgcaacgtgggatagcgttggacagcggatgatcaatattaattaattattgcaactgtttaattctttcaacttctgtttataaatgctcgttttatgcaaacgaaccactctagctctcctttgataattccctgcatcatacccctattccggtatgacttgctgagtacagtgggtagtactcagtcttgctctattttttttcccaaccccagagtatgagtatgtgtcagatggaggtttctccgaggagtaggcttcgtccgtgccgtcgaggatgcctgtggagtggtgttcccgctgcagttctagtcaaggcttagctcttgttgtctttcgtttttccgctgcatttatgtaagacttttatgatgtttgtaagacgtggatctgaatgtcaacattgtcgtttgtgtaccccggccggtcctggacggggattttaatgcacattctgcttggatctatcggatctggcgtagacactatctccttgcttctaatagttttgataataacttcaaattatctctattcttcttggtatatttggaaagctaaaaatgatcacttcttcagaaaaaagattgggaacctttacaaatttgtaatgcctccaatg

SEQ ID NO: 2263 - DNA, 2000 bp, Oryza sativa
  misc_feature (722)..(722): n = any nucleotide
ctaaggctgccaaaactgtcaagaggataaactgctagtggttagcgattagaagtaaatttggactgctgggttgccatatgtctacaagctacaacaggcgcacaagggaaaggagcactttattctatatttcatcaagcaaaaaacccttgcatgttcaatattctaaaaatcggcgcagtcatcacctcggtggtttttaggtgcctgatggtgagtccctgctgccctaatttttctcaccgtcgagcacctagctaacagccaccgatgcagcaagggctctcaacggcgagagatatgtaaggagaaaaattaggccctaatcggcgtgctaggcagggtagccgcatttacctctaaccactactacaaaatcctaaataggggaccgtgtgcagatttctaaaaaaccatcacatttaacctcttcacaatcttcacatgagtctaagattaaaaaacgatactgacatgcctttataggtgcaagtttaattaaaaaaaccagcacatataaatacatgtgctattttttttaaaaaaaatcagcacctagaagaatatatgagtaccggttttctaaaaaccgacacgtttgtgaaagccgagccgatgaaaaccgagctgacctaatttttcttctcgccctcctcacatatctctcaccattctcactgctctccgatccccttttctgtcctcgttgcctccgccantcctccccctctcttttgctacctccttgcctccgccgaccctccccctctcctccacctcccttcccctgtcttccgtcgccccttctcctctcctcctctctgctcggggacggccagatccgccgccgcgtgcttagggacagccagatccgccgccgcacgctcgggggtatccggatccgccaccacaagcacggggcagcccatttaacgactactgtggctccctcaactccctcaaccaccgtgtgcttgggggcggccgaatctaccaccgtgcacacgaggacggcctactcacaacagcggcttcctcaactccctcaatcgccacaggcacaggggtggctgctcaacgacgacggtggctccctcaactccctctttgtgttctcctctgtgttgttaattttgctcttgaatgttgattttataattgtgttcttggatgttgatcgattttagggatgatggagagttgcttgatgcatcggctcgaatcgagcaacctttgttttggattcgggactctcaaagatgtcggttcctaaactggcacctaagattcctcctcatcagtgccacctatgaggtgccggttggaaaatctggcacctacgtaggattcccaactggcacccattagggtttatgtagtagtgaatgtttaattattagtatatatcttggtttgaaagtaaataattgtatgtaaattatgtttatgcaaaagttttcaaaattgaatttgttgaaactcctacctttctcaccaacgaacaataggttggcacttccaaatgatgttttgcatggacaagattggttgtgaatgattgatctacgaatgctaaaaggaaattgtgcctaattaggagtttgtaaggctgttttagcaagagataaattcttataatcgcaagaaaaaatctgcacctgatttcttactcttcttgccatatagtacctttacatgtttgactgattccaaattaattcccaagacgcataagctttccaattaatctatactactactacaaagataaaatatatataaaaaatgtcctccgtcccataatatatgtgcttttgggtggatgtgacacattctaagacacattctaaagaggatgtgtcacatccaccaaaaaatccctgagtactttcttagtgtttctatattatctaaaaaaaatatgctatttgttaatctgcactatatattaactgcagggtcatcgatcatcattggacaccaattaagcaacagca

SEQ ID NO: 2264 - DNA, 2000 bp, Oryza sativa
  misc_feature (110)..(110): n = any nucleotide
gctgcacgatgccgtcgacggaacaaccaccatcgtggtccaccgcgacaagcaaccgccgccagcgccgccgctctcgcacccgcttgccgcacatggtcgaagaggtnatcggtgacgatcggcggcgcagtggcgccggccatggcgcagtctattgggaggaggaagcaagcgaggggcggatctggcctctgggtccgcaactccagcggccgcccgctcgccgatgccgctccgtccatcgcctgccaccgttgccgacgccgatccagacgccgctccacaggcacgaagagaaagagggagagatagagaagggaggagagggaggaagaagaaaggataaatagaggatgacatgtgggacgcacatgtcagtgggtcccataatttttttttgtgtgaatggctcccgcatatttttaaaaatttaatgctacataagcgccacgtcaatgccgcgtggtacgaagaccaggtcaacattgtcacgtgtgcgccacgtcagtgaaaccgccctccaaaatcatcaagggagtcaaattgtatcggtttagacagttcggaggtcaagatttctagtattgcggataaggtatacgatttagattccgtgttcatttcagggagtcaaactgtacttattccatatttccaagcctaactgaaacagaatcagcccattatgaagcccataaaacaggtaacaaattcagtgcgctattgttccaactgatgtctgcttttctttcttttcagattcatgccagccatattcacattaactcaaggattcaatgtcaatgactagcattctttttacaagcatgcctatttgttacttttgctaattgtgcagcagcagtgacgaaacaacgcgaagaggttattctaattgatctagcgtacgtaacttacgtgacatatagacaaagaattgatccaaggcaaccaccacatgtccacgtgattgatgattcataatagtaaacaactgcgcattattgttcggttaaaagttgactgctacaaatttcatatgaccacgtcaagctttataaaattataaaaagaaaactttcggcgacgacctcagtggtggttgcaaatatcggaattagattcagtttgtacaagttgtaaaaaaaagaagatttgagttcgtacacatacaaagtcgttagtccacatgagtcatcaaaactcacaaaatacacagtttcaaagcttgttcctagaaccgacaagtagaatgaactggtcataataatgcatccctaatctatttttttaactaaatgcatccctaatccaagcatggcgtcagtaatcccgaagctgacatgtagggattgtaacgcgagtgcatgctacatgcttgacatgggcggcaggataggtcggaaagtgaagaatacccagccacaccaggcgccgtccaatcgctgcatattggcgacttttgggcactttcccgtcgtctttgtgatgggtcgggggcacaaaacgttgcgtgcaaaagacagcggcattgctactcgatgtactgaacccacagtaagttcttgttggctaggaattttcggagccatcagatcattcatgatcaccgtacatgtaagttgtgcatatggattagtacattaacgacgtgttgattctgtaaccaagaggtttgttgtttgtttgttcagatggaactctgaccaaaatccaggcacgcgtgaaacggtgacacgaaaaatgcttccagctgatttccaccggcaacagccagtgagggagtcagcggcaccgcccgctcgtccccgcagtcactgactggtggggcccactcgccacgcagccatccctgacgtccgcgcgttacaccatccgcgtcgtagttaacacctccgttactccattccttccaaaagaaaactcgaaacctccccctctccggccgccggcgagcggctcatccatccaccccaccttggccggagacggcggca

SEQ ID NO: 2265 - DNA, 28 bp, Oryza sativa
  misc_feature (7)..(7): n = any nucleotide
  misc_feature (21)..(21): n = any nucleotide
atttggnggaattacggatgnggttgtc

SEQ ID NO: 2266 - DNA, 2000 bp, Oryza sativa
tcgttcagaaagatgtcggagactctgtgggtaaatttcattgttccagttagatggtgagataagtaatcaagagctatataggctggtggtaaatctgtgcatttcacacttatcaggatatattacatagattttgaacctatctagcactaatatttttttttggaaaatacatatcaacagccatcggatacttacatttttcatatgtattcatatacaaaataaactttcaaatctctatccttgcaggggaaaaaaaccgatccattataattttgaagtttgaaatggattaatgtaagttttctattcattctggcctttgtgtgtcttcgacacaacagccctgatccattatactaaaaagttcaataataattcaaagttcaaaaaataattattaaaaatatgtatttggcttcaaaattacatgggcaatccatcctaaagtgttctcaccaatgtattaggataatgtcgaccccacgatggagtttggcacttggtgttgcacaaacgaccttgtcagcggtggaggaatttggagcttggcactgaggcactagtggagtttgaagatcagtgcactgcatggacgcactgagtaatggtggaatttcatgctcaggtaggacgatatatagaggtatgttttcctaattgaggaaatgaagctcttctcacaattgagagagattacaagataaagaatacaatcgtgtttggaataggccagattgtgcatatgctcatcgcggtattagtgtggccgtttttgtattggtcatagcctgaagtttgtaccaaaactaataaagttgacaaaaggtcaaaaagcacttacaccaaaagtgagacctttctaactcgcaatgaattcaattgttgaggtttgctagctctagaattcgactcaaaaaggagaattgtccaatactcgaatagttgttaagctattgagatttgctagctctagattttagctcctgatgtcctacatgccagtgactgaatggatatgcccacatgaactttcatcaggggatgtaaactacttgccagtgactgaatatttagaaagtggaactgtcttagcagaaaatatagctccaaaataaatgttttatgcgagcttaaaatataaaattaagatattgagcagtgcaaagagactaacccagcggtctggacaagggtaattattgtgagacaccaaaaatccttcttccccagtatggagacgaagccaccaagaaggataacagtggtccataaaacaagaagataacctagccccttgacggccatagacatgtgtcccatgaacagcgcgtagttgttgatggagctaacttcctcccactctgagtcatcaacgggctccattccactagtcattcttcccttgcagatgtgcagagtggaggtcaactgcaagtctgcaacgcaacaaagccaatatgtaagcccgcatgctcagaactctattcgttgtatactcgtacataataaagcctggagatgcacgccaagaatggaaaaaaaaactgatctacaagaagcatggtcattcttaacataaatatgtccatcctattaaatttaatcagttttgattagcatcaagcaaggtaggctgactttggttttgtcaaaatctgttcagttgattgtttgagaaagtcaaaggaaaaaaaatcatatggtgaggaagcaaaggcctcggctagctggctggagttagtgtaactaaagaagaacagcccagatcagtggatcacagatgttaccgtaattcgtaaacatataatctggttgtcagcataaataattgttggtgccttttcgggccaatacagattcacctaaatatttgttgcaaatttggcctagtgccaaattgtggtggtcaacaataatattccgttttctcaaatcgaatcccaatagatcaagttgacattatatatgtgtacgatgggaaagcaaatacc

SEQ ID NO: 2267 - DNA, 2000 bp, Oryza sativa
acaaaacggaaaggcccagctcagccaagcacgcagacgcaacggcaacgggaaagagaaaccaaaagtggaaaatggccgacgctgccgtgtgggccccacgtccaggtgggggccctatttattccgagcccgatccatcacccagacgacacccaccgcgcaaggaaacgaagcgcggtttccgtagcgccgccgccgccttcgccgccgcgggcaccactcccattaagaccggatcagctctctctctctctctctctctctctctctctgtccgttgcgctcgtctcctcctctcgccgcgccgccgccccccgcccccacgatcgacgactcgccgcgccgccgccgccgccgccgccaacgcatgcaggtagtgatcctgatccctcgccgccggaaagcggcaacagtttctccttgttccgtccgcgtgtgcttcttcccgccgcgcgccgcgcgctatttgctctttcgatcggcgggcggttgttaattttgtgggttgatgggggtgtagatcatcaggacgaaatttgccttctccaactctgctgctagagcgcttcattcgggagagggcacaacgcggatcgaatgcgcacttccacatttatttccttttctctttgttattaccaaaaacatttttcttcttcttcattcttttattttttttggttcctggtagttcgattcatgccggaatagattccgttggtcactgtccaatgtccatgtcccctgttcctaattcctttgtgagccttttctttttcatctgacgtgtgagttgagttgtcagtcgtgtttacactaatccattgcatttgtccatgtaaagcagatgatttgcttttcctgggtgagttatgagtcacatgcaattgcttcttaacctgcacaacctctaaattaagccaaaaggcctagtcatgttatccagattacttgtactggccatctaaaaaaaggattactgttgttgtttgttcttcaagcgattgatactgacttcgtgtcatattaggacatccagatcagttaaatggatggttttctacgtcaggtattacaaagtcagctctcatcttattgtctaaccacataccttattgttttgaatgaagtcttaacacatattatgattctaacttgatccattagtgatatgtgctttttggaagattctaaatatgtggtctctgttttccttgaaaggaactactttcaacatacgtggtcatgtaataatggaatgtattcctagaagtcagtacaagtgtgcaatccgttcaaatcattgtctgctacttttctcagcgtgttgtcgtcttatcctattccaacgaggggcaactcctatctgtttttggtgggcttgtggccagctgggttgataaacattgccacatgttcaagtttttgttcagtgctgagcgcaagcaacaaaccaaaatggggggaacagtagtttcttgttttgttttctttaagttgaactaatattttttttaaaaaaaagacacagctaatggcttatgtatgatattagttttttttaggatcataagttttgcaccttttatggtccatatttaccatcttattaatttttaaccattgtaattgtgcgatatacctgctatgtcaagtaagcttttgttatgtactaaaactatctgtctgatttaatgcatgcaagcctaattttgttccttgctacaagttatgatattttttagggtggttcatcgctacaagctattcctgaagaaagtgtctttactttttaaaatttcttattgtgcaagtatagaactcactgggagttgtaatacctcacggcatgattactgtgttggaaaagagtacagctgaaacactctttctttttttttttatcaggggatgatattgtaggtaactatattttgatgtggtacaatgcaacttcacatggtctcagctagttttcagctttttctgtaggcaag

SEQ ID NO: 2268 - DNA, 2000 bp, Oryza sativa
  misc_feature (993)..(993): n = any nucleotide
ctactttcagacctggccgtggagtcttttggtggttgaagagatttgtttgtccgcgttggtggtccagtttgtccgtagtcagggctcttgggcctcgccggtgcttcatgcgccctgtggctgtgtaaacctgtagttgtgccgagtgtggagcggtgtgcttatcctctactccctctgtcccataaaaaaccaatctagtactggatgtgacacattctactacatgtccagattcgttgtactagctagaatatgtcacatccagtactagattcacttttttttaggacggagggagtacggtgttagagttttagtgttaaggtggagtcggagctgctgcatcatatcgggttcagccaataagctgggcaacgataacactcaccactcttgctctagcttcttggagatcctgcacttctcaagggagtcttgggtgaaagctctgcctggtcttccaggatcggtgacatcgacgcctgtgggtgccgtttcctccttggagatgttaccttgtggactctctccctttcgggtgaaaaaccagtccagtttttgggcggacgtcggcagcgacctctgtcgttgttcacctccttggaggcttcgccttgaaggttttactcttccctcaatcatttctgtgggactagtcattttgtcacaggctttttatgtcttgtgtatagttttgccggtttcctttagcaaactgtgcagttgtatggttttcagacccagttttccttataaaaggatcaactctcttcttctaatatatccgataaaactcttaccgtcaactgtttcaaaagattaggaaaatatcgatgcaatttaaccaatcgaagaacaagcctatctggtacgtaaaaaaagagaccaccttgtcgtcgacaccaacgggacctcgtacgtcgtgggccagctcgccgtccgttgtggcagagagagatgctcgagtccctactgttcacgggggtnacgaggttgccgtccagacgacggcagtactgtccttgacagcggtgaaccatacggagaaggagaagacattgttgccgtcgtcgcccacctgagtgaagccgcagctgtaggagaaagtgccgtacgagagtaccggagcgttgcccttaaatttaggggttgtttagatggtgctaaaaccttttcagtctccgttacattgtatgtttggacgctaatttgaagtattaatcgtagactaataaaaaaaactaatttcatatataataactaatctgcgtgacaaattttttaagtctaattaatccataattattaaaagtttactgtagcatcatattgtcaatcatagcataattagactcaaaagattcgtctcgtgagttagttaggaaatgagttttataattagtctatatttaatactctaaattagtgtctaaacatcctatgtaacaggcaaacaaccccttattcctcatgttcttatagtatactgtacacctggatctctcaatcgatcccctttaccagtacactaaacattgatctcgccttaattaattaatttcttgatctcaagaggacaacagaccccctggcaaggacagatcgaaaaacatcgctcgccgaaccattcaattctcactgaaaaagcttaattaggagtagtagctagcgtgtgaggaagattcataaccatatatcatcttaattattagccttttctgatttagcttattcacttaactcttcattactaagctagctacacgaggcgtagctagctagtacaggccccagcgagcataaatagcagcgtcccctgcttcctttcctcgtcgtcctcagctctcatctgcatgcagttcacttcacacacaacacggcttagcttgctcagcttcactgatcttcttagctatagctacttcactgtgcgtgctagctagctagctgctttgcataggttgatcgaactaattaactcaccaaattagcta

SEQ ID NO: 2269 - DNA, 325 bp, Oryza sativa
agatgaggaggtctcacactccaagctcgcgccacgtgtacggcgagagctcgaatcgatcgcgagacggataaccatccgggggagtgtgggggctccgatgcgggacacctggcgcgggacaaaaggcgaggtggggcccacgcgtaccagggcacgagaccgtggtgccacgtgtcggcatcggctccggtataaaaggtcgccgcgcgcgccgttgttctggaacacacacactactgcgactgctagtgctctggtcttacattcgacgaactgatcgatattcgatacgacgtctcctcctacctggagcttgggaaaa

SEQ ID NO: 2270 - DNA, 2000 bp, Oryza sativa
  misc_feature (591)..(591): n = any nucleotide
tatattgcaagatcattacgtagtattccatgctacatgatgaacgcatatgcatggtggcccatatatatgaccgtatctcactgcctgattgatggaactttgacagcttctagtacagatcaatcagtgttaaactccgtcccatactcccattcccatatatttgcctgtgttctgtatgctaatagtatattggaatgattcaggatttattctgtggaataattcatgatttctgacttactgttactagtaagacaatggtaattgccaagttcttctgctatgatgcatccattgaactaccaatcagatatgtacttgatagtgcaatgacaacgggtgtgtggtttcaatcttgaggtcccatgtttaattcttaacacgctcacaaatttattcttaaaaattgtttggagggatgtctctccctccaaatcttgttttttttaactaccaatcaaggaatcaacacaagaaaatatgttcacaatttcttcttaaaatttatttggttggaggggacatctctttttccaactctcggttttttttttgtttggtgaactaccaatcagggaaccaacnccagaagctaaaaaccaaactcaccagtagctatagtatatgcactatgcaagctatatcgatttttttttttgaaagaaagaactgtaagtatcaatttatttattttttttgccaaaactcatcagatcaatacatgattttgtcagcaacaacctgaggaagaacttgagcgcgatgtcggccgcgggctcccccttcatggcattccacgcgctcagcaacgagcttctcttgctcctcgctgaaggtggcagccgcagccgcaggaggatcctcctccacgaccacggccgcaggcgcggcggcggtcatgctcgccgccggtgcatcgctgctgctgccgctgctcatctcgtcctcctctccgacaaggaaggcagcagagagcaacctatcgacgtctcgaaaggccaggatagtgggcactgcgactctgcgagtgttgcattgtatccagcagagagaggtttgatcacctcatcacctcaccaggtagcaaaaggccaagatttcgctggattgacgtccggatccatggatggctcacgatcaaagggatacggctgccgttatcggcaaagggcagagaatatctgcaagtacagacaggcaacaccgacagcagaagcatgcaaccgagccttctccttgaaactttctgagtaaatttcgcaaaactatgtatacttgtaccaatcataaaactagcaagaccgtgtatcatatggttttgtgataatttgataaaaatatctgtatttttgcaaaatttactacagcattttcccttcagtttcactggatcttacttgcacgaaatctttaaaaatcgatggtggatgttttattttttttcttagaacttctaggacttatttaatttattaagtgtcatgtagcaatttaggagcgtttttaggatctccacgtgccggttcaagagcgttttatagaaagtttaatggatttttagtatataatagatctttgtatccttcggtttcacttattctcacttgcatgaaatcttattaaatttacataaaatttcacattgttgacgctataatcaaatccaaatcattcaattttttaatttccctttttgttttgaacatcaatttgcccattttatgtctgtcaatttgtccatttttttttgtttgagataggaagagcagaagctaatttagagcagaggagaggaatgggccgcccagcccggcaaccaatttaagcctgcaacaccgaggcccataaggcccatatgccctcgctctcagcacgcgaggcctccgatagcgcgccgccgtgtccgaatcgcggatcggatttgggcttccgttgccggcggcgctagggttttggagaggaggcgaggcgatcggaggcgggggatcggagag

SEQ ID NO: 2271 - DNA, 2000 bp, Oryza sativa
atcttcacagtgacagtcaatttaatttacacacattttcttttgccttagtgtaggaaaaagttaaggataattattagttgattatcctgtaaatttcttacccttcatgtttaatttcatatcaatctaaattctagagttctttggctctcacggcattttcatgtaataaatacaaatgtagtctcgtgttgtatcacttgatataactatctgtattgagaggtaaaatgaaaattatgttgccacacttcctaaatccaattaataagtgtcttctgagcttccaatatgttcactgatactgatttgaagatatcctctgaaacatttttttaaaaaaactcactaataccgatggattgtgcttggacaggtccattgcaattaatactccggatgtgaacctttcagcggagaatgttattgccacaatatgtcttcttttgactggtagatttgtatgatcaaatatagttgtatcatcaccatggacattactctgatcattatgtaaaactttgattttattttttatatgcattggtgcttcatctttagattgtaaagtgtaagagttttgttctcagcagaatctgtaaaacaatgtatggaaaattactcatcaacggcattcactgcaaatgtattcataggtttttttttcttacataatcattgattcagcctgaaaacaaatgattagtctacactaatcaagcaatctatatgcaggcggcgcgccattggcgtgccccagcatctagtacaaataacgagcagatgttccttaagagtatatgtcccagagtttgcaatagttccccctgctcatacagctctacacatccgcagtggagccaccgtggcgacacggcatgatgcgccgccgctcgacgacggcgacgggacgccgattcaccttcttcggcgtgtcgatcacctggatcaccctctgcttcttggcggacgcggcctccttgtagccgtcctggagcttgcgcctcgctgccgcaagcttcgcgtcgtccgcgcgtgccggcgccgcctcgtgcttgttcgatgctgtcttcctcggcgacggcgctggcgccggcttgtgagcggccgccatgtccgtcttcttggcgtgatcagacgcggaggcggtcttggtcggtgccggcgccggcggcttggagctgctcctggtcaagtgctcgtcgacgatagccttccagttcttgtagagcgcggcggcgaggccgcgcaccttctcggaggagtgcttcctcctcaggccgctgatggtcttgccgatcctgctcgcctccagcgtctcgaacgtcatcggcgtcgaccgcagcgcgcggagcaactcgaccacggtctcctccgacgagtcggagctcggcctgccgccgtcttccccgccgacgagcttgcccttgatcctctcgacctcctcggccatggaagatttcttggcgcgtcggagctcctgctcgtcgcagagccgaaacacgtcctcgaacggaatgtcgcggcccgcgagctccatggtggcgaaggcgatggcctcgtcgagctgttcggctcccatcgagcgaaccatctccctcaccgccgccgccattgcctctccgccggccatggcaaagcacgcgagatcgctcagattggagcaatgcagcttttggtggaattgggaatggttggcgccaaatttatagggaggaagaattgtctcttcttctccgattcgaattcatggcgagcaccggactcggactccgactccgattcggattacgctggaaacacgcacgcagtcgcgtccatgagttcgaaatcgaatcggagaaggagtacaagtatttcctcccgataaatttggcgccaattccttctccgcgctcatccaagaaacagagacacgagtggaagcagagcttttgcttggaatcgatctttctttcgatctcgcttctcgcatcgcgttcgggttgctgccatcc

SEQ ID NO: 2272 - DNA, 2000 bp, Oryza sativa
tctgtgcgtgtgcgaaataaatgcatagatcgaggggggtgagcagttcaatgtacaatcaggaacatccttcagatatgaatttggcctgtttgattaaaattttctgtttcctacatacatttgactttgattgcctatctaacaaatatcacaaataccaaggtttttaaaattgttagctagtactcaagcagtcacagacctactactgattatatatttgtatgccctaactcgcctgattgtgtagcataactggaaatctagaactatactgtaatagttgccttatttatgacctactagatctgttcttcctttgtagtacactgaggaatatatacctcctacatgtattagatgttattagcagcgtgtactgaaatagcccccacgtgatctattagatgtgttaacactttggaatccttagtcttgacagccttgtgctacaagtattgtgcctgaaggagatacgggtatgtatgtggattgtgattagtcctattgaatctatgcatagaagagagaccatcaatactatttaaaaagaggaattggttctggttctatgcatgatcagatttttcattaatgggtttagaatagaccatctacacatgtgctgtttataggattttttttgtgtaaaatattgcattctttcactgttgcatatgcatatattagttatcggttgatcttgcattattatatgtatacaattatttagattagataatgattacttgtttaaactcaaaatttgtgtatatttatttcgatccatcacaactcatgggatgtgatgctagtttatcataatttaaaatgtgcatgattatccttgattcagatatctatatccattgccatcaacttcttatttgttttgatgcgtgctcatattgatcatgcttttagatagcaatatcatacaagtatggtactgccattattcaaatgtttttgagcctcagcctttcccaccccttgtcactgtcttggggcaatatttaactattgaagaattaactatgctttgcagggcacctgtggggcctgtttgcaataagaaaccccgtggctactaatgactactaatacaactcacagtcttaatcgtgtgtgttatcatacagggaggctttcagacaaacattgaaaattcttgctgaccatattattttctttttcataaataaacactatcaagggtcaccttttgtgggcttgcttatttgcactgaagatgaatttggaaaggtactaaagtactagtggcttagaatttggctatgcaaggttagcaggagaaccggtattgctaatttgtgctaaggatgaaattggtaggtgctgaagtactaaatgatgggagtttggctaggtaaagcttgaaagagaaagtcttcctaggatatgatagataaatcaaggaatttgttgctcactgtgcccaaaatcttaatacaatgatacacaaagcttatgtgtattcgcgaaaaatgtgcccaaaatctaaccaaccaactgctaaccttgctaggcaaggtaggctaaggaaccaaacatggttgctaattgctattgctttctgatcaaacattctgttcgatgattttctcctgtagactttattacaagatccttttagttacacttttgtgatgcatcatgcatgcttacagttacttatatctgcaattttttagtatgtctactaatggctgatttcttcaattatgaattccctgctctgctgctggtacataaaactgatgctagcatcttatgtcggatgactatttttcagaacaagtttagacattgaacttaaaagtaaaactatagcagatcgattcatctgcacaatttattagtttgtaacatgggaggctaggactattacctaatcgagaatgcaactgacaatgtttgttattcttattttgcagtgttggaaatatcataagttttgggacaagcaagagagg

SEQ ID NO: 2273 - DNA, 2000 bp, Oryza sativa
  misc_feature (836)..(836): n = any nucleotide
actttttaagtatgtgtttgaccattcgtcttatttaaaaaattttaagaaattatttattcttttcatatcatttgattcattgttaaatatacttttatatacacataattttacatatttcacaattttttttaataagacgaacggtcaaacatgtgctaaaaaatcaacggtgtcaaacattttgaaacggagggagtatcttttttttcccagcctggctcgagaggcatattgccttgccaaggcattcaaccatgcccagcccaagctcaatactccctccgtttcgaaatgtttaacaccgttaactttttagcacatgtttaaccgttcgtcttattaaaaacttttgtgaaatatgtaaaattatatgcctacataaaaatatatttaacaatgaatcaaatgataggaaaagatgtaataattacttaaattttttgaataagacaaacggtcaaatatgttttaaaaagtcaacggcgtcaaacattttgaaacggagggagtatatcacagctcaggtgcccaactaagcagctctcccaagatcaccaaccattgaagccttaatttgcacgtagaccggtccaagccagtgcacttgcactagtgggaataacccgcatttagcgtggagcggcatgtgtgatttgggttggaaatgggagttggaagcgacggaacgcgaggcacgagggaggtatgtcagcgtcataacttatcccgtcgaaacggaatcccgtcgtgtagtagttctcatttcactcacctttcgctccattaaatttttttttaacggtgagattgccgagtttatcggcggtcgnaggcgcgcacgaacgctgaagcagtgaagcagcatgtcggacccgccggcggacagctgcgacttcgccgtccacctcgtcaggacctcgcgctccgcccaagccatcttcttcgccgccgtcgtggcgtcgtcttcctccactccatcaccatcgtcacctcaccctcgtcctctgctgccgcttctacgccgatctcaagcgcccgccgtggctgcgcacgcaccggcttgctgctgccgccaccgccgcgcccgcgcacaagcaataggctgtgatggcgccggggcggcgaagagatgcggggcgcactcgccgctggtggcggcatcccgagttacgcgcaccgcgacggcgacggcgacgttgagtgcgcggtgtgcctacggcgaggtggagcagggggaggcggtgcggcggctgccggcgtgccagcacgtgtgttccacgccgcgtgcatcgaccggtggctgcgcgcctgcgcgcgagcgccacctgcccggtttgccggtgcgcccgccgccgctggaacggggtccacgcccaccggaggtagtactcgacgtcaatcccttcctgatgtaagttgcagctaatcttcgaagaaagcttcgatgaaaatttgtaactaaacggagatggcgagatcttgctgagacttttcaaaagtaatttgaatccaacaggttcaaaccaaatttaaacaaatttcatatgattcgataaggggaagacactgcagactgctctactgcaggaaatttcttcagaacttttggggtccaaatctagctgacccgatctcgtcaacgtcgccgcccaaatccaacggcacggtgatgtgacacgtgggcagggaaggctacgttttcctgttttccattgaatccaacggctctgatctctcctacagacaaacagctcagtgaaggcagcgtacgcctttttgccaagtctttgctctcgtcatgtcgctaccaaaatgagatcgaaatgtggacttaaaatcaccaaaattaatcaacgaaattgaccgacctgatcgcttgcttgccgctcaaattaaccacacgcatttgcaaccgcgtttttggttttgataattacttctgcgattgttgtggaggaggaggaagagagaggaaagtgtcgtgtcgtgtcgcc

SEQ ID NO: 2274 - DNA, 1630 bp, Oryza sativa
  misc_feature (10)..(10): n = any nucleotide
  misc_feature (981)..(981): n = any nucleotide
gtaagcagcnaagcactaatccacgtcgtcttccttgcttgcttctgtgtattcatgtcgtcttccttgcttgcttccttgcttgcttgtcttccggtggtagtcggtgcgtgcaggggacggctacctgacaacgcgcccagggcgtgggccgcgctccacaagctctccgtctgctgcccggggctcctccacgccggcgtcctcctcgagccctccgatgacggggcaggcggtggcggccatcgcctgcacgccgccgtcgccgctccagccctcgcccacacgccgtcgtcgccactccggcccccagccaccgccgccaccaatgggtccgaaggggggagagaaaagagagagaagggagagagagagagggagaaggatgaagggaaggagaaaggatgacatgtgggccctatatatcggtgggtcccataatatattttgtgtttgaatgacagatgggtcgcacagatattttttttaattctaatgccacgtaggtgccacgtggaatgaaaatcgggttagcaccgccacgtcagtgccacgtcagcaaaaccgccctccaaaaccgttagaggagtcaaattgcactggtttcaataattcggagagtcgtcctacctggtttttaagttaagggtcacgaattagatttggtgaacaattaagggagtctaagtggactttttcctattccaaatagaaatcgttacgtccgtttggtttaggtgggccggaccggaaacggataccccgtaatcaaatcccggcccagtagaaaatgaataccaccgttccattccatcccacgcgtaacggagagctctgcccggcgctcctcttgcccagctagcggcggcgctcacccgctccgcgcgcatcgccgccacggctccccgagcccccggcgccgctggccacgctctcccagcctcctccaccccccccccaaccttacccgggctttgccgnaaccccggggttttgccctgacgaacccgatttagcgggaagaatatttgttgggttttgagccctagatgcatcccgtggagaatatttggtgctattgttgtgcagggctgcatcgcgctgctggcccgccaagcaaaggcaagcttgatctgtttgtgcactgactttgatttgtttgtgagctgaatttttctctttctttttttttctgttaaatggtgtctttctttcttcttctcgtttctgttttttttttccttccagcgagggaactttctttagttatatgaagcataaaggactaaagagtggctcttcagtactccaatttttcaatttgttgatgcatattgtcctacatttaccttttaatttagtaatgtcatgccccattttatacatcgacgatgcttcaagacaatggttgtctgaaatttgtaatgaacctgtatgctaagcactgctcagttaagtaggcttttcatacatagtctaaccaaacgccgtaatgcaaatggacaatgtagccaaacacatttaagtggctttggacatgtaaacaaagctattattcgggctccatccgatcaaatttctgctgcatctgatttcagtaatgtcattgctgcagaagccagccagtgaa

SEQ ID NO: 2275 - DNA, 2000 bp, Oryza sativa
  misc_feature (13)..(13): n = any nucleotide
  misc_feature (44)..(44): n = any nucleotide
tatatttaaattntctatttatttcaactgtgcatttattttcnaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccatgccaaccacaagccagcgtgggcaacggctttaccttttgtataacatggttcattgcggagcactagactgagaagtggcggagataagcccacgggggtcgctggggagtccatgccttgttttataagggggtgattatgatccaggaaaggtgcgctatggtggattgtgttgtgcaaggggtattgtcacagctccttttcgaggtaccgtggtggtattgagggacatggtgatatgatgtggggctgtgtcttgtgggtacagtggtacacctctgatcagagtaaaactattcgaatagccgtgcccgcggttatgggcgggttgagcaatgtttttcgtgattagtctcacacctctcacaataattatagatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttatttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaagatctaggaggagaagacgtttggcttataccccagttgagctgcctgtgggagtggagccggagcttcgctagattttattttccgctgcagttttcttcatggtgaggactaagtgcatcttaagtaagtatttatcgttttagttaatttgatgaatttgtatattaaattgtcagtttgtgtacctcggctgattcctggacgaggattttatgcacaaataagttcggaaattactagtgaattttcgggcgtgacagtagtactcagtcttgctctcttttccctcgcaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgtatttgtaatcttttatatttttgtaaggcgtgggtctgtatgtcaacaattgttgtttgtgtaccctggctggtcctggacagggatttaatgcacattcagcttagaaattcgggttcgagaatttctgggtgtgacaccatgtcacactgagatataaagtgagtgaggagtcataacattatctatcttgccaaccatcaagtatctgtgatgggcaataaagttactttgacgatggtatacaaggacatctgtggaggcacatcacgtaacttccaaatgacatgactcactctgatcccaatagaatatccaacaaaaacaaacactctagagcaaccgataaggaattcaaagaaaacccatccatcgcatctataaatagacaagcacaatgtaaacccacttcatcattctcacaactcaaacattacagcaaaagcataagaactagaaacccaccaca

SEQ ID NO: 2276 - DNA, 2000 bp, Oryza sativa
gatggcgggccaaaagtgaaagagagagctttgggcaggattcgccccaaaaagatggagatgattaattttagttttatcattttaattaaccctgaaattggttgttgttgatttaaaattataggttgctctgaaaatttcagtaaaaattgagggaccaatttagagcatggagaatttaagaaaaatacaccaagccactttgaatttttggatgtattttagtatttgaaatttatttgagacttttattaatttctattattccttttagaaagtgacttttaatttgggatggatctatcaggtgtgacataacgataagagagctccaaattaatttcaagacccaaattaatctcgcgttagatgttttctttcaccttcgagtagacaaagagctctctctgtgtgttccatcttcctttggttttggttctccctgagcagacttgtgtccgttcttctgtttttgcgctgattcagttgttcctcgatcctgaatacttgcacgcatgagtatttgggataagcatgcctccggaacgccatccaccaccagagtacctgcactggtagacatgcggttaagtttgtatcatttgtttcaacatataataagtaaagctaaacatatgtacttctagcttgttgatgtgtaacataagcatggttatatacaagctagtgatgttctcatcagtttggatatttataaaaaacagcaataatgcacacgctcacatatacacatacacttacgtaataatataaatacacacacatacactcattaatacgaatgcacatgcgtatatactctaacccatacggtccaatatatgccttattacacatcactctctagtctctacttgcatggaagcacgctttatctaccaaccagcttgttcagtatgccaccatatatagattatggcacacatatcctccataaatcatcattttagtatatatttgctttctattcttgtatgtcataatgtcattcatcaaacttgtagcttgacaatgtacgtatatatagagggagagatatgagatatgatgaatcgaatttgaagatgctcggcatacccggagcatgtctaggcaagctgttgtccggcctggacatttctataattactaaaacttgaaaaaaaaatccaggaagatattaggcatttgtcattttgccccctatgttcaatttttgtgggttgttagtttataaaaatatgcatagtttatcaagatgggactgtaatctccaagcttgggatgagcagcatatatattgtgatggttgatagcatatggcttatctcataattcatgacatcacaaactattgggtaaaggcattataataggttatagcaacaaatataaaattatgcttagctgtgcaaaattatctaattgatgactatttctaaatacacatcatgggcaaaaaggtgcgaaaagttagtggcagagtacataaatttgaaaagaattataagtagttccgtactcgacatataacaaaactaaaatattcacacatttcatctccgttactttatgcggtgtataacatgagtgtacaagctagacaaaaatgacaacaaaaatacaacttttttgttgtaaaagaaaaacaaacttatcccatgcagaaactttatgacgcaggcacaaataaagccaagaaggaaaaacatctaaagtgtagggatagaaaatttctgaactaaaagaatatgcatttttctacaaaacacaataaaagcctagtatacatatagatgtcttgttaaccgactttgtgtatatatacttttttttttgcacaactcaatacactttataggatgtctattgtttatactccaagtaactttgtaactgccttacattccaagcggctttttcttggctataaaagggacctcatgtcttgggaaatcacatcagttgagtttccattatcctttcaataaatagcc

SEQ ID NO: 2277 - DNA, 2000 bp, Oryza sativa
  misc_feature (168)..(168): n = any nucleotide
ttgtgccaaaggcgaatctttggtggcatgaggatgaaataagttctaagttattgcatcatcgccttttcgatcttatggtcccataataattttacatagagttgtgtgctactcattcgtgtattcatacaaataggtccatcatgtgttcatcacattatatcnataacacttgaatttaacataacaatccatcactcataaaatcaatccatcctctataagcattcgaaggaaagacaagtataagtgttgagtgagttggagtgatgatggtccttgtcagattctatcatcgtagtggcataaatgtatgcaatacccaaagtttcaagtgagaaaagaacaaatctcacattttgagcagtggcatatccactgtgtgggttttgtcaaccgtaccactaatagtttttctataccaacactagttaaagactacgatcgaaatcctggtgataactatagctcctaatctaatggtcggttgctcgttactagtccaaagggatatttttttatcagttacgtcttattttcttacaatattactatttatcatttcacttcagaaggggaaaaaaactcgccttcaattttgaaattgtatcacagaaaatgagagtttttatttttccattgtctgttaagaccttgtaaccagctgaatatcatcttgctaggataccgatactcttcttattttttttatcgaaaccactctttgagacctgtgtggccatacacaagattacctagatggtgacaaccgatgtgcgatatttgtccgcacaattcattcacatatatacattctgacatagagtctgcatggattcacgaaaccaaatcaccttccaaaaccgctatgaagtccgttccctctgcttttcacgaaaaccatcttaaaaaccattgactagccgtgaaattcaattaacttttaccaaaactttaaaatctagttaaactcttttttcctagctcgaccaatttactgagcggttttgtgatctcaacccaacaaaaaaacctatttaagtttccgcgaaaaccaagtggtttcgtaataaaccatctgcgcacacgcacagaagcccacaaccttccccgcgcgcgagtaccagcctcgtcgccgggcaacccaaacgtgcccccgcgcgtgcgcgcgcggctccgtgctccgctctccagccacctatctattctagccccttacgttacggccttttacgttactacgtacagctaatctaccagctccgctttccatgaacaccgccaaaaagcccaaaacctcccttgctctttgcagctcatgctctttctttctttgcccgacgccaaattgccaatgcttcgattcacgccttccattccattccatcccagcctcctaacaaccagtagcacattgcttgcatgcctaccttcgaaaatcgcagagcacatgaatgcacctgcccaggaccacggccactgtccgtttcttcctcctcgagaaggagcaactgatcgaactgcgcacgcacgcagtagctagcatcgcatcgcccgtttctgttgcgagaaagaagcaagcaaagcaaagcgaagcgctgatcatgcgcggcacggcgcagcctgcggattcagtggcatcgtgcagccggtattgcagatgagacaagccgggagatggatgccgttggtggagtgcccggcggggagcggggcttgctagctgtgtggggggcttttcgtcgcgaggagtgcacgccaccgtgcaggtggtggacgggacggaatggctataaaatgggggcgccattgccaagaatcccaagaacaccagccaggaatcagaagccagaagcagcaacgctcgctctgattctttctttcctcctcgagctaggtgcgtagttgtcatatttgatcgatcggttttagttcttcttgtttaattttgattgcgcttgtagcagcaggaagtagttttaattttggtgtgatcg

SEQ ID NO: 2278 - DNA, 273 bp, Oryza sativa
  misc_feature (256)..(256): n = any nucleotide
cgtcgcgcccgccgcgtagcagttgcaccgcgcgccgccgctacccgccaactcacacctaccaccctcccccctcccccgcgcgcgacgtgggctcgctgcatgagcccatgggcggacacgtcgcctcgccacctcccccccgccgccgccctccgccgagcttaaatgcacccccgcttccgcctcctccaacgccattccccaccaccacctgtcgacggcgtacgactactatctcggtgctttgttgctngcttcttccagctagcc

SEQ ID NO: 2279 - DNA, 2000 bp, Oryza sativa
cttgcgtgagctctgaaaccagcttaccaccgttagttccagctcggttttctttttttccccttaaaggtttcatgcgtatcgtgacagatgttacataatgacaaattccccagctggagcacctttatccctgctgtttgcatgaaattagcttgtcttgtagttccctccagcaaaaagaagtctgaaacaaaacaacatttcgaaaaaaaggcatccatgagttagcatttctacagttgtctatagaggggaaggctgcacgacaaagtttccaggcttggaaacaacctcttatgtaaaatttttcgtatgtatcagatgatttgtttgcgttacggcatctccacctaacatcaccttcatcatgcgcctatggtctttctcttgcctgttttatacgtaaaattggaaacgacagaaacttttgccatctttattaaaggaaggcaaatatgcaaatataggcatcaagatcacagttagtggattatcatctttgtaggttaacatgtcctaccccaggggagcttatactcaagtactccatgcattttcatgaaatgagaaaaaacgatttttaagagaaatgtactttcttgtatttatgccaaatggcaaggactgaaagggaaaaactaagaaagggaacgttacagtaaggctctgtggggactggggacttcagagaaacgtgaaccctgcttccttcctctgcatgaacataacaccagaggtttccagcctttcacacagttgttgatggcttcacacaattcatctctacctcctgactctttataaggacccccagcatcaccacaattgcacaagtacaggcattagatccacaagaacacttgggcaggcaagcacctctttgatctttaagccgttgttatgttctatttctgagcatatggtttctagttatattctttttcttcattcgtttcatatctttgaagtgttgatgcaaatgcggtgaacaactatcaactgtgtactctccaagtgaatgcgaataatcatttcctgtgagaattgtgggctagataaacgaatgaaatgctgttttatctatgtcatgtgtggaaatttagttaattttccggtctttttatgcattgagatgggtatgctgtttttttagttgggtcccatcatcttgagaattctttcaaatttccttttctttatcctatataaaggatagagaaggcgtatgcctaggtgcaccaaccctgaaagttttattctaattgcgggaatggtttgtaatttttgcttgttcaggttctttttcgtggcctttcttttttttccccttattttgcttagtctttcacagtccaatttttgggaagtagtatatcttagtttggtcctaaggcaccatgttgtactgcaggaaaaaaaagagtaattgtattctgttttttccttgattactatatccctgttttaattaattttgtgcctttgttgtttgatgttggaacttcaatgcccataattagtcatttgacttgttttgggttttgacgctatcttgagtgccataggaaactggtagaatttagtaataattttatatagactgaatgttgagcccaccacaaatggtttccttctgtacaagtatttaataactcaagcacaggaaacatcagatctctaatctaaaggttaacaatgggctcaagcaggagcagtagttcagctctatctgtatatttagaagggctggatctacctgtccaccagcttttaattttaccctggcagctggataacttcttgtctgttaatttcatttagtgctgtgttattttcttcttgttgttcaggatggatgcttttgaatttctggaatttcgtattttgttctatctctttatgaaatgacgttatggcacactttttctgcatattcttgatgaaaataattacctagtcatttttttagttgcaggtttgtctgggactttgagtac

SEQ ID NO: 2280 - DNA, 1161 bp, Oryza sativa
  misc_feature (3)..(3): n = any nucleotide
  misc_feature (12)..(12): n = any nucleotide
  misc_feature (15)..(15): n = any nucleotide
ggntgccgacgntancggcggaaaatgaggaagggaaaggcccgggacggcaccatagctagccttgccgcatgtgggttcaccgcggaagggcgcagccgccgccgccgtctccgggtgacgacttggaccatccacaacgaggtgccttccgacgccctcgccttccttgtcgtgccgtgcgaggtccccttccgtgaagtaagggtacggctagcagagaatgtcggtgcctctgctgccaccatcactgcagtcaggtacagcctcgcgcgacgaggacctgttggtgtcggtctccttcgatgaggagctcgcccacatgcgcgacgagtacgaccgtctcagggcaatgcatccgttcgcgagcttccagctgttcgtctccaccgctgttgcttatacctcctcccgtcgcgaggcgctcgaggtggcggagttcggccgggctcgacggcggcctctcccctctctgccgctgccggcctatcccctctttgctatcgctgaagagaagagaagagaagaagaaaagagaagagaggagaaaagaaagaagagacttatatgtgggttccataatttatttttttaattttgctgactagaataacatgtcagcgaaacccgaaaccagagatctatactgccgtggaatcgaaattgcacggttttatatagtttagggataaagatttctggttttggggtttcgggatgtcatacaaacttgtcgtaaagttgagggatgactgatgaacttgttccttcagttacacgcgcacgcatggtgatacggcccacgagagatcgggcccaatacaggcagcggcggccgaatgcagcagcgcccgtaacctcgtacgtatcgcctcgtgggaagcggccgaggccgcgcgcggcggcaaccacagcaaaccacaggtgtcgctcggcgtccgacacgagtcccgcatgcgccccacgcggcggctccagcacccgcctccacgccgccccatgcacggcgcctccccctataaaccccaccctcttctccctcctcaccgtcgtcagtccacttctcactagctcgtagacagtgctgcacgtgggttagctacttagctctttctctgcattgctggcttaattttgcagctgcaggtgtgctcgatcccc

SEQ ID NO: 2281 - DNA, 1031 bp, Oryza sativa
  misc_feature (7)..(7): n = any nucleotide
  misc_feature (16)..(16): n = any nucleotide
  misc_feature (114)..(114): n = any nucleotide
ttttttnggttttttngggggggggggtacccaggaatagcatgcaaaatttgcaatctcaatgtttctagttgatacttgtagcgttagttcgtcacacatgtattggactantggtagcaccatatgggacactagtaattattttttccagattcgtcacaattttgctaccaattaattaggctggtgatgacacatatagatatttgtgcttctgcaagcaagtaatctaagtacattttgagcatgtaaatcctcctggctggtgctattttccttttaaacgagtggacaaataacaagtgcagtattggcgcgattaaattgtgtgaggtaaattaaaaaaaaatctccacatttcatttttgtttatacttaccagtagcacattgttctccttactatacataaatatgtgaaccccttaattaagcccacaggacaatgtaggtttcttggccggcataaatagctaccagaaaaaagctgttaatccaaaattacaaagccatcatttccaaaatctttatccaaagaattcagttccaaatatgtctcattagtaatggatattaatccatcccattctcacactcaaagagatcaacagaagtgtgcacacaaccaaaagggcaagaaacgccactgcacgcagccaaaagttcagcaagcaaacacaccgagttcttgttgcacccggcgcccgaggacgtggtttgcgcctccgccgccggcgtgatcctgcgaaaccggcgtgtccgggctccaggagcccgcggcttcgtcgcggccgccatggcaaaaccgggggttcgctgttctttctttgcctgacgaaatgtgtcgtcaggtggtgcactcctcctcctcctgcttctgctgctgtctgaaaagcctataaattggaggatttgatggctgctttacacacaaatcatccatccatcgatcgatctcgcattcattagcttgaattagctagttggttagtgtgatagtgtgtgtcgatctggtgtgttttgatcgag

SEQ ID NO: 2282 - DNA, 2000 bp, Oryza sativa
ttgggaacctggacaaacgaactgagccttagaagcagtagcggcatgcacgacgatggatagaaaaggagaggagggatctagccacactgcttggatctgctcgtgagcaccgaagctcgttgctcacgccctcctcgggagttgccatggcatgggaaagagaggatgtccacggcgacgatgacgacgaagcagcgacagtagaatctcatcggctacacgcgcctagatccgctcgcttaccccgaagctcgctacgcctgtggcctcctcggcggccatcatggcataggaagaggggccttccacggcaatggcgaagcaacaacaacaaaagttcgctagtcatctgctcgccgtccctaaagcttactacccatgcatggcttcctctgcaactaccatggcacaggaagagggtagatgggaaaggacgccgagagagatgcagcctgcaggggacgagagaaagaggagagagttgagagaaaagaaagagagaaggagaaagaagtggagacaaggacatgtggggccccacatgttgactcaatctgtttgattaggtcaataagccacgtcaataaaaattatcctcaaaacgattgagtgattcagtttggactagttttaatagatagaggattaaaatatttgatgttatagttaagggaataagggatatgattcgcattggacctatattggaaggtgtcaatggacttgtttccacaggcaaatgtgcgtgcagccgcatggcccgagcacaaaactgagctagcgagcccattaagatcaccaacccagttattttcatccatcgcacttctagattggacggaacctatatatataccggtggtggttgataatttgacatgacgaagttaaccaccattaaagcatcatcaacatattgaaaaaaaatcttgccaaaaaagaaaaaaaacagacccacaatatattccatccatcctaaaatataacaacttatgattaaaaaccgaacatctataaaaatacatgtctcatgtctctaattgtcaggtatagctcgtcgataattttcattcgatgcaaattacattcatagttgttcataatacatttttatgaaagttattaaaggttaaattgtactgttggagatcgtgacattaacatgcactagaggaagtatatatgtacaagtaattatctttatcccttgcaacacgtgagtattatgatagttatattaaccatacgtattatctttgaaattgaaattttaggttcttgaattatatctaccatcatcttgtacacacatcaacgaccaaaatcatccatgttagatccaaaatggcatacatgggcgcgcataaataataaaaatatcacaaaattctccgtataccactttgtagtttttatatttttctggaaaaagagtgtccttatctgccgtcgtagaaagtaatcctagacgacacttcacttaatcacttgttttttgtgggtggtattctacctcaagagtcattcatgctcgagtgtacgtcatgccgtcatgacatcattcctcgttaattactcatcctctaatcactttcttctttggctgactcaaaaaagaaaaacttcttttcgattcttttaatttctctcacactttgcgtttccaatagagaatgaatggccaaacaaactaaagtgaaactcgtcaaaaagaataaaaaaacaaaaataaacaccccaaaaaagattgtactgttggagtacaacacgagatgagccaaacgtgagggaaaaataaaagaaaaaaaaagaaaaaaaagggtgaaaatgaaaaaacgccaaaggccgaaagacaaccgtccgctttagtttctcgtcgtctcctcatttcgcacaaaagaaaatttatttattcatttatttattgttcgctccaaatgccaccgcttcgccttcgccttcgattcgccttctcccccccgaatccaaaccctctc

SEQ ID NO: 2283 - DNA, 2000 bp, Oryza sativa
  misc_feature (1326)..(1326): n = any nucleotide
agtacacagatgaatgtagcctcatcttctgtactacggctgtactactgcatttgggttgtctaaattcaatgggagacaaggctacgtgtagcccatggacgttcctggagtagcatcttttgattcagaaataaaatagcactccattattcgtactgaaaagaagtagtggcaacattttctaattctgaagattcagtttgtttccacttaaatgaatgggtcattttatatagattattagtaaaagtactaaaagtaagttattcacaaaagtcaaattttgtgttttatgatttttcaaccagccaaagaacattgaacattctaaaatttatgcaaattttggtgaaagaatagaacattcttctgccggtccatgcaacttttccatggtaaaaaaaacccatatcgaacttatttcattatagtataccataataactctgtaaggctacaactgcatactatgcctttccatgtgagaagcataggactatacaggtggcatagtttagtacagtgcccttccaagtttcatgtgacaagagatagcaatcactactgcagttactgcacaacttctgatttgttgagtcatcattatgtgttaacccttcacagaattttaagctttgaaagaaataggtgcttgatgatcttctaagcattcatattttcttgacctactaaaattcatttgtctgtttttcccaaatcaagggattttatgcgtaaaaacttccccacaaaattcagttgaatggtgtgtagatcaagtaaagctgttgggcgttagctgagtgtgggatcttgctgacacattttattgtttagataatgaaaatcttttatatcctcggtctcaatcatcagacacactaccaaatttagctgacacacttgctttccaatttcatatgactaatgttttatctatgcaacattttctctacctgactaaaatgcatctgatagcaaacaattcgcttgttttaaggcgtcaagaaatcacaaaacaagaacaattaaagggccaaaaaatggccaaaagcagacaaaaaatagcacaataattaatctcgtcagtttagcacctctaatcttgcaaaataccttcagtgaaggatctcttttcagtttagttctgacattgttatgccaaaaagctctaaggtacaattttttcttcctaacaaactcttacaaacgctgacgtggcatactaaaacctttaactcgtcttaaggcgtcaagcaatcccaaaaaaactgtcagaagattgcacttaattagtcatcagaaatcaaaatcttgcaaaangcacaacgaacacatctcctttctgttgaggtgacactgaactttacgctctgaaaactgaaagcgcataacaaaatcgccttttaatcatcacgaattgtcctaattcagcttgcgtgttaataatctcttaccagatttcaacacgaagggtaataatcttgtcgccatgtaccaaccctcgcaacattttgccgcgcttttgcgtgggcgatgcgccaacttcccacgctataaataggcagccagttgaaccgagtgatctcatcttcatctcgcagcagagttggagactttgagctctcaactgaaccccaatctgcgaggtagcattgttcttctcatcgcctcctagctagctagcaaattatttgatttctgtagttatagaggctttttagcgtcattcgtatcctgcttaatgctccaaagaagtcaaattcgtgagattttggggatttgctattcggataggggggataaaaatcataaaactatataaaagtctcgtgtttgagtcagagtagtagtagccaagaaaccaagaggtcaaacagcgaaatctcgcggtgtttcgagtaggattttgatcttgagataacccgccctgattaattaatcggttaattggtgtcgtgtttgatctcaaaagcgcaggtgggagaaggaggagg

SEQ ID NO: 2284 - DNA, 2000 bp, Oryza sativa
aaaaacggatttattataagatttcataatcaataaaaatatattaaaaaagaatcaataaaaatctgttgaaaaaagaggagaaaaaatttgaaggcaaatatgatttgacacgaaggaggcaaagtagacttattttaagagagacccatagacacagtaaaagtaataaatggtgttaaatggagaggaaagtgggaatcaaaccctggtggccgaaatgaaaacttagatagattgctacacgtgagaggtaattacatggaagatacatataccatatcaaacgtggttttggggtagataaaaaaaaaccccggtccgactgttaaccggattaaatccggattttagcgacgcgtgtggtatgacggacaaaaaaacatccagaaatcaaacgtattttttaattattaggtatatagactagaaaaaatgtccgtgcgttgcaacgggtaaagtctattttaatcttaatattgttatatggtttagttaatatgaaattcactgtgggagttcgcttggatatatatattttttgaaaatcatgagctgcagttaggagtccgatcgtctcaagttagcatgagagtttttttaaaacaaatttcttatatgattccttttgtattactaaaagtgaacgattttaaaaaccgactcaaatacgaatatgtatttccgaaaccaaacgaacctaaaaactgactcatacacggataacgtaccgacataaacatcttcaatttttataatagcagagatatagatttcttacacattagtcatcagtctactattgaataatcagataaatcaagtattttaagtaggaacaaaaatttttatgaaaattcgtgtataagtagtaccattttgaccgtttccgattttagcccgtaaataaaattcgattttctttctattcctttagcacataatacaacctacagtaaatagttaaattggtaaatatataaaaaaatccattttaactcacttaaactattttgataaagcgtttaaccccctaaataatttttcatcctgttttatacccccacccccgaactattgaaagtggttccgcttattttctaacagcatttcttttttttatctctctcgtataagttatatacgtttgttcgactaccaatcttcgttgttaactttctcaatattcgtgccgtgtattattacgccaataccgtaaactagcgactatggtttgtgtgtgttgtatcattacctaattagagctagctctgccaccactgccattctacctgtattttaaacctgcatccgcaactggcacgccatcgcctgacggctggactggagtcgtgaagcgaaccggatttgttctcacgtggatatggtgcagcgctgcacaccgcgaagcttccactggcaggtggtccccggctgtcagccagttctacggccgtcgaagaaacgttccgaggtttgtttagcacgccggtttccgttcgtgcgtggggacgtgggggttttgccccactttccaaaaccacctattcctccgcgcgtgcaccccgagccgttaacgtcaccgacacgcgggccccgcgaaacgggtgaccccgcatggcagacaaagtaactcgcttctggagaggtggggccctcggtcgaggttcccgtagcggacgacggggaggggaagagaagagaagaaacggctactcctccccgcgcgccgcgcgcggctgcgttggttttggggttttggagcgttgcggattgccacggcgcacgccaccggtggcgcacgctttacaggtggctcccccgccgtctcccccgcgtgccctcctcgccgtcgtcgctcgctgcccatttcatcccccgcacggcacgcgcgggacgaaagcaaagcacgcgcacacactcaaacccgcgcctcctccgctctcgtccgtcgcttcggttcggttccggctcgatcggggaggttcctcggggcgacc

SEQ ID NO: 2285 - DNA, 2000 bp, Oryza sativa
gggaagagaaaaacttggcatcctcttcttcccgcttgcttaagtgcaaccatcgcggttaagtacagtgctcgacaaggcacctatttacgtaggacgttgcacacacgtatgatatcgccgtcttgtaagctttatacaagagagagcgcgcacgcattgaccaactttcaatccccggtcttcttcgcggctaggaagatttttctttcttaacaacacgccgtgaagttctatattatagagcaataagaaaaataatcttctaaacgacgtctttgaaaaggatacgatattgagaatgctgccaccacacgtattagggtgacaggatgtggttttcatctaaaaaaatccattagagggtaggaaagatcactcaacaacgcctcaagagaaaagctgtaggtgcccgtgagcgtcggcgttgctggcccgaagagactaggctttcacctgtaaccctcctaccccttgtgtcgagatcgcttactgtacacagaagccaccatcaactacactccttcgatgcacagacactgcgccagcacctcaccaccagccgaccatcaaatagaagctcgacattcgacgcgttcaaatccatcaagataagtagaagagggagagggtgagagaaaaatagaaccctctccctcgcactagttttcaaacgtggtcattttgtgatgccaaggcaccgcctcaagagaactagcgtcttgatcgggactcaccataggcctgcaacgtccacgtcacggcgctattgtcatagccaccttgactagactgcacgtgtcatcataggccgtctgtctacatcgccgtcacctcgacctattgctccttagcgccactggaactacagccagagcaccgtctgccactctagctcagttgccgttggttgcggcctcccgtcgcccacgcctcaccactctcaacgccgtcaccgcatcggcctcttaccgttgatgggtgtgccaacctctacgcatgtaggaagatcgaccaaatcttctgttaatatagtagtagtgactgatatgtgaatccgaatccatatgttagtatgtactattgtaccaataatactgcagataatccctaccaatttttcagtgttcgagaattgaaaccggaaaggaggacaagcgaccagaggtgatggcgcagagccaacaagtggaagataacctgctgatcgatcgatcaccgggcggtgttaggttgcctcgttgaaaagcttctggaatttgtactgtctagtccatctggcgtgtactttagaccggccttttcccctgtctcgatggttccgtgatactactaataatccaacatgctaatctctatcagtacaaagattaacgcgtcactaaaaaggccagctcattcaagatgagcatcccgttgtcttatcaatcgatcggttcatcctttgccgtgcatatccgtcaggtactagatcttgttctctctttctttcttcttttctttccattattccatacaattaagcagagaaaattgtctcgacatccaaaagcttaaactaaccacgaatacggacagcaagtagtagtaacattcaagtcccattttttgatcaggtggttgccgaaaagcgaactgaagttggcacaaaagtactactcctatgtacgccactgactcatcgtgactgaggacaagacaaaccgtacgcgcatcatcccccaaatcccgagattttcacagcgaaagtcagcacatcaaagaggcacgcagcccacacacacaccagtacaccacaccaaccttcccggagcctccccttcaatgcctcgcctctgcctatataggcaggagcaaagctactgggtgacacacaaaccattgatagcctgtgcgtctccaagaagaggcttgccgctgccgccattggagccctctcgtttctgctcgagctctgcatttcttcagtaggaggaggaggaggaagagttggagtcgcc

SEQ ID NO: 2286 - DNA, 2000 bp, Oryza sativa
atggggactaatacccctgatactcaagagatttttcgcttcttggcatcctttcacatgatagcaatatcagctgtttataacaagttaggtaccctaggaagttgtagagatgtaatgccatctccctagaaaacttatttttatttttgcccttctgcaggctactccaggggatccagttgtggacaagtatatatccatggggcttggacgtgaagctgtctcatttgctgtgttgaactatggagataatccagcgaaggcatgctttttcccttatttatcttgtgatttatcattaccttctttcaacatatcatcaagaacaaaaaccattgctttgataactcaaaaaggttttcaaaggtcaacaagatagctatatacaatcagtatttgcagaagcactagggtttcttcttctagcaaaacagtgattgccattctgtccagttggtagtttttgtggaattcgattttctacttctcagggagatagaagtgtcttctgccattctaatcgccacgagcatttgtagacagtggaaaaaaaagagagagaaactgacaaggatgaatcctatgtacttgcaggtgaaggagtttgtgaaatcctacaacgctctccacgagatgggcttcacatcctcaaatgttcccgaactgctggccatccacgacaacgaccctgacaaagttatccagcacctgatcggcacatcatagtccagaacaaaactctccacatattcccccatgtataggtccatcttacgctggcaagcgccatacatgtcgcgtttttaatgatggtttcgagtgctagctattgtacgcgtatttccgctacgagtttcatgaactgactattgttgtgcttcccaagcggtttcataaacttaaccttgctttttgtgtcggatatatagagccagtaggtgatgattctgattgctgaaactttggttgctatacgtttgctactcctttttggtcgattcagcaatttcttcccgccgttgttcagtaagctccgaacgctgtgtgctgcacagcagcagccagattcctgtggcaatttgctggctggagctcactactggatagttcatgtccgtggatgacggttggttgtcacttgacatggtggcaaaatcactcgttcaataacgtgacgaacaacttccagatggtaagtaaacacgctaacaattactacctcagtcccaaaataaatgcagccatagttttccacgcccaactttaaccgttcatcttatttaaattttttttaaaaataatttaaaacataagtcataagtaaaatactgttcatattttatcatctcagaacaacaaaaatgctaattataaaaaaaattcaaataagacgaatgatcaaaattgagtgcgaaaactcatgactacacttatttttggacggaggtagtgcacctttttgcatgcctaaagcactggtttgggcatactccgtatgaaacaagcatatgtactgtggtgctgcagacaagtccagaatatgtgtcggccggtgactgttccatccacacactaagggcctaaatgtcattgaagaacttatcgtttgatctagaatcgaggatcactgttcaccacgctatcttttttctgctgaggatgagctttgcatcactggacagcaacaacgagcatgaacaagaacaaacaccacaatccatccccatctccttctctcccccataacgaaatcgttgcaatgctgtctcaatttctctcattaaaagaaaacaaaatcgttgcaatgccgtctcaatttctctcagaaaaagggaaaaaagaaaagaaaagaaaaaagaaaattacatttccagcccaacaccacgatctcccatctccttcctctctcccgctataaaacgacggcatgtcgcgccgtctcccgcctatcgccgatcgaagcttacgagctatctgctcttctctctctctccgcc

SEQ ID NO: 2287 - DNA, 2000 bp, Oryza sativa
  misc_feature (22)..(22): n = any nucleotide
  misc_feature (877)..(878): n = any nucleotide
  misc_feature (931)..(931): n = any nucleotide
  misc_feature (983)..(983): n = any nucleotide
  misc_feature (1725)..(1725): n = any nucleotide
  misc_feature (1734)..(1734): n = any nucleotide
  misc_feature (1788)..(1788): n = any nucleotide
cttgttacaagaaaaaaaaatncttcgcaacacaaagcaaagatgccccacaattatttctttttttttggatggattataccctactgtcagcaccatttttatttagagatgatctataaaactttctaggtacatatgccactgtactccctccgtttcataggtttagatgtttttgttgtgtactaagtcaaatttcattaagtttgatcattttttttttggaaaaaatatagtgtaaagcctggcccaccattgataggccacccaagttatctttgacctgtttcattacaggctcaaccggagtcataacttatctttgacctatatatccaagagaccgtttgatggataaagattaccttatattttacacagttctccccatagttaatttaagatggagactaaccacaaaacatatatatttcctccgttccgaaatattcaacacttggttattttacacggtcatgagagccatatttcttaccatgatctttttttagcagagcaagaaatatatatttttatccgagtttggacgggtgtattttatttctaagaatgacaatgcaatttcatagcgtcccattagcatactatcttctaggggatgcgatgtagttacaagctcacgagccaagggactatgtcagttactggtttgctatatatctttcaacagatttcatctttaaaatcagacggaattttcaccattgattttacgtataagatccttgcttttctcgtttgatcacaaacagactgcaactgatagagagccatgtcatgtcctggcgtgcgtgcagcaaccagagcagggccaatcaggctggcaactggttaataagtgagacccagctgnnacagttacgtaataaaatgatccagcaaattaaagtatgcaatatgcctattnggtattataggtatacatgagcttaatgacgttattagaaaaataaattgangccacatttcaaattacagtgtaatgagaatgttgtaagttattttaagctacgatgtaatttatataaaattacattgtaccttgttaatatgcttgtaactttttaaatctagaaattttaaaacaaaattcaattatattgtattttctaactaagatacttgtgtacgtctttatcctcttagtgagctttatattgttctaatagccaagtgtagggtggttttaaaaatccatgtgattttcccttgaaaatttcttgacaaaacaatacctagcaaaaaacgattttactattccgcttacaatagattttgggttaagtttcagtcgtagaatcttctagatgtgttattgcagaccgaacttatggttaaactcaattagtacaaaacaccaaaaataaagtttactactattttttctctatatttatgacattttaaatgtttatcatttttaatattttatttaaaatagactatgtttatttattagaattgtgttaagatttgaactccaaacctttcgacagtttaaaagaaatatatatccgaggctgtttgtttccagtcgagtcaagtcaccagccgcatccatgcctaacctaaccacctggcagaacgcctgttctactcgacgtcgcccacgcacacgcccgacgcgcagaatctccgccgaagcccacgtccgcactcatcctcatccaggtggaaagcaaaccggcttcatgccgctcnacccccatnccagcacacgcgcatgcacgcgtcggctccccacgttctcacgcgtcgcgcatncaccccgctcacacgtgccccctcgacgtgtcgcgctcgcgccgcgcgcgcctcgcctataagtccaacgcttgcctcgttctcctcctcgctcacccaccacaccgatcatttccaactgaaacagttgatcaactcatcgcctctcgagcaggcgagcacacacaacacgcagtgatcgagtcgggctcgagcgacgtcgtacgctgaga

SEQ ID NO: 2288 - DNA, 2000 bp, Oryza sativa
  misc_feature (788)..(788): n = any nucleotide
ctcggcgagcgacatgttcggaacggagcagaatgaatagtgtgctacctaatgattacattattcgagtagcaccttaagatcttaaatttaaccgatttggctatatctcactcgaaagatttttttcttatctcactcgattttctcactcaaatttacagggtattttcttgtaaattacagtgtaacttatgaaacttacattgtaatttttgtaagttgcagtgtaattttttaatctttgcatgtaagttttaaaatttatattggatttggtctttttcttgaagatatggtaatttattgtccattatggtgtttcttagttgctttttatcttttactgtgtctattggattttaatccaaaaattaaaaatctgtgtgatatggtcataaaaatcttttgaaagatgcataggtactcccaatttaattcttcatccgagcgaattttaaggcttagttaaagaaaaaaaaacttactaataaaggcccaccaataaaaccacgcgcgatcggaataagttcacttcgtcacccttaactgtgatcgaaatctaatccatgaccctaaaccacaaaaccagatatatcgacccccaaacttatgggcgccggcaactagcaaggagaggatggcacggaggaaggcccgcccgccgccgtcgtcgccgcctccgctcgggcctccctggcgcccatcgctatcgcctctgctcgatcctcctctggcaccaccgccgctcgagtcgggtggccgccgccgttttgggatgccccgtngcccggcgtcgtcgcctctgctcgagccgagcggcctccgcccatgaggcgcgcggcgaggctaggtgtgcgcggcgtgttggcctcggagggtggcgcggacggcctgggccgcgcgagagcgccagaggccggctcgatctggacgccgatctggatgtcgccgcggaggaggttggcgtcgaggtcgaggctgttgcgtggcgcctggaggcctccgtcgtttgtgccgccccgtcgcccgacgccgtcacctccgctcgacctgcctctagcgccgccgccgctctagccgggtggccgccgccgtttggcctccccgttgcccggcgccatcgcccatcaccgcctgtgggagacgtaggggaagaaggggggagagagagaagggagaaagggaggaggaagaaggaaggaggatgacatgtggggtccacatgtcagtgggacccacaattttttttatgtgtgtgaatgacaaacgggtcccacaattgtaatgccatgtaagtgccacgtcaacgccacgtggatcgaagactcggtcaatattgccacgtaggcgccacgtaagcaaaaccgcctcccaaaaccgcgcagggagtcaaattgcaccggttttagaagtttgggggtcgagatatctggttttgtggtttagggtcatggattagatttcgaccacagttgagggtcatgaagtgaacttattcccgcgcgatcaaacgtgttaaggatccacgttgcggcccataaaggcccagatgtctctactatttcttcttctagtgagctccatcgaagcttttaggcgaggcctaccgctgtggctaagcggcggcgtgtgccagcccaacccccgacgacgacgacgcgtggcgacggccgccgcgacacccgccgccacgtcgccccgccacgcgccgccccccggcgagctcctcctcctcttttataatcccagcctcgtctcccccgcgatgaccacccccctcgccgcgccacgtacgccgcatcgcatgcgcgcgctttccctcgccagagcaagtagcccgccgcctcttcttcttcacctccgacgagcccttgcacccgcgtcgtcgtcttctccggcgccggtgctgttgctgcgtcctgcggtttcttgttcttctttgtttgttagcgacagggcggcggcggctcgccggagcagcggcagcagcaggagaa

SEQ ID NO: 2289 - DNA, 2000 bp, Oryza sativa
aaaatcttctatattttataacggagataatatccgtgatcttccacttataaggacaagcttggaaggcatttttatagcttcgacttataagtcgcatgatcatgatatagcgcacaaaattaggttatcatttattttaattacgtgcatgggtgggaagagtaataatgtcccccggcgatactatggtgtatgatctgctatacatgatggccaagccaccaaggactcaacagcttataattgtgacgataaaatgaacgaccagatattctttctctaacgcaaagggacatttttttgaaggatttcaatgagaatatagaacctaaaccggatgaaaattctatgctgtcacgttaatatatcgtttacacatgcctccctatcatgccctatcttcactttagttcttttttaaaaaagatattcagaagacactctctacatttcttctctccctagtcttaatattttctttagaaaaaaaatacatgagagatgcacgcacaccctaaactataaatcgaactgtcgctaatccctgatctcataacgttatatataagaaatcgtttaatgatcagttgatcactactcgatcggttcttgcgctctccaactgaattgatttagcagattgaaaatggcgctctagctacatcttactgtgtgtgtcaccatctgatcgatcatgcccttttgcactatgtttttatttgctgaatagatgaatggttgagtgattttgtgattactattaaggtacaaatgaatgaactaagtaatacaaagttgaaaaatgaacacataatagttttttaaaaattcatatatatatatataagtgtttttaaaaaataacaccatttagaagcttagatagtgtgtcatattaatccaccatgtatctccttagttagtctccttacggagtaataataattagatatatggctgtacgttccacaacttctgccaaaattgaacggagcatgtacaggtcatgaaaactacgggggtgaactttaaatgtactttctccgtttcacaatgtaagttattctagcatttctcatattcatatttatgttaatgaatttagatagatatatatatttagattcattaacatcaatataaatgtgggaaatgctagacttacattgtgaaacggagggagtattataacgacttcggtctggtcaaatctttacaaactgtgccttggcggttcgctctggagtcacatataatgcctgctattggcgtgtgctgggatgctttgaagatagagtttgctgcttacgtacatagccccaaagtccaaacttagtgccagatatatcggcaggacgatgaactagttgcggaaacgacgtgacatacctaacaaaatttcggagttaggagcgatccaaccggatataccgcccaatcagcaccgatttctatagcacgattggccagttgcaacttgcaacgagccaacgacgtccactatcttgacctcatcccgtcgactccatgccaatatgccatggcactatggcagcatctatctagctaggtcagatgttcacccttgcagctgcagttgaggatgctgcggcccagttgagtgtttggcaaaaagtgaaaaagggcctggatattcggcctgctaaagaaaccgttctccgagcccatacgtgacaggccttacatgtgtgggccgtgcaacctgctgcttgctcggcccgaaccggccggagacatcctcaccgatgacgatgacgatgagcaatgagcagggaaagccagaggcaaacgtacgtggaggcaggaggagtggtcaccgcgtgcatgcgcgccacctccccggtctgccgactctggcggctgcgcccgcacgcacaaatgggagctcgtgggctccaggaaagaccgaacactgcactgcacaacacaagcgtcgtcttcaggccgtacgtgacaaacctcagcaggcgagtgtc

SEQ ID NO: 2290 - DNA, 2000 bp, Oryza sativa
tctagtggttgtccatgactgcgggtccattatatacgttggttttcttataaactatatgtacagtaacaatcacgataatttaatatatgtggtctcttagtttatgtgtgtgtacggtgtgtgtatttatttgtttctttgcatctccataatcatggttattttgaatggtttgtttttcaggctaccgtgttcctgcttccctcgcttaatgcttatgtgtcctgccagttgcattatcacggataactgatcatatgccattttatggcttcagtcataatatattgttttactaagtttgtctacatgataaagagatacacatggatctctcctaaataaagtcatcattgatgtccacatgcattattatgtatgttaatttacaagtgataaaacacatactactactacacccaagatgtggtatagctcaaacacaccccaacgtagtaatttttctagtgagagaacaatcatatatagcaaaatatcctattgagcctggcgataataactcatagtaataattttattatgtaagaagtttgtttttagttatcacacacactgggtgcatcttaatgctatatatttatttggccacacaaaagtagttcttcctctaatgcctttcattctcaactttcatcatttatttgtcctttttgttaggttccgtcaacctaatatgggtgaaaagacagttttctattaatatgttttaatgcaagatctgtgatttttatattttcttttgagttacaatttttatactagcttattatgcatgatggtcgaatatctctcatgaaccataatattattttagtaatcaagtgtgatgcaaaatcctttaaatttagtatattacataataaaataattttctcaatttctacttcttagcttataggctgtgcgcatatagaatttgaattttagaagttttaaagttgattttggttttttatcatatttatttttagcactgacttttgaatagctaaaattgaaaaacttatcgtaaaaaatattaataatgggtggctccgttaattccggatgcatcttaacatttactgtaaaaatataacctatggtttacttatatttaatcaacaatatttattgttaaaaagtaatagacaagagaaaaacaatcttttcttccatctattaacattatgttaatggacaactaacggaaagggcaaataagatatcaaatttaagaataagtgtataagaggggaagccaattttgtgagaataaataaggaaccgatcaagtctagaggacacataaagaattttctcatcatggtgttcatataactagcccgttgaactgtgagattgaatacttttgggatagtgaaagaatatttgacttaatatttttcttgaacactacaatctgctatttgtttcacatataaaaaagtgaatattgcatcctcaataaatgatctaacataaggtacataaatatctaaatctttctctattaatgggtcatacatggatgcatatatcttagtaaatatctaaatctttctctattaatgtgtggattcatacatggatgcatatatcttcaataagtgagtagtaaatatctaaatctttctctattaatgtgtggattcatacatggatgcatatatcttcaataaatgagtagcaaatgtttaaatcttttctttattaatgtgtgggttcaacatgcatggatgcatatatctttaataaatgagccaattaaatatgaggtgcacaaatatccaaatctttgcatgcataggctctctcttcaccattgattttacatccaatggatacaattcgagcaacatgtcaacttttcccctcgatggccttatataaacccaactatccccaactagaagatacacaccacaacaatatagccactgtattgatatcaagaaaaaggtctatcctagctgctttatactaaagcaatagcc

SEQ ID NO: 2291 - DNA, 2000 bp, Oryza sativa
gaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcatacttataacgtctttttttatcaaattatgttggctgaatcccttggagtgtgccaatttccatcttgaacttgagtattccaagtagctgttgtgagcagcccgaccagtattctggaacttcttcctaataagcctggttgctgcaaattgatggaatgatggaccattgtttgcccgcagtatgctggaacttcttccatctgttattgtatggctagatagtggatggtaagcttagtatgcctggttgctgcaaattgatggaatgatggaccatttttagcctgcagtattcttgaacttcaatttgttagtacaaggctatttagtttgaatgagtgatggaatgtttgttcactgttgatgcctgcaagatagaatgcctcgaatgtcttcttgctttgatcaattaaccatctgcagggaatttcgttgtttcaatcatctttggtcgacctcgagagctttctgtttccgtttcaatcatcttttcgttgtttcaatcatctttggtcgacctcgagtactacttagtagtagtggaccagtaatttctgcccctccgctctagcacaaacccaactgacgaactgatccgccggttgagagatggagcacatatgcgtttttgcgttgtgaggacatcgtgaggtacgtgtcggctgatctgctggctgagctcacgtgcatctgtatcggatcggaggcagaggttagaggtacgtgtcgattgcccgtcgtgagtacttcctctgcttgacacctggtgcactgcc

SEQ ID NO: 2292 - DNA, 2000 bp, Oryza sativa
  misc_feature (60)..(60): n = any nucleotide
  misc_feature (1844)..(1844): n = any nucleotide
ggtgggcgtgatggagttgggtcggccggggtgtccggttgtccagctgccggattcacngcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaacgggtgtagttcaggtggttggttgggcctgttgcaacgtggtgtagcgttggacagtgtttggttaatattgattaattactacaactgttttactgctttcaactactgcttttaaatgctagctttatgcaaaagaacccctagcctcctttggttatatcctgcatcatacctcctcttccggtatgacttgctgagtacagtgggtagtactcagtcttgctctcttttctcccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgcagcatttgtaatcttttctatttttgtaagacgtggatctgtatgtcaacaattgtcgtttgtgtaccctggctggtcctggatagggatttaatgcacattcagcttagaaattctagttcgagaatttctgggcgtgacaccgcggggtggtcgtcgtcgtcgcgcccgacctcgccgccaccgcgctggatccaccgcgcctgacctcgctgctgccgcttgccgccgtcgtcgtcgccgcggggaggtcgtcgtcgccgctgtcgacgggtggtaccgcgactacggtatttggatggtatagggatcgtcgataccaagggtatatgcgagattgaggtaaaagagatggagacatggatttttatacaggttcaggcaccttatctaacaggtaatagccctacatcctattggccggaaccggtgttgctctttatttatctggatcacacaagtagaatatttgggaaaacctatctagttgtcgtcaacttggtggcagggataaccaacacgtagtcaacgacagggtagtcttcctcctcgagcatgaactcgtcgagatcagagatagcgctagatccctctagccggcctccgtaggcaccggatgcggtatgtctaggctaatctctgatgtcgagatctggcggtgtgtgttggcttatgtatatgttgtgtcttgttggtcttgtggcttgctttttctcctcctggggggcttgtatttatacccataggtgtccccttgtccaagaagaactagggagaccaatatggatacaatccaggtagtccttgtcattttcatatagaactctatttgtccttccttatccgaatctccttctatatacgaggtatgattccgtataagatatggtatgtggtgggccttgtcgtgcttagtcaactactattaggtatgtggtatccataacactaacagccccgcccgtgtgttggtatttcttaacgacattactagaaatataattcccagcaatggcccagaaatactcctggtatattatggttacagagttcatccacaagcgcatggatataccattgtagcatttcacccgagaatattccaagggtatcgtattnattttatcccgtgggaagataatgtagagagaacttgactaataatttatatattacttgtgataatcatattctaagcaggggttaagataatccaagggtagagtgacacacaagcattaactactcattctcataataaatcatctaaacaca

SEQ ID NO: 2293 - DNA, 2000 bp, Oryza sativa
tattaatttgctaattcaagtgatgttttttttataagattagggtgaagattaggccggggacgcaggaattttacaggaatttcacatgtaatagttcaaccatagtaggaactagaaacatgaaaatttgtgggttgcaaacaaagttccatctacatcatcgtgcatgtatcgagccaaaggcaggatctacctatacccatgtaagtccctctagtttctgtgatttcctccatccagaaagacttgatttctagcatttataatttgttaaaaaaagatttggtttcttttgtttttgtggggaaaaatacttgatttatagcccctagcttacctaccatcggtctataaatcatgaagttttattccttcagtaccccttatactaatgccatttttctattagtgagcggcacttttgtttttcccccttaacaactaaaatacttgggattactaggactcaagttttttggggaataaagggagtgctatatatgccttgaactatttcggtttatcttttattgtgtttcactatttatttgtatgtggtatggtctctttgttaagctagcaagttccatgagtttatatatcaatgtacaatttggagtggtatatttgattagcccgttttccttaggcaccgcttgttagctaactgctaacatacaaaagtaattaagtatgtataacattgaaaagatggcgagtcatgagagagagcaatgtggcaaacaaactctatactaacattcaaaagtaaagtactaacatacaaagcttgttagcttgtagctgatgaatagcatacaaaagtaataaagtattaagtacatggagtataaagttatgtagctaggaccacaaacaacacatgatctatgcatggtatgcatgcaaaccatgcacttactgcaagcaagtaggccaggacatcatggtttattattaactaggtcattagacaattgcttgcgttacacaatgtatagaagaaatgtaggatattaagctaaaatacaaaattctccagcaggaaaggcgccgaaagtatacttagtttgctagcaatggatcgagtacttatctactgatctagtcatcgatccatgcatccatccatcatttaaccacgtagcatgtattggctggaatcaagctatcacatatatgcgtgaatctaaagcaaaacaaactcctcgatatatcttgcatacatctggagctaaccgtccattgattagctagctaacttagagatagattagcatgtatgacacatcaaattgaaatcatgatgcatatgcatggtataggagaggacaaataaatatatggttcaattaacaagcaagtcaatttgtgacatgattgatacgttacgcaaataaactacaatactttatcttggttgtctttagcataagaagtgtggaatgcatggtttagccttgtgagccccacatatataaagcttgttgtttcactagaaaagatacacgctaggctaaaagatttcaccaaaccaacaagaaactaataaacctttttttctctttcttcaactttctttcgtctcccttctcaacaacacagatgtcatagaaaccagaatcttttgggcctatataaaccaccccaccttgcatagtatgttcatccttgtgtcatattgtgttcatcttcatactaccaaccaattagtgctaataggtagcattttctgcagttgcagctcaagtaaggtaatgcacctactagcttattattcttgtgcctagtattaattagtttctatactggtacttgtgaaaatttgtgatttgagcgatgctatttgatttgtaattaagctagctatctcttttttcttggaccgcaatgtaacatcgtgttgctaacttttaaactataaaagtaagataaagaagtaacaaaagtgtgtgcttgctatgtaggtctattattcggagcaacaaagggaagga

SEQ ID NO: 2294 - DNA, 2000 bp, Oryza sativa
gcataccgcattagcactgaatgttatcttaacatgttatcccaaatagtcccttctactcaaagacatgtacatgttcttgcccaaaagtgatgatttttcactagcatatattcttttcggttactttccagcgattttgccacccttttgcatgggtaagttggcagtattttatcatggctaatatactaacctttacccctttactgccatgtgcaccctaagattcctatcttattctacctcacttgctagtttccttaaacaaaaaaaacttccctgatgcatatgatgagttcacaagcagtaataagagtttgccggctcttgtattttattactatttttatggtttcttcagaaagttaggcatgtgatgtgaacatgctcttttcaacttagcaaaactgtacagtaatctaaatcttgacaatactggttaattcactgattgcttctacagctgtattttccccagtagggtcttcttttctaatgtcctgattagtgttcacaacgtgacccaccttgcaattgtttagtactctactaatctactgtgaattactgtggaggaagttagtgcagtgccttgtacagtgcttcaggctacaccccctacatagacctgcctaaaagtttgtttctttgtccatgtgcagcagcacaatatcttgtcggatcgctgttgtactcagtaatacgctaaatactactagcagggaaatgtttaatggtttgctagatgaaatgatgcatcatatacagcacagagaggaacatgacaacagggatagtatatgtgcagttatctgtggcagtctgctactgtaacagatctgataaaatcaggtgaagatgattgtgtagggtaaataaaagaaggatattctgaaggaaatcattagcaggtcatcagtcccaacaaggttggattaccaagagcacagagcatgtttcacctgcatcactgctgtatctgtatgatgttaaattgttagcttttctagaaagtcagacttctgaatcttccattgccaagatgtaaagccatgcagtaacaaaacgaaacaaaacacagtgagttgagcatagttaaggagtttaatttctcaaaaagtactactcaatgtaccggactactggagggtaggcttgacaaagcttagttcagctacaagtttgacataattgccaaattactatctagtactaggaatattttaattacaattctgcagtaaaacaaatttggagtatttatttcgcaagatggtctgaacctctgcagagcagcagaaacatttcagaaggtaatactcagaggagagagcatgtcaaagcaatacagtaaacaaacaccagcagcagacgctgttaacttctgaccatcctgaaccaaagcagtacaaaaaaacaaactttcacaggcactagaataccgtacttaacaatgtataaaagttggattaccgagagaattacatgttttttcccacaacccaagagaggagatgtttttttttgacagcagcaactgctctaattaacaattcagggtgaccctatggcaataatcagtacatcaactaggggataaacatatccaaatgatgacatcaacagggctccatgccatcttcctcccatcttctccttatagcttataaaactgcacatattcctttctgatccataacttcaagaaccaattttttttcttttgcacaatccaaatcactcatcacttgctcacactcaacactactactcaaacaccacacccaaatcaaatccgttgtttattgcaaaagaatatcctataaaagctaattagattgtttaattgttaatttggatccagatctccaaagcctctgagatataaacaaattgtggggtttccctcctctacaatcccaaggccaggaggaggcgccaccgctccaaaccaagtcctcacctctctctctctctctcttctcctcttctctacg

SEQ ID NO: 2295 - DNA, 2000 bp, Oryza sativa
cccaagcccagcctaaaaccattttgagagttttgaaaagaggggagaggtgtgcatccaattccacaatagttcaaccattccataaagtccaagggatatgaatattcccaaagtctaaagttataaaaccacctaatgttgtcttattaatcagcgaagcatctacctaaattcatactaggggaaccatgagtagagtgcccactagttggggttttgtttattctagggtgaacaaggtaataataacaataacaataataaggtcataacaaaggtaaataggcatggctaaataaaacagtgataacgcgggtgacggagctcctggctcctcaccgggagaccgcgcaggcccccctttgccagttcggccgggggcttagggtgagatctcaagctctctttctctctgtatgtggaaagattgtctgcccgcaagacacacgagacacagcgatgtatacaggttcgggccgctgcgaagcgtaataccctactcctgtgttttggtggatctgtgtatgaatgagttacaaagtgtgagctgacttctcccccgttctaagctctcaatccgggaaagaatcaaccaaccccctctctatgggcaaggtcctccttttatacttcaaggggataccacatgcacccttccctttccaaactggacttttcttctctttatggacggagatcggtatggttgccgtccaaatgacactttgatgggacagcccatacctgcttccactcccggcggagacaggcgcaacgtgggatcgtggctgcccgttgctgatgcgaccagtgtcagaccggtcattcttgtccaccacgcgtcggtttaacaacgtgcatgtttgcccttcttcgtgtaacaccttgcctgtaatggttaggatgaagcctggtatatatcgatcggggttaacgtgccatctttgggatgtaacacgctagctccagctggggacgagtgcttagaagctcacaccttgacgggatggggcaaggcgtgcgtcagaccgcctgccgccacctaactcgcgatttgaccggtctgtgactggtcacagaccggataatcgagtgcactgcactgcactccgtgccggcgtgacacgcttagccgatgtgcaataaatgtggttaggtgagccctgctgtgctcacccaacctacgtacatagtgcaaacccctcagggggtcggggcacctcggccctcggggtcggggcaagcgcaccccgactccccctcgggggaaatcaggaggagggcggacacctcaccctcgggcccgacgtccccgaaggtgccaggccacgtgggcgattatgtctgcctcaagcctctggttatgatactcccggtcccatatcaccgacagtagcccccggcgttatgccagagcaatttcccttcccaagggaagcggtcaggtgtgacgccacccttaaagcctggtgacaggtgggaccggtctccatagttgggcaaaatacccaacggtctcaatccatgcacattggtattggtaactttggttgtccataatgggcggtctattcaagactgccacaccacttgagcagcgcgcgaatctgggtgagcagatttatctcgctcggagatacggtaacgccgcttcggtcggcgagcgtaattaacgcgcgcacgatacaatccgtttcgattgccacaaccgcatatccacttcacgcgccgtaagcgggcaaatgggattagtggaagcgtgggcacgggaaacgagggagcgagatagcgagatacgagggagcgaggtagtgggcgcgagaaacgaggagccaggcctagcgatggcaagggtataaaagcatcgagaaaaggatttgctcccttcctttcgccattgttcctcttgccctcgccgcctgagctctaactctttctctgctacgccctactttcgccacacgcgctcgttctcaatcatctcttcctccaccgcc

SEQ ID NO: 2296 - DNA, 2000 bp, Oryza sativa
  misc_feature (1039)..(1039): n = any nucleotide
  misc_feature (1093)..(1093): n = any nucleotide
  misc_feature (1096)..(1096): n = any nucleotide
  misc_feature (1099)..(1099): n = any nucleotide
  misc_feature (1102)..(1102): n = any nucleotide
  misc_feature (1110)..(1111): n = any nucleotide
  misc_feature (1114)..(1117): n = any nucleotide
  misc_feature (1131)..(1131): n = any nucleotide
  misc_feature (1145)..(1145): n = any nucleotide
  misc_feature (1206)..(1206): n = any nucleotide
  misc_feature (1208)..(1208): n = any nucleotide
  misc_feature (1740)..(1740): n = any nucleotide
  misc_feature (1770)..(1771): n = any nucleotide
ggcaagggcaacctgtcataactatagcaactccaagctaaaggggtgtaccgtgtggcaccaaaaaatcgagaatactcaaattgttgttaccttataggttgctcttccatctgtgcacctaccaccacatatgaatatttttttatttagacacttctaagaatttattttaaaaaaattatttctaagaaatggataacctcaagcacaaaagcatgacactgcacactaaacgttggccttgtacatttcaaatgggatttaaggccattcctaacccaatgactaggatggtgtctgacggagctcgtggctcctcaccgggagaccgcgcaggcccccctttgccagtccggccgggggcttagggtgaaatctcaagctctctctctctctctgtatatggaaagattgtctgccagccagaaaacacgagacaccgacgatctatacaggttcgggccgctcagaagcgtaataccctactcctgtgttttggtggatctatgtatgaatgagctacaagtgtgagctctcttctcccccgttctaagttcctaatcttgaaaagaatcaatcccctttaccccatgggcaaggtcctccttttatacttcaaggggataccacatgcacccttctctttccaaactggactgttctttttctctagaatgggcggagatcagcacggttgctgttcgaatgacactccgatgggactgcccatacctacctccacttccgccgggggtgagcgcgtcgtgggaacacggctgtgcgctgacgatatgattagtgtcagaccggtcacagatcggtcattcttgtccaccgcgtgtaatcttggcaacgtgcatgtttgcccttcttcacacaacatcttgcctgtaatggttaggatgaagcctggcatatatcgatcggggctaacgtgtcatctctaagagataacacgcttaactccggcttgagacgagtgcctagaggctttcgtcttgacgggagggggcaaggcgtgcgccagaccgccagntgccacctaacccttgatctgaccggtctgtgactggtcacagaccggataaangancgngcngtactgcnntgnnnncagcgtgacacgcntgaccagactgcantaaatgctgttaggtgagcacagctgtgctcacttatcccatatatgtggcgcagacttcntnaagggggtcggggtgcctcggccctcggggccggggcaagcgcaacccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttgtgccagaacaatttcccttcccaagggaagcggtcaggtgtgacgccaccctaaagcctggtgacaggtgggaccggtctccgtagttgggcaaaatacccaacggtctcaatccatgcacattggtattggtaactttggttgtccataatcgggcggtctattcaagactgccacaccactttgagcagcgcgcgaatctgggtgagcagatttgtctcgctcggagatacggtaacgccgcttcggtcggcgagcgtaattaacgcgcgcacgatacaatccgtttcgattgccacaaccgcatatccacttcacgcgccgtaancgggcgaatgggattagtggaagcgtgggnncgggaaacgagggagcgagatagcgagatacgagggagcgaagtagtgggcgcgagaaacgaggagccaggcccagcgatggcaagggtataaaagcatcgagaaaaggatttgctcccttcctttcgccattgttcctcttgcctttgccgcttaagctctaactctttccctgctacgccctactttcgccacacacgctcgttcccaatcatctcttcctccaccg

SEQ ID NO: 2297 - DNA, 2000 bp, Oryza sativa
  misc_feature (898)..(898): n = any nucleotide
  misc_feature (1052)..(1052): n = any nucleotide
gtaaccgtgagtcatcacagaacctactgtgctatgagcttgttcctaatggaagcctagaggcttggcttcatggtatggccaattgagtcaactatttctccttctgaaattgctgcataagttccactcagttgcagttgaatgtggtccttcattgtttaattaattagtggtgatcatgtaatcatgatacaccttgactcttgagtctctgactacttacatttttttcaggtacattgggagctagccgccccttggactgggacactagaatgaggatagcactagatgctgccaggggattggcataccttcatgaggattctcagccttgcgtaatccacagggatttcaaggcttctaatatattgcttgaggatgactttcatgctaaagtgtctgattttggtttggccaaacaggcaccggaaggttgcacaaattatctctcaacacgtgttatgggaacattcgggtaagcaggttgaccaccttgaagtactccccagatgtttctgctctgcttttgcttcatatagctgtcgtgctttcaggtatgtagcaccagagtattgcatgacaggacacttgccttgtaaaaagcgatgtatatagctatggagttgttctacttgaactacttactgggaggaggcctgtggatatgtcacaaccttctggccaggaaaatctagtgacatgggttagatttctttctgctcttatcttcagctgttattgtattacctttttatatctgaacatggatcctttagtatgataattgtcatctgaagttcactagccatgcatgttagatatttatcgatatatctcgacaaggcaaacaaacaaatggacttagagcaatattactactaatctgtttccnttttcgaaaaaagagagacattttttatgttcctctctattcatatgcattgtgtacatccttgggtggaaagcagatttatgtgtgagtaaatttacacttcaacatttttttatgcctgttgtgccaaagcgccatctatctgtttgtttcnttttgtgcctatgtttatgagcttacacaaatgtttcctgatctttccactaaaagccttgtgtcacatcaacctttgctggccaatttgtcaggtttgttcattaggtttttgaaagccaactctcaaacgtcaacgtatttcttgtagacagtaccaaattcttatccctgcataggtgtagagatacttatttgctcaattttgactacgcaggcacgaccaattttacgagataaagatacgctagaagaactagctgatcccaagcttggtggccagtatccaaaagatgattttgtgcgagtatgcacaattgcagccgcctgtgtttcaccggaggcaagccaaaggccaacaatgggcgaggtggtgcagtcactgaagatggtccaacgctctgagttccaggaatccataccaacacctccagcacgacccaatgttaggcagtcctcaaccacctatgaatctgatggcacttcatccatgttctcttctggacccttttcaggcctcagcccctttgagactgagaacatatcgagaacggctttctctgaagatcttcacgaagggcggtaacagtggtggtttgtgaagctgttttgggtagagcctcagagtctctgaccacccatttgaaggctggtggtgcaagtgacctaaccagttttattgggaggtaaatcctgtaaattccatttttattcaccacctgcgaaagaccaaattgttacaagaacattcggtggctttgtatgatggaaatgattttgttccaagttcttttttgctcctatagctcctgtctcatttactgtatggatcatagacatttaattaggtgatgtggttgtattcttcagtgacaaattgtggtactgtagctcgtgtcctgattgaacagcagagagctgcgctggtgaccctacacgtgtcatgccc

SEQ ID NO: 2298 - DNA, 2000 bp, Oryza sativa
ttgtgcagggaccatggagaaaaaagaagtaaccatttcctcaattctcagtgcagagctttccttggtgtccctgtttctcctcctcatccgacctttcggctggatgtataaagcattgctgaaagctactaatgcttcaggagcagagcagctctctctatcgtcttgttcctacgcgtcatagtattgaatctatttctcttgtattgtcgccataatccattaattgtagttagtacgatatctattcttctctattacaaaagaccacacgcaaaatttatactccaaaagaacctttcaccaatttcacagaaaaacttgtggtgcttacacaagtactaataaagctgtttgggtgtcgagaaattcaacaaagtaggctgctttttacacccatctttcctactgttgttacgctagcttgttctccctttcactctctcttcagtatcctgtcgattctttgtgatggctacagttcgattcgtatcggcgctagcaacaaaattgcggcactggcacacatcgatcgatacggacgatggaaacggagacgcggctgttgtgtaatggcatcttaacaaaggacggcgaaggaaacacggaaacatttaggtccatataaatgccttgtttatatcagctgatgagaggaggaggatgacagcttgaaaagaaaactgtgtgttctagaagcaagcaagggtaggagtacataattgtgatttatgaaaggccctacgggaaatttaaagctgcagacatgtgctcagggaattaaacctgttagttctctgatactaaagagcttaacaagtactaaaattactaattgtctagtggccattggaacgacattgccctgcatgtgcagcatccttagagttcaagccgtttaatccgctaagattcatactgaatcataccagtaatcatgtccgccattgttgcggctttgcaagtaggcctacttaattggaaggcctgatgagagacacaaacagttggctattttgcttacacgaaatctgttgtcaaaatgttagtagtagtaagctcccagctaaaggcaaatgccattcttcaggtcgccttcacaaataaccaactatcccacgtacaagcatcaccggccttattttattgtttctcccagtgagatgtttggcacaagaatgaaagaattgatgctggtactaccaaactaagaaagtagttgagattgtgaccattatcttagcttcagcctgttcaagtgttcatacgatggataagtgattgattaactactaatttaattatcactgtgggttatgcaggactgatgctaaaatgctaaataatggctctcccaagacgaaatggaaaagaaaagaaaagaaaagaagagagatacggcgaattccatttcaccagctgtaccccacctttgccgctcgcttccacgtgggccctaccttttgacccccccacgtcagcggcgcagccagatcattccaaaagcggaccacatccccacgaaaccccaccgcgaccgacccccccggaaaatatactaattacaaacaggtccctcgtgggctcgtgggtatatataaggctctttcagttggctccctcgtcgtctccgttaccacgcgcacactgccactgcgagtgccgttcccctcctcctcctcctctctcccatggcggaatcctcgagccgccccacgaaaccctaaatggcgagccggcggcgccgccacgcccctgtgccgtagcctcgccgcagcgagctggtcggaaggtaatccccgcttcgcctcccatccccccgcggaaccggcggatcttacctcatttggcatcttctctggatccactgctgatctgttcctccaccgtcccaaccgcctcacagatttctctcaatccgtgtagaacacagcgtcacctctcgatccgccaagtggtgggggagtaggaagcgtgtcttctccgggaggcgcgcg

SEQ ID NO: 2299 - DNA, 2000 bp, Oryza sativa
catggttgcattacttatagcttccttatttgtagacaaagcggattcggaattgtctttccttccaaggataacttgtatccatgcgcttcagattattagcctgttaagtcctgcgaattatgttcccgttgacccattcaagatgtcactgcatggctccatgcctccacctgaagcaaatgcagatgtagaaaaccatttttgtgaactgtattactgcaatcatatcattgatatcacacatcgatcagtgcatacccaagttaatctgtgtattgactagaaatggtagtactgtttcagttcagttattttgtgtcttttgttgcaccattttgttggttgcccctagctaacaggtttaacttctgctgatcgtcatttatccatctcgcaatgatattaagatgattatgtcaataaaagcactgcagtgattcaaattttgaatgtacgtaagatgtaggttggaaatagggaactcttttagcatgtgaaatagacatctgtgttatttggatggtgaatatagtcgtcacgcgtcagtagtatgtaaattatatccactgtgcccccaggttaattgacaaacctcatgttttaagtacgagttataaacgttcacatctcaggctagaaattagcagcaatgtgtagggggagcgcacatggaggaaggagaacaagatattagagattaattatccttgctgatctttattcatacgcacagcaatacttaaattgaccgactaattaacaagtcctacaacttatttctactgcagttaaatcaactattgtaatcctaagccaactaacttgcgaccaatgtggtggcctgcactggctatgtataggtgtgctcaactcaactgcatattcgtgaaaagataggatggctaatatgtcatataatcataggttttcttcctcacagtaaagagaacgaggcacagatgacttcttcaacattacctcttccagaatttcggtatagtatttcactaatcttgtgctaaacattttaatttcttgctgttacttagatcaaaacattcttgaaatagatgttccctatttttcgccattccaagagatattttgatctgatatctactccctccattccacattataagacgttttggcctctacatccttcgtctagattcactaacatctttattaatttggatgcatatataaagcacaaacatagatctatgcatgcatatgttcataacccaaaacgtcttagaatgtgaaacagaggaaatatgtactaattgtataattcattagatggatcataccatcatgatctaaatccaatctgtgttcaatgtcatgtgccacctttaattccaaaatttgaatataaaaattagaaaagtgtagctgaggcatatttttattttactttatttaaactgctgtaactctaaatattaccaacatattgtgattaatattttaatgtttataataatagcccatgctatgcaggggttaaagactagttcttaacatcagatgtggaaacatatttattctagtctacatcgatatctgttactcaatttaatgttttgaaaacaatctgtattttatctgttccactagttctgtttcttgactaagaatattcaaagtcaatgctgagataaaccaacatgtgatatggacaaggaactgaaatgtacctggctctcattgctttcctctgtcctctttaaagacgttgcctttagaccaatacttctatcatacggcacacgacagtcgacagcaatacaactgggttagtgcaatggtcatctgaccttagatagttgtacaattttgaaagaagaaaaacacaagtccttataaaaaaaagaatcagcagcatccagagaattgcagtcctcttcttagttcttatacgctaattggggggttaaggaaaaaaaggagtgggatttgcgtgcacatggttgttgctgtgtacgaga

SEQ ID NO: 2300 - DNA, 2000 bp, Oryza sativa
  misc_feature (1108)..(1108): n = any nucleotide
  misc_feature (1135)..(1135): n = any nucleotide
aaatagagacaaagaaaccataattaatcctataaacgatagccgatcggctaggtgccgatgacatatcatttatctctgagccgatgtcatatatgtatcgatcggcattcatgaacaaataagaaggaactaaatctactcgatcggctgtagatattaatgatacatacttcctatatcgatatatacttaaatcaagtgattgggatagatcggacgccatgccgagacagtataaatcattagatcgaaatatatattaataatggaactatatacattcatagcatagccgatcaggtagatctagcatgtatcggctaatactccgatactactctatattaagatattaaagcaagtagaatatatcaaacaaaagcctaatatacttaactgcaacaagatcttaatgtaaagggcggatttaacatgtcaatcatgcatatagaataaaagtagttaaatcaggtaagatcagctgaaaccccgatactaccctaatcggcaaccagaaggcaggctagaggttgatattctaagcacgacttaatagatcaaactcaactgatgcagcattaagtatgaaaagaagaacaatatctagacaatcaagccgctggaagtttcatagagtggtggatattttatataatctaaatcaacgtcgagatctaacctaatcggctgtactctaccgacagatgctagccgattgtaagttagataacgatattgctagagattatataagatatttgataactcgacggattacataaacaagattagagtatcataatgatggaagcactaatcccgataacgcaaaccgccataacaagttttacctcttgttgaagatcgaaaccgatgcagctcaaccggaaagcagaactcgtcgaaataaactaaagcaaaagggtggcgatgcgccgaaattgtattgaacgtgtgttgttgattacatgaggctcagggtctatttatacccgagaattacaatatatgtgtccatactagacacgactattatctctaacaaactcgaagatatcataagtctttacggcagacttttgcccaacatatctctaaggaattncatagatatcctattaatcgatacttntgccttctcaggactctatccttgcatggcaattaccatgaagcacattaactcaacttgatgatgtacaccgagtcgtattgttggaatcggctgtatcggctaaccccgtccgactcaaactctgccgatcttatcgtagccgatttggatggcagccgattcttgctctgttttcgcaacagtctccgtcttggattcctcttcgatctgaccttcatccccgatactgaggttaccaaatttggtcgttaacacatgccccccaagtccggaatattttggtaatgtttcggatttgccatatccatttccgagagaaactcgcacttgccgtcttcccgaccgttatcgctccgctttaaatactaaccgttgcccccgagaatcttcacaccgtgactcccgttttcaccgcttaagcaaattccgtcttctctctctctccggcgatttccctcggccagatctccatccgcggcgatgtcgacctccgccggtccgtctgctgcgccaccaaccaacccatctgctacaccatcagccgagtacgcagaggtctgtatccactggctacatccctttctcttatcggcaaatcgattttctcttgtcttatattgctttcttcttctcggtcgctttggatttgtagcacctctccaatctagtggcggttcccagtttgctgcacgactaacaatatttccttggtccaatcggtaatcttgaccccactgaattcatcatatccgaaaccaatagaacccccttcaggtcgaccaacccaaacatgaatcattggaaaaacacctttaaatcctggccttctcttgagaaaagctagcctgcatggtacaaacgg

SEQ ID NO: 2301 - DNA, 2000 bp, Oryza sativa
  misc_feature (691)..(691): n = any nucleotide
  misc_feature (1039)..(1039): n = any nucleotide
  misc_feature (1045)..(1045): n = any nucleotide
tcaacctcccctgcctctagggggtggtggcgagggttgctagtgaagttgggcgtggtactatcatggaaccaaattttggtaactcgacgaaggtgagaaggggcacaaatcttcatgcacatggaaggtaactgttaatagcaagattttgttcttaaaaaactatatgtgtataggaaacgaaaacattagttgtgttagtgtcaaagccaagacccggccactagggacggttacctaggccgaccgactcatggtaagaggcagaaatatgcgtcgtcaatatcaaacaatacctaatatcacaaaaataatccacaacatatgtgttcaaaattcatcggcacctgttcgacaagttttagatgaactaccaaaatattaatctaggaattagtagctttataataaaacatcacatgtgacatggctgacggttgtggttagaaaattttttataaaaaaaatacatttgccctgtatgaaaagcatatcttctagtagtagcataatgtggttggtagcgtacaaaaaatctcatatgctcatatacgcttctctcttaccttcacggctttgctccagccgacactaaacttctaactttacatctgtatacacatcaccaaactacggctatatgctctttcggtttcacttaaaacaaatacacctcctttttctttcntttttttccctttgcctgatcaccgcagaagatcctggccgctacgcaagtcgacccctctcgtctccgccttcacgtgaacccacaccggctcggctcagctcagatcggctccagccgtcagccggggaagcctcggctctggcccccctcctcctccgcgtgagcgagcacgtgcgcggcgcgtgtcgctgggggatcgggaaggcgactcagggggggctcgtgacgccacgtgacccgtgcgcccccgcccgaggaggaggagccccccgtttgtgctgcaccacgtccccgtccacccccagatcgcacgcgacgctgacgtgaggggaccacggttaggtnggcccnacctcgcagtcacgcggaggcggggtagggtcgccgggtgagctggggggcccatcgggcgcgtgtgcgcgtggcgtgacgaggtggtgggaaacgtgaactctatttaaggaaaaacgtgacacgttttcagggcacccccctatccccggcgctaatgctaatgactctgcccttccctcactcgtgccgtgtccgccacgggaggctgacgtgtggggccaacgagggggcggggtggtgggggccatgtaggcgtgactcaggcgggtaggttcgtgggtgcgccatgacgcggctggcccccaccccgggtgattagagcagctacaatagcagactatcagcgctataaacatattttaataagataaaagataagagagaaaagctgcgggctacagatttgtagccagctacagcatggactctaaaacgcaatatgtatatgatatgtgagaccatatattagggcacccgtaatggttatctataggctctctaaaagagatctatgtcagcatatttttctacttggaataaattaaataaagagagagagtaaagctatctactaacatggagatagtctgtagagaaaaacgaggcaatagaagagagagctatagatacccatgtagacatactattgaggtggtttactattaatctagtctattactgagatgtacatgttttatagagagcaacttactttaccattgcgggtgctcttaataatatagtaagcaaatattatatgaactggctattagattagttataagtgaattggaactaagtattgggctatgctattaaacttgctcttatactggatgatgatttattagcacctaatgcatgtgttaaccctccgaaaacaaagtggggggggggggcgagtaggcgacacgagaaaaggcgtgcggggatttagatgtgggggccaacg

SEQ ID NO: 2302 - DNA, 2000 bp, Oryza sativa
tgaatgtgctaagagaattcgaatcaaagaaggtaagataagtcctggttttgcctttatatgcatgagttggatcatccagtcaaaactgaagttagtatttctcctggtccatttggttcattcagaactaacataaatggccattagactattttgcttgtgtctgaaatcaattcctaaaattcttcaggaggcagagggtgaccaaattttgattaaggcatcattcctggctgagctacaaaggcgaatattaaaggccgaggcgacagtccgagaaaaggatgaagagaacgagatgcttcagcagcgacttcagcaatatgaaaaccgatggtcagaatacgagcagaaaatgaaagcgatggaggaaatgtggcagaagcaaatgcggtcattacaatcaagcctatccgtagcaaagaagagccttgctcttgatgagacgcctaggatgtccgactcatcggtcgaccagagctgggagagcaatggggttcacattggcagcgcgtcgcagctggttccacgcaccgttggacgggagatgaatgccagcatcagcgtcatcagccgcttggccgaagagttcgagcagcgcagccaggtcttcgctgatgatgccaagttcttggttgaggtcaagtccggacaggccgatgccagcctgaaccctgacatggagctccgcaggctgaagcagaacttcgactcatggaagaaggacttcggctcgcgcataagggagacgaaggtgatcctcaacaagctggggagcggcaacgaatcgtcgcccaactcggtgaagcgaaaatggtgggggaggctgaacacatccaagttttcatgagctaccatgtaatggtgtagaagatgcggcgctggtattttacaaagccggcgaggttggttgctagtgctagagtttcttctcaactgagtattggtgaaagcccagcgttttgggctggatttgtgatttgtggagggcgagtttgtatagttcttccactgaggccttctttgcaggggccaaaagaaccactgagttgtgatgtaattacttgttaagatagctgctaaacgggaggagattggagattgttcagtgccgtttccttctcttgtccgatctcagcttgtaggtctgtagttttgtagtttgtatcaggtattatcatcactgaataatgggaaaatgtatctgcctgtgccaacgcatttctccttggtcgctgcttgttgcaaagttgcaatgtgctcgagcatcttatcagtgctttttatgtgggcccacctgtcagttatcatgttttttttccttcaaatttttataatatcttaaataaatttcccaaaaatacaatcatttggttaaaaccctttgtatgactttagccgagttctccctcggtcccaaaatataagtgattttaaatagatgtgatgcatcctatattcatattattaagatgtgttaccctacaaaatcatttatattttaagacgaagaaagtattttataaaattataacaatggcaaatggttttataaaaaactgcaacttaattctttgtgtgtgtgacatacgggccaacttgcaatttgcatgtgtaaatcagtaaattataggtcggttcaaaattatcacaaacaaggttgtatttcctttccttttttaaaaaaagaatcatacactgccgttgcagctctcggaaaatatcgagctctaatggttttgataaaacatttctaaacttttaaactttatttacgccgtgtttagttccgaaatatttcttcaaacttcaaattttccatcacatcaaacttttctacacacataaactttcaacttttcacgtcgtttcaatttcaaccaaactttcaattttagcttgaactaaacacagccttatttatgaaacaaaatttcataatactcttggcccgaaacacacgttggctgcctctcactgccactcgggccccaccc

SEQ ID NO: 2303 - DNA, 2000 bp, Oryza sativa
cacttaggtccacgaatttgcaaagcgcgcatcgaggtctctaaacttggtttattgtatcatcccgatccaaagcgtctattgaccgtggtcttgcgtacgtggcacaccacgtggacgataatatggtgttttttcctttccccttttctttttcctcctattcttttatcttcttcctccactaaagccacctcgagctcccccgcgtcgaacaggccgaagaagagagaaatgaaagaggaagaagggagaaaaaataaataaataaataaataaataataataataataataataataataataataataataataataatgtgccatgttgtcgtttacatgtcatgccacgtaggcaagaccacggttaaacaacgctttggatcaggatgatacaataaatcaagtttagagacctcaatgcacactttgcaagttcgtggacgtagataaaacctgcttgtatatttaaggaccgctagtgcaatttactcttataaattttgaatccatgtttgataattaaatagttcaaataatctataaatgtgattatttgtattaaaaaggtaagcatgaaccactacaaagatagcaaagataatatttgtgtttaataatattgacgctgtttttgaaatgaacatcaaatgtttcatattgttatagcaaataaaaagttataacattatagtttagtttggaaggctatatatgatctagaaaaggtaaaacaaaaccgccaccaatataacgctgtaacatctagtcattgtgacttgttggagtgcgaggaaacaattctagactgcattgccatcaggcaacaggtaatccaactgtccagacatggcattttcagactagtacttttctacattgaacgggactagtgcattagaaaattttactagcgacgaagacatgatgtggttgatttaaagccgcgtcctaatattccatctggcatttttttctaccgcaacccaagtcatgttgactcagcaggatgcgaatctagcaatatacaagtgagaaacagctgaagaggagaccaaactaccaaaacggacaaagtaattctacagatggatagaatcaaatttatttgatgggtacttcttgcaatttttgactatttagttgtggtgtttaaaaatcaaatgtcattaattaatgacatgaaagctcaacattgatttgacacgattttgtttgtcatcctaataatttaataattcttaattcctaagttgtaaccgatatagtttgttactatttggataattacatgatggcaaaaaatgttgttttactttctccagttcacttgagtttgttggggaactatctaatagcgagttgatgtagtatatacacaccagttatactagtatttcattatgcaaaaaataaaattccataaaagaacatttttatggaattttaatttttttaattcaccataaaattttaaaaaataaatttaaggacgaaataatttggaaaatttcagacaacgctgtgtgtacataactgttcgtcctttttacttacagttgtcaatcacctgttgtactttacgagatttttagcacggtatcattccaaagtaagattaatatcatgttcttgaaaataattattgagtgattttacaatacttgaggacgtatcgagcaagataccacaatttttaggtaaatttacactagaatatctctaaattgtaatgcgaagtagaaaaaaaaaatcccctaactgttactttcagaaagggaagcttgtggaaaaccggggtagctagacacctgacttggggtttagggtatatagtccagcgtggttgtggtctcaggagatccaccgtgcaaaatatttataagatgcttacctagctaccgtgtaagcacgattaaccggtgttcgaactacaaaatatacgctacatatgctcttccaacttccttgaaggctgaagttctatacctgtg

SEQ ID NO: 2304 - DNA, 2000 bp, Oryza sativa
  misc_feature (1669)..(1669): n = any nucleotide
tgggtgctcgtatcatatctatggctaattatgttttcaagtcacgtcgagttatgatttagattttattttttagaaacacaatacaaacgcagacgctcacaacacacactcacccttataaatgaatatgcacacaccctatctctattagaacctctgaaagactgtgccgatatatttaatgaatttacaatgggcgcattgctacagataggtacatcctctatcacggaaaaattaattagctgtaaatgtgagcatctgttttaaccacagagaatcttactagttgagttatgctcacttcgctagttttctttttctcacaaggaagagtttagaggtggttagaattggttttctgctaggagatcaaggccggcccatgttcggcattacgccagcacgggcgcatgggccgcatctggaattcggagttatcttaaccggatgttggctttagctacatttcttctttacaataataatcatttgaacagatcaaggccaccctgaaggcggaagcagaggcgtttcaattttttcttcgtgatacaataatgagtggcacagcaaaaggcaaagccagctagtcacattctgaaaaccttcatacatatacaaatctggttttcacgtgtgaaaaataaagcaggcatcactcatttccatctatgaatattttatatgttttctcaaaaaaagtgtttgttcattgttaatttagtttacgttcatatcggaacaattcacggtcccggaaaaaagtgacagataacagttcacattcagcgtttatagagaggaaaaaaaagagtgataagcatagttcaattgattaggtttcttatattagaattagcccatccgggttcaagttctacagcctgtttaggagagtttaagattttgataagccgctagttggtaaccaaaatttgaaattctaaaaaagttgagttctctatttctagtttattttctaaaattctacgggccaatttggtaaagctccaactcataaatttaactctaagagttgggtttggaatagagttgtgcagtagtctaaacccagctctatctctttattacattttgtgagagtgcttcgaccggctcaattcccgttttaggtggagctgaaactgtttagatggactctagctcctcctaaagctagagccatgccaaaacatacgccacaactacagcttcttaatatctggatgaaaaactgaattgtttatgggagtttctaattttgggagaagatgcagctgacagaagctctcccaaacagacttgacacggatgctcgcatttgtagctcattattcttttagtattaggtaacgtgtaaccattgacagcaagacgtccatggtccatctttcaaatatacttatagaggtaaatgtgccataagcatctgcatttgtaatgtatttcgaaaactgagattgcgtttatacaacgaatcactagactatatgtttcaataattcgatgaataaagtgaaaataacaaggccttagacgcagcggctgtggttaccagtcacacattaccttaagaaaaatgattttaacatgtgggataagcaaagggaatgattttctttttctaaaaactaacaatcccaaaggaggaaggaaagaaacnaaaaaaaaaaaagagcactgactttcgtgtaaccaaacggcccaatgcaaatccatccccgaatgctcatcaacaacgagtgtgcaagcatccggaccgaaatacgcacgcattacacggatgcaacccaaacccaacacggcaagtcgcggcccaccgtattctctatctctctacgcgtatatatgcatacgcgcccctcccatcctctacacgtacggttacacaaatccatttcccaaaagaattcaaaatttaaaacgtacataccacgcagcagctagcgcgcgcgctatagcttttccctccaacacacaagtacgtatctccc

SEQ ID NO: 2305 - DNA, 2000 bp, Oryza sativa
  misc_feature (222)..(222): n = any nucleotide
  misc_feature (226)..(227): n = any nucleotide
  misc_feature (254)..(254): n = any nucleotide
  misc_feature (256)..(256): n = any nucleotide
  misc_feature (261)..(261): n = any nucleotide
  misc_feature (263)..(263): n = any nucleotide
  misc_feature (270)..(270): n = any nucleotide
  misc_feature (406)..(406): n = any nucleotide
  misc_feature (1390)..(1390): n = any nucleotide
acatttattcttctttttcttcctttcttaagaggataataatttatcatctagaaagcaccagtaatatggtgtcgtattacgtcgtgggtacataattatatcctatctatatgtgtgcgatatttatgggttttcaacataaatttaaaaaggctagagatttcgacaacttgaacatatgttaggagactctgcatttacgaaattgcgagtatgctnaagnntgggtctctttagcatatgttaggggntnaaccnanggttgtntatgtatgggaaatgcatgcatagttgttggcttcttctgtcccatgaaaaacagaactaatacgagatttgatacatcataatattatgaatctgaacagacgtattatttactaggtttgtcttttatgagacngaggaaaatatgtacgtacgatgtatgcgtcttccatccaacggaaaatattattgccattttcttttaaaaaaattaaggtaaagaggggaaaaaatgagagattttatttgtgaggacagagaagtccatccacttgccccccaccctacgggcactatcttttaagccaaactaactccattaccacctccctcccttcttgcattggagtagcagcaaagcaagctgaacaagctgtccctcccgggaaaaacacacaggagctgaggtgcaagatgtctgcttgattgcctcctgcttcacttcactgcttctcttccttctccctctcctctctgcaatcttcttgtatttttctccctagctctcctgcatcagcatcagttcttgcctgtggctaaggatcttttgatcttcaaagggagagaaaaggatcttgcctgagcttcagtttcttgtaagttcatctttcctttatgttttctctgttaggttgtgttgaagttgttcagacctcatctcatgaagttgttcttccattggaaatgtgactcaattcagagagatggtgttatctagctttggagcagtgtgtgggattggtgtttagggattcatcagtctgtacatttttgtttggttggttcactacttatcttgagaggaaaaaaaatcttaccagtctactggattttttttcttggattgatggttctgcagtgcagccatttccagtttttgtatacacactttattccaagttcatctctatgaacattaatttcctagttctgttccttttcttgaattaggttagtcttgagggtaaaaaaaatctccctttttttctccactaaaaaatctggttggaaatcagttaatcagaaccacctccttttttttcagtacactccaatctcatcttggtccaaggaaagcaactgtttgctcaaacctgtggtctgcagcatgcagttcttngtttactcactgtttgactgccttacatgtgcaaattccttaaaaaaagagctcaagattggatttttatttgcaccccttcatgtggtttttcctccccactgcaacctgataagattccagcctcactagtgcttgtacccatggtctccctacaacccatcccccattgtctcacccaattattctcactgtctcctcaccccaagatgctgctcttgtgctttgcaggtgctgcctcctcctctgtgtttgtgtgatccaatttccaacttggaggagttcttggtttcctggcattgtgctttcttggacccagagcttgacaagattgggtcaatagtttgccaatctagagagagagagagaatacttggtttcttggcaagggggacaccagggcatagatctttgtagttaatagttgctcttgccctctggactgaggagtaaatagttgtgtgccagtggtctcttgcttcatcttggtcttgtggttctgattttctggtgattgttggagacttggaggagtaaagtaaagggtgaaaaaaagaagggaaataagaagaaaaaaaggtgacagattgaggttgttcttagtgtgtca

SEQ ID NO: 2306 - DNA, 2000 bp, Oryza sativa
  misc_feature (1725)..(1725): n = any nucleotide
tcatatcgtatagcacataatatgttcatatgtggtagatttagaccacgggtaacttagagaaaagatataagagaaaagagagaggaatacatttgtgaatataaaaacaactgattaacatggcatgtgaaaatcagtttgttgatgttgcgttacagaggaacaaataacagcgtagtataaaaaattgttgcgatgcggtttcttgcataacatggagcccaaacaaatactaggtttattatacaaaataatcagtaaacattttgaatttaaaataaaaaaagaacatctacacccatgctttctcgagtacccctacacttatctacttaacatgtgctttctctattagatctaagatttgaacttaagaaacacataaaaagacaatcagatgatatagcatataccgaaaaagttattgataattgggtagtctactataataaacctttgattaaaatatcggatatcgctaactcaatcctttgtttggaaaaatggcatgatatatcgaagaaaattacatgaggccggtcctaatcttctggatggcatgtggtgcttgagctaagtcatcagcgctatatttgatctgatgatgttggcaaaagtggcaaacacgttgttggtgaccaacaagggagaaaccggggaaaagaggaacatggcgagaaagatgaggaaaaacgtggaagaaggatgactagaaagataacccagcatgaacaattaattaatacgatggatgtggaaatcacagaggaatttcttcttcgttacccaatggatcagatttaatcatgatttgattgggtagtttaggatatgccaaatatgtccccacctgtgtagtaatctacaactatattcacctgtaagcgtagaatccattttttttcaaggaacaatgcattgaagtgataaacaatatagattgattcagggaacatatggcacatccttttgcacaaggggaacaaattattgggacaaaacgacctagaggatgagagaatatcaaactcttccttattcctttagctattattaacaacacattatatggggatgactatgactcctagtcggtatgcatcatccgacaaaagtgcattttcattcgatggattgattcatcgcccaagctaacccatggagctatggtttcttggcaaaccgcccttagagacccgcagggggggaggaggggggatatatcggatatatgaagtgactagagtagaccaagtctattagcgatactttgaactataactttattaatgccgaaagcaaaagataaaatagcaaactatcctgatcaagtaccatatgaaaagaacattgcaagccaagtcatgccaatctaaggagcgcaaacaaagtacgaagatcacggtatatacgagcactccctacagaaataaagcaaactttatgaaataattagggcatatgactcattgagattttaagtcaagcaagtagctagactagactaatctagatagcttaccatatttatatcttatcttactgaaataatgcacaataattagggaaaaagtaatattaccaagggacaagatttatatacttaataccgttgagcactgaagaaagaaatagaaagggtgcaagggttacaggagagtgtgaacatgtagctaagggatttctcataaatgtaaaagcatttttgttcttaaaaatgtntaaaaaccatttcccatcttacaatttgtgattgcattttttggaaaaaaaaagagaaggaatcccaaaagtgcccaacacaaagcttcgaccattgccgtcccaagcgttcaaattttccacctcgaggcctacgggcggcctgtacgatttacctgttggttcggtcgctccgttcctccggcttccgcctttcctcgtcgcggctatacggctattatacctaccagccaccacaccacccttctcccacacttctccactgactcctcgag

SEQ ID NO: 2307 - DNA, 797 bp, Oryza sativa
aaacatatatatgcatggttcagcaacagggccatgttaaaaaaaatgggtcagctcgatcttcatccggttggtaaggctcagccggccacgtggctgagccatctttagtcccggttggtgttaccaaccgggactaaagatcgatctttagtcccggttatttcactcgggactaaagatagcgatctttagtcccggattggtagtcccggtttggaaaccgggactaaaggggggttacaaaccgggactacaaagggtttctccaccagtgaaatgcgagcacccgtgtcaaatctacgacttgaacccaggtaagcaagttccaccacaaggaagctaatgatcagttcagctacgttcacttcgtcattaaaggtaggttgtagaactgatgatctgtacaatggtcgaaatatatgattcttccaaaaaaatgatctatgctaaatggatggatttcatttgttgctaccttgggtttcttcgagcatgtgttagtgacacactcccgcacggacgtgcttatgatgcgttatgcttgtatatgtggctttcaccctaatgatgataaacaagcgcaatgataagctgaagcagtacataattatgccccctaccccgctaatggcatatatgtgctttccttcataactcagttaggtatcaagttcttcattctctactctgtcgtggcatgacttttgttgctttaatttctagcttgctataaattcctgcacctcagtcctgtcccaaccatcaaattcgtcttgatcaaactatcagagcac

SEQ ID NO: 2308 - DNA, 2000 bp, Oryza sativa
  misc_feature (3)..(3): n = any nucleotide
  misc_feature (5)..(5): n = any nucleotide
  misc_feature (8)..(8): n = any nucleotide
  misc_feature (11)..(12): n = any nucleotide
  misc_feature (14)..(14): n = any nucleotide
  misc_feature (19)..(19): n = any nucleotide
  misc_feature (21)..(21): n = any nucleotide
  misc_feature (24)..(24): n = any nucleotide
  misc_feature (26)..(26): n = any nucleotide
  misc_feature (32)..(33): n = any nucleotide
  misc_feature (35)..(35): n = any nucleotide
  misc_feature (39)..(39): n = any nucleotide
  misc_feature (41)..(41): n = any nucleotide
  misc_feature (45)..(46): n = any nucleotide
  misc_feature (55)..(55): n = any nucleotide
  misc_feature (77)..(77): n = any nucleotide
  misc_feature (95)..(95): n = any nucleotide
  misc_feature (1072)..(1072): n = any nucleotide
gtncnagntannanatccntnatngncatttnntncaanancttnnaggggttancctggggtttcccccgccgggnagcccgggagccgttggnaccggtcagcccgggagccaccgccgccggttggcccaagcatttccgccaccgcccctggccaccgactgtcgacgccgccgcctccccggctgcctcgcgcacgccgccacctaggccgccacctgtcgacgctgccgcctgcgagccgcggccgccgcccgcgagccgacgccaacacgccgtggcccgcgctcgccacccccgcatgctgccaacgtagacgccgccgccgccgccacaaccagttgtggccatcggagaaggatggggaagatgatggagaggagagagaacgggaggagagaggtaggaaggggtagttcaatggcatttttgtgtaaatatagtaaaaaaattaaagggtaatgggtcttttggtgtggagttatggagcagcaaaaaactagctccacccccatagtacaaatttctgtagcaactctactaacttcgctccaaaaaaaaaggagaatcggtactatttggcacagctccagctcgaagtaagttggagttgggaattggagctgtgccaaacggagccttaatgggcttgggtgatgtaaatggatagtactgtgcatgcccgtcctttccacatcatgatttggtaggtgtaatggacatccagtaatttttacctttgtatatttgggtatggataattcaactaaatggataattagggggtgtggctaatgggcgatcgatcgcttggagagatcgatccccatgccccccctgtacacacctctcctcccttcctcctccccttcttctcttcctactacactacaaatttaaaaaaaaataaaaaacaaagttggaaaaatttatgtatagaaatactatatataaaaaatatttgaattcaaatttaaatttgaagagggtaattaaacttttgacttataaactttgggtctataaactttaggtgtataaactttagatgtatagaaatactatatacnaaaaatatttgaattcaaattcaaatttgaatgggatatataatttttgatttataaactttgggtctgtaaactttagatgtgtaaacttgaggtgtaaaaaatttaggtgtataaatttactaaaataggaaagtaaagcggtgcctaaaaaggaaaccacgtggaggagaggggggagacccgatcgcccctggcgatcaatccccattagagcaactccagcagagaccctaaactcagcccctaatcagtttttgagggtttagagataaaaactagattcagcagggaccctactagagcccccaaagtgaggaggaccctagattctcctcccaagcccccagtcctgggggttccgagtacggcccccatcgactttttttcctggcgtgaaaaaaaatccgcttcgcgcgatctcgcctcgcccgcgcggcactacgaccagatctcctccgacggccgccatcgactcccccacccacctccgccaagatcgccccaaaaaaggtgaggattttttcctacctttgttgtcgtcgtcgtccacagggccttcgacctccgcttgcacgcctggcctccgcctgcatgccagccgttcaaacgctcggccatcgtccgcctggccacacgctgcttgcctgcacactgtgttagagtccggatattctttgtacatgtgataatgctccatatagctgtcggacagagtttgttgtgttagttagaagcgatagaacttatccatgtaatctaggttctcacaacaaactctgaaccgaagctatatacctcattgtaatcctggcacccattttgtggcaatcatcaacacgtaatctcctcaccgtaggagttcctcgcttccacatggtatcagagcctgttgctagattagattagttcgtctttgtgtttctgc

SEQ ID NO: 2309 - DNA, 2000 bp, Oryza sativa
  misc_feature (828)..(828): n = any nucleotide
  misc_feature (890)..(890): n = any nucleotide
  misc_feature (917)..(917): n = any nucleotide
  misc_feature (1305)..(1305): n = any nucleotide
tatatagaatttacttaaaaaagagtccatataaaaatataatttaaaaatatctgaaattcctaattaaaaaaaaagaaatattcaaagagaagactagactccatgtatatacaatgtagaactaattaaaatttggaactaaagttagagtccataaagaaacaaaatttagaaataactaatatttggaattaaaaaataaaaaatattgaaagaatattttagattcattatggaaatacaatttacaaataacagaaattcagaattaaaagaaatatgggaagaggagtctagagttcatatagtaatacaatttaaaaataattggaattcaaaattaaaaataagaaatacttattgaaagaaaggtttagagtccatatggaaataaaatttataaataatagaacatttaaattagaaaataagaaatatttttaaattagaaaataagaaatattggaagaggagtctggaatccatatagaaatccaatttagaaattacaaaaattcaaaatttaaaaatagttagtaactatcacgtatatacaatacaatatgaatattatatgtgatatacaatacaatatgaatattacatattggttggtgctgttaagttagtacaaaatttaaaattatgttgctattttaatatattttaattatattatgtgaaaatatatgctactatgtgaaaaaaaataatgatatacaatacaataaaaatatcaccacatttgttagttcaacccaagaatttaaaattatgttgtcattttaatatattttaataataaaatatgaaaatatttaagcnaatatatgagaaaaaaatttaacgatactagccgtgcaatctgcgcgggccaccatgctaanttttttttttttgacaacagaggtacncaagcaactccaacttcatttcagacgtacacagaaaacaggtacaccgtacacgaacacctttactcataggcgtgcaagaccaagtactccattcacatcgcatacacataaaaactcataaatctcacgcaaacaagaacatcataaaaataaatataaaatataagatactaaaataaccagagcaaaggagatcactaagatgattcactcatagttatacgaaaagaaagaagcaacagagagctcaaccacaatgtttcagttccagacaaacgctgcgacggcgagcacagcggcagcaacagcaagtgagcagctcccaccggcggccatggggcccgtcgccgccgcgccgttgttggacgatccgctgtactgggcngtggcatcctcaaaacagctgacgatgcatacgacgaacagcacgagcttgcgagatgaccggcttgggagaagaactgctccatgcttgttctgcttttgcttgcctgtctcagagttcagatctcagagctgagacgatacacttgagcatttcgctcaaattgacaggatttatatagaattgcctcaagttgacatggtaaacatagtacacagatgcacaatacaagtttgtccatttctctacatcgtgttctgctcgccaggatgagttgggtttgatctggacggctggtttgttgctgcatattcgtctgaaaaattcaacaagcagatgaggtgctggctttgtttctgatgctagagttccttcctttttgtcacttgtaagttgtaactttcactatccatacaacaaacgtaacaaaatttccttttcagagaacaaaactgatgatctgattgacaacgtcagttcttatgtgtgttggtcgcatcgcatttatcaatgagcttagatgatgcctatgttcagctgatgcctgatgccatcagccacagccatgtcgatacgctggctgattagctgatcgatgactccaatgtaagcatggaaaccacctagtacatcatatggcactccggtgatgagaggagttcgtgttttcttggggcgctgcgttgctggagttc

SEQ ID NO: 2310 - DNA, 2000 bp, Oryza sativa
  misc_feature (1038)..(1038): n = any nucleotide
  misc_feature (1042)..(1042): n = any nucleotide
gacatgtattagggctccctttggcattagagtgtattctcaaaacaaaattatttgtgctttgggatatattatgagctgttatcgtctttttcttgagttgtagagaaaagtcttaatagaatcagtgacaatctccctaacccactctgatagtatccatgttgcttccgatgcttttttcagttgggccgagtactatgccatgccaactgatggtgggattctttgcttacgctaaatcattggagatacatgttgacaagaaagagcttgaaggtttgtcagtatgaaatgttattttttttcctactcttttttgcaactgattggcctggtccatccatataatcctacgtttcagtcggtcttctgttatttttcttatgcaatcttacaagaatatttagatactaactgagtaaaacttatctaattgttaaattggtgatctgtaatacatcgaagatacttttctacaatgaacttcataatagttctgcgcagaccttttagttctcatctctcgaatgccattcttttaccaatgtagatgcccaatggcacagccgtgaggatgtcaagaaagcactaacatttgcagaatacgagaaagctcagagaacaaatgcgctcaaggtcaatcaaatatgcaagggtgttgagaaaaggcagagcatctctgctgacctcaaaatcgaaagtgaggagcctgctccaatgttcgttcctgggccctatgcgattgctcaccacctcatatcatcatgggcttttgaaggagcaccaaaggcacctagctccttctccaacctatgagccttgatcctgttattcattttcactaaacaacacaacaacaggagatagggaataaaaaattttagtcccatgtatcatgtatgccttagtttcttgttagtgtagatgtgaaatgtgtccattgccggttgtaataaaaggttaagaaaagtacatcacgttcactggaggatttggggggagtacagattacagagcaagtgtaatattttagcntacnatttgtaacagtgtatagatgcagcacagatgtgctgatgtttgtatcttccatattcaaagagctggcatcaagtgtgaaattttgccaggtttgttacaagttgaggacatcttttacatgttgactggtatagttctgcttggagaaaactggaatattcaagttaattttccacatgagtacatctgtttgtcatgcaagtgaatcaagaattcttgtgcaggggttgatttttcagtgtataggggtatgaaatgaatgtagagagtgatgtgcctggacttttgttgctaatcataattgaagcttctccttgaaacaagcaaccacatgacatctttgactaatctgttgcacaaaaacaataattaacccgcatcaatcttcaactggtcaacataaaatctactgttggacagcaacaccgcagcaccttgtactaattttttttatgctttcatccaactactgacaaagaattctcgtcagtttttcaagttcagaacaaaggcaggaactctgattaggtgtagcctcatatacagtactaatatatgctaggagcacttaattaattgctgttcctctctaggtagtacttaattaattaggagtactaattttgcacttgtgacacgttttatgttgattcacagtgacttgattcagcacaagagagtggtcacagcaacatgtgcaaaattgtcattagacgaaacgtatcaagctctaattgcagccgaagaagcagaagcaaaccatccaatcagctgcacagctagtcaacacaagctagtcaaaccgttgactaccactgtctttgttgcgcgccagatttttccacggtgcacagccgcaacgagatggagacatggatagagtaataagcagcagtagccatgcaacgcaatgcaacacttgaatcacttgcagcttggaactgatctgatcagcc

SEQ ID NO: 2311 - DNA, 2000 bp, Oryza sativa
  misc_feature (89)..(89): n = any nucleotide
ttatacgctaaaaagcaaaagaggattttccggtggcaactgcagctgctacggataatatagcaccgtcaaacacctccttagttaancaatagcattttttaattataatcgacagaaaccatgggtcctggtcatagcatcatataacatgaagtggcagaaaagaaaataaaatgcaactggaaagttagatttgagacgtgacataagctatctttcttctgtgcaaatctatcgttaacacttaacatgtctttcactttcctcatggtactcatccctctactatcccatctgtaacccattcatatatggctatcagcttttcgccattcctgtttatgtcctatcccattaaaaaaagttaaatccaataacaacattatagaccaacaagctataaggttccaaaccgtacatcctcttgatggataagtagtaacatcaataaggccaagcctaatgttccactctatccagtggtctaaagcctccacatcggagccgaactgagttggcaatcaagcgcgtggtaccacaaggtcggacgatgcttgtagaggaaattatttctctccgttcttcggctcgggagtcgcgaagcctcgtgttggcttagcccggtgttggctgtgcccggagcaccatgccacacctcaccctggcggtccttcctcgtgtacctatctcgcttcatacacattgtttgagtggatgtgtagttacacttaaatatatatatatcaagacatggcttactaagtactacctgctctttgatcagagattttacttggtatgattataatcttcatacaatctaatttctccacaacgttgtcctgtgattgttttacagcgatactgttggctaagtttttgtaagttttattggtacagggagcgatagttaacattttgagagaatccactatatgacaccgagtttactccgttttaacaatttgccatcgactttgtctctctttataaatggcactggctttgtcattttttctataatatgttattggggtgaatacttttcaaaataataccttcaaggcttataagaggttacaattaattgatctactagaagtttcaagaaaatatatgttacaattaattgatttactagaagtttcaataaaatatgaatttttttatgtagccttctacataatatagaagtgtgtgtatatttcaagattttcattttacatgtatgaacttaaacaaaatgtaatttatgtttgttaatatagtactctcgtgttaatgttcttttctgtactgctgtacatcatcattgacatgctataattttttttctaatgcggctatattctatgtatgtgatttctctttcatatgctacacattttttttcaaaaagcatgaaagaaaatctcacacacaagcttctaaggctaaatacaattttttatatttgttttaaattatagtggatcgaacaattgtcaacacctgtagtatgtctcaaagagcattttaggcaattcttgaaaattattgtagaaaacaacaaggtcagtggtatatatttacaaaaggagataaagtcgatagcaaacagttgaaataaggtaaactcggtggcatatgatagattatctagacatgcatattttcagattcgtaataaatataccacattcagttctagattaatttattttggatgaatgtataacccttacctaacatcagatttgggccggacacatgcgaatacagcatttcagattttggcccatcacagaaagcccaaatggtagccaagcccactcgaccaccccacaggcccacacccacactctcccagtcccgcaccatccataaaccgccaccgccccacgagccgcagcgccgtctcctcctcctcccccgcctctccactttcctcccctccctcccgcctcccaccaccaaaatttcccccactttcccgcctgtctcctccagtccccgca

SEQ ID NO: 2312 - DNA, 2000 bp, Oryza sativa
agtagtggtagtggactggtgcaccggtggcaaaaccgcccgaagcagcaggtggcagtaaaaaactggcactgttcccctttttggcacgctgcaggcttgctgcgtcgacctattcgcctcttcccaccttgaagcacccatatcacgaccaccagcacgaggagtgcaaccaaccctaggtcctaatcccaaacgacttgtttgacaagagaagggaaggatattcggagtttgaaagagagttggtagagggattggggataggagttttatttttactccatgtcccttgtttggttgtagagatgagaggtggagggaacaaagaatgagtgcatgtactacttggaaaaatgaattttctggatcacgaaaaaatcacattagctctggtttgaataagaactaggattaaaaatatctttagtcccggtttaaaaacccatggtacttttttaatcttaccaaccggaactaaatattattttcaatcccggttcaaaacatgtcagatccccactatctttagtctattaccaacaggaactaaatatccatctttaatcccggttgtttataccaactgggacccaaactaaaaaaaatgccgaaaatccaaccgaatcccacgccctcgtccttttcccctcctctctcctccaccccctctcatcctcccctccttctccacctcatccccatctcctccccctcccccttcccctcctccgaagatggcgacagcgagtggcggcccagcggaagccacggcggtggcggcggcgtcggcacacaaggttgcgggcggcggccgggcggcctcccgccactagattcggtaggaagggaggccgggcggtggtgaccagcaggattttgtcaattgttttaagatgtttggaatgatttgtaaattttcttgtagtttattttagatttgtgaatgattttgtgaatgacttgtggattgtggatgattttgtggatgggcatgtgaattgtggatgatttgttgtgcatgatttgtggggatttgtggatgaaaataaatgcaagtagcaaaaaaaatgaaaaaaaactaaccaaccgagataaaatgccgtggtcccggttggtggttaagactaaagatttatttttactcccggttattttaacaaagactaaagataaacatttttagtcccggattaggcgtcctgatttacaacccgaaaataaaagggtttataaaccgggactaaatggtaggaagactaattcgtgcggtggagttggcgacggtgttggtttggtacggggagcgcacgaatacggcctgtggtggctactgtacaattcgaaatacgtagttgcgcgcctttaatttccacctacccaaagcttgcagacggaggggagctaggtgcctgtgcatgggattattaatcaatctagcttagatcatccatgatttgttacctacctagctcctaattaaattagctgtggtagaaaatctcatatggttttagttcttataaaaaaaattaaagtgctcctcgattgaaaacctttaagggcgcacattttaaattttactatttcaaatttaaattctcaaaaatcattagaaatttcactcagaatttacttccgtaccacgtcgaaacttgccaatctccaagttatcaattgaattaaaaactaccagtgtgcaacaggcaccacaaaagggtcatcagagcgaccattagtttgttgtctccgtctggatatttctaaccttgataagaataactaaaccctctagattgattggaccgactagcgacgacgtcgacaaatttgataaataaattaagcaaatttttttgctccccagtcccagatcgacgtcgatcgtagtactagcgaaagtataaataacgcgtaatcctttgcacatagaaggggcatccaaactagcaacttaattaggcacctaattaactccgacgatcgatcgataattaaga

SEQ ID NO: 2313 - DNA, 2000 bp, Oryza sativa
actgcacaacctcctctcgtgcgccaccaagcccacgtgagaacggcatgcctgctggtgcttttcacgtgaccttgtaatagtagtgatatgtttatgcaattaatgatccacatgaccatagtccatgcccaaacttgcactactaatccccattgcatgcagccaagtaattgccctgttttcttacacgaactgaagccaaaagcaccacgagtccacgatccgctctgccgatttcgatacatgagtttgctcctaactccgatccacgcctaccaaacagagtcctttacgatgtcgactccgaatccacatcttctccgagtcaagtttgatctgcgtcttcttctgcattgaactcaattttatcgtcttccttgctgcgtcatcgtctgcatcattaagcccatggcttcctgttcgtctgtaagccaacacgtgtattttgtgcatgtgtatagtacatactccatacgcactgtccgtgcctccgcacgcaccgcagtcgcagccctcgtgttcaccgtccacgaccccgtcgtcatcggccctacacgtccgccgcgccgcgccacgctcgccagtttcgcccttccatcagtggcctccctgccgccgcggatccgcattcgccgcgggcgtcgggcacgccgtacatggcgctacccctccaatctctcctgtcgccttcggccacgcccggccccgtcttccggtcacgttccgccatcgccggtctgatcgcgagcgaggtcatcgcctccgcaatgtcctcattgtcgccatcgatctcatcgccacggctgacgatctcctgtcgatgcgcgatccctgcctcgtgtttcctcctccacatgtcttcttgatccaatactgaaaccttcagctctgataccacttgttataaaagttagtcgatatagcggaacaacgactaaccttcccgatcgcttcaatcattgatcacccaagacatgccagatgacgacacaggaacacacgatatttgttaacgaggttcagccgaagcctacatccccggggctctgattatgggcgctcctccccaaccaatatagctcctagctgctacgagtccatggccacgccgacatcctctccctgcgtgtctacgctacattgtagtcgctatggttatattgtggtgcccccctctctatttaagagagatgccgggttacagaattcgactctaactccaccccctaacacctattacaattccaagtccaactgtaaccaaataggactagtatattcaacacctattctaacagatgcaaatgcacgagataagaagagaaacaaatagggtagcacatgttttaactcaactgacaatgagtactaggttttatgcggagtggagactttgttctccttcaagaatcctatacttcttaaatcaggaacataatccattattcagtcattaataaaactctctttaactagaaaaaaaaaagaagaccgttcaaacacaagaaactcttttaaacccttagggatgtcctctcatatgtcttaaaaaaccatataaatagctattaaaaattataaaataaattgacaacattcgtacaatatatataaatatcaattcataaaattttaagtccaaaactcaactcacacattttaagtacaaacccttcaaacactgctcttctgaagttgaagcttgggaagcaaagcccacaatgcccgcaaagcttatggtccagtcgaaagcccacagtgccggcccattaggctaagtaaggccttgggctccaggttggccagaatttgttggcctactacacgtgattccagcgttggaatcatcacgattctcgaggcggcggcgggtgccgaggtcacggactcccatggcggatcatgtctcactgttcagaacctcgcttctcgctttgacttcgtgaaccttgtgcagctccgagcttgttcgccgccgccgccgcgccgtgcgtgca

SEQ ID NO: 2314 - DNA, 2000 bp, Oryza sativa
  misc_feature (20)..(20): n = any nucleotide
  misc_feature (1010)..(1010): n = any nucleotide
ctgggtacaacgaagttctntggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtnggactttagtcccggtttggtagcaccaaccggggctaaagatcaccgggatcattagtcccggttggtattaccaaccggaactaaagttaagatctttagtcccggttggtgctaccaaccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtgatttttttcaattatgtaagaatgctactcgaatgataattctatggtatttttgtaattttttaatagcagtcttgcaataacgtggaattcaaaccaatggtaaatttgtaattgcgtgtgtttttgatacaggaattttgacaccactactatttagacccatcactgttctcttatttttatcagttagctcttttgtggatcttcttgtgtaaagtcaggtaagcttcctcggatgccctttatcaattcattcattcatgaatgtactcgtttgtttttcaaaaaccacacaaatcgtatacagctgtacatcgtatatggatttttccccatcaagcatcctctcgttttcttgcattttatctagatataaaaaatatattataaaaaatatgagatatatcagttcaaggatacgtataattaaattggatttctaccagctgtaacaaaactctaactaagtatccgtatacatggttatgtttgttaaagctaaatttaaagctgtatattcgcggagtgatatgccatatgctttataaaaaaaaatataaatattcaatgcctaaaactcgatcttgttcatcgaacacgtacgcaccattagtcgactgagctcgagagctagtcga

SEQ ID NO: 2315 - DNA, 2000 bp, Oryza sativa
atagagccacataagccatgacacaatccaacaagcgccacaaaagtcaagagagatctatagctacctataatctcgtcgagttccaaattgaggaatctgacgattgctagcagagtactcaatcgaggaatctgatgattgctagccgtcaaccacatgcttgacttttatgccgctatactgtcagactcctccccattgtacttgtgagagattgattttataatggcatctgcttcgaccaacaggagtagcgctattacccgtcaaagggagcctgaacctatacaaaaatatgtctcccgtctattttaccacaatcttgcatatgccatggtatcaacatcctcaatacattacaaatatcatagtcgggtacagtccgttgatagaaagggggagggggattatcttgttagtagcttttaatgttgactcccttagcactagaattagctttcagatgtgcatatctaattatggtttcaatccaacggcataaaatgtgacaaaccatagttcaccttatgtaaatcaacaacgttccatcaaattagtatagttccttctcaagatcaaaagtaaacgcaaaggacggttacatagctttagtaaaagaaaataagaaaattgctgtggttggcatggggctatagtcatctggactgtgtggaaggccagaaatacagcttacttcaaaaacaagagaattaaagatcctactgaactaatacatgaaggtttttactggatcaattcctgatccattatgcagatatcggaggactagcgaagaatactgcagctggggttggcgctgctaatgagaggttgccgttaaattatactccctccgtattttgaccaacgtttgatcatttgttttattcaaattttttgtataaatatgaaaatatttatgtcatacttaaagaacatttgatgatgaatcaagtcacaataaaagaaataataattgcattttttttaataaaacgaatgatcaaacgttaaacaaaaagtcaacgtcatacattagaacataaagttagtataattcaaagatatggatgaaggtcacaagcaatgcgcttgacgtggtgcaaatctggagttattgagctttccattgcatgtctgtgattgtaccaagtcaatcgacgtttgctgttttctttgcaaatagtcctagactaagttgcttgcagttgcaggattatggtggattggtgacggagttggtgcttatggcctttgttttctgtcaggggagttgtctgctctgcaggtcatataaactctgtaaaagtgtatattggcatttcgtcgatgaaatgggagaggatctcctctcttttttcaataaaaaaaagtaaatgcaaaatatatgtccgttgcaccgatctcctttccaaaccgaaagtttccctgccggcgcttgatccgtcacaccgatgacgcgacgccggtagaggcccggtacctgttcgaacaaccaactgatgtgcggctcctccgcttgcggcttgcctcttatcaacgtatcgccgtttccgtcatgcgtgatcggtgatcgatcaccgagagagaccggacgacgagtcgagagagctcgcgcgcgcctcgatcggcgcggcggtgactcgagcagggcctgaagtagctgcacggctcaaggcggcactccatcaccggacaccggggtccagactactcgtttccgttggagaaataaccacctttatccatgttgcttatccgtgaattgcaacagcattgattgttcgcgtttaattcgcctcggccatgtaacctccgacctgatcctcttggacactataaatagaggccagttcaggcaatgcaagagcagagaagcagagtacagcaggcagctcttcttctctttgcgaaggttggctacttggccagccattaggaaacaagttagtttggagaagaagcagagttgagactgcatttgcattgctctgtag

SEQ ID NO: 2316 - DNA, 284 bp, Oryza sativa
  misc_feature (19)..(19): n = any nucleotide
gctatatttttaaaactantaagaactttataataacattataattatattatagtagtatttttttttaaaattatggatatagagagtcccatagagagtccgacttgtttctctctctttttgggcaagtcgcaatcattgccttgtcccgcaccccacccccaccccaaccccgcaagcaaataaaggaggaaaacccgctcttccgccgccgccgccgccgccgcagagtccctcttccgccgccgccgtcgccggagccctaaccctagggcggaggg

SEQ ID NO: 2317 - DNA, 2000 bp, Oryza sativa
  misc_feature (203)..(203): n = any nucleotide
tgcacccccctcatcccaacaatgtgtacccccaagcagaccatcaggccgagcaaaggtaacaaggccaacagagaagcgcacagccatgaggattttcttgtggtgcagcatgtttagttgacaaatttgccctgcataacagcgttgttaactacttcaaggtgaaacagaatgcactcggtggccagccacagcctatnctcttatcacctattaatcgtagcaggcaaggggtgacgtcaaaagaaagttttgcaatttgctttcatagtttcattccattttttcgataatttcaaacgaaaaattaagttgttttgtctttttttttccttgagatgctgatgttggacgagtagttctccaattttggccacctattggttgtgattttaatcttaacttcttcaggacactgcgctgataagtatcgtcattgggaattcccattttggcaagtagttttataatttaccgctaagttttcgttcttatatcactcgttcatgttaatgtagatactgaaatcaatggttttactattgtttaccataatgttctttgataaaacatgataggtcgtacgtatatcattttcgaacatggtagtatattgctactatagtggtgcaccaccctctgttttgctctagcttcgccactgaccacaatctgcgaacatggtgacgcttctggtgtagcagcatccaccctccatgagactgctctagtcacgcatgtgctggtgccgcccgtcatctcctatggcttggttcaaccaaaacttcgtccttgcagccaaagatgacgaaatctctatcttcatctttaaaagtagtgctctggtgttatgccactccgtacaacaaaatataaaaatatcattttttttctacaatgatgattgttaattacttctgttataaatattgtttgaaagaccagcaatattgtcaatatccaactttcaagctagcaaaatgtatgcatatatttttttatgaattacctggcaaacctatctctagttgtgtcatatacctatagtcccatagtgtgacttttggatgtacatcgttaatctttagaaaaatataatgcgacatctcagtactatttcggttggtcacaagaaaatcatattattatatgtactagatttttcaattatacaaagaaaataagtagtcaaagttgatttttgtaaattgtgccaattttaaaaaatgatacattttcatgactggagggagtatacttgcgacagtttagcaataccaaacaagaccaacaattcaatgcacttgaccaagtatttgaacccaatacactttgtatgaagcaagcactttaaactaatacccacttcagctatttcagatgtctagtcaaatggccagcaaacgttaaatgatagtgtaattatatttatattagtacctcatcagtgtcttgaagtccagaaaaaaagagggtgagtccaaggtatacctccatccgaatgatgctatgcctgaaaaccttcaacaccgtgtgaattatggtgagagtaatttcgccctacgcaaattatgccagtaacgttctctatgcattcaaggcatccatatatgtagcattcatgtgagcaacacattttttccatatcatctatgttaaaataaagcagtatgaaagattcatcaagaaaataaggcataagccaacttccaaacttgggagtgcttatctggttatctaccatccatacgtaatcgcctagaacttcaagccaagcacatcatcagttgcacactcttttaataaagtacatatgacaaacaacacacctaccttaagttttttggatgcagtcatgttacacctttcaaccctcttctatgttctaacagccaacttcgtttttgcatcacaggctataaaaaggggtggcatccatagctgaagggacacacctagaaaatttaatagaactttacaaattgagtgttatagtg

SEQ ID NO: 2318 - DNA, 2000 bp, Oryza sativa
  misc_feature (981)..(981): n = any nucleotide
gtagaaaacttttactttagagacactttagagatattttcagcacattttattaaattatatcttgtagaagtattctttcgacactttaaaatgtacctgatatgtaaatgcatttcttgagatattttaaactttgtacaaacacttactttttagaatgataatgtaaactgaagaactaaatataaataactcaaagcacaaacatacaagtaacgacataaggttgagttcgctagtgcattgaagataaaaatgatttgtccaagagatcttgagctcaaggatttgcaatagcaagggaaaaatattttactccttttttacattggtttcatagggttgtggtacaatttaataatttaatgcctctaccattttatagacattttataaaatgtctctttgcgtttcatatggttgtggtataatttaataatttaatgtctctagaaaatgcccataccattttatagatattttataaaatacctctttgtttgtacagacaattcaccgtaagtgtcactagaaaatgcctctaccatcttatagatattttataaaatacctctttgtttgtagagacaattcaccataagtgtctatagaaaacgcctctaccaacttatagacaaatttataaaatacctcttgtctgtggtgaaaaatgcctctaccatcttatatattttataaaatgtctctttgtttgtagagacaattcaccataagtgtctctatagaatgcctctaccaacttatggacattttataaaatacctcttatttgtggtgaaaaatgcctctactatcttatagacattttgtaaaatgcctctttgtttgtaaagacaattcaccataagtgcctctggaaaatacctctaccgacttatagacattttataaaattcccattgtttgttgtgaaaaatgtctccaccatcttgtagacattttataaaatgcctcttngtttacacagacaattcaccataagtatctctagtacatgcctctaccatcttatagacattttataaaatgtctcgttgcttgtagagacaattcactataagtgcctctaccaacttatagacattttataaaatgtcttgtttgtagacacaattcaccataaaacacttcttaggtattttattttaaaatgcctctacagtattgtaaaaacatttaaaaagtgtctccacaaagcatttttcttgtagttggctcttattttggggttggtcttgccttccataggtatctctccacgtcccactaggtgtacaaaccaaataggactaaagaaaaccttagcccaagcaagggaacttgagaaacgacaaaatcaggcacggagtcagactctgccagtctatctggccacatgccgtcagttagaccggccccacactgtctgtctgaccggctctatgacgatagtcagacttgtcgcgcgtagcaagctaggtccttttcaaatttggctatattttcctattttcgctttaggtgccaaatttagggttttatgtcacatactccatccaagataaaaaaaaatctaaatctaggacgaagggagtaggtgaatttgtcatattcgatggagaaggaaaaaaaaaagaaaacttggaaaactgtctagagccttcgcacatagttttcgaatacgattatgctttaaaaaaacaaatgaattcacaggtaatagcagctaaacctctcaaatgtaataccagcaaaaccgtttaagaaataccagcgaatccttagaagcacctcaaataccaccatactttttatttttcgtgacgtgaaatggttacgttgttgcaaacaaagcatattattttgtctatagtatgaaaatcttgccccagcgatctctataaatactgagaacctctagaaagtactccaaactatcatcagccatcactttcccccaccttatcaatctgccctcctgaccctagaggtgacca

SEQ ID NO: 2319 - DNA, 2000 bp, Oryza sativa
  misc_feature (1573)..(1573): n = any nucleotide
  misc_feature (1850)..(1850): n = any nucleotide
  misc_feature (1892)..(1892): n = any nucleotide
atatctgggccttttgccagaatcccagctgaaatttctgtcggtttccatcagtagaaaaacaaacccaaaaaaagagaaggtaaatctttgtcgcatctcgccatgtaaaaaaaagtactccgtactctataatctttttttatagggatggattacattagcagcaaaaggcttgttttggttactactactacgcatcacgcccagaacgtcgcgagatcgcccatagaattatccctatacgtggacacgtagggcctatctttttcccgtaatataccgtatggctactaatatactccctccgttttaaaatatttgacaccgttaatttcttagcacatgtttgactgttcgtcttattaaaaaaatttgtgaaatatgttaaactatatgtgtacatgaaagtatatttaacaatgaatcaaattatatgaaaagaataaataattacttaaatattttgaataaatattttgaataagacgaatggtcaaacatgtattaaaaaatcaatggtgtcaaatattttgaaacggagggagtactccgtactaagatttccatagagatagggtctacttcctctattgtatattataaattctttaatttttttctagtcaaattttattaaatctgatcaagtttatattaaaatttagcaacatctaaaatatcaaattagttttattttaataatttataaataaatttttatgtatatatttttagcaatttagaaactaatgataagaaataaacttggatgaaaaattaaaaacggaaataaattttgatttcatgcaagggaaacaccggtgaggccgtggcgtggccgtagcggtcgtctgattgggggaaagcgccagacttccttttctgccgaacgagacgtcgcgtgccgatacggctggggccacactccggtacacgtacacgacgagacgacgtccgtgcgacgcagcggcggagagatactagtaggagtagtactacacttttgcttggttcttttcctcgcggggcacgcaaggtgcggtccaccccctcctcgcggccattgcgcctctctctctcgccgaagtggtagaggcaacgcagcagcagcagcagcagcaagtgtccctgtgtccgtctccgcttctcctcctgcctcctgcagtctcgtctccaccgactgcaactaaaaccctcctcctccggcccctctcaactgcagagcgcgaccaccacctcagacaaacccgaggttttcttcttcttcttcttcttgatcgatgcagccagcagccatcgttcttgcggggaaagggttcttttttcgttttcttttttttttgtggctgctgatcggggattatcaccaccttcgcgcgatctctcgtttttttctctgtggaattgggggtggtggatggatggttgatactcctgttcatagatggcgatggtccaagtttatccctttttaatttttattttttttcggatttgtcctgttgctgtagttgccgtttcttggcttcttgctttcaatgccttctctcttctccttttctctttcttncttttttttttattttttgttgttgttgttgttgttgttgttgttgttgttgttgttgtctgttcttgggggtaatggtgtcccgatcgtattggacaagccttcgtgtatgtcactgattggaattggagtgtggagttagacgccgacaggtgaggcagatgaacaagagttccaacccaaaagttcactcatgaagtgttgtgtaaatagaagtaaatataagggagaaaatactagttgcttgggggagttgggattctccaaaagattgtgntttttttcccttttcggttacgcttggtgagaagatgaattnattttggagatggtggacgacgcctatatttctgttttctggctatctaattctgacgatggcgtctcatgtttttcaggtgcgtttcgcgtgaagcgggttttaagg

SEQ ID NO: 2320 - DNA, 2000 bp, Oryza sativa
  misc_feature (1125)..(1125): n = any nucleotide
aggcggatttcggggcccgacgcggcggcggcgcaccggagagaatgacgccccgcggcggcggcggcgaggagcggcgagctggtggtgggtggggaatagggcaaggggatttttattttttttttattttttttcttcttcacaaaatgcgatgggccaatgggaaaatggaaaatgaacggctatatttgcctgtagtttgctgtactttgctggctttcctaaagatttgatagtcatcaatatttgtaaaaatattttgtaaaattttaagaagggtatgacattgtggcaaatcacattttttatatgaacttaagcatgtgagattatggtcaaagttttaaattgtataccaaatattgtcctgaatattaaatttctacgagaactttatcctaaagattatcctaaatattaaatatcaaattttatatcaaagattttttttattggtatatatgctctcctctcatcaatcttttttttccttctatgttatctatttcgttttcttctccaactagaggtgagtcatcgcaaaaccaagctttaaaaagcagagaaagaggacatggaaagagaagaagaaaaaaccgagttttaggattttgacgggttggataatacaaaacgtgataaataagtagacataacatgttttttatagtatgaataacatgttaaaccacatgttttttgaactcataaatggtataattattttaaaaatatatatatacatgtgaatttcttacaatattgtttaaatccatttcactttataatttaatcattcatttataactgttaacaataatcataaattattcagctactcagccatatgtagcacaaaacaacgtggacatgcaaagaaaaataaaaaaaaaacagcactacattttaacttcgtgccaaaaacgttaagcagtaaattataagtaatgggtaacactaaaaggaaaaaaaatattcgcttcatccaataaacacaacttaaaatatgatatgatgaacacagataacgttttgttgtataataaatctggatagttcatgtgtactatgaattctggttggttttttatgggacagagagattactgctcgttcagatgnttatagtatttggcgtccgtttaaatgttgctatattttaacggggtaatagtaataaacccgttttgttttccccaataatgccaaacatcacacgctaagcctgcctgctctgctaatccccctacgcaacacaatccccttctctccttccccggaagaagaacaaagagcagctgaggcgagcaagcaaaggcaacaccaagaaagcatccaagatctctctctctctctctctctctctctctctctctctctccctcccttccacaacgctcgcctctgttcgtcctcctcatccgcaaccaccccgaaggcccaaccaagatccacaggtgaggtgagctctgtcttgtttgccgatgcttgacttgcttctgcttggagggtgtccgggttcttgattagatgcgtttccgggtgcaatccggagaggatatgttgctgaaatcacggtgttcaatcgagaaagctactaacttgattgcttgattctccggctgctcgctgtattgttctctcttgtttttttgttttttagttcagactttagagatcagagtgtgcgtgagctgttcttgattcgattcgatcactctagctagatcgaacctgcctgtgtggctaatttgattatgtagtttgtgcaattgaagaggcggacccgatttggggggcaaaattggttctttttttttgtgtgtgttctgctcttgcttacatctgcaatctacaactctgaatcttctgagcatctattttctgtccatttacattgctgtcagtttggtttctttgagtagtaataactaactagagttagcactttttgtatgtatagatggattgttccaatggtgaggttcagcatcagt

SEQ ID NO: 2321 - DNA, 2000 bp, Oryza sativa
tgaggcgaggcccaagagatttcagatgacggcttctttgatgggtgaagatgagatatgtattggcggtgctatagggtggttaaaatgtttgaatgtgaactttttgtttctcgtgtgtacttttacacttagtcatatgctccttggcctttttaaaagttatgcatcctattttcccaacttttagggtgcatttgggagggcataaggccatcagcaatgcgtgtttctagcccgtgccctcgtaaacagtgtgctccttccgtcaccgggccgtgccccaggcgagaggcacaacccccacgcgggagatgggtggctttggctctgtcgagaagtgaccctctctagcgggtggtcgtgagacccctctttgtaagttcagccgggggaaaaggagcgctgatcaagagcgtatatacgcctagagtgctcagagtctacgtgtgagactggggattatacaggttcgggccgcttagaagcgtaacaacctactcctgtgcttgggattatagttggcttttacagagtttcttgagctccttggagaacctagctgttcttcctcaggctcaagtggtcgagagtcgtccccttttttcggtgggcaaggtcctctttttatagttcaaggggataccacatgcaccgcctctacctactccttcatgaaaggggggacccacaccgcctggaacggactgccattcgtgccttcgcctagaagctaagcagccgtccgtccttgagtggggcccagcgccatcccccgcctgacacgggggacacccctgtcattcccctttaaatgaatggagacttttggtggttcacctcacgtggagggagctcctgacgatgcatcgatgggacggagcatacctgcccctactccaccgagcacagggcggaacgtgggggcaccgttgcccgtccaatcggacgtgaccggtcacaggccagtcacaatccggtcatgcccgattgacgtgggtcattcaggcggtgccgcgcgtccgccctcatcgcattaaacgcagcgagggacggttgggacgtcgcgcattaatggcgctcagcctcacccttcgccctactcactttccccgccacgtggtggccgggcgagggcctcggggttaggcaccccgagggcctaaggggtgtgatgtggcaccccgaggccccctagttgcctcagcgtcgtccggggaaccttggggggggggtgggcgaggcttcatggtcgcgtggctagacgggaaggagattttccttatgttcgcatacccccgtgcccatatcaccgacagtagcccccggcatcgcgtcagacagcggtcctctcagggcggtctggcgtggtgcctcatgacttcccgtgccgtgatggtgggtcccgctgggattccaaacagccgccgtcggctggcccggctcgagcgccagccatgacgatggcttggccgctattaactgcgccactcacgggggcgcttaattcgggaaaatcgaggggtctgccagatcactcccataattatcacctaacatcacctcgactcccccgctgtcaggcatgcgatgggaccgacggcatgcccgcctagccacgaccgtggtcatcgcatgccccgcgccgagcgcgcgactgacaggcgcattaagcacggggcacgggtttagtggggcgaacggggcgagtgggcgcgagaatcgacgaggcaactgcagtggcgagaaacaaggaggcgggcgcgggcgaggcgaggataaaaaggaggggagatggagaattcgtctccttcctttcgccgatttcacgctcgcatactcgctcctcagcccccaacgcatctctccctccaccgtgctccgcgcaccaagctcctcgccgactcccgccggctatcatggctcaagacgctggcaacgccgttctcccaacagcgcgcattacggcagagaggcatcttagcctcatccgcaagatc

SEQ ID NO: 2322 - DNA, 2000 bp, Oryza sativa
  misc_feature (555)..(555): n = any nucleotide
gaaccttggtgaacagcttgttctcggggttggaggtaacgaagccgacgtagagtgagccctccagtatagtcaggatctcggtcgcacgtgggtgaatgtgcggagggttaagaccatagggcgcatagtcgacgcgggccaaagagatgcccaaggtgttgagcccagagatctgggcgacgttgactcctgtcacggccgatccctgcctgttgctggtgtttccagccatgtgaaggccggagaagaagaagtcttccacggtgatggccgctgggtccttgcatgcaaatccattgactagaactgcaagtttgcccaaacatgtagaatagttcaatcggattagttaacaacaaaattaccctgtttaaccctaaagacaagtacacgctatattactgatttaaatgcacatataagtaaaatatatggaaactaactgtagcatgtttgcagtattaccttgcgacatcttgtcagcgacgcagaagtcctggagttggctgggatcggaggcgaaagcattcgaaatcgatacagccaggaggncaaggaggaagaaccatgttgaggccattaggagtttaggacactaatcactaaatcaagtgcgtgtcaattttagcaggaaacaaaaggatgcaacgcaaagtttcttgtgatgtgatgaactgatgatgatgctttgctgtgtgcttcaaacggggtgagagatacccagtatatatagagatggagtagagtaggaggatcaagctggcttgtgcttgctttgtgttgagaaagttaattggatgtttaatatgtattgaggtttgaagaaatggtctacgccaattctctggtaatttggaacaagtctgaataaacgtgttgtggcctgcctgcagcagcggctacagcaaattcagtaagaagctaatatagcttctgactgattcttcatcatgtgtaaattgtgctctctccaggtggactcgatggtaacggcacctgcttaaacaaattacgtcaagcaacaatttaataatggctatgcattacgcgttcgtcgttcggttaacaaattctgtttgggaaaactacgttttaattaggtatcattatcattgagaaaggcatgcagcagttagcaccacaacaaggtgtggattagtcgatgtactcggtttcaaggcatgcagagtcttaataaattttgatatgggagtccgtcctcttatatccaacgtttaattaggcataattttgtagatagtataggcgtgtagtcaatcctctgtcatttcggttggtcgaaggagttttaatcccgtcttcttggaaggaagcaagcaatgaaaagcaagcattattatttccttacgtgcatttttctccggaacaaatatggtgttaattttaattgctatgatgagataagaatattacaatggagatcggaccattgtcaatcgatgatcaggccggccggcaaacagcaaaccagtaaagaattaatatgatccatatatccaccttggacaacattaatagccacggctgctaagtctgcagatacagtactcatccatggcttagacttcttcaagcacaaagcatgtatgataacattaataagatttatttcaggatagataggtatatgtatctgcagactgcaggtgcccatccacgcaatattatgtatttatgtatgacgccttcttcctatctagctactagctagcagtgactcgttcttggtgctgtacgacgcatgcatggcatgcacagacagacaatattctctgtcatcacaatcattaccagagatttcagagttcaataggctattctgaaacctgaactccccctataaataccagctttcctctcaatccatgacattcttcatcatcagttcatcacaatatatatatcatcagagcaatctgctataccataagtattcttttctatagagaactctctgcctcctccaggctccagct

SEQ ID NO: 2323 - DNA, 2000 bp, Oryza sativa
tagagaagaaaaggagtacgacaaacggtatctttcagatattttccggccactgccttgcgagtggtttgtatttcgtttcgtcgatgaggatgctgtagtttgaagttcacgcatgtgtcttttgcagagatagattagagcaaaaattggatcacgtgcgtcagtacatgagattcatcgatcaaaactgtgaactcggagtgaccattgaatcatcggttcattgcacattcacacaggggcttcgttaaaatatcgtcgtatcatgtaacatttcttctacttttgcgtattggagttaaatcttaaaatcatgatcttaggctatgcacgatcacctaatttctcttatacagaatttgatggtgtactgaccggatgaagaagccatatggttgccttagatgcgtcggtgtagtagttgtgaggcgacggtgatgaagatcaccatgcagtgacggcgatgggaattcgcccttcactccccttcaacacgccttaaaatcggtagtttgagggtttggagaattggcttagcgtacatgagtcgtcgctcgtgcacggggttaaggttccctttttatgcgtattgaggggatcaggggtgattccttctcgaggaaaatgacgcttccgatcataaagctaaagagagaaacgtgtgagagaatgcgtgagactcgttcctcaatgttagggatcgcgtgggctttggtgggctaagcccaacgctctcctttctggctcggtggccagacatcaaccaacattgcgtactcgttttgcacatgtactatcttggtgttatgcatctatttatatatgccctctgcgttccagatttccgggcgtccccaacctgcaatggaataagttcactttgagtccctcaaatactgctccaatctgattcatacccctcaaccacaataccatatatcttgattcttgacccttaaactatattggaaccagtgttttcgctgacgtggctcgttgacttggtcaacccctacgataatgtggcagcccagtcacaaattagaagtgggcccatatgtaagtgactagagagagaaaaaactatgacccatttgtcatactcgttgacactgtaccccttatatctcccttccctctcctgctctccctgatcgacaatgccgattggcgaacgagggagcggtggcatgggcctggggtggcaggtggcggcgatagccaccagcaagtgccggagaggcggagagggggctagggaactggcgtgccgccagcactaggggttgggggttggggcattgccgtggcagcggaggaggtgcactgaggagaggaggggtgggtaaggagcagatgaaagcggagtaatggtcgcggcgaaggaggagctcgagctccatgacgtagtagagagagaatgttagtgggcccacatttatgtttttttaatttttatatgccacataagcatcacgtcaatgtcacgtaggacgaaaactggtcaacaccaccatgtagacgcacgacagcgaaactgctcttcaaaaccaccgaggaagacaaattgcatcagttttaatagttggagggtcaagatacccggttagtcaaggcagtcaaagtgaacttattcaacctgcaatccctctgtctccgaacgcaggcccgttggcccagctgcgcaatgcctgctgccgtgctccgtctcgaactctcgatcccctgtaacctgtttctcgtcttcctactcctttggactactagcccgacgcgaccaaagctgaatcaacctatggatgcagtggcccaatgcccactggccagctggtccactccgtcgatctcgtcttcttcctttccacggcacacggcagcgctgacggaatcactcactggccactcaacttgctactcatacccgatgatcaactgagccaatatatacactcgttctcttcagacttcagtgcaagatcacgattcacgagtccgcg

SEQ ID NO: 2324 - DNA, 2000 bp, Oryza sativa
  misc_feature (1249)..(1249): n = any nucleotide
tgagactgtatcggttaggtctggtcttctgtcttagacgatatatctctacaattacaatgttgttttaaatatatgtggtatgtccatcatgttttcataggcttatcggcttattgagtattagattattatatacaatcatcggttaggtttgacctactacattattgttgataatctaagtattgttaagtcgataggtttcttacctatgttttatcggagtgctagccaataaattatttgtgcaccagacttccagccaacgtaagttttaaccactgagccaacatttaatattcagcataaatatcgtcgattggttcatcgggcatctacttcattatattataatcggctgattggattgtttgttaaagttctatcattgtttatacaagtgttagaatctatatcggacatatagtcgattgttcaaaattctatggacattggctagtatcgatatcagctaatatcgctacatttgcttgttagccgatcggcttttcgatcatttacatatttatatgtcttgttagtcgcaggatcaaactgactagcacgcccgtatctcatcaataatttagaacctgcactagcgttttttttcggagacctgcactagagttaagcagatctcccaaacaattgtgttgtttttcgcgtcaatggaggtgagtgttacatcgataatggtgcgcttgcgaattttagatgtgaccgtatcacaacgacgactatgtagttttttttttttgttagttctcaactttatctttctctttttcacacgcatgttttctcaactactaaatgatatgtattttacaaaagtattagtaagaaagttactttagaaaattatattaaccaaaattttaagttattttaattaatacttaattagttatgtattaatctatcgttttccatgttgcatacgaaggggaggaggagttgagaataagtcacatcaacagtaaataaagtcaaactcgcgacaggcgtggccgacctcaaccacacccgaccgtccactgaaccgggacatcctcacggctctccccaatcccctatcccccaaacccgtccagatccatcgtgccagctactatagctcccaaacaccggtcgtaactcgtaaccccgtacggagcgtgtcggtgtccggtgtccccccgtatctccgtgcccccccaccacccacccacctacccccgtcacgtgccggccatcccaaccnaaaccagctcgttttccgcgagaacccacggccccctcggtctcccctccgtctgcagggagccagacacacggggtcgcggccctacgtgccttgggccgtgcggcccccatcgccgtcctcatcctgatcctaatcccaagcgaccgcggcgcgatcacgcggcgaccaaccatttctctcgtcgacgagacgacgtgcccgccgctcgccaccccccccaaccgctcgcgcggcataaatacagcacgccacgcccatccctctccctctcaccaacaacagtaacccaaccagagagcttgcggaagcgggggtttggtgcgggcgcgcgcgtgtgaggggggagagaaggccaggaggaggcgacgccgtcgcccgagggaggcaaaaatccgatcctcctcctgccctgctcgctcgctcgctcgcctgcgctgcgcgcacttggccccgtcccgtccgttcccgctcgccaggtgatttcttgcagccatttttccccgagattacatggtttgtggggttagttgggtgggtggtgatgccattgttgcgtcgaatggcccgctggggttggatttgaggtcgcaatcctcgtcggtgtgccccgaatagagtgattcttgtctgcttcgggggatctcgatttggggattaggagaagctttacaatcttctcgatagtatacaagattttctttctgatttatctgctgtttttgcgctcaaaatgtgcaggcatagaaag

SEQ ID NO: 2325 - DNA, 2000 bp, Oryza sativa
agtcctccgatgccggcatttgccaattgccgtggagaccttgttaaaggaaattgtaagcagagagatgcgatgggaaggcatattgctgaccctctgcctggagaattaggaggctggtgtgtgataaataaagcgtccgactagttccggcatgtgtttctagaaagattctgtgctgttcgtgttgccattttactctgaccaggcaaatcgttcgtctgttggttgttgtatgtatcccggccattgtggtcgccggcggtgtgcattggcatttcaggtgattttgtacatatgcttcttcttccttagagttggttgatgatgattctcgtctgaacaatgaataggaagtgtagcaagatccttgcgatgcatggggggtgctagcttatgattcttgttgggtacatttcatatgtagaaaatttcacaaattcaataggaacattgtgatatactagtgaagagccttttcactggttgagtaaatttttaacctactgatatatgtatatgaaacatactactagtttttatttatttatttttgtctgaatagtgttcagtcggtttcctttcaatttcttatcttacgcacacatgccgaactcgggttgctatctggcccgtcccaagacgagttctgatcggatccggcccagctcagccaatgccaagctgcagatgatgaacaagaagcatatggccttatcttatcttttcgtttatatttatacttatcagacaaaatttaaaattttaacactagatttaaaactaattttcaggtttttctcattaaaatttgtttttcaatctttgcttttaggtcgttaagaacacgtatataaaaattttattcacaaattacttctcatttacgaatatgccgtttggccaaacaataggcatctgaaggtgcaggtgacgggagcgaacaagttccagggcctccttccattctgctcaagcagcagcagggggaggaagaagtagttaccagcagtttattaattaggccaagtggacaagatcgatggcgcagaaaacgtacccttccacaactgtataatctagattaaattttacaaaaactacatgtattttacattatttataacaaaactataaatttaaaagcttgtttttttcgctgggatggtgaagaatgccgacccgatgtatattaaggaaaagggaaaaactgtacaaacctcctcgggaggaggcacaaatgtagtgcatcaaaagcaccgcctttacaacattaagcaagtttcaaaggctataatctctctaaagctggtgctgcggcaacactcaatgagctaactagccctgctaattttcaagtttcccattcatcacacatgatcgcacacagttgtgtgaccgacgagcttgttttataaaattacaaattcagcgtctccgtttatcacgaaactagacatacttcgtgcaatatatccatcaacacagataatctctatatcggtaatcactaattagtgagcagatcatccatcaacatagataagatctacaattaattcgttacgaatgaccggtttcgtagtggtggtggagagggaggccgccgaccaaaccaaggtcctgcggccgggaaaacgatgtggcttttagtagcaggagtcggcagaaagcatgttggtcggagaagaacatatgccgtacgttttgtacaggtggtgcatccagaagaatctcgatcgcaactagcggggacgtgtgtccagtcctggtgttccgatcgatcgacgtggtgtacatgcatcgcgtccacgtaacagccattcatgcatgatgatcgtctttgtccatcgaccaaagtcgtccaagtgcagcatatatataatcggatgcaactcgagcaaccttacttcccatcatacgcactgcaagcttagcttggtgaggatcgatcgatcggagaagatcatcagattgataattaaagtaagaaaggtcga

SEQ ID NO: 2326 - DNA, 838 bp, Oryza sativa
  misc_feature (110)..(110): n = any nucleotide
  misc_feature (715)..(715): n = any nucleotide
  misc_feature (757)..(757): n = any nucleotide
ctgggatgcctcgccttcgacgacttcgccggtgcgctgcccgttgtcaccggctctgcctcagctctcttccccaggcttggcggctctgggcccaccgttcccatgcngtcattactcaccccccgtcagccctggcatgcatggttgtggccccgcctgtcagggagaggggtctccaaagagagctttttcctgaggagccattaatgtcgacgcctgcttcgtcgtcaccggtgcgccctgacgtcgatgcttcatcggtcctggcgcccgctgagcgggatggagattttttcaacttgccgggagcgcgcctcgctccctcttttgtgtcgactttgctcgtccctggcccattggctgtctaccgccgccgccgggagctcacttggcccgcgggcctttcctctttttgggctgggggtggaggagtgggctgacccacggtcgctccttgccgacccagtcactctctcttcgccgcgcgaaccttctcaatctccacggcacgacaaagcagctggcagcccagaggcggctgttgaatgggccacggctgctccccgccagcccagtcactccatcttcaccgcgtgtctctgctctgtctccaccgcgcgatggagtggccatcgatccggaggcgtctgctgccgcgccggcggccttggccgatctggtgggaccaccgccttcgtcgcttcttgggaancgtccccgccaaccttgacaccgacatcgctcgtccccgtanactccaaggtggagtgagcgccttgccgcccagaatggtgggaaacatatccacacgatcactagagcacaacgggtggtg

SEQ ID NO: 2327 - DNA, 2000 bp, Oryza sativa
agcagaacccgtggaagatggcaccgacgacggcgaggatgagtcggagaaaaagaagaagaagaagaagaagaaatccaaaagcaagagctccgatgatgatgatgatgatgccgagaagaaatccaagaagaaatcgaagaactcggacgacgatgaagatgacaagaagaaatccaagaagaaacccaagaacccggacgacgatgaagatgacaagaagaaatcgaaaaagaagagctccgatgaagacaacgacggtgccaagaagaagaagaagaagaaatccaagggcaagagctccgatgaggaagatgatgaaaagcccaagaagaaatccaaaagcaagagcaaatcctcctcctccgacgaagaagatgagaagaaatcaaaatccgagggccaagccgcggccaaaccaaaggaagaagacgaggaaggcggctcggcatcggcatcggcatcgacatcggcgccgaagaatgagcaccactcgggcaccatgtcgctcccggacccggacatgatcgcgcagccggtgatgcaggcgctgaacccagtggtgaaggcgctgtgcggcaagacggaccacgccgacctgtgcgagtcctccatcgggcagctgccgcagcagccgccggcgcagctggacgacatcggcgtcctcaggctctccatgaacgcgctgcgcgccaaggtgcaggaggcgatcagcgtggcgacgaacaggatgggggcggcctccggggacgaggtgtccaaggacgccatgggcgactgcctccagatgtacgacgacatgaaatccaacctggactcggcggacgcggcgctcaagaagggggacaaggacacggcgcacaccatgctcgactccgcgcgcaccgacgtcgacacctgcgaggacggcttcagcgagcgggaggggctcaagccgatcatgggcgacctcgacaagatcctcgccgagctctccagcaacaccatcgccattgcctccgccataattgagtgactcatctcattttctctctgtctttctccctctgaccgtcttgaacaaacaactgaagtgtatgtagtatgtaccgagtgtttcaaaagctgaaactgcattatgtatctgtaccattatgattgattattatgacttgtgaaattgtgaattgtgattatgacatccatccccttttttaatcttgggattcttggttaatcagattagttaacttgtcaatggggaggaatttcctataggcgccaacattaatcagcaaacaaagtttcacacacacacacaaattttgttcagaatttgtttctttcaacaggggaaaaaaacccagaatttgcagggaaactttcgtttgattaataataagaatggagaagctttttatcagcatattaaatttcacataataaaaaagtcgtttgataagtaagagtggggaagctttatcagcacaggaaatttcgcaaaaaaagaagattcagaattttgctggcaaagcttttatttgattagtagcaatgagagtggaaaaaaaagaaaaaaaaataggggcattccgagaattgaactcgggacctctcgcaccctaagcgagaatcataccactagaccaaatgcccttgatgatgaattattaaataaattataccaattcaaatgtgtccaatatattttggtgtaatcagcatttggagatagtctcctgtttctgcttgtaattgattcttcatttcataatcagaagaggagagtgtgttcttgttctaaatcccccaatctggattttcaaataagctgcagcatctcagacaatcaaagaggtaattaagtggctaaatgctaatgccatcaatcatggaagagtactcaactaacccaagttactgacaacatgacctcatctcactgctaacacgaacctggtactgaacatttcgttcaaattctgaatttggtgcgagaattgtgaccataagcaatcaag

SEQ ID NO: 2328 - DNA, 2000 bp, Oryza sativa
aaactttagaattccaaattcagaagtactatttatgctcacattgaactctccatttgttatcgttattaacttaaatcgaaatattataatttaatataccgaaataccttagtgtgcagccttagttatacaaattattgctttaataatatcaagatatgaacaaattttccttagtctagtttagaatttgagaactaatatacccgatataacattagtttgcaggctcaactattatattttcataatttaacaacatatcagaattcgtatttttcccctttattcaattcaaagatttagaatttttatagcaagatattgtagattgttgtcttgatcgtagattatcataatctaataattccacaaattgtcttaataaatatcgtgtgataattagtttgatctcaatcataaatttttcatggtttaaaaattcctacaaatatatagttgaatttggtttgtacacagagtcatagttttcccatgacttgcatcatgttgtattttcacttttgcgtcatgttagtggccttaaatcctgtagacctaattaattaatattctctagggttagagttaatcatgggataaaaaaaattaaaaatagatatagtttaagataagcacgtcaagaaaatagaccaacggtataccactgtgcctcacgttaaattaaaaaagaagtctttttctcaatacattctactgctacaaatatgatgctcagatttttatgattagcttgtgagttcaaagcaagtgcctaatagattgaggatgtggtgcttacaatcgaacttcttaactgcaattagtcaaactgacagaaaacttttatgaattaattactgatatgcagtgaccacggatggacttatttggggcaagcaaactttgtaaatcaacatctcaatacataaaagttataatatgatcatataaggtaaataccaaaaattgttggcctgcttaccgggtcactgcatggatgagcttggctgcacgtcttccgtcgtgtcgcgatgcgatgatcggccttgcgagcagaacgtccaggcgggatgaaagaagtccgctcgtcaccatctccgggcggccatgccagcgagcggaactggagtgcaaagaaggaagtcctcacgtttacgagcaaacatacgtaataagggatgagatcgatacattaacatgtgcaaatctaaggttggatctaatctagatatgattggactttactgagcccacggtacataatatacggttagaatgctaatcgatggctatatatttctagttaacgtgagggctcgtagaaagtgtccaattagtataggtaggtatagatgtgtatagatgtgcaaatctaacgttggttctaatctagatgtgattgggctttacagagcccacggtacataatatacggtcaggatgctttaatctattgaatcgatggctatatatttatagttaacttgaggactcgtagaaagtattcaattagtataggtatagatagatagatagatagatagatagatagatagatagatagatagatagatagattatgacaccgttttacttgttgggaaagcagttaggcaatacccagcggtccatcctaatcgaacgcataccgtgcaagctgaccaatcctggtggcggtaaaaatattctgcacgctttgttgatggtttgaaacaaataactcaactcggaaaaaatattatgcaaaatttacaattgtttccctccaaaataacctaactttttgcgaatttgggtccacaaaacgtgtttgccctaaaaatattgaacaatattaaagggcaaagagtaaaatgtgtcgacattacgtgggcggcgtgttgtttgtctgatctctgatgacgaatagatatccgagctgaataaaaatgtcaccatagtatagaactccccataacttaagagttagtaggattgtcgacaaaagtaggagg

SEQ ID NO: 2329 - DNA, 2000 bp, Oryza sativa
tagctttctactttctgccaaacaacccgtccatggtttgaatccaacaccctaagttttggccacttaatttgtgtcatgcatagattgaggtagatcaaatcatcgttttgcttaaacatcgctttgtctaatcttattttctttgattcatgttgacctaactatagagacggtaaaatgttgcaaagggcataacctaggatttaggtttggttttttcaagtcgaatcgtcattccaagatatgattgatagcattgctctatctttcttgcacttctatgatttgggacttggtcgattcatgcacttcatactcctctgcataccataaagttgatatcttgttatgtttcgcatttgttaagaggaatgtttggcatttcatactactgatgtgattagtcttggtcaattagattaatttgggctgccaatcgtactgtcaatatcctttaagtggtacatccaaaactccctatgatatgttgtaccatcatttttaggtggtataaattcctcgtgaagtccatccttttgtgatatattaggtatgtagcctacaatatatgaaatcgctttgctcacatgtctttgtgttaatatgcttcttatcttggttggagtatgttgtttcttatttggttgtctatgaaaacattttgatactttgatcaattagtcacacgtttgagtgcctattggttgctcaatcggcatatggttggagatggtagtgttgaaaagttatactggattggcagtttaactaggaaaatgtggaatggttggttgcatccaaaaaccgttcatactttgtaaatttggatgtttttagctattcgaattgggtggtttttaggtgaactaggcattaaaaccgggatgagttggaccgggtggagggctgatgattttttgtagtgggccaaaccgaggtccaattccttccatcaaggcttgcgtcatcatttcttctttttgcaaagctcctaaaaaggggcgctaggtggggactcgacctcgggtttccatggtgtaggcaacctagaaaggaacatgcatcctagatgattattttgatattgtagttcgatcgctcggttgaacagtcaaaccacttgaacatcgcttagctagttcactttctagttcaattgattatactgcgggtgcctatgagtgaacactctaaggagcaccgaacacctataaatgtgttttgtgttgattgacgtgatgttttagaaatgagttgctaggagttacttataggattgtagctaatgtacaaaaggctacaatacttttatgtgcactagataagcaaggaaaatcatccatagggtggatgacaagcaagtcttgcctttgccctgggttgttgaggtcatcaaccactatgttttgctataggccaattagaccaatgcccatgtgtcgggttaaggacttgcacctcttgagggtagccttgttcgtcccttgcctcagccatagagcacatggagtctaacccatgccaatactaagggagtgagggtgtaccacctagaaaccatgagctgcttataggggaaccttagaataaagggttccatcaacatgctacaacctttgagaaagaaccaaaacactggccacatacttgagtgtagcaaatagtggcaatgaaactttaaccagacagataactgatgcataccatctagaagatccattccatgtttgattcttttccctaactatagtgggtatgtaaataaagagtcctcgacttatttaaacataactacaattgctagagacaaggtgatgcttgtaatattcaatagaccagtaacaatgcaaaactgcagcctgtccagtttttttttttttctttaaatggtaataccatctacttaaaacactacgatatttcttgtcactgttgtaataccattaatgcaagactttccatgcatatggtgtagtgtaattaattgcttactagct

SEQ ID NO: 2330 - DNA, 1790 bp, Oryza sativa
  misc_feature (79)..(80): n = any nucleotide
  misc_feature (601)..(601): n = any nucleotide
  misc_feature (606)..(606): n = any nucleotide
gaatgctgactggactgcaggtatatgccacgtagaccaaaaccaccgtggattggatcgagagggtaattcatcctgnntgtatagtggggggtgaagaatgtccggttttatggtttaggggggtaatcgggacgacccgcgatagttgggcggtaattcgtacttttttccaaaattaaatgcagtttgagatgtgatactcatacaaaccagcgttccttcagtcttaggagatgatgggcatgattagcttgaaacagattgcactagcgaaattcttttctttcccttccaattctagtttagacttctaacgatgaacgtttcaatcaaccaacagccaagtggaccctcaagaatattgttagcaatcttggtacgatctagctgatatgccttggaagcttcctgctacgtaaatgtacaacatgggtgcgtatcttcaatccaccaaaacaataatagtacgtgtgacgatctttttgtcccaaacactcaaacagcccatgttgaagctgttggctctggtccttttctgttttggattgaatcaactacctctttttctctaccaaaaaactggaatcgtgtgtgcccntgggntgtggagttaggctctcacgatcaataccgtcattcagagcagagcccagctgtctcgggctctcggccccgtacaattatccacacgcgcccgccatcgacctcaccatgcgatccttaactttgtcattttcgggaacgcattatgcatgtacttggaacactactgtactagtttctcacattttgttgcctaacttaagaagctcctccatttactctacacatgcccgtgttcattcatgcaaacagaaacgaccgcagcgaaggaaactcccgcgcagatcaggctccgccactgtaactttcactaagaattaccattgatgttcgaaaaatagttgataatcaaagaaacgttattagccgttcgactcaaccatgttattggctctgctgctgcacaacagaacagagcatttaccaagtcaaatcatggccagtcgtggacttgaaagtacgccacattttcgcgctgcccttaacttatcaaatctcagagactacctacaaacttccgaaaacgacggcagaattccagcagaatgcatgcacagcaattaacagcctaacagaagacgcgcgtccggaaatcaccctgccgtgcacggcaaacaccaaacggaaatgcatcagcgatgccccgagctgaccagctacgccaaacgccaaaacggtataccccgaaattgcagttgcaaggagccagggaccaatggaccatcagcccatcgcgagaagttaatggtgctactgtactatccaacacgtagttaattgtaaacactgtactaagcagtatacattttgcagacaggacaatacattatacaaccatacagtcatacagatacagatcagtagctttgcaacaagagaaaatcttgtgcatgcgacagcctgttttgactgccttttgttttatattgggtgaggaatcatttgacggcccgggttgtgttctgtgcaacgagacaatcccggcattgatcccttttttcccctggattttaaccgtgtgcaatttgggaggaccacgcacttgcggtgcacgcttgccatctccgttgctttataagcttgcagcgcgcgagccaacgagagaaaccggaagtctcttttgaggttgcaacgcacgcacagtttgcatccgcagcttagctagcgagtgacgagatcacagg

SEQ ID NO: 2331 - DNA, 2000 bp, Oryza sativa
tacttcaggcactggcaacccgctcttcccaaatgtcgctctactacatacccggatagggaggacttaagtgatctcgagggctgtcaccacctctacacctacctcaaacgtattgtgggatacgcaacaattattggataataattacctaaacaccacgtctaagaaattaatatctacttcagtgtttataactcactaaagcaatcactatattttagttgattatagtgaacaataatcccgtatgctatttaggaactaaccaagaaataattctcacaagataaatctaaattactcaggaagaatattatattaaaatcagagtaataaatagaataaaagaaatgagagaagattaccaacaactccggaattcttccgacttcttctactctactctcttcctattctagtatacaatatagtacaatggagcctcttataattcagctcaagcttggaagtgtgtgtgaaagtgaaggagtgaagctccttttatagggcagttatgacggttgtgagaaggggaaatgtccgaactgccccgcaaccgtcatgaggagagcatctggagcgtccacgccaaaccctaggatcaacggtgatcagaggagtttggccgaaccagggagtttagccgaaccagatcaacggtgatcagaggagcgaacctgggctgggccatccggggctggccttcggcttgtggactcccctgactctccatttctcggagttttggggtgagtctttgatattttgatgaagttcacaacccatcctcgtatggatacatgtttcttttcacttctagatttcctcccaacttcggggtttaacacctgcatacaaatatacactaacacttggtgaaatatgtgagattaaacacctatctctatgttggatgttttattatctggtagatgttggtggtatagaatcgacatttaatagccgccaacaaccacacatttcatttaggcttggatagagtacgaacatcgggtacaaattgcaagcttagactgtaggaacaatccattagatttacctaaatggtatgagtatccaaagtgtggttgtagagatcgctgctaggtggctaccgcctttgatattgtggatccacaaagtgaatccgcacctccttgtattgccctgagcaataaatatagttgtcatggcgaaaagataattgattttgaaatagaagtagagtaccaacgattgaaggagaatgaaaatgcaatatggactgacgaacgatggtgaggaccttcttttgcggaggcgattgtgaggcggcctaatggcgatctggcctccatgggggatctctccttcgcggacaagtgggatttctcactgggattggattttgcctcccagatttggtctcgtctccgatcaccggttaatttttcccgctctccctcatccgctttccatttggtggtttgtttttcacatttctccttccggctttctatggattctatggctattgccctcaattgctgtcttcggggaaatccaatgattttcgggttcgacatctccaaaattcctgttatagtttttggtgtcagataggaaggtaggtctctggatgtactccttgaaatctttccaaaataagttcttcaagcttcattttcacttatggaggaatggaggtcctgattggtaccgtgagtacacactatgggttcttgaagaggaaaattcttggactaaagttggtagaaaatcaaaacccatctcaaatggtgtcattcgacctggggtctcgtttgctaatgtgttttcctctgaacctactcggtctagagcagctgtactgattaaaaaagtttttgacaccatcaaggattccattcttgatcctaatcggccttccgttcttcctgtgaggaaattagtttttgactgtctggattttcctagacgaaatgttgttcaagtttctggcagtaatttgcttcacg

SEQ ID NO: 2332 - DNA, 963 bp, Oryza sativa
  misc_feature (784)..(784): n = any nucleotide
tgatttgggttcaaaccttcttttgactagaattcttttattcaattttgttttaaaacccctttttattattattatgaaattgtggtccaagaaacattcccaattttgcccttgaacctaaaccaaaataattccaatctcattagaattacttgttaatccatcctttggattttaaacctatcctttggattctcaatccaaatatccaaattcctccttttgatctagccactaatttaatttctgtggcttgatttccttctcggcacaagaataaaattattacgaatattgtgaataattgctcttgtgctaagaaaatagattatatctttgtcatccaaatttcctattagcctcaaacaattctttgaaatccatgccatatattttgaggctaaaaccctatttatccttctccaattatctttttcccactttcctatttacatattaaattttattcatatatccctcaccctttcatttgagtgcatcaaataaattccattatatactacttctaaaatattgcactcaaataattaggaaatctctctttgaaaattatctccaaaataaattcatctcaaaggttagccacttaaatttcttccaaatattaatttagattcaaactccatccctcaattccctacacaaattagaaagcctttctattcatttgggccgaattctccctctcttccttcggcccagaccggcccaattcagccgagccgccttcctccaggtgcgcgtgccgtgcacggcgcangccgccgccaaccgtcgtcgctaagaaatcggcgacgtgctgtcttctccacgtcgccgcagccgtgtcttcgtcgaccttctcctccgaaccgcctctctccaccaccctcgacccctataaatagacggcaaacctttccttttctcccccacaaaccaagctctctctcttctacc

SEQ ID NO: 2333 - DNA, 2000 bp, Oryza sativa
  misc_feature (1841)..(1841): n = any nucleotide
  misc_feature (1868)..(1868): n = any nucleotide
  misc_feature (1872)..(1872): n = any nucleotide
  misc_feature (1966)..(1966): n = any nucleotide
gaaagagagaaaggtgaaattgcctctaaaattttcatcaaacttcatttcaaattttatcttctcttttaacactggtggctagttcagttgattggtgcatgtgcgtgcctagtgttcgaatctccttcctggcaatgtttttctcttgataataaataaattgggttggcctgattgggacatggggtggagacattaaggagttttcccagaattatttcagaaattattgtaccaaaacagattccaataagggaatatcttaaaaacctacattattaaaaaaataatgtcttattaaaaactacattattagaaaattaagatttgtgctatactagatacatgtacatataggaaacatggtaattacagtatggttagtaattataactatattgtaaccatataaataattataactacataattaagtaattaactacttagagctcgaacctagactcgttgatagccctactccattgggtctttaacaatttctcaagcgtggatagaagatacatactgaaatgtatccatatatctctataatctctgtggaaagaaagaagagaagagagaagcagtcatttggattattttccgttcacaaactcacacagccacattgctttacgcggaaactagcttgcggaaactaattcgcaagacgacacaactttatactacgtcgctagtcttcatgcatcccatcaacacgcgtccacttctgatcatggaaaaaaatgggaatacggccacacggttgtccctttgcttttcttccatattaataataaattaaaaaactatgatttgaaaaaagcttcggatcggtcgactcagcaattagattctcatgcaaccacgtgcttcctattacgcaaattttgctataggatatcgtaacttcacggttgttatagtataccgcacaaaggtaacttttagagaagatattttataaacgtgataatttgtcaatagacaccataccgattaaaataataattcgcggttaaggaggagagaaaaatcgtgtgaaatgtcagaaatacccatggtcccacctatcagttctctcatctctcttctttcgttctaccctccgtcagtgccataggggtcatcgctgccgataggaagcagcacgcactgcacgggcaggatagggaggtgttccgccgcttcttccaatggccatggcttcgtcatcaacgagaaaattgacatttagccactgcaaggatgggtttcgctctaatgccattccgtcaaggatggatttcggcgaaattggaaaaacagcgaacaagcgtgttgcacgagcgtgacgatggcattttagcgaagcaacttggcggaattgcattacagcgaaacccatcctacaaagtgactaaatgtcaattttctcgtcatcaacacattcgaggacatcatgggtgccttcgtcaaggctacgtagcagcgctcaacccagaatgcgtgggggcatcaagacaacatgcgccggtgccggcacggatgccgacgtgagggccagcccaggcaacctaaccgacgtagacgctgaccgtatccttgcctagctcgacgcccatctaccggcgtccatgctgtacataagcttcggcaatatctcgcatctggcggcgaagcagacgctactacgaaaaccttttttcatgcgggcgggaaggatctttgcatgcggacatgcggttacgccaaccgcatgggcgagaaagtctgcgaaaatcacgcttttcacatgcggtcgcttataccgtccgcatgcgaaaataaattcggcaaacaaaaaaaattaaaanccaaaaacccgaaccctagccccccgncgancgccgtcgtcgccggcgccagatctgtcgcccccgctgcccaccatcgttgccaacgctggatcggccttccccggcaaccgctgtcaaacggnaccggatcggctactcatcatccgccatcaaagt

SEQ ID NO: 2334 - DNA, 2000 bp, Oryza sativa
  misc_feature (116)..(116): n = any nucleotide
  misc_feature (121)..(121): n = any nucleotide
tttgaattttgaagcgatttcgttcaaggttcaaaccaagctgatcacaagccagagagagagagagagagagagagagagagagagagagagagagagagagagagttctctctngtgtnttgtgtactacctgatgaagatgatgcgacgaggaccatggccaggaggaggagcagtgctgcgtggaaggccttcatctctgactctgacgccattggcttttttttttccttgtgacttctgctactgctaccggtgcttagctgcagctttgtttcttttaggtgtaccgaatgggagtgtggcgtttatagtgttgttgttcgtattatttttggaatcacttactacagtaagttgtatggatatggataacgggaacgggtttaatttcaggagtaattggcattgatactgctatattcgtttgtgctgatctttaggattatatagtggccttgtattaagggttgtaccaaattggtacctaatcaatagtaccaattaaaggtgatatttcggtgcattttaatttgtcaattttcacgaggaaaaaaaaagcgcatatgctccgtatggcatggaaaatgtttagatgggtcatagtcaatccaaagcatatgttaaagatgttatagcccataatgcaagtagccagaacccaacagtcatagagaggtaatttctagccttaccaaataacgaagtgagattagggcgagaggtcaatcttgtactacgtactgattggaacgaggggaccgcaacaccaagctcaagccatgagctcctagacacgctgccccaacccgcaccctcatctcgcagctgcgccatgctccggggtgttgcgtcctttcttgtagaagagtcatgtctccttgcataaggacacaaggcgttgcttgtttggcctgattcctacaaggagtgccggggtacgtgacacgatggagcattggccatggactaattcaccaaatggataataataaaggaattgctacacttcagtcaacaaaaaacctacctctaaatcttgcaaattttagttcactggatgtgtttcgcaattcgtgctccagctgcttcttctccaactccgacgaactcctcttcttttccggtgccggcgacaacccaaactccggcgaagaattagggtcctggggtggggtggggtgggaagggtgggagggggagggggaagaaggaagagttcgccgggcttaaagggatggccgggggaggcggcagcccggcggtgggcggcgaggcaccggcggcggcaccggattcgcggggctggaggacggcggtgggccggcgttggtggcgggggcatcttgccgccgacggctcgaggaggatggaggggggaggaggaggggaaggacgagggggaggaggctggccgaggggcctcgccggcgccgttgacgccctctggccagccggcgaggcgggcagcggcgcggtagggcggtggcggctgggaatcgcgtgcgagagacaggagtagcggtggcggcgcgatctggatgggggaggaggagaggagttagggttaaggggtctgcacgaatcttgaagcatatccaatgatctaaaatttgaaagataggaggtgggattttctgtcaacatatgtgtagatgcactcttataaaagacaataaacatcacctgatctatgattccttcaaaaaaaaaacttacttgaatgtaacagtcgacacttgacaccactctcataaacttgcttcattgagcagttggctcaaatgacgttctgacgttgataggcatgtgattgtttcattctcaattaagttgaatcaaataggccctttttccctttttgagtcaaacattcttagaaaaaccttccgcatgctttaatatcttgttggctaagtcgagcttctaatgagacatgcatacaattgtattactttgtttttttaatataagacatagttgtcattcacatgctcc

SEQ ID NO: 2335 - DNA, 2000 bp, Oryza sativa
ctttgtcggatgaagaaatcaccaaaataaaagttatagacattgatgagttatacaattttgttgttgatgactttttcagttgaaatcatttagtatttgaaaatgttgtttgaagttgtcataatttgaaattcaaattcaaattattgaaacaaagtcatatagcaaaatgaccaaacaaaagttgtagatatagatgagttatacaactttgttgttgatgaccttttcagttgaaatcatttagtacttgaaaatgttgtttgaagtaatcataatttgaaattcaaattcaaattattgaaacaaagtcatataacaaaatgaccaaaacaaaagttgtagatcttgataagttatacaactttgttattgacaattgtttcatttgaaatcatttactacccgaaaagttatttaaattgaggagggaggtaaaatggacttcttggcgagggaggagcaaaaagtctgggccggcagcccaaagagggaagaggagggagagagaggctgcgggctgagagagggagagagtaaaattttgggccgaaagaggcccaaggaagagagatgaattttaatttgtttcatttattttaataggttaaatgaactttggggtattaaaattagttattgaactccgaaaattcacagaaattttcagagaataatttagaccacgtagaatattacaaaaatattttcggccataatttttacaggaaaactttattttcctcattaattcacttgattaaattgctttaacttttaatactccctccatctcataatataaggcgtgcacgcatttcaagattcaacttttaaacatttgaccaacacttagtataatatgaaatgaattttaatttttaaaaattataccattagattgacatttaaatttactttcatatggttataattttgttgctacaaatcttaaatcttatagtatatgagaaattataagctaaagattagttttggagaccgtgccaactttaaccacgccttatattatgggatagatgaagtatatttttctagaaatgcattatatatatctatgatgtttgctttgtgccccttatgacaagttaatattcgtcacgatgtcccattgaaatactttatgatgatttctagttggcattaacgacgaacacatttttttcgtcactaagccaccccatctcatactaatcgtcataaaatggaatgtgctaatgacgaatagctccgatgtcatgaggaattcgtcacagaaggtcatatttcttgtagtgattactgtactgatcacctaatcgtcagaaaagttttacaatataactctattatgatatgatgaatctagtatttttatatataatttataactcactgttattttacttggtcttgaaatttgttaatcaaaagtatttaaaaaaacaattgtacttaaccatttcagttaaactttcaagattagtttattttattttattttattttgattttcttgttttattcaaattaaatcaaaacttgtgctgttaatgggatacatgccttaactctatcctttcacttgtctttagacgccgatccgcaagcccagtacttgctcggagttgaaggttttatccgggagctatgtacgatggcctttgccataggattcaagactgcccctctttatgaccagatcccccatgatcgtgatgaggagaaatgccgtgtcaaggtcaccataacaagtgatcatgaagatatcccatcggtgatgtttgaagctggtggaagaaggtatcacatgcttgtcaggaggtggcaagggtcgccattggagaactccgcaacctctacaacgatcagctggtcaacacggagtatcgctaccatccttgccaaacccatgatcgtacccaagccagctacgtggatcctgagggacttgaagacgatgctaccttgtgccatgtggtcgagctactttgggc

SEQ ID NO: 2336 - DNA, 2000 bp, Oryza sativa
aaacctgtgcaattggcttggaactagccgatctgtgccctctggacacaaatgccatcattctgggagactaataagtcataactggagccatgggggcatagctaccttttgtgggttatctttgggacctgcttctaccggaaaacatcaagacatgtgatttatgctgtacatgcatgagaagcttcaaactctgtatgatgcatacttatccatgttggtttgtaatagcagcccacaaattcacttgtccgtaaccagtttgaccgataatggcagggcttgaatgttcatgcaactacccacttgcacaatatggatagtaggagtacaaaaggtaatttaccatcccatcacaaatcatagggatgattttaatggaaggttctactttctgtttagcttgcacatgttctatcacatatactggtagttatgcatctgtaattctattccacattcaatggaagtctctttctgtttagaatgcttaatgaaccaatagagatgaaagtattgagatcatgagttgtgcttaaagtgcaacagcaagctacatggaaccgcagcactcaagttgctcattaattgtactataagcaacaaaagtcgcaatcaagttgcctttgttccttcaatcatttttttccctgcatgcaagtttgtatgtcagatacaattttgtaaaggaaaagcagtgagttccattcttataccaaggtattctcactcatgtgtattgtatttgacaaaatacaaatttagaacctatcatgatctttctcgttaatctatacaaaagatcaactgatcaatacttgcaactgtttcccacaacgacagggcctttggctttggacggacaagagctgacatggaaccatcctcacagcctcagcctgtgatgggtgttgccactggtgggtcacaagcatatcctcctcctgctgctgcatatccacctcaagccatggttcctggagctcctgctgttgttcctcctggctcacagccatcagcaccattccccactaatccagctcaactcagtgctcagcaccagctagtctaccaacaagcccagcaatttcatcagcagctgcagcaacagcaacagcagcaactccgtgagttctgggctaaccaaatggaagagattgagcaaacaaccgacttcaagaaccacagcttgccactcgcaaggataaagaagataatgaaggctgatgaggatgtccggatgatctcggcagaagcccccgttgtcttcgcaaaggcatgcgaggtattcatattagagttaacattgaggtcgtggatgcacacggaggagaacaagcgccggaccttgcagaagaatgacattgcagctgccatcaccaggactgatatctatgacttcttggtggacatagttcccagggatgaaatgaaagaagaagggcttgggcttccgagggttggcctaccgcctaatgtggggggcgcagcagacacatatccatattactacgtgccagcgcagcaggggcctggatcaggaatgatgtacggtggacagcaaggtcacccggtgacgtatgtgtggcagcagcctcaagagcaacaggaagaggcccctgaagagcagcactctctgccagaaagtagctaaagatgatacagtgaagttgtgacattgatatacattgtcctgtgaacttagggcctctaaaactcagtgctcttgtcaaaactattcccatgattgttggctgaaacgggtaatctgattaggtcttaggctttcctaatgttagttctgctctgctatggcagcagtagaaaaaaaaaagattgtgatttggtaggtgatttgcaactaatgtagtaactgtaccttacctttcatcagtttctaatccaatactcaaaagtgctggcatgtggagacccttgtatgaattgagtgtttgttcatgtcatgcatcagtctgttgcctcatttatcagtcatc

SEQ ID NO: 2337 - DNA, 2000 bp, Oryza sativa
  misc_feature (1991)..(1991): n = any nucleotide
  misc_feature (1997)..(1997): n = any nucleotide
atctgaggcacactttgagcaatcaaactggcaaacacggtcagctgtggcattgcaaggtgatgactcatatgagtcatctgggcaaccaacactgcagggcaagcagagtctagaatttgcaggtttacatgtcttgctaccactgccaacttcaccatggtttgcgtattcatagtagccatggctgcatgaatcagatacacaaatccccaggggataccgccattggtagtgctaatgggccactatgcccccagcacattggcttcaacgatgtctcggccggcaccccacaagtgaagtaatctccagccacaattgcataaactctgagcccttttggtgcaagtgtactgttctgaagtgtgaagccccagcaagccacttggtgatcaagactcctgatgccacaagcatggaaccgcccaccgaccacggagaccattgcatccatcggaactatgttcacatcaccatcatcagtagaactgggtgttgacatctgctgcatctccaagctcctaccccagcagaatacctgcgcattctccagcaccccgcagacatggtaaccacctgctcctatagactggaaccgcacattcctcggagctagcccaatgacaccactaaccgattcatcgccccagcagaaaaccgtcctgttccgtgcaaataagccacaattgaacacagaaccagctgaaatggccgatacagctccggtgacggtatgtgtggcggtcatgttgtatccccagcaatcaatcaccgatgtatctccattcacgctgtgaaaccccttgacagatgttcgtagggcacaaaggtggttgtctcctgcactgagctccgagtacatggctccctcgaccatcggctgcggcacaccaatcttgacataggagttgctcccccagcagtaaggctgattggtgtcgagcaataggccacaggcaaacccatcccccgcagtaacccctacgaacgggatcctgctgggggcaccgtacacaacggaggcatccgcgccgaagcaggtgaccaagtgagaaccatccgagttgagcccgcagaacacggggccgtcctcgccgtaggacacggcgatggacgccatggatccaaggccataggcccaactgggcagcaagaccaggcagcagcacaatgctacaacaggcacaatgtccatttcttgaaacttggaggggtctacacaaaattatttttcctgcaaaggttgcaacattttgggctaagaatcagcggaaatcaggcgagtcttattataaccgaaacgaaaaggttggaactttttttttcctctcgctctctctctctctctctcggtgcataccaatcagggatggtgcagcggctaacgtggcgcatcggggttcagtggaagcatacaatccccaatctttcgggataaaatgcgactgctggtgctcctccacctttgcaacagcagcagcaaacgaatcccaatccgcagcaaactaacctggatggattgaacagagagaaaaaaaggcttggattagacatactcctgtagctagcaaataaaaggccagagcttttagcctcaagacaatgcaagaaatctactacatttgatgaggaagaaaaaagtttgaaacgaatctagcagtatctcggattggatctccactccaatcaccgcaaagctcaccaactcaccagcgcatgcagctcaagtagtagtactagtagtagtagcagtagtagtgcactagtactactaggggagacagagagcgagtacctcggagcagggggggcggcggtccggcgaggcgaggggaatgtcggcggcgaggcaatcggggaaggggagacgacgaccatgtaccaagaagggaagcttttcttgggagagcaggcgccacgggcattgcacggcggcagcggcggcggcggcggcgtagccgtgctggatccccggggaagaggagganagggcncgg

SEQ ID NO: 2338 - DNA, 2000 bp, Oryza sativa
  misc_feature (182)..(182): n = any nucleotide
  misc_feature (977)..(977): n = any nucleotide
  misc_feature (1987)..(1987): n = any nucleotide
cattacaattttatttttacagaacctttcctatgaccccaaatttttacactaacgggtacgttcacgtcaggaaaactcatattactgacggtatctcatccacgtcaaggaaaattccaattgttccgacggttttaaaggatcgtcacacaaattattttttctctgacagggttttngactatttgccactctcccgaatggcgtgttctcaaatgccactctcccggatgacttcgctattttgccaccgggagatagaatgtttcttgcctgtgtgccatttttgagcctgcaaggcaccacgtcactcgatatgaggacaaaataattgtcttaccctttttcttcatttctcctcctgtcattgggctccggtgagctccccgcctcgcactcctccctccttcgctctgctccttaccttcccggcccctactccattccactgcggccaacaccggcccctgtcttttcttttgtggcctcatcggtgcctcaccccatcaccgtcgacttcgcattcctcctcacagctcttctacactctcccccgatgtcggcggctgcgccaggtccaccctcagggcttcccctaccttgtcattctccacccagcgccaggaggtcggttcggcggtggtggtggcggtgtcaccggctcacatacagggaggaaggttggagaagagagacccgagctagaggaagaagaagggcaagacagttattttgcctttggatcgggtgacgtggcgctttgtaggctcaaaaatggcacacgagcaagaaatcttctctctccgatggcaaaatagcgaggacatccgggagagtagcatttaagaacacgccatctgggagaatggcaaatagtctaaaaccccttctctgactggtggttgcatgcatgtcactgagtcagtaaaattagcgaccgtcaggggtattctaatttctgatagtgtaatagnatttaaacattctgtgagtgtatgatttaaaaaataataatttaggagagaagagatgttaattaattgtcatgcatgtatttatgttttatattatgaaacacctttaaaaagcatgtgtcctatattttggaatggaggagtactactacatgcaagcgaagatcctacaattcaagcaaagcagtccactaaatcgccgctcgctgtaattgcgtaactaatgatgccgtcaaacaatacatgtacgcacttgattctacaagaactcagaagaaggctgcactacttgcagtttgcagccatctcccggctagagcgggcctggaagacgacggtgggctcgccgaggtcgtcgtcctgaagctccccatccacgtgtcatcgtcgtcgatcgtcgccgtctgtggcgtacgtcgagcaggttcaggggtttcctccgtggcggcgtcgatcaagtataacatgggacactttctcgtcagcccgagcttctgaatgggtcttggattattatttaaaaccaccatgtgtgacacctcatttgtgcttttttttaaaaaaaaaagaaaaaagaaaacagcatcgatgatataattaagtacagactttacaaataagtgcacaaataaagcgaaagggcatatagtatagtggttgcagttatctgagtagcaccccaacgttctaagttcaaatcattatatgagtgaattgtctcaatttaaaatgggaaaaagtacgaattaccccctgaactattgtggttgattgaattaccccctaaattcgaataccaaatatttctcaccctaaacttttaaaactggacgaattacctccctactccaaaccataacggttttggtcctacgtggcatccatgtggcgctaacgtggcaatctaattagaaaaaaattaaaaataacataggccccacatgtcatatggagtagtgcactagtgctaaattgctaatctctctctctctttcttccctctagggtcncgggtgcgacgtg

SEQ ID NO: 2339 - DNA, 2000 bp, Oryza sativa
tagaactcataataataaaaataagtacccaaagttaaacaatggccttctcatcaaaacaatttggaaatgcaagctgaacatgcctagtacaaatgaggggaaagacttaggactagatgaattttgcagacaacatgaatgaaaaggtaattcctaacataaatgaaaaggttattccaacccatagcacagttaaatgtagcaattaagcaccataaatcaattattacagaatgggcatccaatcacacgaaccgaccgcaacaagcatcacaagattgaacttactatgagcgcacacaactaagattactaagaagaattagcactaagatagaccaaagaaaggccttccgtttctgtcagggatccaaactaattgcgattcagggagaagagtggggtcgctaccggaagttggacggactcgaggagggcggggatgagggcgaggaggagaccgacaggaaagtgtacgccatgggccgctcgtcggagctgccaccgcacgggcgcaccggcccgtcgaggcggccgatgaggctgcacgagttcctcgggagccccctcctcggcacgacagggggaggccggagcatggacatgcggtacgccacgctctccacctcctcccgccctcctgcgtggagggaccgccggagcgccgcggccgccgacgagcgccccgactcggcggcgccggcgagggagcgcagcatggggacgtttcggggaagtgaacggggagagagatctgtgggcccccactgtgatgcccttaatatccctgaacggaaaaacaacgggtcccccaaacctagagtaaatttccaaaactacatgttttatagggttaagtggtagaaaatcacacatattttgatccttggcacttaagtacatatattttggtaatttagttttacaaaaccacactatcgatgaatgtattcacctgcgagatgacgtggatgttttatctaggataaggacgtgacatcctattaatttcgtgcgatggcgggtaatatgatgtcatgtcctcgtccttcatgaaacagtcacgtcatctcgcgagtgaatccattcattgaaccaaaatatatatacttaagtgccaagtgtcaaagtgtgtggttttctacaacctgaactacaaaacgtgtacgttttgtgaaatttacaaaaccagtgcaaacctcgatttacaaaaccagtgcaaacgaggtgtcagtattatcctcggttttagctgacgtgttaactacgtggctaatttgactaattctttgccctgtgtggtattgatgtgacgcttatatagtacccctcattcccaaattgatcctcatatataaatataagtttatgcaccaagaccaaggataatttaaatcatatcaatcaaggcaccatacacatatttttccacaatacatgcatcgattaaaacaccatgccaattactcccatgcagcattaattgtattctaatgaaatccgtgttcatgcatgtatatgatgatcaatttgagaaattttaaattctattatatgatgatcaatttggaaaggagggagtagtttaattaaaaaaaataaaaggagcaaagctgaaaactaaatctatctatatctatatatacctaatttaaaaatacataaggcttccgccttcactttcgtccgtcaccccttgcttccccctctctcccctccctccttcctggtgccctgatcttcacacgctccccctgcccatggcccctcttctccctgacgtccttcctctcccacctctcccggcgaccctcctctcccgcctccatcctccctcacgacaccccacatctatacctcgccgcacgtcctccccctttcccacgacatctctactccttggcatctctcctctcccctgcgtatcctcctcttacgcattcaagaaaaacggaacctcctcgttcgggaacacgttttgatgtactcacccgtcc

SEQ ID NO: 2340 - DNA, 2000 bp, Oryza sativa
  misc_feature (643)..(643): n = any nucleotide
  misc_feature (669)..(669): n = any nucleotide
tagtgcatggctacgtcaacgcgcgaaacttaacctgagcaggtatcggcatgctgtcatgtacagtgaggcgagctcttggtgaggcgagctcggcgaaaagactgaacctgagcaggtatcggcatgttgtcatgtacagcagacggcaatgtcttcatcgcacgacaacagtgacgccatgcgggatgcggcaccgaccatcctcggagtatttcgttctaataatagtccaaaccaacgacttgcgaagggaaaggatgactggatgacgaaaccgacatgcatgcattgatgaaccagtccaaaccgatctggtgtagtacaatatatgacggggtacgtaaatcattagccaaggccaacactacaaggacgtttccctcctcctcccgcatcgccctccccaggtgactcgggaggcgacaccgccaacttcctcctcctcccctgcctcgccgccgcatgagcgggtgccggcaaagccgtgcggccgcaaggacagcggcgacggggccttgtctcaccctccacgcgctcagcggccaggggcgttgctcggagcggcagaattggtggccagatccaggccgggcccagccggatctggcggaggggtcactggcggcggggagtaaaggtnacggcggcaacgcctggtggcggacntggcaccttggggtttggcggcaacggtggcggagtcccccagatccgcgccaactcggtcggacctggatggcggctagcggctggcggtcgcggatgtggcagcggttggcgatggcggctggcgacggcggcggtggctatggtggcggtgttgtggtggatgctgactgctgaggtggtggatggcgaagaggcagcgaatgtgattgcggcggcggtggctggcgacgacggctggagacaccgagacggcggcagcgacggacgtcggctgcggcaatgaaggtggcggtggaggcggcgtctggcggctggcgacgtcggcggatgcggcagcggctggcgacatcgtgcagatggttgccggcggcagcaagtggaggcggggaaggagtgatgtgaccatggctactacggatacaaccattgttcacatcatggatgaacaacaagatatcaagttcaagtcctccaagtgctaggatccaattcggccacctgctacactgctgacttcaaacagccaccgaatctgcatacgacctccgtttttgacccgtgagtacttgatggaaagctctcggagtcctctttccaacggatctagccacatcaccaaattccaccctagccatctgcaaataaagaaacaaggtgctgtaacacctgtcatgggcctttgggcttgtaactttgtttggaaccccggcccatgtgggacccatgttgggggcgccccaaccaggtggagcacgaccctaggcaccctaggtcgtcctcccacatccataaatagctaggtaccacttcagggtttctcgggttttgtttagattaaagtttagcttcgctactttgccgtgtaatcccgtgatcggttagatcgacggtttgctcgttacggaaccccaatttatcatttgtattgaattcctatctgcaattcagattgcttttatcttgttcttgcttgtttcttctatttgcttacaggaataaggttgatctgcaccggcaagatcaacaacccacggagaggtgtatcgatcgctaagacgcaatacaacaacgtcttgtacggttgtagtcgggtcgtcaacgtttctcccaaagtgtagttatctacaactcaccgaaagatcgggccacggagatgatgtgaccatggctactacggatacaaccattgctcacatcaaggagtcgggcagcggagaaggagaagactaggtgtgggtgcggacgcgatgtcgtcggctggaaacgggcgatgacagacgacgggcgcttagccgaggaggcgtgacagacgaccgcacttggccggc

SEQ ID NO: 2341 - DNA, 2000 bp, Oryza sativa
ttgagatgagcatgatgggtgagttatcgtactttttaggattgcaaattaatcaaactcctcaaggtacatttgtgcatcaaacgaagtatacgaaggatcttttgagacggttcaagatggagaattgtaagccaatttcaacatcaattgggttctacagctatgttggatcctgatgaagatggtgaagctgttgatcaaaaggagtatagaagtatgattgaatctttgttatattaaacttcttctaggccagacatacaatttgctgtgtgtttgtgtacgcgttttcaagcttctcctcgtgcttcacatcgtcaagcggtcaagcgaataatgaggtatttgaatcatacacttgagtttggaatttggtattctacttcatcttctatatgcttgagtggatattccgatgttgattttggtggttgtagaattgataggaaaagtactagtggaacatgtcattttcttggtacatcattgattgcatggtcttctaggaaacaatctagtgttgctcaatcaactgccgaatctgaatatgttactgctgctaattgttgttcacagattctttggcttatttcaactttgaaagattatgatattacttttgagaaagtacctctcttttgtgataatactagtgctattaacattgctaagaatcctgttcaatattcacgcacaaagcacattgatatttccaaaaaaccaaaacatttttaatgggtttgccaatgtgttcatcaagggggagattgtaaaatcaaaggtgtttttgattattattctgtgatgaacaattggcattggagattattggttttgatatttggaatttattttcgaagtggttttggagatgattggatttcacaggtgatctacaggtactgctggatttggtccggtcggaccgagcaggtgctgccagtcagacaggcgtgtattgcacggtcagaccggcgcatcggccgacactgtgtcggtttcggttctgggttgtttgtttggatatccatgattgtttcatgattatggcttctagatggatactatgcgtatgtaatactgttgtttgctactaatgagtcaagttagagatagcttggtctcggaatatggtttctttgtttgttccatgtgtaggtgactcgatgcctcgggagagtttttgcggtgatggactgggagtcggcttggggataagacgacgtccgtggtggtcagatatcatgcgggatacttaggctagagttgatgcacgtggttgggagattccatatggcatacgatggaggtattgtgtgcgtatgggatgcggagtcgaatttggaaggagtccaaatttggtatgagtagttatgtaaagtttgtttcttgtacaagaaggtttcctatggggattaggacttctagtatgagtttggttcatggctttaggctacctacctcatgtataaatagagagggagagtgaggcttcccggtatcgtttttgagagcaattgagttgatagttgagttagggtttcgagtttagctaagatttttgtaaggagtactgttgttgcactttgtaaacatagagagaagcaatacagttgtcatccactttaagagttcttcgatttgtgtttcaccgggtttcggcggtctaaccggcatctcaccggcggtcagacgggcgacaaggcggcggtcagaccggcgggtgtaaggcggtcagaccggcggcgatgacaggcgcggcaggcgatctcggcggttcgaccggagttcgatctcggtcagaccgacatgttccaggtggttagagcggcgcaacaccttcggtcagaccgcgatccgtcgaatttgagggtaacttttatttcggctaaaagtttgggtttttgggcataccaaccattcacccccctctgggtgccttagttcctgtgattcgatcctacatcgcgcactttttgcccgggtgtgtgggttgg

SEQ ID NO: 2342 - DNA, 2000 bp, Oryza sativa
ttgcttgcgtagtacccgtagatgatagtgcccttaggttgcttgtgacacttcatgagatagaagaaagtagttaaattttgaaatgagtaaaactattgaaatgcattaagtgagttagtattacgtaccggccaatacatatatactagaagcttctcccttgtttttgtttgttctccacccctgaacttgtagtagttatacgcactgtatggaattttttaccgtttcgcattaaggaccgttatttaattataatacattaatagtaggcatgcaagtatgagaatcacttactattgtaagatttgtagaaattatttatatgtcttgtgagaataatcaagggggtccaagactgtcactatgccggtcttcgggtagataatgaaacatatgtaatgatcgctacataatggcgatgcagttagtcacatatgaaataacacaggtatgtacaatgaaatatacttgacttacttgaagttgtacgcaaccatgatgactcttattttggaagtgcaagaaagctcgtccaatatactgtacgacaataatcatcttctacttgtgcaagctcttcttgtattccgctatctctgtaggagtcttgtccttgagctgctcggagtttggtgatagtctcacggtatgctgagtttgacagatccttgttagatccagaaatccgataggtttccctaaattctcagcatccatgttttgcatactataatagcaatttgttaataattgatcacatacttattcatgcaataaataaacactcatactcacaagcaccatgcaacaacgtagtttacatccatcttttctcgacgatggatggcgtgcagatcattgaaatcaagccaaatgaatccttcacaggctaaagtttttgccagtgatcgaattgttagattagttaggcctttcttgctggcttccatgtaccatttatgtagccttatctcccatggagcctcatcaagtgcataatctggcagaaaagcttttgtcgacgagtgatactcgcggatcggaagaatagggtattggggtacgttggaacagggatctacgtagtacgacatcaaaacagacaaaagacaaggattatactagttcatgctccttatcaggtaatagctctagtccagtttatatgggattgatgatgatgagaacagattacaaaaagagtaactgaatacgcgatgccgatgagatcgtagtcgaggaattcgacggcatctctcggcgagttggctccgtggactccggcttcgtaaactttggtgggtgtgttggcgatgaggtgcgatgcccttcgcctctccctaggggtcccttttatatcgtgggataccttgaccctcaagtaagacttggagatatgtaaaccgacacgatatactagagattttaccctttccaagtaggacttctctaatcccttaacttcgtggagatattttccataatttgaggtaaattactaacagtgtatatgggaaccaaccgtatacttgaaggtataccttattggtatatttcataaattgttggatagaaggtatgccttatccgtaaccctgacagtagcccccgacttcaacttaaatgaattcatgtcctcgcatgcgacttctcctaatagagcgttgtcgtactcgttagatcaatctcggttatataaccgtagagatatagagttatcgataacgctcttagggagcctatctatgcgggttttgaatttaaattgaagtctgaacaatggtcctcaatgggcctcagaaattttcggtggcaatctctcccctttcctcgaaatgcgaaccgtcaagtagtgcgcttatttaatgggattttgggatccattttgagtccgtttaccaaaaaactctcattgttcccccgcttccccggactctacgtctccctaatctcctgcgcccttcaccagtgatcttcttccggcgatcctcccc

SEQ ID NO: 2343 - DNA, 79 bp, Oryza sativa
ggtgccggaagaggagcttgcgggggagtaggtgtaggagcacgaggaggagtcggtgcaggatcctgaggaggagtcg

SEQ ID NO: 2344 - DNA, 2000 bp, Oryza sativa
  misc_feature (1435)..(1435): n = any nucleotide
  misc_feature (1453)..(1453): n = any nucleotide
  misc_feature (1494)..(1494): n = any nucleotide
  misc_feature (1942)..(1942): n = any nucleotide
  misc_feature (1960)..(1960): n = any nucleotide
  misc_feature (1963)..(1964): n = any nucleotide
ataacttcttgtattttattaggagttgttgcccctagacaattttttctctactattcgtaaaatctgatcccgtccttgatacattgacatgagcactctcatcgccagtttcatcaattacagagagtccttaccatgctcgtgattgcatcgtcgtcaccaaaatggcttatccgcctacgtatgtacaaggtcgacactataaggacatgttttcatccgcctatgacatggccaccatctatctcggtgctagggttctagacattggtcctactccagaaccactgaaggcataggcggaaaaaaaaagacaatgtccgtgagcataacatccaaccaaccaaaaggaatgatgtcgtttagcggagcaattaaaacgagtcaaacaaaacagttatagaataaatattatatgacgtggaaccagatcatgtcgtatcccattttgagatctatacgcacgtcaacccttatcctaagaatgccctatcctacctttagaagccacctaaatactcatatgataacatatttacacgcgcgagtttcaattctcaccgtacaaggcattcgaaggagtaggatattatgattttgatttgtttagagacacaaatgcactccttttatcaaaagtgcaaaatagatagagttcaagtataatactctataagtttcgtaaaaaaaagattcccatacttttaatgtttttaatgctacaatcaaaagatagtaattcaaatcacaaattgctatgtcacaaacatagaacaattatccttttgagtcgggtttgtgctaccgctactgcactctcaattccatccttagtattatgatatatacacaacaacatattttgtaggccatatagaaaatcctcggtagctcctagctccgtcataaacttatataaagcagtatcatttagtataacacgaaatcatcataagataattttgaaaggaaggtaattatcacaagatgctacgctattaactcgtgtttctgaacttatttttcccatatatcataatcaaaatgagaaggaacacaagcattagtttttgttaccacgaaaagccccgaacgtgtacatcacttccttgttttaagagcacaacaagcatggtacgttcaaccactactacaagtctacaactaaagatactccccttgtttgaagcaactatttttgaccctcccctttcttttaaagctaaacaatttgttggtgttttgttttgaggcattgtaaaggaaaaggggaccaaacaaactgctgctactaatatgcgtactacacccatcaccataacaaacaagaaacaataaagtgccagaaaaagagagaaaagaagaaggaaaagaaaagagcaacaaacccagatggccgcacctgtcaattacttgtaaaaacgacacaacntgctcccagttaatcagnttctttaatcgggtggtgtctatactaatcgtcccctctcnttcacactctttctctcgctggtctccgtcttcgtcttctcctcctccaccctctctctctctctctctctctctctctctcctcccctttgttccgccgcttcccctctctctctacctctcgcggcgaattcgccgagagggcgcagggaattttattaggagaaatcccctttttgtatccgtttctccggatccgcacacctcctgttaatccgccgattcttctttgatttgttcatattcgttttttttatttttttccctttgtttgcctttttattcgttcgattgtggggggagggaagagtttggtcgaccggatttcttggtggtttgcctggatctggcgtcctagaggccctcgtgcccgaatcccgattcgattcgcctcggcgcggcgccgctcgcctcgacgggtttggatctcggggtgggattagagggnaaaggggggggggggcanttnnccttcgtttggttgagaccatcggagcagcaaggag

SEQ ID NO: 2345 - DNA, 2000 bp, Oryza sativa
  misc_feature (978)..(978): n = any nucleotide
  misc_feature (1257)..(1257): n = any nucleotide
  misc_feature (1273)..(1273): n = any nucleotide
actaggatacacatctgacggctatgcagttggtagggatgctagctattaagtgacgcactatgatacacattcaacgaggatagagacggaagggacactagttattgaatgatgcactaggatacacattcaacaaggatacatatggaagctaggacgctagctatcgaatgatgcactaggatacatttaacgggagataccgatggaaggaacggtagctattgagtgacgcactaggatacacattctacgaggatacagatggaaggtacaccagctatcgagtgatgaactaggatacacactccgcgggggatatagatggaatggatgccagctattgagtgatgcattaggatacgtgttcggcgggagatatagatggaagggacgccaactattgagtggtgtattaggatacacattcaatgaggatacagatggaagagataccaactattaagtgacgtattaggatacacattcaacgaggttacagatggaagagatgccagctattgattgccatattaggatgcacattcaacgaggatacaagtaaggatgctagctattgagtaacgcactagaatacacattcaacgggagaaacagatggaagggacattaacttttgagtgacgtactaagatacacatttgacgaggatacaaatagaaagcacaccaactactaagtgacgcgctaggacaacacgttcggcgtgagatacagatggaagggacgccatccattgagtgacgcattaggatatgaattcggctgaagatacagatggaagggatgccgtccattgagtgtcgcattaggatatgtatttggctggagatacagatggaatggactccagctatggagtgacgcattaagatacacattcaaggaggatacagatggaaggcacgccagctattgagtgacacaataggatacacattcaacgaggatacntatagggatgccagctattaagtgacacactaggatacacatttaacgcgaataaaaataaaatagatataaattgatgagtgactaccaggatatacattcaacaaggatacaaatcaattccaaaacaaccgtgctcatagaaaaaaaaagacttgactgaaagtaaataggacctagaagcaatttgtgacctagcaagggtataactgcaatccttgcaaggggcgtggaacctacagccttgttttgtttttgtgtacgtcggtaaagaaaggnaaaaaaaaaccccganaggtctacaggcaataaactgtagtggcatttctgaaatatacccgtaccaacaggggcaaagctctataaatatatctctctctcccttcaacaagacaacaaagaaagatgcaagagagagatcagagaaaaagaaacagagttggtgtgggatacgacaggtcccagaaagaaaaaaaaaccccctcattttctcttttatttctacaccttcctctcctatcccctctctctctaaaagcaaaacacactgctcactctctctcccaggtctctctctcttggagttgctgttaaatggtacagggcctccttgcctttgccttggtggagaaccagatgcctttgatgtgtgagtggttggtgtttccttctctccccttctcctcttccccccccctctctctcttctctcttttttttatataatcaactaatttcttgctaatttttttcctttgctcctatctctcttatggctgtgtgggagtaggagagagaaagctgggatggatagatagagaggaagagagggaagccaacaaaatcggcagtagcctctcccccattttttttctcccctctctctctattcttcttctttctcctctccagcaaccgctctcctcagtcctctcctccccaccaaatcaagctgctcttcgccgcggaggtcgtcggattccgggccctctcaccgcgtggatctgccggcggggagggag

SEQ ID NO: 2346 - DNA, 1071 bp, Oryza sativa
  misc_feature (8)..(9): n = any nucleotide
  misc_feature (14)..(14): n = any nucleotide
  misc_feature (20)..(21): n = any nucleotide
  misc_feature (23)..(23): n = any nucleotide
  misc_feature (31)..(31): n = any nucleotide
  misc_feature (43)..(43): n = any nucleotide
  misc_feature (231)..(231): n = any nucleotide
  misc_feature (555)..(555): n = any nucleotide
  misc_feature (905)..(905): n = any nucleotide
  misc_feature (918)..(918): n = any nucleotide
ccggttcnncgggntccggnnanacgtcggnagcccccttccngccaaaaattcacacttaatcaaaattaactactcttatcagtttatcacaaacctgtttcactatttgcactgtttgttttgatgactgcatgttacagtacaaaggcccccatttttcttacatagaagtaggtaaaataagcctgagaaaacatgctctaaaattttgtagttgcatgtctttantgattttttttggcatcattggttggctacgagctgattctaagtaaaaacggcttattagaaaaaaaaatttatgtttaaagctttttatatatcaagaagaaattgcgttaacataccgtagaattaacttcaagattaagttttaaatttaaattttggctcttgttcatttgttttgtagggcaaactatgaggcttgattgtttccttactccctgttggcggtatggtatgaggcccttcgaccaaaatctgccaaaggctatgtgaggagtgggaatccaagcccgagacgctaaagttagtcggggcgaagccccntcccccatggcgaacactatggaacaagtacagcgagaggcgaaggatcgtgtgggtactctgccaagccggaggcctcttgggcgaaggacgcagggcgaagagtatatgccgaagggagacgacttcgccaaagcaagctccccccgcgagggccaaagaagccttttccggcccatcaagcctaggggccattgggccgacgatcgcctaacggcccatcaggagtccatgaacctctattacactatgtactcatgtaaatgtcctttcataagggtaaccatgtaaattcccctgtataaccaaaaccctaatagtaataacctgtaataggggctataaatagncccatagggccangtaatggggggatcccaagaaaaattctctaatcaatacactttactttttctcaaccactgttgagtaaccacatctttcgacgtatgcagttgtcgtttcgacaacagctggtgccgaccgtgtggacctccgagcgaaaccactgagagc

SEQ ID NO: 2347 - DNA, 2000 bp, Oryza sativa
  misc_feature (470)..(470): n = any nucleotide
  misc_feature (478)..(478): n = any nucleotide
cggcggcggcggtggctggaagaaggcgcgctggggcttgtaggggtcgaggatgaagtagtggaagtactcccagttgccggagaaggcggtgcggcagctgaggatcatctggccgccggtcatggtgctcagcatggacaccgagtggttccgccccggcgccgccggcgacgactggtcgcggggctccgccgcgtgcggcgacagcatcccgacgatgatcacgatcgacgggatggcgatgaacacgaacgggatcgagatgatggtcagccgccggagcaggtccttcttcttctcctcccatatttaattatgtactttaaatttcttgtagaaaatgcttcagttttgctcttcttcttcctcctctctctcctcgaagcctctaatttatcgtgtggttgacgagttggcgtttcaaaattaggaagtgaccacacctgaatgcagatgagaaatttggngatatttngaccaaatgtatcaacgatttaaacttgctcgtagctactccctccattccataatataagagacagccacttttcttagatgttctataatataaggttttaaactataacatattttttattaaattactactttttttaaaatccttcactgtcacattctttaactttattggatgcatgcattatatttattaggatgatccaaactacaagataataataactatttcttggtctttgggttaagagtggttgtggcttatattttggaagggaccacctatacatttgtcgacaaattttctcctaaaaaaataacagatgtaattatagtataattgtagtgtaattacattgtaacttgtatgtaactacagcataacttgtatataagtttcacgtaattttgaatcgttaaatctattacaagatttgtttaggtgaggaagaaaaaaatcacagcacacacatatgtataaggatttgttctcacaacctccattttaccgaaataacatattacagagagatttttgaaagttacatacaagttacactttatttacagtgtaattacactacgattgtagtgtaattatatttgtcaaatttttaggagaaaatttgtcgttaaatatatagcaaaatcgttttcgaatggagggaatagtaatttggaatgaaccgattggtcgtttccttgaatatcaggctctcgatcaggacgccgcctctcgacagatcaaatgaagcccatccagaaaatgggcccatcaggcctgataccgacattatcaggttagaataagttcactttacgtccctctattttgttgcttagtccgatttacgtccctgaaccgcaaaccgggtatgacccgtcccccaacccccaacttacgaaaaccggacaagcgagatccctcggcagtatgaagggcggttttggccgacgtggcgcctatgtggctaatttgactcagtcttcatctgacgtggtattgacatggcgctgacatggcaattcgatctagaaaaatattaatccatgtgggacccacatgtcactttaacgcacaaattaataaaatgatgggccccatgtggatcccacatgtcattatcacccttctcttcttcctctcctccctccctcttcacggcgtcacgaggaggtccggtggtggtggccgacgacgcgacaacgacgaaacgggagaaggctgggtgtcggcggcgagagcgttggggggaggggctccgcgtggggggcgccgcccgccccgagaagctactcctcgtcttcgtccgcggcgccggcgcagagcccgcgcgggggctcgaggagttcagggccgtgcacgtgggcggagggatgcagcagcagttcggcgccacgcggtggcgccggagatgtcgccactcgccggcgggaggcagcggcgggcggatctccatggcagaagcggcatcgcccatcaacaaccggctcgccgcgggccgtcagcggcggcgccg

SEQ ID NO: 2348 - DNA, 2000 bp, Oryza sativa
ggcatctccaccatccttggctgggttcgccgcctccactttggtttgcaccgtctcaaattttaagatgaaattgctaccagatcattgtgcacaacttaaccagtagaatataaatataaatatatgacactatctacctttaacgtgcgacttttacaactattttttctattaaaaatataataacaatactattaaacaaaattataatattttaaaattactttcaaagaaatacctaacaatatgatttttatatttttaaactaaatatcttgagagctactaacaagtcagagctttaataatggataagccaataatattatttgaagttttttttaaaaaaaactggtgactaatctttaagcaattccctatattaaatagggaggtaatatataatcatattcacttaagatggaaacaattctaaacccttgagaggacatccctctttatttacatactattcaaatttctataaaaaatcaataagatatattaatatacgatagatcattcctcaaatatacatgatcaaatttaatttatacacgtttaaataaaatgtaaatttacgttaactaagtatatagtttaatttttttttcgttgaaacttgtataagttaaattattttaacttatatatttgtgaaatgttatatatcacatatatttatgtatcttcttaattctttcttatatttttttcataattatttgaataacatgtaaataacaaaatctactcttatctaatattaaaagttggttggtgagagccatttataacgccattcctcatctgctgagagtgccgttgctgctagtgaaacggcgagaaagttggtagctccatcaattcaatgacgaatgtaatcttgactacaacgagtagtatagcaagaagaagatgatgaaagaaaaaggttgaacgaacaatagaaagccaaactatagttatgggatatttttttaaaaaaactagagttatgggtggaagcaataatggataccagcaagaacaaaaacacctgccaccggcatagtgccaagcttagcccagccagctactacaagctttgtttctttctggtgcgattgtggtcgtcacgtaccccacacacgtcacatgtgcaaccccatgtcctacccttttcaagtccagtgggggtcgagcgagccagaccatgcatgcatgcatatgcatggcctgcctcccgtgcgccgcccgcgtgacgaagcatgcacacaacatgaggtggagtcgcagaggccgcgtcgcgtcgcgtcgtgacgtcgtccccaccaccggagcaaagcaaagccgaataaggggggtgttttaatgcagggtataaagttttagcgtatcacgtagcatattatataagttatcatatgggtgttcaggcactaaaaaaactaattatagaatccgatagtaaaccgtgagatgaatttttttctaatatattgacgtgcaatccttttgcacgttcgtggaaaaaatcgtgagatgaatttattaagcctaattagcacattgttaaattatggagcaattaagattaaaagattcgtcttgcaaattaatcatgtaattagtttttttttatatatttaatactttgttcaaatgataggtgtaaaatttttgtacgtgaactcaacagggcctaacgcagcctttttcaccgccgcccacgtacggctgtcccccccgcttttgctcatctccgctcgccgccggcaaccgccaacccgcgctgtccagtccgtgacgttttcaccgtgcgccggcccgctcgactcgaggacgaagccgaaaagcgcgaagattctcgcgtcgccatcgcccatcgcccatcgccactgtacgtgctgctcccttgcttaagatctctcatctgcactgcactgcatgcgtccagtgtcgccgccgcgccgttaaaactttctaccgctgctgctgcgcccgccgcgcgccga

SEQ ID NO: 2349 - DNA, 2000 bp, Oryza sativa
acaaatatttttagcataatgacaagtcaaacattttcaactttgagtattagtaggaaaaataaaaaaaaagatcactcatgtaaaattgatgttactagatttatcattaaacaaactatcataatatatactctttttattgaaaacattttacttttatagatattgttggtcaaagtagcatctcggaaaaccgtgtcagagtctaataatacttatattttggaatagagtaagtatgtattatcatacctgaagtcttagatttgtaaaatgcttgtgaaggcatgacaaagagattggagcttttttacccaaactttattggaagggatttatgtgcattgatacaattgtttacatttagaaacaattatacttcctctgttctaaaatataatataatcagcggcggagccaaggcccagccagtatgggcaagcgccccggctatgctgcatacatccatgcattagaactaaatatggtgcttagccattagcctagctgcacatgcatcattagattggtattaattatcatacttagtcattagacagcagcccaattttacttctatccatgataaaatgttataggtatttgtgttttcttgttaatttgttatccattgttaggtttgtccaggctaaaaaaatttctagatccgccactgaatatagtactccctccattttataatgtaagtcattctaacattttccatatttttattgatgttaatgaatctagacatatatatctatgtatattcattaacatcaatatgaatgtggaaaatactagaatgatttgcattgtgaaacggagaaagtattggataaaatatatcccggtattaagaatccagtaggaggttgttatatgggacatagagagtagcatttttcagattctggcccaaaacatgtggcccaatcggcccagagagatagaacacagacagatagaggaagagagagagaggaggagcggatttctctcttcgtctctcctcgcactcgcagtttagtccgtttcacgagagggaggagagagaaacgagagagagagagagagagagagagagagaggcattagctcatggaggaggaggggaggaggagctccatttccccttttgttcccctgcgcattccaagaagagagcaatctttctctctcccctggtacgatctgttcctgtggctctccctcccttttttttcttggtgtaataggggcccaaatctttgttcttgttcttgccatgtgatttctggccttgaatctttagtgctaaccggttagggattgtgtgatgtttcgattgcatttggtcctgtggtgtctcatccttgaaagtttagaatctggtttatggatggatcaacgcttgggtgatattggaagctgcagaattattctttccccacaaattactcataataaatgtatatctataatctaagatgaaaccccaagattcactgcttttgttccaggagaaaatgtatattggtgcatgctgtgctgcatgatttccatggaatatatattgccttgctatgttaaaactaaaggttaacatttttatttttgagaaacttaaagattgacatttgaattcatgcatctaagtcttggaaacataatggatatcatggttctaaaaatcagtaaataatggatatcatggttctaaaaatcgataagcattattcagtattcactaatcaccctgatggtagtgagcatacggtgtagtcatcaattatactgtaagttggtaacagccgcctgttccttgtatgcaacctaatatacaccctattagacgcgttttagagcatttacggttattgacataatctctagtctcataacttcttatgtgtaatgggctggaatgcccaataatattctcaggttcagactagctgcagggttcaaggacttaatttacctatacattgtcgtcaggtttgtctggaatg

SEQ ID NO: 2350 - DNA, 2000 bp, Oryza sativa
ataattggactaggcccgatttattctattaaatctcaaaggcccataataaatgttaaggataataataccacctcaggaattaaacgaggagtatctcaacttaaatagggagttattggaggctccctgttgaccggttgaggtgggaatcggaaagccacacgcgcgcgcgccgagccggccgggccggggccagggcgtgggaatggcgtggcgggcgtgcgttgcgcctgcctctaccctttttgcaaccacgatcccacgatcccacgattgcctccgtaacggcgcgtgcacgatcccacgatcccacgattgcctccataatggcgtgtgcggcaactggcggaatcactcgtgctatataaggaggccgctaatccgatcagaactctctcgcttgctttctcttgctggtgttcttcctcctccgcgcgcttgtgctgcctctgttctgcctccccgcttctgatcgcttgcgtgcacgagagatcggaacgagcagggcctccggaaccataccttcgcctgagatctgtaccaggtaggcgggtgatcaagtttttggggagtgcttccgcacgactgctctcgacttctgctctgttcgtcgtcgtctccaccatgtctgcacctggagccggcgcagctaccgccgtccctggagatggcgcgccgggagccggagccgctgcgaacgtcaacgtcaacggaggcagttctgcctcacaatccagcggagagacattctcggggtatatctttctgctactgttaactcattctttgatacctctgttagaattgcgttcttggtatgttcatgatgcttattatactttaagcatgctctggttatgttacattttatcattagatcaccccacattgttcatgccatgattattgtcataatattttgaattaaaatatgccgatatatgaccatatttctaacaggaactatgctaaactactcaatttgagaaaatcataaaatatattcatactaactgaagaaggccctcatagaagcacttccacggaaatttcaggaggccaaaggccaggaattcacatattaatcgggaaagctaaaatttctcacattaataataaaacaaattctcaaatcaataaagagccaaaatgctaataaactaaacagttttggtaaaattatggcaccaccttttcggttgatttcaatcaattttttcatcatgtgatgcaaactaaagttttgtcgttgtccttttgcttatatgatttaagcagataataacagtatcctgaatataagaaaaaattacagcaaattttactgtgtaagaaaactacgctatacatatataaaatttacaatgtaatatatggaatttatagtgtaaatactgttgaaagatttgaactttttttatataatatgacgtcataagtatagccaggtcataaggtactccctccatactcataaaggaagttggtctaggacaatgtttaagtcaaatcttaggaatataaatcataaataactctcaagttgttgagtttgaaaatgtaaaaattatatgaatcgatttgtcttgaaaaatactttcacaaaagtatacatatatcacttttcaataaatatttttataaaaacaagaaatcaaagttgtgttttggagaccgtgtcgctgtcctaaataactttctttatgagtatggagggagtatatgcatcaagttgggcatttaatacagagacttatgtcttaatggcaaagattttctgacatataactttcatatctttaacaatacataccctttgttttggtttgattttcaaatctacatttataccaaattgtatactgatatagatatgcatccctccctgcatattaaatatttttttgtcttggaaaggtggagggagaaaattaatccaagcctttaatacataaaccatcctatgctcaattgattatttgatcacacgaaaataa

SEQ ID NO: 2351 - DNA, 2000 bp, Oryza sativa
cggcaacccggggtggtctctcgaaacaccaggagggcactgttagggggtattggctacatagttgtatactagcagatgtaaactaagattgagtgtatagaagtataggaattgattgcttttctatttcttcttccacatagtgtaggattgtttaatgagagatatgagttctttgcttcgtgtcactctaccgttatgaatatatcaacccctgcttagactctgatcatacaagtagcatatatacattattagcatagttctctcttacaatgttcccttggcattaaataaatacgataccttggaatactcccaggtgaaatgctacaatggtatatccgtgcgcttgccgattccttctataaccatatatatactaggaccaatttctggcgtcattgctgggaattcatatttctagtaatgtcgttaagaaataccaacaaggaccaaaactatataaagaagaatattttattactggataaagtcttacaagggccatacccgaattctccggagactcgaagaactaaggaagactattctaattctaatcctactagcactagagcaaagtgagtaaactaagagaactttttcttcttgaatccttcttggtgtgtgttaaaatgaaggaggggaggtcctattatagcttgagaatgacggttgggggcaccaaaaccggtacaaccgtcattgggaggtcggtagtaaccgtcattggcttgggccaaacaagaccctgctgaagcgaacaagataggttcaatctactcaaatcgtgtttgctcagtacaggtattcctccacgttagtacatattcctaagacaaatttctggggagggtactcctccgtatttagccccggttggacggtcatgataggttgtcgtaaggaactcagcaacccggggtggtctctcgaagtaccaggagggcactgttagggggtattggccacacgattgtatactagcagatgtaaactaggatttgagtgtatactagaagtataggaattgaatgctttctaattcttcttccacttagttagaattactttattatgaggatttgattagctttgcttcgtgtcattctacccctatatgaaaattaacccctgcttaggctttgacaattacaagtaacatatgtataaagtgtattagcatagtccactcttattatcttcccttgggattaaaaatacaataccgtggaatacttccgggtaaaatgctacaatggtatatccgtgcgcttgcggattacttctgtaaccataaatataccaggacaatttctggcgccattgctgagaatgaatatttctagtaatgtcgttaagaaataccaacagtaacttagatataattctataaaatttaccttttctcacagaaatcacatatgtgccgatttactcactactaccgaatcaatttttcagatgagaccgcttttaggttgtaggcagactataattatcaccgtatgcaaaaatcgctccccctcggatcgttcaaggacagcttacgaaaatcaattttcgcatccgggtgtcttaacaggtccaccctcatcaaaaaaatacccctctctcttggcactcttttttctcccctcccctctctctctctctcccccacttcaagtctcccctccactcaagtccggcatctctccctctcctctccccacactactacatataccctttttccaaatagtcaaaacacatttttgcaggcaagcaaagcgctcacccactcgtagatgtctatgaagattagtaattttcgaggcgcctagctgaaccgcatgcgaaaatgaattttgcaaaaaacaaaatttggcaaaaaaattccgaaaatatcaaaatctagaaaccctagccaacccaaccatactgctgtcgtcggtgtcactatcaacgtcaccacagactaaagcacgcttctctgcttccctcgctggagt

SEQ ID NO: 2352 - DNA, 2000 bp, Oryza sativa
  misc_feature (411)..(411): n = any nucleotide
  misc_feature (421)..(421): n = any nucleotide
  misc_feature (429)..(429): n = any nucleotide
  misc_feature (444)..(444): n = any nucleotide
  misc_feature (446)..(446): n = any nucleotide
agcgtcagcgtcaccatttttgaacgaatgcaagggacttacttaaatacgtttacttttggactcatgtatttatttttggagatggtacatgtcatgccctataatgaaatttatgttggatatatcaaattgtctacatgatgcatatccttcttattacttgaagttaaacatgtttatgttaggtgatagatagatagatagatattgtaccagtacactactcttctatctccaagatgtctgaaatgcatcattcacaaaagaagtgtgaaatatacccaatgaactaaacataaacatattttatttgttgtaatttagtacatgtttccaacatatctcttacaacaatttcatattgtcgcgaccaaaatttcatattgttcaaacctataccaatccctnccccccccancccccccnaaaaaaaaacttcancnaaatttcttcttctcattttgttacatttactatttcatattgtcgtgacgcatggccggtcaattatctagctaggttgatgtcatcaaagatattgtatttattgtcgtatatatcttctcacctcacaaatttgactaccaatcatcaccattgatgaatggacgcaaggggctaacaataatatttccacatgcgtaagaccctataataacatttggacaagaataaccagtgaactaaaatttaaacttgtttgtgttggttaaataaatatatacaatataacattgcacgacatcgtgtatagtctaacatttgtgaaaagtatcccgcgaaagaagatgcaacattattttccacaggattagaaaaatcttcatgttgaaacacagacatggagcactccgtatttccaatatgtgtaattatggaacaaatccgatagttttgaaactagaagatgcaatgcttgctccatctctaacatttatatgagagatagatacggcgtatatactcaccatctatacggcatccgtaaacaaactaatagactaaatcataaaaaaagggtccatttggggattaaaatatggagatatcgtgagatggacatatgatgcattcgctatctctaacatttatcgaagaaatcaacatagatcattcatactatctctaatatttatggaactagatacatatatttacttctgtttaagtcaaacaatactatgtcacgagatagatggatacgacgcattccgtatctctaacatttatgaaacaaaacggatgcactaaagtgtaaatagctttcttcccatggttaaatgtgaatatggcgagggagggatttggtgccatctcccagtctctcaacatttattgagccaatctgatggactaaaatgtgaataacatttttccttttggaacctggacatgtttttgctggatgggtgtataaatcttggaggggctagtgtagtgtacacatgtaccagacccccctcttctctgtagactgtaggggctcttggctttctctgcctgcctctcctctcccaccctctcttttgcccctttccagttgtccatgcccccatctttttcaccaccgtctctcctcttctcctcccctaggtacagtcccccccggtttgcaatttccgtcatctccgtcgtccaaagttgtaagttttactctctctcccttaccaccaccacactctctcttggttggaaacggaggccaagatagatgggcgtagaggcaagaattgtccccaattcagcgcccaaatcgctctcgtagggtgtgctagttggtggtacgcgagtagcagcagcagcagcaatgcttgcttgtggagtggcaaggcagcactgcagttcctggcttttgtgcatcgcctatccctgtcttgtgtgtgcgtagatcaactgaattttgtgttttgcgcagggaaggaaaggtggtggtggccatgcagcacccccagggtgccggcgacccgccgtatggcgtcgtccccgcgccgccgacc

SEQ ID NO: 2353 - DNA, 2000 bp, Oryza sativa
  misc_feature (1329)..(1329): n = any nucleotide
tgtcattatccgagagaagttatcctcaatccataaattaatcatatggattgttaaccctggataaagccgaatttctcaaatgatgactctttcaatgaaatctgagacacgaatgtcaccatcttatctcgcaagggatcaacactacgagaatatgcgggctagcttatgtttctcagtttctgcacttctgtacagttgcagacgatcgacgggtttgtaatctgaacattgctcctgacttgctactaatgaaataggtttgacttgaaacacatgccagcgtgtttgctcagcttgatgaatcagtgacctcctgtctgacccttctgttttttaggagatctcaggcttccaggttacacatcgcatgaagattttgacctatatatatatgagtgtaagaaatatattgtactatattcatggctgtgtgttgttcaaactagcatgtccgtcattcagacgccgccatccgattgacagcaaatcgaggaaatatgaatacgaaagtaaacagctacggattagtttttcagtgggctgtggggacgatgggttagttaggacttaatgaagtctacatgttgtaatcagccactggattgtgtactaaaaaaacatttatacgaatactagctggtgacaatagtattatgtagtgattgattctctactgttgcaccaatcatgattgcgcatcgctgaccgaatggtttatgtaatggtttcctggagctacagcgtcctgtttgtttgtgttggggcgtggcagtgtcgcgctcgttggtccgcagcgaaggcagcgactgcagaagcgacggatagaggtttgcgtgggcgaggcgaatgtgatgggctaagttttgtcgttggcaagatgggctgagagcgaagctttgtgaagcgataccgtgatgggctactttttgtcgctgactagaaacgtcgtgatctggtgggcttattgtgagcaacacaagatcgcgtcctgtcggcccatggttttactgatttagacatgtattttggtccggatactctaaacgaaaaaaggaccagagcgctaatgttattgtccatcggcctcttgttgcagacgggcttaagaagagtcaaagtaggtaggagtagagcttaatctccgttccaattttgtgcacgtacaaaaaaaagatctccggaagagaaacacaacatggaaacataaattttgatgttaccctgtgcaaccctgcaacgcggcgctcgacccaggccccccggtcgcacgcatccgggccccgtgcgcgcggctctcacgccatcgcgccgacgatttcgttncgcgaggcaacgacgtcggcgcggcacaccgggcacgtcgtccccctctgcagccacaggccgatgcattccgcgtggtaaaacgtgcccaaacggccgcagccgccggcacggctgtcccccgccgtccgcgaccgcgaccgcgagcctccccttgcagatcgcgcagagcgccacgtcgtcgccccttgcctccgtggcggcggcgacgtcgatgatgacgacctcctccttgttcagcaacccttggcgctccccgttgggatcgccggtggcgacctcgaaccgccggccgattaagcatcgcacggtccaggagatggcacagatcgcggcgatgagcgcgacgacggcgaggaatatctcgaggcctgacagatcaaccatcggcgagagttcgttttcgtagctaggtacgtgttgctggctcgatcgtcttggcgagtggtggaaccctgcacgcacgcgtacgtattaacgtataccagtacgtgctccggctccaggtacgtttgttactcctacttgtttcctatactgatttgtatttcgaaaaggtttgtttttttcccagatattactgcggagataattaaacagttcgtatcagaggagaaaatcgttgtggctgatctccacgtctttgttactcccacaaaaatatgaacaaa

SEQ ID NO: 2354 - DNA, 2000 bp, Oryza sativa
atatgataaaagtaacttacatatataataaaagtaatttacaacatagatatttcttttatcaaaatatagtcatgtaagatattgttataaagatttaattgcaacgaacacaatggtgtaatcggatttgatgttaatgaatctagatagatatatatgtctatattcattaacatcaatatgaatgtgggaaatgctaaaatgacttacattgtgaaacggagggagtacttctctgtttatatttgaaaccgggcaatgaattgaaaagaaaagggaacagaacggccttgtgaacgcggccaccggagccgccagcgcccggcaggacgatttgccgaccagcaacggaaggcgatgtgccgtcgagtagccaagcgatagatctaaatgtacaaaaactttttttaatgaagagtggataatatcctaaataccaaccttacctctaatcactaagttagtaaagtactaaaatgtccttatgaatcaacggttcaaatcaattctactagttgtataatactacgagtagagagtaccgagcatcgctctttattttttgggaatgctatgaatctggaatcgcatattaggtttcatttatacatctatagtcaaattcatgtacacacaaaaaaagccgaccctaaaaaatatgattgaattcccagttagatttgtatttatctatctgtatagattttattttagtggaaaggtcgcaaggacccggcctatattgaaagccaaccacgagcagagtttttgctgcggttaccagctttacaaaatggagcacagaaagcactcggagatgattaagtaccaacagaccaggggtatattaagggggtgtttaggtgagagaaggactaaactttagtccggacttattttttttgtgagagggaccctctcacccaaacaccccctaaacctctaaagactagacggcagcaatctaaaacagaccgaacgccaaagcattgcacggggctagcaagatcaaccaactcctattctattttgtcttagagcagctcctccctccttaaacctctttaccagcttctctagatcactcttattcatctccagccgatgcagaggactacactgcaataagaaagagacaatttggaaaggtagtattaggggtgagtaaacaagtttatccctgaacatgatgttgtttctcgttgtccatatatagagtccggcaaatggcagcaagcagggcatttttcacaactatatgtttaattcagctctaatgtcagcaaggataaagtcatcaaggttaagaggaacatgatcccagttcagcacatctctacagaaacaccaaacaaaatgcgccaaagggcagctaaagattatgtggtttgtagtttctagatggatagtggagaaaaaaaactaattttaaaatcagtaactagagggtgagcgtgcatacggtacggggtcgaccacgggccacggccggcggggagcacaacggctacagtttatacttattttagtgctagaggagacacagacagtaatacacgctacttccttcgtttcataatgtaagtcattctaatattttccatattcatattgatgctaatgaatctagatagttatatatgtctagatttattaacataaatatgaatgtggaaaatgctagaatgacctacattgtgaaacggagggagtagtatcaattatttgaagagttcagtgacattgtaccataaggacgaaacgaatactccactttagtggcatgtggtttgacttactcttgtttcgtcgtcacgcgccagcccgagaacgggtccaatggaggatacctcaaatacagactcagactggcagtataggaagttgtgtcgttgctcctccagcaggagaagccgatcagtacacagtactgatatcacagtactgtatcagtatcaccttgcacacgatcgatcgacgctggctcgccggcggcg

SEQ ID NO: 2355 - DNA, 2000 bp, Oryza sativa
ctgctttcttttcggtgtgaggactaagtgcctcttctgtaagtattttacgctttatttacgtttggaactgtatattacttgtcattttgcgtaccctagctggtcctagacagggatttaatacacaaaatagtctggaaatttcgggctaaatttctgggcgtgacacggcagccgtggacagtgcaagggcgacggcggcatgttgaggtggcagctaggctagaactccaacaaaaagaaaataggaaaaacaggggtagggtgacttatatatgggtgaagataaaagaggttgggccggaggggagagagtcggcagggggagggaggggagaccgactcggatgggccaaggggaggcggggagcgcgtgaacaggagagaggggcggtggccgaataggattaggattcctaaaaaggaaaacaaatgtgtgttgacaaccaaatttggttagagcaagtatcagattcaaggttaagattgaagcggatttggcaaaggagatgttctcgaaaacagagtatgcatcggctacaggggcatcggctgaagatagcatcggctaatgatggatcggacagaagacagccgatgcagccgatctcgccaaggtggttatataatcatctccgggattgatcaacgtgctgcgcaagcattgccacgattgagataagctcacggataggcaattgtatctattaattaggatattttgaatactttctttagagatatttatcggcaagagtctacctaagagacttgttcgcatcttaatggttgtaatagttttagattctcgtccggcaagaatacattatgtactttgggtataaatatgaccgagaccatgtaaacatcaaacgacagttcaataacactttcggcgcatcgccatcctttttttcattgtttcgacgagttcttgcgttcgggttgagctgcatcggtttcgatcttcaacaagacgtaaaaaacttgttatggcagcttgcgttctcgggattagtgacactctaatcttggttatgtaaattgttgagttatcatatatgctacataatctctatcggtattataatctaaccctaaatcggccagcatctgttactcggaggcagcagatagagttagaggcagcagatagagttagatatcgttattgatctagattatataacatatctaccatctcatatagattttcatcaactggcctagatcttgtgattatcattgtgcttaatgctgcatcgtttaagttcgatctattaattaatatccataaatacaatatctaacctgttttatgattatcgatagggatagtatcggggttttacccgatcttacctgatttagctacattattccctacatgtttacttgatatgctaaacctgccctttatattaagatcttatcgcattaaagtatattcggcttactagttggtatattttgcttgttttaatatcttgatatagagtggtatcggagtattagccgatacatgttagatatgtttgatcggctatgctatgaatatacatataatcttcatctcaaagtacttttaagcataagtgatttatactgtctcgactagctggtcgatctatcccaatcacttggtttaattatatcttgagaaggaaattacatatcattgatatctacagtcgatcgagcattgactttatttcgttttactcttcattgctgatctaatgccaataacatcagctcagcggttaacgatatgtgattggccctttgtcgaacggctatcgtttatggatttaactttgtttttcttgtttttctttcttgttgattgtaggatcaaatcaactggcatgcctttgaacccaaaagcaagatttaggacctgcactggagtgaagcagatctcctaggccagtgtgtgtttttcgcatcaacacacttttggcacgcccagagggacacgagttgtaacgctttca

SEQ ID NO: 2356 - DNA, 420 bp, Oryza sativa
  misc_feature (41)..(41): n = any nucleotide
ggagagagagagagagagcgccggggagggagggggagatnggccgagagagattcggcccatcgaacccgggggaggcaaaatagacttttgcagaggaattgatttgggaaggatttggattcgggattgaactcgacgatagatcggggatttgagatctgagatggcacggacactagacaacaagcaaagaaacagatttcgtaaatagagtttttaagagatagttttcccgctaggcgccacgacggaacgggcgctacaagacctcctctcctgatcaccgatgcacgccggtgagcggaataaagtatactacgagcgatgacgcagtacagaataggacacaaagcccttagattgattcccgcatgtgttgcgtggaggaggggactttatttatatagagatatcaaa

SEQ ID NO: 2357 - DNA, 2000 bp, Oryza sativa
ttttgagttgtgagaagaacaatacatgcatatgcaatagagcaatcatttattacatgtatctactccacatctattacttctattgtgggatatggttaaatctgtagaaattttaagtatcaatgtttctttgaataaggagtaaatatgagaaaacatcaaaaaacaaacaaacatggcagcattgagccatgatgcccctgtgctcatctcctgttagctctacaagtcgtgcactccacttttccaccttggtgacaacaagaaggggctaatagagatagaaacatataactaaaagaataatggtgccaagaaaaatatgtcattcaataaaaaaacaaaagtgtatcatgcatgaaaggcacttgttccaaaaaaaagaagcacatttcttacataatcaaaccatacctagaacacaccccgaaatgagctgtaaacaatggaaaatatattagtgtaaaatacataaatgatgaaaaaaaatagagaatacatatagattatcctgttatgcttcatagtgatttgcttgttttagtacatatgacatatggtagcatccatgcatctgaaaattctagacttctatgttatatactcgatatcttttaaacagagagtaaactttcactttccacaacaaaaagagagaacataattttgagcgctagtgtacaaattctgtttgtttctctaccactatatgcctactataacacatatttttaagaaaaatatagcaagaaccacatatatcacctacatctagacttcttcatttttatctaaatgataatcattactgcgatatcactacatcagtgctagttttatcatctaggatattcggcacctatattgctttgaacatctgaagagaaatgataaaaatcttggtataaaaagagtgaaagataacatagaaaattgattatgttgtggcatttgcatggataattcttttagtttggccttccacatcatatcctttatgtgattccgtcgtattccatcccttagagtgaatgataagattgctcaaaaggaaagtaaacaactaacgtttgttgtacatttgtatttttatggctgcaccatttaattttccacgtcatatgtttgatctgtaccaccatattctatcacataattaaagaggacaagaacaaaagtacgtgtcatatgcatttatccattcatgactcaattctttatccttccacatcatcaactccacctccaactcattctatccctaagaataaatgaagagataagaaagcttaagatagaaacaaatatcatgcattgtacatatgaattcaaccatggaccaccaccctcgtccaaatgtagccacataataaatcaataccaaatttcaggtgacctccctaggcatttcacttttatttttggattttcttatgctagtattaatgccatcattttttttcattctagcccttcaatttttctacatattcttttatgaagtactcttacttttctaactacacctctcattttgtctaatggaatataagttctatgtgacctcattcaacaattctatagtcaaaatatttagaatcaaattacccaaacgtttttattgattatagcctaagataaaaaataatcgaggcacaatttatgttaagacatggtaggacactaaggtatgatacaatcaaacaaaatcgagattaagcttattcatgagaaatcccactccacaagataaactaactataccagcaaataaatacacgtgatgtctgattgagtgtgatgtagacacagttggcaaccaaactaggagccggtaccgcaccgcatcgcacctagaacgactcaaggggtcgaatacctgtgggctacgattataaatagtcacttcctatggaaagaactcttcacccaaaaaatttcccgtacaatcgctatagttgaaggcaagagacccttgtaatttccaaaaatattct

SEQ ID NO: 2358 - DNA, 2000 bp, Oryza sativa
gaatggcaaaccctgtatggtacccactatcgaaatgaaaaacgtcaccccatcgttacaagttaaccaatttttttaaccgataatcagcagtaaaaaaaacttccattcgaaatacctttctaaaattttttgtagcgggccagcagttagttccaccttttcagtgctgatttgaattttttggcccgctccgatataagggtgttacacgtacgtttgcttgtgcacataataatcgttagtaattcattcgtttgcacatggatgtacagctatctagcgagttgcgctgttgcgttccactgtcacgcaaattggcaaccaggcaaaattcggggatcgaatcaaataggacgtgtgtgcttcatgccttcatccaatggtggctgccctgctggttggtggtacagtgaagcgcgctggtgcatgattttaggatgtgagcattatgcagtgcataattaattaagtactccctccatcaacttttgatagtcatatttcatcttggcacaatgaggtgtgttcggcaccctctttttctaacccctctcgatcgttttccgtgcgcacacttttcaaaccgctaaacggtgtattttttgtaaaaaaatttttgtacaaaagttgcttaaaaaattgtaattctcacaaactctccgaaacctgcagccacagccggccacagaaaattcaccgagtcagactcggcttgccttgccacatgcccaggccagccgacgccctgcttgcatcaccaagccgagccgctgcatgctgcacagtacgcatacacacatgcatagcacaacatgcatcaccacgctactgcaattcatagtaggcacacatatatgcatgctacagtaccacgtgtactgtagcaccatatactcttactttccaatttccttcgcgaacaccgacgcttgcacgcacacctcgtgaagcccgttgcaaagatttcacccacacggtatccatccaccgtatgccatctcgtatccaacttcgtcacccggtatccttgaccgtctggacctcaactcctcactgagtctagaacttcaattctccccttttcaagaagtatgcattttgtatatttctccccctttgacaataatttcatcaagatgtaagttataaaaatctaaatacacccatagcatgacccatcaatattaataattaagaatttagcaagaaaatgttgacacatctagctttttcctaactattgaagttaccaaaaattcagtaggacacgtgttggcttcaattcaaaacaaccttaatatgagagaacgtacctaacattaatttcagcacgcggaatatatatcctttgtttcttttaaatactaagatatcttttccacgtttcatccatggaatttaatattaaatacatatatcctttttttaaaacattatcctatctgaatggatatataataattcttccatggataaaataaacaagagggtttgatatttttttcctataaaaaaattacatgataaaccttagtaacgaagcaaaccctagttgggccgcctcgagatggcagcccattccggcccaggacacgagccatcgtcatcgggggtcgtctactacttgcttcctcctccctactccgcctagtctactactctacttcgctctccgccgccgccgccgccgccgccgccgcccacctcgtctcgacgccggtgagcactctcccccgctggagatccacgcgccgctggttggattagttcgggctagggtggagcgagattggatcgttggatatttggtttttggtttttgattttttttttgttgaattgttggggggatttgactggattttcctcgtgcaggatgaggatggagggttcgtcgccgatggaggaggaggaggaggcggcgaggctggcgggctcgcagggggagtcgccggcgatgctgcacccgaacggagacggagacggcgacggcggcg

SEQ ID NO: 2359 - DNA, 2000 bp, Oryza sativa
accaaatctatactataaaacatttgttagtaccaaaacttacccaagatttagcacttacccaagctattttggtatgattttaaaccaaacaagtcaaacgattcacgggtcacgacccatcaaaacagaacaaaacttgttcaaaaaagaaaagaacaagcaaaactgaaatcagtttttagagaatagacaatgaggaaacttggtaatgatgcggacgacttgttaaaaaaaacataactgcaatctaaatagagaatagacaatgaggaaacttggtaatgatgtggacgacttgttaaaaaaaaaccatagcaaaaacgaaatcagtttttttagagaagaatagacaatgaggaaacttcgtaataatgtggacgatttgtttgaaatgtattattaaaaaaatccgacctgccggattcgaaccagcgacctaaggatttatctgcacatactacagtcctccgctctaccaactgagctaaggtcggtttccgtttgtattttacagatttctgttatatccaacataaaacaaacaaaacaaagataattcatacaaccacattacatccatctccataggctgaaaggattaaccgcttgctgtacaacgatctgataatacagacgactaaaatctcttcaaattccatgcgaaatgaaaagccttcaccatacaactactttcatggttgatccatcggccaagaatccttgcgaaggtagaaacgcttccatcttgtcagcgccactttcattatcttcctttaatctattccgtgcaaagtgtgatttctctacatcattcaatctccacaacggtaacattatgcacatcggacaacttgcaggatttttggatgcacgatgatcgatctcgaggtgaggatgttgattcagtttcgaacagtactatctttaactaatattttttttcattgaacaaatgaaagaatttcaccactacccccaggtacaaattttagccgcgtggaacactctccaccgtggtaacaaaacaacagtcctctactccattccaacaattctacccgacgttggagcaggccgacgtgtcggggtctacgagcgccggaaccaggtatttcctccggtgcgccccccccattcgcgttgtagctggccccgctggccgggtccaccagcagcgacccagcgtaacccgggtacgcccccttgccgtacactccggcgcacgcggtggcggcctccagcggcgcgtcggcgtcgccctggaagaagccgttgccgaacgggttggtgacggtgccgacgatcatcgaggcgagggatatcaccatgccgtcgacgccgacgtcgccgttgggcggcgtgaggggcgccgcctgcgggccgtacaccggctggtggtacggccacgcgcactggccggggcactgggtcgccgggttgcccacccacacgtaggcgaaccgcccggcgcgggaccgcggcgacgcgccgtgggtgccgcaccggctcatgcagaagccgtcgacagcgacgtcgtcggccgtgagcaccacgttgatggcgcggctcggcgagcctcgggcggcgagcctgacgaggtccttctccccgagccgcttgccgagggagtacgactggtcgagcacgtgctggccgagggacagcgccgggaagcgcgccttcgagttggcgtagtacttctgcgccgtcttgaaccagctggcgacggacggctccggctgcggctgcggcgacggcggggtggacagcgacgagacgaagtcggtgatcaccgcgcgctgcggcgcggagaagttgccgtaccagatgaggttgacggcgatgcggccggagaggagcgcgcccttgtggtacgtcattgtgatgggctggtcctgcaccagcgcggtgagcttcctcgacgcgacgcacatctggaagagaagcgcgcacgcgagcaggcacgctgcaaaagctgcggaggaagccgccattgg

SEQ ID NO: 2360 - DNA, 2000 bp, Oryza sativa
  misc_feature (1882)..(1882): n = any nucleotide
  misc_feature (1889)..(1889): n = any nucleotide
  misc_feature (1968)..(1968): n = any nucleotide
  misc_feature (1971)..(1971): n = any nucleotide
  misc_feature (1975)..(1975): n = any nucleotide
  misc_feature (1978)..(1978): n = any nucleotide
  misc_feature (1983)..(1983): n = any nucleotide
  misc_feature (1986)..(1986): n = any nucleotide
  misc_feature (1989)..(1989): n = any nucleotide
  misc_feature (1993)..(1993): n = any nucleotide
  misc_feature (1996)..(1996): n = any nucleotide
  misc_feature (2000)..(2000): n = any nucleotide
ttaaccaaattatattcatattttgcttgatttgatcgagactaattatattttcagctcctgctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaaaaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacacctgcttcttttttcttcggctcaccgactcaccaccctcaccccttgcctccaaaacactggattgctgcccacccttgaaccgtatgaagtgatgaagatcagctaaagtagtttccttcaaggtttaccaaaccgtttaggatagagttaccaccaacccactgttatatagtttggggttacggccaccccacggtttgacagttaccatgaggtataccttggtttcaaaaactaaaaccacacatggtaatcgcgtgataaccacacagttttgtaagccctagtttcctctcaattggtgtattaatagcgattgcattgagatacactgtgctaagtgtagctataatatgaaaatcaatctcaactcatatgaaaacttgtgtacagtattgttttaaaaaaagttcaactagatgaaaaaaaaatatatcacatgtaggagagatgatgatggacaagcgtgtaaaaaatctatccaaattcaactacatttatgagatataaacaaggaataagttcactttaggtccctctatttgttgggcagtctgattttcgtcccttcaccacaaaaccgggtacaacccgtcccccaacttacgaaaaccgggcaaacaaggtcccttgatcggagtatggagggcggttttggccgacgtggcgcatacgtagctcctttgactaggtcttcattccacgtggtattgacatggcaattttatctcgaaaaaataataaaaatagtgggacccatatgtcagctacacaaaaaataatttaaaaaggtgaggcccacatggtcccacatgtcagcgtccctcttctctctatccccctctctctncccctanactgccaggagagaagggcgagcggcggcaccgagggggtgacgggtggagcagcgatggagcggcccggcgacgggcnatngacntcngagcnacngcnggcngcnggcn

SEQ ID NO: 2361 - DNA, 2000 bp, Oryza sativa
atgccccttgttatgctgatttggagatgcaacaaaacccaagtgagaatgagagccacatagccaaattgagtgaaagagataaaaagagtgtgttgtctgattccaccaaatatggggttgagagcatccacaatgagagtgagagaaatacaccacacaaaaagagaggattagagtgcaaagcatgtgaggatgtttttgattctaacaaacttatctccacttttagtgttgtctctcctaatgttcaggtttgcaaagaaaaagatgaagagatagttgtcaacccgatgaaatgtcaagaagataaaagaattgagaagatagaccttatggagaattacccaactactgccctgagtattaaccatgatgataagggaggtaaaaattcagaaacgacacccacattcgatacgtctccacaagagctgaaaggtaacaaagacgaatcatatttctgcaagcatgaagagttggtgagtgaatttgttgatacacttgatcaacgtgatattttaattgcaaataaatttgatcttgtggaactgattactcatgatgaagtctttacaaaaatattgcctgttgaaattttgtgttatatcatcctcgataaacatgttgaaatacacgatatgcttgagaaagtttctgaaatagcttcgctgaaatctttgaatagtattcatgtatgcaagtatacttttaatttgattggtggatatgctgaaaataaattctatatgtgtgctatttgcattacttgtgacaagcttgctgatttgaggttaaaattagtgaataatcatgcttttgaaccttcttatgctcagcgtaagttgaacaaaatgtttggtgcttgttgtttggaaccatttatgtcaccgacatgtgcatatttttcttctgagacactaaaacataatggtagaaatgatgattctttgaaaattttctcatccatgcttgaaatggttggctttgaaactaatgaatttgattgctcgaatatgttgcatgatacaaaatcttggaatgcagatttggtcgatgatgatagggatgaccgtcgggtggcaatacgcactgctcctttcaccgatatccaccggcaagacacgaggcgccgtgcacaactccttcccccctcctcccaaaaaaaaaagacgtgaatattagggaaggacctaatatcaaataattagaaggggtaaggcttcgaacccagttcgtccagcccaccaccttgtggagctagctggtagacctctgggtgtttctccacaactccttccccgacctcatcctccgtacagcgttgcctcgttgcacgctactcgcaccgcccctcatcgacgggtagtcctccttgctcattcaagagaaaagaagaagagggagagagaaatcccaaccatcaatgacgccacgtcgggctcatagctccatcgatacaaccattgcgcggcttcaatccatcgccgccctggccgatgattgtcgccagtcatcgaccacgccgtcgctactacttcgctgcccatttctagggttgaggagagaggatggggaatgaaggtagggacaaaattgtactctcacatcatcacatcattaattttatctctccgattcatccggcaataataaaataaggccgtgggtgtccagcagctaattaccagtcttttgtgatgtccgacagcatatatatattcttgcgatgtccactagctaattacacgtttttttgaatatcttgtagcaaattttacctttttaatttgggatgaatttatcacgacttgacatcccatgcccacatccaatgtgctctccttctcgtacacctgaacaagaatggaaagtggccaacaacgttcgcatgccatctcaacatatcttctccatgtatcagtgcaatccataggcataagctcccaaaaataacctacaagttgacggttaaccaaaacataaagtactataaggcc

SEQ ID NO: 2362 - DNA, 1713 bp, Oryza sativa
  misc_feature (12)..(12): n = any nucleotide
  misc_feature (25)..(25): n = any nucleotide
  misc_feature (196)..(196): n = any nucleotide
  misc_feature (774)..(774): n = any nucleotide
aaaaaggtaggngaatatatcatcncaaaccagagcaatccaagaggtcgaatgtactgatgcagccttgaacgacgccgacgtaaacgatacaattgcctgggatggcggaacattggacttaccccttagtcggagatcgaacatcgatgcagcctcacgtcaggtgccaagtcccgccggacgataaaataangtagaaaaggtaaaaggtggcgatgcgccaaattgtattgatcgtgaagataaattacatagaccctgggtgtacatatttatacccatgggttgatacaagtccttgtcggacaagaaagaaactttcctaaagataaaaggcaagataaagtccttataggacactaaacacacgttcctaaagataaaaggaaactaataaattattcctaattaatagataacttgtcatgccgtattctctttgaactcggtctcttctggataagcttcctttagtagatcaatttccttaaccgaatatatcaagaatccgacaactgacgacttgacaactctcatcggctaatcttaggacttcgaagccgatgctgactctaagccgatgactactccgggcttaccaaaattcactgttaactgtgggcaaagaaaccttatttatctatttatttcattcggcaaagaaaacttctatatctcttctttttatggggcagataaacatgtggtcatttatgattatcacctaaatattaataatgataatcaagcatgattcgttggtttggagtnccaaaaccttgccaagttttagcactagctaattaattagaatttgaattagtgtgagaaaaaaataatagcaaaccaaacatctatttatacctatcattaaagttttcgaaattttgatacggcaaaaaatcagcttcatgatcattccaaacatacccgcaatctttcaagatcaaattaaccagatttaagagtaaattacatcagcggtacacaaactggctagataagtgtaatctagtgtatgaacttgtaaaatgctcgttttgatgcatgaacttatttggtgcgtgcgtacaagaccaaaaccgtacgacaatgttaatcttgctgattttgttattgattttaatgctatgtaaacaaatatcacgtagataaagatcaatttagcaaaacatataataatgcatattgattgcatgaagaaaaagataaaaaattgagtaacgatgcaagcgatagtaacaaaggaagataaagtagaaaccaaatttatacatataacctttctactatatgtgcaccacgcatgtcatgtaataatttataatgttcaacttgaaaaatcagccttgtcatgccattttggctttgggatgtacgcactaaacaagttcgtacaacaaaataagtgttttacaaatttatgcactagtagactgcatccactaagttgtgtatcgttgatgcaatttactccagatttaatctacagatatgagatatccaccaaggcccagcccattttgggcgctgaagcgagcactttccactacggcccagcccgctttgggatagcgaaagcgagaaccccagaagcccgtggaagcttcggaagcggcgcggcgcggcgctgggcgggggagaagaccagagcggcgaggaaggaggcggcgcccagcggggagagcgagcggctcgacgccgacggcc

SEQ ID NO: 2363 - DNA, 2000 bp, Oryza sativa
  misc_feature (191)..(191): n = any nucleotide
  misc_feature (194)..(194): n = any nucleotide
  misc_feature (299)..(299): n = any nucleotide
  misc_feature (342)..(342): n = any nucleotide
  misc_feature (391)..(391): n = any nucleotide
  misc_feature (601)..(601): n = any nucleotide
tcgacaagaacccagcgaggttgggatcatcttttcctccacctctgtcgaatgctgctccaactgctgctcttcctccgccctagtgagacatcggtgagttatcggcttcttattgacaaattcaaatctagaaaacttgtacctatttgtgtgggaagttttgaatttttgagttaaagtttttgganacnatgatatggaagtttagggattttggtatgaagtttccggaattcttagcagaaagttttagattttgaatcgaaagttgtgtgattcaagttgaaatttttagngtataccgtagaaagttttagtctatccagttaaaagtcttanattttggattcaaagttttacaattcgaattgaaaatttcagaacatgngtacaaagttttagattatgaatccaattttttttttgtaacttttggtttgatgttttgagatttctaaattcaaagttgcagaattgaatcgaaagttctgtaatcggagttgaaaggtttcaccacgatagagacgcatcgaaaaaaaactctcaaatcaaacgtgatgcttagtgtcaggggtaacgcgctgtcgtgatgcagttntgcacgtcagtaatggtttcatgtgggctgcactacttgctgtcacagcgcatatgcactagcaagcagccctcctgccaagcagcccatgcgactgctggggcagggtatggctagggatgataatgggttaaggcccatgagttttttttttcaaaaatacttcttataatccttaaacacttttgactaaaaatatatagaaattaagctcacccttttacattttgtacgctgaaatgttattggacccattgcatgaccggtcgagacagcaaatcggcccaggtagatgagccggccctgtgcagagggcccaaccggcgaaggtagtcagtaataagtgagctgacggtctgtttgttggacggagtttttaggagggatttagagtctagagggatgtggctattaactgttttgtttagatgggggacataggaattttggtgggatgaggatggggaattgaggaatgaactccctccttttcaatatctgggtaggggcaggtaattgggagggaattcctcctttacttcgcgtaaacaaatctcagccatccgttttctttaatgatctaatctccaactaaactccctatcaatttctatcacctctaccaaacaagagactgggatgaaaaatcaaattcccatcttaatctcaccgtcaattccctcgtgtaaactcccaatcctcttccctcaagttgccaaacaagccgtgagtgtgagatctgccaacatatacgttctctctcttcgcttacgcctactccctccgtcccaaaatatagcaacctaggaaggaatgacagtccacatacatcaacttagaagggtcacattccctcctaggttgctatattttgggacggaggttgtaatttacaagttcagggggtgtttagatcatagtgtaaagttttagcgtgtcacattaaaatcatggagcaattagactttaaaagattcgtctcgcaaattagtctaaacctatataattagttattttttaaatctatatttaatattttatataggtatttaaacgttcgatgtgatatggcgaaaaattttaggtggaatctatacagggcctcagatgcaaaggatgaggacaaattaagccggcttcatgcgtggagcaagccaaccaaagcgctcccgctgccctccacgtctcagcacgcaccacccctacgtgtccccaagccgagcaacctcctatccatgcaaaatactagagcggcaatgcaaatctttgctctctctctgccaaacttgtgttcttgcgaccctgctctgctctgatacgtgtctgaagctgaaaacgatcgaagagaagatcggtcgaggttgccgaggaggaaggaaggaaggaaggaagaaggcga

SEQ ID NO: 2364 - DNA, 2000 bp, Oryza sativa
tgactcttcaccttttgaatcttgagtttttcttctagccaaatcttgagctaatcccttgcgagatactgtatgtttttaatcccttgggagaacttttgtatgtgctcataatctcttagatgttccttattgatgtattccagtacacttctattttttatgcacttgggtttgtatttgttcatcatgttgatggttttttttttctgaagttatagactgttccaattgatttttttttctgaagagaagaaattatctttgttgctgttcaagagatcttccaaataatatatagttttttcgttcttcattatgccaataaatttttagttgctctttccatgttgatatatttcaacccatatcctattttgttgtacatagatctagatctattttttttcaatccatgtgatactttggagtaattgatttctcccatgacagtaattttttttgttgaagataaataattatccttctgtccgtttaggagtctttcggataatggctagcttttttctacgtgatttccataatttctaagtttccccttttatgcttacatatactcttacctatatctattctttatgtacttcgacatggatctagatctattattatttttgtggatggaccattggtctgataatttggaatgggtcatttcaggacaagaactttatgtttaggatatataaataattttgcgtgattgtatagtagatatttcaaatcatagttctttttgttcttcactgtgtttataattagttacctgttcttaatttatcatggtgatgtatttttatctagatctattcttttctgttgatggtcatttgaaagtgacattttagaataattggctttctttcatgagcattcatactatttttgtttgcaaaccgtcaaaagataacccaaataataactagttcagttgttcttcaattatcctccattttttagatgaagaaatggctgaggcctctagttgattgtctgacatgtgaataaatatctcataatctaccatccaaatacagatcagataaaaacaatatgatttcaatgtggtgaatctcctgaattttgtatatatgtacttacttttacaggtctaaacaatcatgtattattccagggcagaacactaatgtgtgtaataccaaactttagaaaaaaaaatattcatgtgtcttttgttcaagaccaaaaatatgaagcatttctattgtcttttatagagtagttaagtaagaagtgagcacaaatcttcgtactgcagattggttacaatattgagcaaatgagcatatttggcttacttagcatattatactatttacactatgtgcatatctcatgtacgtatgcaatcggcgggaaacaattatagaactcaataagaaaatggcttgtacttgctttctttcacagtactttcctatttaaagttggtatcaacgtaattactactccctccattccaaattgatcttataggtacataaagaccaagaaaagctaataactctctcatactatatttactctagcaacaaactcaatgcatgcaccatccccaatattttctagccaatagcaaatcaagatattgcatgtgggttataaatacttgtgtgcatagatgcatgtatcaatgtccatttactccactgcacaaataacgaatagactctaataaatgaaccccaatatgtagatcatttaggaataacctaaaaaaaactatatgtagatcaatttggaatggagggagtatatgatatataaatgaaatctttttttttttgctatagcatggttcagacatcaattactgatgcattatttggaattgctgcccgtaccatgatatccacaaaaacttcttagtacttctattcagaagtgtgaataatacaaagctttgcactaatttatttctctaacatataataagtcactgaagttgttgtgcagtg

SEQ ID NO: 2365 - DNA, 2000 bp, Oryza sativa
tgttgagagcttgagctttcaagccgttgggagcccataacccatgaaagacaagaaaattaatataagaatcaggtggtatatgctactgcctttgcatgtatattagcatacaaatttgttttagacagcagtattggaaaaatatagtgtgattatgtagtttgcccccaacaaaaaagtgggacaatgatgatacagcatgaaaattttgcaccctcccccacacccaaaacattatggtgctttttcatgctcttccagagtgcactatgaaaaggatgtttgtaaaattcataaaaatatgaacttgtgtatcatgttcacacctaacttcaaaaacaaaagcacaacataaaaagaaatatttgatatgcgatactatttttgtaacatcatgatttaaaatcaatatatgaagatcttcccaggttgtcttaatcaaagaaggcagtaattggattctcagatgaaatgtgatattcaagggcaccatagttgatctgcgacaatggaatttcctaaagttggaaaggcaggaaacataataagattcaatcatgcagctcaattaagataataatccaatttcgtttcgaatctgaaccataggatctcaccagagccagacccaccctaatcaagagaacaatcaccaggcaggaatgactgtcttcttaagctttgtattgatttcagcagctgcagaaattaattccagaaagacctagattattctaggctgataaaaatgatctagtaagacaatcatggatctgttcagagctcaagaaaaatttgctattaaatatctaccttttcaaactgcccctatatggtggagccatggtcaaagaaaaataatatggattcaaggatatatctctaattgtgtcttctccatttgtttatgatcctcgagaaaatggtaggaggaaggcagacaaggtgatgagatggctgttttcttctcatgttgcgtgcatggatgtctttcagaggtaagaacaaggaacccacacttggtttagcacgtgggaaatatctgatgaaggtgatcgggtcgatgaaggtgatcgggtccacatcataggttcaaaacttggtgtggttgagcatccaatattccctacttcagcgctgttgttcaattggatgtcctgcaaatggcggctggtagtaagcagggcagatgtagttccacagaacaacctgcatgcaagtatgcaacatatatgccaggttattatattagctagtagtatataataagtttcttggttactactcgtctacttgttgaagttcttgccttgatcatggatacttcacatttccttctaacctctgctttgtcatttcatacctgatttcagtgtgggaacacagaataaacacattagtccaagcaaataagttttcaagccaaataatacaaaattacagctcaatcatgtggttaccttccataccatctttctgcctaagttaaaagtgtctaaccaggaatcaatacgaagacacaagtgttatgatagccctcttatcacccaaagcacccttcttaaaaaactatatctggcagaaccaagcacaacattacacatataaaacaactacgagcacaagacaaaggtagggaaaaaggattaggtgaagtttctgtcacatcacatgatagtcatactgtttgccccaatagacagcattcctaagtcagcataatcaaaggctcatatacatttaagtatggacacagccaacaagaatccttacccaggaccaaggacatgcaattgcatgcaccagaaacgagggcagattagtcttttctcatccaaaaaaaatgtatcgtggttctgttccttaatatggttcaaaacaccactatatataacccatgttctggtgaccagtgacctgagaaaaagctcagggaccaagtagaggcaactcatctgccctctcctactaggattgtcgtcctacttcttatccat

SEQ ID NO: 2366 - DNA, 2000 bp, Oryza sativa
  misc_feature (604)..(604): n = any nucleotide
  misc_feature (744)..(744): n = any nucleotide
  misc_feature (927)..(927): n = any nucleotide
  misc_feature (947)..(947): n = any nucleotide
aaaactgttgcaagttttttaaggaaaaaactttcaaatctaactatagtataattgtaatataattttactataactataatgtaactcgtatataagtattaaaataatatatgtaactttatatctaaattatatagagatgataacgtagttacaatgcaattacacaatgcagttatagtagggtgcaactggagtataactaacatgtaactcaattaattttttaaaaacatgcaacagatctaagtggctagcacgcacggcttgtgggatggatatcctaggttcaagcccttgcaaggacacaccttaattctcgcgcagatttttttttccaaatctcgcacgaatcatggcgtggatcgcacggccagaaaatcaaaagttttcagcctccaaaactgtcgacggctagctagcaaaaccgtaaaactaaacttactgtaaaggagaaacacggaatctcgcggaacttgatcacatagggaaccctagctctctactatataattagccaagccatcatggagagagatcaaaatctctgccaaatttatttcttccttcccaaatgaggggtgcagtccaccccccctcnaccccatgtggtacaatgtgcagtggcagtcccccatcaaggcaagcaagcaaccatagtgatcaatatgctagctgcacatatacctctctctctctctctctctctctctctctctcttagctagctagcaacaaacnagggagctagggttttcttggctctgttgccataagcagcaagtgtaccctgtccctggagagctcctcatggccatggccaacctaacaaacctagctgccaagatcggcaaggaggaggaaaccgggtgggcccacactgtcagagggtggttacaagtccacacacatgttgctttccanggtgccttgtgaggggcatncagagagttgctataggctacatacaccttcctcgcaattgcatgtagtgttcatgattttataccatgcccatgtatatatagctgcactgtgctctgatgagtaatactgttgcattatattgcatgagctacatacactgatatctctgaacttttgtgtgcgtgatatatgcactgttgcagtgtgtgttttgtgtcacaagctaggctcgtgtatttgtgcagagatcgaccagagagtatatgctagtgcatcatcattgcatgctgcaagtacacacatggatatgcacactgatctgatcatcatcatcatgaagtcatgcttatgtctgcatccgtttcttgctttgactcactatctgatcctaattacacactgatgcaggggtaaatgtaaaactagactagctagcatattagttacagttaaaaatgtagtttgttgctttctggatatttactactccctccatctacttttgatttgatttggagtagtacactgatttgatttgcaggagtagtagtgtgagagtgtgtgacagagagaaagcattgtgtgttgcacattactacaagctctctctcctatatatgtctctccttctgcacctcctgccttagcctttgaagcaagcttagcacttcacaaggtatgtacatagcacattactactcctgccctatctatctaccctgttcatgagtaattcaagaaaaaaaaaaggacaccttttctagctagttcttcatcctttcgcagcaaagagtttttacatctctagctactagttgttcctcttctctacatgaaattttttctacttctgattgcaccctttacatagctgtggggggaaatccaatttgagcacccatgccttatgttgattttaacaaaattcgtccatgtatcgatatgttcataacttggccatttctgttcttcttcttcttcttcttcttcttcagtttcctcttgtgcagaagaaggagaaacaaaagaacacagaaattaaattaaactcgatcaggaaggtatagcag

SEQ ID NO: 2367 - DNA, 1461 bp, Oryza sativa
  misc_feature (23)..(23): n = any nucleotide
gtacaataaataaatatattttnatttttattactttataagataaatctatatatgttgttctagtgcctttaaactaatattttaaaagttactgaaaggcaaagttataaaaaatttgatttcaaccttatccaaaacattaagaataataaaaccaataagagtaattacaaacttacactatttaatttctctacctactttctattctcaaccaatcataacctttgtcacatttaatttgcctacgttcatcatcaaccgtatgcaccattcatacattttgctggtctgtagctactattgatctatgcgtttctataaatgaaagatcattttttataataatatctaaatcagttcgaaccattgcatagtagtcatacctgaccagccgtgttctccggcaccgtagtcgtatgaacgtacagaatgatgagccctattggacaaagagaagcaggatagtctcatccagaaaaaaaattggtggagaccgggtgtaaaccggttcccgtgcagccccgacccccgatgattgccgcgtggacaaccgtagaatcgaacgtctcactatgtatggctccaggcgcagcgcaaacaggacggaggagccgactcgctcgatggctccgggcccatcggctcaccgcctcaccggctcacatcgcatcatcgacatctcttctcagcagcagccactgccgccgacgcagcctatctcatccgtcgtctgcatggcggggcggcgatagcgagtggccgcgcccccacaacccatccctctcgtcgaccgcaacgttaacgacgagttcgccctgtttgccggcggctagcgcagagatgtactccatcttcccgtgggcagtagctgctatctcttgatcgagctcacgggcttctttcttaccatggtgcaggattgatttgattagttagtttgatctgggcttctgcattcaaactttaatatagttgttaattgctacatttcaatgtatgtagtctgaacgtttgcagattctaattagatttgataaagtactaatattcattttggtcctttaccatttagatttgatacatactgaagattttggagatttaagcatttcatttcttcatggtcacttggtcagtgcatatatttcagtaaaagagtgtcaagttcagttgaacaaattaacatgtatatcatacggttttccggccatagtaaatggcagatcgacttttgttttttttctggggagatcgacttttgtttaacaacagtgctttactaacattatctactacctttctgtctctgaacaaatttgctccaaattcacgctacatttcttgggcttcatctatatgaattgagaatctgcatctatatccgaaattttgacaatctaacccttttagaaaacttatttgaagagtaaaccatgccaaaaacttattttaaaa

SEQ ID NO: 2368 - DNA, 210 bp, Oryza sativa
  misc_feature (110)..(110): n = any nucleotide
  misc_feature (117)..(117): n = any nucleotide
  misc_feature (122)..(122): n = any nucleotide
  misc_feature (137)..(137): n = any nucleotide
  misc_feature (148)..(148): n = any nucleotide
gaattggccagggcccccggaaacccaggggggcggggttcattgaggttaattcgaattcgaggaattcggggtggccctggggttcgaaggctaaggcgaacaggcgncgccgcnggggncggagtccgaacaanggaaaaacggnagattccggcccccggggcccttccgggccgagccgccgccatcaagcccatcagtcccgcc

SEQ ID NO: 2369 - DNA, 2000 bp, Oryza sativa
  misc_feature (1541)..(1541): n = any nucleotide
gtgccctgggcgagcgccccctgctgggcaaggagcggaaggagcgccacgagggtggaggcgttgggcctgagccgatgcatctgcatctgcatgctgaggaggtgagcaaccgcgtggtggtacatgccatggtgcgcgtagccggcaagcatggcgttccaggcgacgagatccctggcgggcatggtggcgaagatgtgggcggcgtcgggtaggcaagcgcacttgacgtacatgtcgaggagggccgttggagacgaaaaggtcggcctggaggcccgcgtggatggcgtggcggtggatggcgcggccgcagtggtggtcggccagcgcagagcaggccttgagggcgaaggggaaggtgtagttgttaggggcgacgcggtggcggagcatacggcggtataggtggaggccatccgcagcggcggtcggtgaggaggaggagtaggctcggatgaggtcgttgtaggtgcgaacgtccgggctggggatttgatcgaacaggtggtgagcgcgggagaggtggccgctggcgatgtggtcctgtagctggaggaggagcgacgccgacgccgacgccgacgctcgaggaggttgcagtggaggtggatggaggcaggcggtggtggaggagaggcgacgagcagcatggtggcgccaatggaagtggaacgagggcggcatttgtggtggcggcgcagaagcagaagcagcagcagcaagagaacggtgacgcatcgcgcccgctactcctcgctgccggcgggacctaccctacataacgccgaccaaacgccgccgcgaggaaagattggtttggcggcggggcgatctggcgccggatgaggtcgggcggcgctggtgcgcatttgcacgagcagctggtgtacgtgcgctgccgggccggagtggagtggaggaggaggggagctgggttgctgggccgcgagaagaggatggcccggcctagcgaagacgatggcctgctgggccagtgtgttttcagccgggaataagtccatctccaactataagatttgtttcttggtctacatcgtctatgtgacaataaaagaagggaaaaccaactcaatagacatatatcagtcgacccctctctctttatctctgtagcgttggatgacaaaagcgggcacctccttatttttacatacgggtcttctcttagcagttagaaaaattaaagatgtttctatatatagcgtatatattggccattcatcaaagagattttgacaaataacttcccggtggtgaattcgatcggcaattaagctggtataaattaaagaatgaaagaaaattatatattacctctggtactgtttgtaatttaggcatgcatggtcgatgtgcatgcatgccgttttcccctgctggttaaattagcttttctcacaaacgggcgtggcacatcgatcgtccgtccgtgttcttgtaatctagctcgccacctcgacgtagctatctctatctccctttgaagcgcatgcatccaatagtacgtacttttncctttttcagtatccctgtggcgtcgcacctgcgtacgatcgacgtgtagtcgttatctgtctcgctagctaggaccaatataatctcaatttgcaattaacccaaaacgatcgagcgaccaagaaagaatcaacgaatactacgtgatcgatcgagtaagcgtagtgtacgttttggtaggaacaagacagcatcgatcgatcggtgcatgcatgcgtgcgtgcgatatacgagttagctagctagctaggcgacatggccgcacctacgcatcgtccagacgcccatacacgtatgcatacgtgcgtcatactttaattacttgctaatggacttattacttttgcttgctttaattttgcccggacgttgcaggcagtaggtaatgaagtgcgatatatagcgcgcttgcattgtcgacgagcgaggggagctagctagggaattgaagtgaaggt

SEQ ID NO: 2370 - DNA, 2000 bp, Oryza sativa
atattttttcacaaacatgtgagttaaaattcttctgatacaatttgaaacaaaaataataaatttgaccgtgaattacacgtttttatagtcaaatttgttatttttgtttctacttatataagttgaatttgaatttgcatgtttgtgaagtgacatatcacatattgatctatcctactaaattttttcaaattttttatgattttttaagtgacatgcaaaataaggggatatttccttaaaggatgaattgggtttcccgttatctgtaaatccaattttctttcctacgtagttccgaggacaataatagagccatcgatattactccctccgtttcaatgtaagtcattctaccattttctacatttatatggatgataatgaatctagatatatatctatctaaattcattaagatcgatatgaatgtgaaaaatactagaatgacttatattatgaaataggggaagtattagagagtcatacacaaattatgtggcggcaatctgtgtatgactatgactacagcttaatcctatatacatatacaagtcatccccactaagtgcaattaaaactaatttcctgttttgagagtaagccacgtcaccttgattcattccagccatcggattgctcataaacgtttggatagcaatcaatcaatcaactggagatagcaatcaaaataaacatttagcaatgactaattaaagaggcccacctagccatctcttaattttgaaacatacagttggaataccaacagcaacgcatgtagtaccccagcagttataagctctttaatcttccattgaagttattttatctcctgtaaccggtgaatcagatgaacagttatgcctttatatactctctcattcactaggactttgttcctgatcgatcatctgcgcttgacagtctttccatgcatccagttgatttatttgcccactcctctgctcatgctgatgcttcaacagatcaacatgcacaatccgctttggtcatctctctcttgcttgcttgctcatggatttatttttctttttcttactaatatcacttcttgtttagttgtagaatctgaagagaagaaaagaagtagcagtttcaaatatttcttattttctgttctttgtgaaggttgcagatcttatagagagaattgaagggttggtgcattactatattcacataccggttgaaataaataagaacattttttttgtttcagttggttaaaataaataagaatacttttttgtttcagtaggttattgacatcttcgactgaacttttgaaagtttctacttcattaaaactatagtttggaataagcaattacatagcatctttgtgtaatcaccatgacgtatattgtctaccatttttctttcttgcaacatagcatagaacaatctatgttagtaccattctatttattgcatctgtgttcaattggccttggttccagtaaaaggaattgaccattcactaaacaatcagcgtattctgttatgattcaaatttcagttgcttattattataacattgttggtgaagtgttcagtgtatatcaatacgatcattcatacctaatttttcatctttacattactcttatattcccacatcaatgcgcggggtgtcatctagttagagttcgtttagtgctcatatatgcgtggtggacgaaaccgagatctcgagtcagtctcagtcgtcgtggtcataatcaatcatgcgtattcaggagaaaataaaaaagaaaaaaaaggaccagctgatggactgccgctaccctctctttagtcccggttgataacaccaaccgggactaaagatctttagtcctggattggtagtcccggttttatctcggtttgaaaaccaggactacagagggttatgaaccgggactaaaaagcacttctccaccagttataagtgccgtgctacttacgtgtcagggtctcagggacgacta

SEQ ID NO: 2371 - DNA, 2000 bp, Oryza sativa
  misc_feature (1214)..(1214): n = any nucleotide
  misc_feature (1365)..(1365): n = any nucleotide
gagctaggtaagttgctattgaatttatcacacctcattttgatttcttagaaaaatattaaatgtgaaatttttagtacatgaaaattatagagctcagagtccgattgttagcataggagttgccacgaaaattttttcctaccctatcccttgaaacaacaacttagaggctgtgttcaataaatgtgtggtttccaatcatctatgcatgtaaaagggagcgatttattaacacataattaattaagtattagaaaaaacacttaaaattggaatagtattattgttcaaaacaacttttgtatagaacttgtttgcaaaatgcatacaatttagtttgagaaatgtacatgtagaatccgagagagtagaaattgagaaaacgtagaatcaaactcaaccttaagagtggccaaggctatggaacgaggtaaaccattagcgtacgattaatcgagtattaattattttaaatttaaacagttaatttatatgatttttaaagcaatttttcctatagaatttttttagaaaacacaccatttaccggtttagaaagcatgcgcgagaaaaatgatatacttttcctcctcttctgcttggagcgaacatcagcaaggcgttgaccgacatcactcgatattactttctccatcccaaaatgctagtatttggtggacacgtgtattaagaaagtaaaatggttgtagaaatattatgactgactgagaaaagaaagtagatgaaaaaaaaaatgaagaatggttatgattggttgataagaggtgatatatgtagaaatttagataagtcactatgctgaaaatatctatattttgggacgggggtgtactactaaaccgattatcctagaagaaattaaaaatagagtaaagtccatcaccggtccctaaacttgtactgttgtgtcatcgcggtccctaaactcgcaaattgaccgttcaggtcctcaaacttgttcaattgtgtcatcccggtccctaaacttacagatcactcgtttaggtcctccaacttgttcagttgtgtcaccccggtctctaaacttggatttgaatatcatctgggtcaaatagaacggtctaaagactttatatttaaaaataattcataattttttcatgtgaactctaatgaagacaaattttatatcaaacttgtagctctcgacgcgatctacaactttgtanctaaattttttttattttaagtcattttttgtcccaaaatgtaattttaaaattaaaatttcaaaatctataaacatgcaacaatattttaggaccctaaacagttttaattcaaaaacttatcaactacaaagttgtaggtcgtgtcganggctaccattttgatataaaatttgtcttcattagagttcacatgaaaaatttatgaattactttttaatataaagtttttaaaccgtcctgtttagggaccggggtgatacaactgaacaagttggaggacctaaacgagtgatctgcaagtttggggaccgggatgacacagtcgaacaagtttaaggatctgaacggtcgatttgcgagtttagggaccgggatgacacagcaatataagtttagggagcggtgatgaactttactcttaaaaatatgtcgtaggtgtagtgaaataataagaaaaagcacacgaaaacactcccggccaattgcagtgaggtcacgaagccatacattccaagctgggaaaagtcgagcaacttctggaagttcttcttcttccattgcatggaactggaaacgctgcccatacgcttcttttccttatcgcgttggccatatcatacacacgcctcactcacaaactccattataaataggcctccctcccccacgtatcgatcatgccctcagcaagatcaagtgcacgttcgatctcgacgtcgccacgcgaaatcccactggacggacagcgttcttgaatataatcttgatcgatgcggccgccgg

SEQ ID NO: 2372 - DNA, 522 bp, Oryza sativa
  misc_feature (16)..(16): n = any nucleotide
  misc_feature (21)..(21): n = any nucleotide
  misc_feature (24)..(25): n = any nucleotide
cccaaaggggcccccnggtanccnncccccccccccccatctctcaatctctctctcactcactcactgtcactgtttgatggaatgccgccttggtgagtggtggggattggcacttaccatcggtggagaggggtgagattcgcatcgcaccgggaatcaacaggaagtggcctcgccgccatctcatccatcgcggtcgcgccaggccccgccgacgaggtccgggccgcacggcgctcgccggaccacggcttggtgctgcccacgggcgcacccccccagccggcgcagatggagccgctcggcgctcgtcgtcgcacgcgtgctccacctcgccgtctccgccatcgccggcacccactcacacgctccctcgccgggagagatcggggagaagagaagaatagaaagggggattagggtttacctcagccgccggcgatttctccggcacgggggagatcctggccgtccaacagatcggacggtcgacctcgctcccgcgttggcccgctgtgc

SEQ ID NO: 2373 - DNA, 2000 bp, Oryza sativa
  misc_feature (361)..(361): n = any nucleotide
  misc_feature (383)..(383): n = any nucleotide
ggcgactatctaagcgcccggcgatagcacgcgttgcacgacaaaaaatacattttgtggcccccgcaactaccctcatcggatctcatgtctcatacttgtgttcccaccaatgttctgcaggccaaacggttcctcccgcttcggattgcgccgatgtgcttggttgcctggccggaatgttggccagcgtcacgtcactacaccggcaatgattcaccccaggagagttcgagagctccaccagctgatttcgagctcgcgctgatcgacctcatgcatgcgaacgacgcccttgccgctggatcgatcttctctcggcacgaatcaagcttctcaaacctcaaaatcgagttcttgntgctggggtcgacgccctcccntccgaactgaagcgaatcgatgtatggatggagctccttaatctgtgactcgacataacccaccgctcggtttgctctggtatgaatcagccattgcctagctgcaaaacccatctttcttctttgctattctcttgttttttttcttttctctcatttttgcttccgtgtgaatggagatggataaaaggataaaccaccagtcattttcttttagttgctgtttctggtgttgatttcaatctaaagctgtgcgggagatgagctaggaaagcaaaaaccaaactctttctttttcttcatcggtagactactcacgctcatatgacagcacaaatggctacaaagatggagtacattcttgatcgtactgtgtatccaaaattaattgtttaatagcttttatgtagttagcacaatagccaatctattgtattagttagctttactctagctataaaatgatgtggcatttggtactgccgggagtgggcaggatctcccaaaatttggtgcttgatttgctaatgtacgtggcaggatctcctgtgcggcgaaatatcttgcgtttgtttaatgtcttgcggttatcattaatcctttatttagagagacattccttcatcaaccgtgcaagcaacctaggtttttcagttttaatttaatagtggcgtccaaagaacaaacacacccgctgtccaagctgctaatctactgaacgttaaatttaatagtagtactatttggcaagtccatttcaaaggatgacaacactaaacgcggcgaaaatacagattatccaactaaaccttattggggtgttctttgaggaatactccctccttccctaaatgtttaacaccgttgacttttttaaacatatttgaccgttcgttttattcaaaaacttttgtgatatgtgtaaaactatatgtatacataaaagtatatttaacaataaatcaaatgatagaaaaagaattaacaattacttaaattttttaaataagacgaacggtcaaacattttaaaaaaagttaacggcgtcaaacattgtagggtggaggtagtacatttctcttaagaactcgttttctattcttcttcttggttcgttgaaccacaaagatcagtgtatccaacaaccgattctgcactgttctctgaacatgcgagaggctctcatacagtatggaccgatgccgatatgccatcatcaggtgtgctgtgcgtgagcagttgccggctagtttctgtgctgattgttggtgacatcacatcataatagaagtaaagtaaatttctctctgcatcgcaggatacgtgtttgcaacgtgccattgctagggataaatcacactgtgatcgatcgagatggcacgaacaaacaacactctaccccccgacaccatgttactccatctggcggaacatgattaaacaatggctgtgcctgtatctactatatgtgcatcgaggagattaagatctccgtgatgaggtttgacaggctgaaaagctgcggcgtcccggctgtgacgaggccccagggaatttccctcgcccgctactttccaacacctgaatgacacgcagagccgccgcccacacggacgg

SEQ ID NO: 2374 - DNA, 2000 bp, Oryza sativa
tggtccatcgtccgtggcgccctcatcgtcgtccttgacccggcgagatttccgtgcaggtttaaggtatttcagtttaagattattgtaatctagattattaaatcagattactctaagctagattataataatctgatataaaataagttgtgagttgtttatttcttgggattattggagacatttaagggtagagagtatttagccacttaataatctggaaaaaaactcctctaaaaaagattattggattatactaatctggcttatagattataataatctagcataataatctacttgtttgtttcagcttactcctaataatctagattataataatcctataagctgaatcaaacagggcctaagtttaggtgctggtttagtttctaactttttcttcaaacttttaacttttccatcacatcaaaactttcctacacacataaacttttaactttttttaaaaaaaactttcaatccaattttgacgtggaactaaacacaacctaggttaggtggagtcgtggagatcactagctgtaggcctgtagcaagtctgccgacttcacaccctgctgcagcgttgggaagacatacgcgaatattagagaaggacctaatataaataattagaaggggtgaaactttaaatccagattgtctagcccatcaccatgagaatctagctaaaataccctgggtatttctccggcgttgggaagacggataaggctgtgttcgggagtgagggttgggaaccttactccctagcacacaaaacaaagcagtgtttagtgcatgattaatcaagtattaaccaaaataaatttgaaaaatatttttttaaagttactttcatatagaaaatttttgtaaaaacacactatttatcagtttgaaaagcgtgtgtgtgaaaaacgagggagatgagttgggaaagtgaagataagaactaaggatatgtttagttcatttcaaacttccaaaaattccgtcacatcaaatgtttggacacatacatagcaattaaatgtggacgaaaaaaatcaatcgcacagtttgcatgtaaattgtgagacgaatcttttgaggctaattacgccatgatttgataatatggtgatacaataaacatttgttagtgatggattaattaggcgtaatagattcgtctcgtagtttacatgcgaaatctgtaatttattttgttattagtctacatttaataattcaaagaaaggtgtgtccgtatactctaatttttttttgtgaaaagtaactaaacacgtccagcctaaatccacccagaaaccagagccaaaattgccctgtttggctgttcacacggattgatcattgatggatccatgctgatgaatagtgaggatgttgacgggcgcaactactactacgtactggcgtagtagtgcactggagcagaacagaagcatatactgtatattcctatatccctagttgcattttgtcgatcccaattcccaactgctcactgattacagccttgattacgaccccgggcccaattaatcaacccatgcttaataaattcatcaccaaacaaaaaaaatcaaaccatgcacactgcgatcagtcacgtactaagtggctcgcgtcgattcccttgcaacgctgcaacagggcggcgtgccggcgagaggaaacgtgtgttccgttcgccgcgtccggagcccgcggcgcgatggcggccgcggcatccacacgtacacctccccaccgccgcttctctttcgcggacgcgtgtggagctcgcccgccgagcggtcgccgtcgccccagaatttctctcgcgatccgatccgatcagacgcggtagaatcccatcaggcaggcaagccgcgcgccccggtatatttagacgcgctcgacgccgcggcgcgcgcctcagtttgagctgagctgagctgcgagctctctctctctttctctcggcagctggttgccacgccttg

SEQ ID NO: 2375 - DNA, 151 bp, Oryza sativa
  misc_feature (5)..(5): n = any nucleotide
  misc_feature (24)..(24): n = any nucleotide
  misc_feature (62)..(62): n = any nucleotide
  misc_feature (105)..(105): n = any nucleotide
  misc_feature (107)..(107): n = any nucleotide
gattncaggaacgtccaaagtttncggcgatttacccgtaggttttgctcaacattaagcgntcgtttaccttagtacgcctgcgaaacgcagcaggttttttangnatcatcgttatttgaacaaaatcgatctgctggatgacgacggc

SEQ ID NO: 2376 - DNA, 2000 bp, Oryza sativa
aaaaatctcaaatcgcttaattagtttctgcaaatttcaaccaaaccactcctgaaacgcagcagcaatgaaaatttcaaaaatgaaaaattgtgtaccttttcccagagcttggtgtgctccaagcagaagccggcgacgacgccgccgccgccgccgccggccttggcctcctggtactcgatgcagaggccggcgtcgaggccgcaggagacgtggaaccctaggccgcacctgggctgcgagcactcgagcgcgcagccgccgccgctctcgcagacgtagcacgccgtggcgaagcggtgcgcggggacgcgggagcagtcgacgccgtcgcggccgtcggggtcgcggaagaacacctccggcaccagcagcgcgcacgcgatgtgcgcccaccgcgcgtccgtcgtgcgcttcatcgcgccgcccctcgccgggcagaggcagcagcgtggcggcggcggcggcggcttgttgcccttgctcttcttggcggcggcggcggtgcagacggagcagaaccagtcgccgtcggggatgaacgaggcgagcgggttgccgtagcaggaggcgtgcaccatgaggtcgcacccgtcgcagaacacgatggggtccgacgggtcgccgtcggtgctcccgcacaccgcgcagtgcacgccgtcgtcctcctcttccacctcctcctccgccgccgccgccatggcctcttgcgttggctctcgcgccactctctctccatcccaggagtcttcttcccgtgctgcttcgttgagatcaatcgctttgcaagctttctcgagtgcttcgacttcagattgcttcgcactaatagcactgcaggattgattgcattcctgatctttcgattctctgcaagtgtttgatctttgtttcttcgacacttgctccttgatttcttcatgattgataggcttctccggaatcttgggcttctcttgaatcttggatgcttcagctcttgcataatcatcttccacaccatttgccacgctcgaattggtggtggcgccacgtttattggatccttgaggcttggcttctttaacagcggcgacgcgagctccatccgactccttggatggaggcggcgatggcgggagaaacggcggcatcacgcgcttattgctcggtaggcaaaccgagaccggagcggcggtgtccttcggggacggcggcgcgcgggcgctcttcttggccgggatgctcggagaaacggcggcgtctctcggcggcggcagggtgttgacgagatccttgaacgggacgcggggagaagcgtcagtagccgccgccgccgccgtcgcgctgacgcgcttcttagcagggaccgggatgctcggagaaaccgccgccttctccggcgccggcgccggcggcggttgcggcgcgtgaacacgcttcctgaccgggaccgggatgctcggagaaatagcagccttatccgccgccgccggtggcagagtgtcgacgcgcttcgtagtcgggactgagggagaagcaccactatccggcggcggcggcggcggcgcgtggatgcgcttcttggccggaagacacgccggcgcgacggcatcatccaccggtggcgcataggcgcgcttcttagccgggaggcacagagcgaaaccgcccccctccaccgccgccgccgccgcataagcccgcttcttcgccgggaggcaaacggggacggccgccgccgccgccgccgccgcctccagcatcggcgggcacaaccgcttcctcgccggcaggcacggcgccatcccgagactggagccgccgacgtacttgaaccgcttggaaggcggcagatcacgcacgctcccgctgccgacggcgaactccatggacggaatcgagaccggagattttgctacacggggaagaagaagaggaggttcgcggcgggtgatttgggatcgaaacgaaccgggggtttaaatgactgaaaatttcgcggtcgaatcagcgag

SEQ ID NO: 2377 - DNA, 2000 bp, Oryza sativa
  misc_feature (283)..(283): n = any nucleotide
  misc_feature (290)..(290): n = any nucleotide
  misc_feature (293)..(293): n = any nucleotide
caccatcagcggcccacctctattgtcccgcaacatatataaccagataatgatacttacgaatctaagcaccgtgcttacattaataaatactactctacacctctgcagatgatatagagcaaccgataaatcagacactaaacccacaccgttgcacctatctggtaggctacccacacaattataccaatacaaatgtaaagaacgagtagtactcatactaagtaaagtaccgagaatatataaagaagagtatttcattaattcggagagtattacnaaagagnatngataaactaccagagccataccgaaattcctccgaaagctctgaggactccaagaactattctatactacttccacttagcactaaactactaaataaagtatgaagaggaatcttgagattgcttgagtgcgttgagagagtgaatgagctcctccttttataggacagttatgggggttgtagccatgcgagatgtccattttacccctgcaaccgtcattaagagagcatctggagcgtacacatggagggccaagctggttgggtgctgccagggttcgaccgaatcagggcccaacaggcctccagcttcggtctgctcactgacaggtgggtcctttaggcggttgtggcagttaaagcagtttccaggactgttacacttgacttgtgggccctcttatccttaaacttgcttaggagtgaggtttcttcactttctctttattttatttgctaaattcctgcaacacattattctccaagtataactggaactatattattctgaaataaatatgcattgcaagcatagctaattctctattattttagttatattgacggtcaaaatttatctgtaatgaccgtcaacacctacctagagtgttcgattccactgaccaagaatgatgattgcctctagcttcaatcaacccgagtgtgggcctcacatctccctattgagagcagctcaccagaaagcccgaatcacccgtctgaagtgttcaacccaccgattcgatcgtcaatcacttctaccgctgtcaacccaagaaccacatctggtcatcttcatgttgaaagtagccatcaaatagttcagaccgccgcctgaagtgtttgacccaccgattaaattttattgatcgctgccgtgctccaccttacgcacatgtccctccctggacataaaccgcaagcggcatgtgtggggcaccccatcgcctctatccatggacctcccatagactctgattccacttggtacaaaaccagcccataaattaacatcggaaaccaaacacagaagaaaacattataggagattcaaagtttcaaacacaatgatgacactaaggagcaattgttaacgaggtttagccgaagagctgcaccaactcatatcccacactggcatcgcaccctacacggctgctcctcgctggtcacatcatgcatggtgtgacgtgtgtgccgcctccatacctcatgcaccacatcttcacttggctgcttgtgggtttagagttacgtttggactgctcttggcccacatcatgtggcagatccaggaatttgtttttgttggtgtcatagcatgtctacgagtgtcaaattatgccacatgtatatcatgcgaatctgttcacgccattgaaaggcccttgtcttaggccctatttgtttcagcttaagattattataatctagattatagaacagattactataagctggattataataagtcgacatagaataagctgctagctgtttgtttctctgaattattatatgtttgttagttgttagtcacccaataatctaaaataagcacatttagagtagcttaccagattatagtaatttggcttatagattataataatctatcataataagctatatgtttgtttcagcttactcctaataatccagattataataatcttaagctgaatcaaacagggccttagacata

SEQ ID NO: 2378 - DNA, 2000 bp, Oryza sativa
  misc_feature (71)..(71): n = any nucleotide
gtgggctcaccgccggcgagggcggccgcagaggaggaggggagcggcggcggcggccaacccgggcggtntgggtagcatgtgtgaccttgtggcccgaacgggtcggcatcagcagcggtacgaggatggccggcggctggtggccgggtgggtacagcttcctccctctccatcgaattattgttgcttttttttaatttttttttctccttgatttgatttggggtggattggattgcggcgatggctacgcgcgcgtgcggttcattgcgcctcttgacctaacctaatgcgcgtgtacgaggcgatggcattggtcggattgggttctatgaattggatcggtggggatgccatccctgggtgtggaatgtttctcgcggcgatttgcatatgctttaattttttttctctctctgggaaacaagcactatcaccaactagtaagatagcttgatgtgtgtgagcacttagctaagaatcttagttgcaacacctgatgatagcgacatcattattctgcggcccattccgcggtatatccatgagaatgatttttagcagcatgtgttaagcctattaggaatggggttatcctccaatgtcaagattgatggatgtgagtttagtttgatagatacatttctcagtgtatgtcgatgtcgctgcatattgctggttacgaaaaggtcatgaatcattattggtagtcaaagcgtttgttcctgataggtgaccaatttctgtttttaggcttactcttagttaagttcttctgtttttctaagctagggaagcatttctgtgcattatggcatggcaagctaacgagtttgtggtgctattatctgttgcacttctcttaggctggtggatcagtactcaggatgagatttttgtaaatattaaggaattatagtagctaacctgaaaatgttaatcaggagatgacagatggggcagctaatcagatctaaacaaaggaaatataactatagagtgggggaatgaaagctaaccatattttcatcgataatatgtcttgatattttagttattgaccttccctagatctttccttttcatagtacaaaaaaattctgcttatgcttgttgagatgcaggttgggaggtgcacctacagcatttattggcaggaactagctcaagtagcaccttttacatgtatatacattattgtgttgtaggttagtgttgcaatatttgttgccttaatatatatatgcacactctaaggactactggtttcggctctttctgtgacagacctagttcttctctggatacgattttaccatgttggagaactatatcaattcacatgtattcagtatttttcttttacatcttgttagcttgtttatgttggacaaaaaacctttgtgaatcatgtggccgtgcgtagaagttactaataacatattctgtttctatgtagtggcttatttacacattctctgattaagttcattatctctacagatgcataccgttcaggtatagaactagtaatgatgaaacttctgatgatgaaccgaagaaaattgttgaagttctcatgataaactctcaaagtggtccaggtctcctgtttccaaaggtaatgttcccatctgaattagaatcaagaaatacatgatgatgaaaaaaatgtttataaattgtgtacgcataagtttgccaaactctttatgggcggttagtttacatgaaattgcaagaaaaaaaatcaaatataaattttgatgatttatgatctaaatttggattggcctttacttgatatgaattgctataaatttacaaaaattgcctgttttgacatgctacactgaagcgctactgcactatataccctatactatgagcaacatattgatatttcagttagcccataggtggaaaagtgtcgctcttggcatttatcatgttctttctgcctctcagatgaatccatatgaagtttgaatgaaatg

SEQ ID NO: 2379 - DNA, 2000 bp, Oryza sativa
  misc_feature (221)..(222): n = any nucleotide
ttggtgctccctgatttttactgctttccttctcttgttacaaactcttttgtgggtttatgtgttttggctgtgtacatcctagttatgcagaggccgggagttttcttagtatggttctatcaacttgatgtaatcgtctgagattaataaaagcttcctttataaaaaaaaaacaaagtgaatgcaaccataatagagaaatgtacgaagattctccnntgagatagcatggcagtatgcaatttacaaaatgcaggttatatgagtgctaagaagtttcagcaacagtactgttcattgaacatttggagtaagcattgagagaaattcttctgttgagtaagggagtccataatcttctaaaacaacagctgctgcttcataaggtgtctttccaactaatttgtgagctttcttgctatcccactttttcccatttttgactagaaacggtttcagcacttgacttacaacacaatctgtcaaatgattaaaacaagataagaaaatatgactttgagataactgaacgaagcaaaggttaatgataaacgcaagcaaattttgcaacattttaatcacctgtgtttaagagggtaccatctaaatccagaatgacatgggaaataagccgagcaatgggctcgggagttgccatttgcaaaaattggaagagcctagtgcagcaatagacaggctatttgggaagcccaacctgacaaaaagccaaaatattcaggccaacatgacattggtaataagatgtaaccatagaagaaaattgatgttaagtagtagctcatatagtagccatataagttaagtagctgctttaacataaaaggtgagtccagtaatgcgtttaagaacggatatcatattttcaattaattataggtttaaacagatcttacactatgttcttataactaaattagtaagaaatcagaattaaaaaaaaagggtttcaagctttgatggaaaatgagtaatgttcgtaggcaattagtatacatacatattaagctatgtttagggtcatcatcaaacaattggaacaattaaacacttcgaaatttccatacacgtgggcttgctatattttgtagtaataaacttggaacttgtttcaagctgagattttgttcaaaattgctgctctgttagtccccaactgatcacacaagttcactcagtttactcatcaagctaacgaactaaacaatggtgccatgccatcaacactaaaccgaactctacgaggtggcaaaacactgacatgacacactaacgaataaccatccaacccatgtgacgaaggtgagctcaaaaccaggaaccttcaccaacccagcagcaacagtctactgcaagacagctcgaaatttggttgcatctccaactcgcctgctttggggcgtccggctcaaccccaccacgcttgggcaattcaccgaacagctaccgcgcagaggtgaggtgactctataccgtctcagcaacagccaacaaggggcgatcccacaatctaatccaatcccacacccacctccctcgttcccgtagctattgaacatgcaccgccaacgcacgcgaacctcgctaatggaaaggaatcaacggcgatgtatacgcacgccgggcgcgctcggcggaggagaggaccggaacgaacgtagcggccacagtggaggaggcttaggagggctacagctttcccacacgtgaggcagcggccggtgccctgcccagcagctacctctccagctggcttggcggagggagggggataagagcatctccaaccgtctctttaaatctaactctccaaatgtctatttagctaactctccatttaattagcaagtcaaatttattatttactccaacagtctctctatctgttctctctattgtgagtgtatgatagtggaatccacatgtcagcatcacctctttcttcctcattttgtctctctttttcccggaaggactac

SEQ ID NO: 2380 - DNA, 2000 bp, Oryza sativa
ggcctagatcgatttaaattagataggggactgacatgtggggctagggggtatttctgacctctcacaccgtatctctctgattcaaccgaaaatgtatattttataagtgtggtgtccaacaacaaatattcacatttcgagagtgtatttcccaaaagattgacttttgtcgtgtcctgaagttaaaactgtaaagtcatagtgacctgtagcaaaatttatcaaaaaaataagttactatagatgtttgattgcataacatggtttgatatataacttgatcaacaaggcactgtagacgttttaaaaaaataacatgattaaaaaaagttatgcttcaaacatctaatagtcattactttttaaaaaaaaaagtagtggggatgatacacagtgaatctactaccatcccaccaccaactccctctgttaaacatccaaaaataaggatgtgtttggttcgtgggatgggtcgggttaggatgcgttggtcctatttttaaggttggagggatgtatggagtgggatgaacccagatgggaatatacctcttagatccaaatccaattagtctgccaaaatcggctgaaccaatcgaacccacttcgacggagcgaattgcgttagcatctcagcgaggatccgctactcctgccgccaccatgggccgcccgtccctcctccgccgcctggccaccggttactgctgctccttcgcgcatgtagtccgctagcccactcaggccattcatctacctcaacgctagtcaatgccgctcgagacagtcgtccgcttgcctgtcagtctacactgcctccttccacctactcgctcgcccgctcgccgagtcaccagccgcgcctctctccacccgctcgtgaagctcctccttatgcctgctcgctcaccagcgcaccactcctccgtccacacacgccgccggtcactcccacactgctcctccttcagccgcccgctattcgccgcccctccttcctctgcgagttgtgagcccctcttctcgtcggccaccaccactcctccacttgcaggtcgccgccagtctccactgctatcctccacgagctgcaatcttcgggttctctctactcgctgggaataaacgtcgtgctaacgtggctccaaacgtaattcatcccatccctgcctcatcccttctaccaaacaaaaaactagaatcaccccgtcctacaaaccaaacaagcaagtagggataatttcatccctaaaatcagggattgtttcatcccatccccatatagtccccaaatcaaacatatgctaagagagcatagggctaaagggctcacctatgacctttacgttgattatattttttttcttctaatacatattttttaaaatttctaataacatatagtcattcaactagtgtctacaaaaatcctttccaaattgtttttcaagttatagagcatcaaagcaagccagcatagtaatttagcttatggagaatcaaggcaggacaacaaatttaggtggctatattctacacaatatcatcatgccaaataataaaaattcaaaaacacggcgaagcatatatgacttccactgaaatgaatagctccatcatatttactataagaaatagataaaagtatgatatccaaaaacaagatatgccatatcaaataaaatatgcccacattaatgttttctagagtgtccaagatgtgtgcattaaatatttgtctcttccaagaatccaaaatgaaggtatatgtgcatatccattttggatgtagagtagcaattaaatgagtaatgcaacacccctaggtgccacacatttatcaaacatgacagtcttccacactacaaatagccatccaacctttcccttcctcctcacccaacccaacacatccaattcagttcatggaaaccaaaattgcatccactgtgttagtcttgctcctcctcacccttggtaagttcactcaccactca

SEQ ID NO: 2381 - DNA, 2000 bp, Oryza sativa
caaagtttgagccagatcttggtttggatcctattctggatcttgttcttgttggatctgagtggcaatttaagatccaaagtcgagcaagcatgtggcaagacaatcttgttgtaacctccacacgctctgtggaccaggatgttctttcacctagtgaggtaaggcactttcttcaatgaattgtagctaagctttactttaggtctgatagtttcttggtttattttcatctagttttcagaattttattactgtataataaggtgactgcctggtgaaccgtttactggttgattgccagcactctatccaagactgacataaagatattagacaattggttaatatgtgtgcttctcctatcatgcctaactctttgatattcttttgttcattgctgtttctaggctgcaaaggtttttgagtcacagcttgcggagtcactattggaaggtgatggacagctcgcgttcaagaaactcgcaactgcaacactcgaaactttgatgccaaggattgaaggcaagggtgaatttggtcaagcacggtggcgactggtttatgcaccgcagattccgagtttactatctgtagatccaacggttgacccacttaaatcgctggcaaacaatatatcttttgctactgaggtcgaagtgcaacttggaaaacgccttcaggtatttagcctttttacatttttgaaaaccgaagcattttaagcttactggcataatgttctgtatgaatatcatccgacctgaatcgctcacatcgttctgcaggcctctgttgtcaggcagatgaaagattcagaaatggcaatgcagtggtcactcatatatcagctaaccagcaggctccgtgttctcttccaatctacgccgtccaatcgacttctcttcgagtactctgcaacatcccagggttgattcatttttgcccactacacagagcaggagctgtggaatggcagctggtctgtacaaagatgtggcgcaccgacaccgatcaattgttcttgtagataatggaagttttgataggcaggcagttgtacatgtagacttgctgatgtttttgctctttgttgtatctacattctttttctcggaaacaaagtttctgggtttgtacataggtagcaaattttagctcctttagctagttaacgtaagatgtaaagaactacctgcataaattatatgaaaatttccaatctcgtggagtcgatggatgtgtggtgagagcattctcaaatggtaggtatagcatggcttcatttggtattgtagtaaattatgataatcttggtgcgactgttttttgatatttcagcatttcacaaactatttctcttctaatctgtttcccataaatgtaagtatcgctatgtttaatcgttgtaccaaaaattggttgtttcatgttagatcccgtttgtatcctagatattgggctgaactacgccatcagattctagcattttgggtgcgttcggctcactcctgagtcattatgcatgattgcaaactaaaggagtaagtgtatttgcctcactctcttgcttctgattgaatcgcctccctcaattgtaaaactaggtataacatctctccatcctcgaaaaccggtgcaaatcaactccttcagtggtttagggagtgatttctgctggaatggcaggccgatcatgattggcttgctaagtcaatgggtgagactcacatgtcaaccacttcctcgatcatcttcctcacctctcctcttctctctctaaatgtgtgcgagagagagagattgggttataaggcccaagaggttgggctacaaggcccaatttgttatagtaaaataggaaatataaggaacccgaatggttcgcctttttctgatagacgctttcctctcctcctcaatttatccccttttctcctaaacagcgccgccaccaagcaccattggcacatgtagatcccctagttcgttctttgctt

SEQ ID NO: 2382 - DNA, 2000 bp, Oryza sativa
  misc_feature (65)..(65): n = any nucleotide
  misc_feature (1239)..(1239): n = any nucleotide
  misc_feature (1241)..(1241): n = any nucleotide
cttttacctttttccttactaatttcctcaatctaaataatgcagctaattagagttactttttngtttcagtgtgtttttttctggtgtttctgttgaatcattcaatcaaaaagggactgcgccagatcttagtgctattctgtgaggcgcatttttcaatactgtacattcttcagcttgatttagtttccagtgctttggagcgtagtggttccctaacaatggaggtactctcacagttaggtgcgcactcttattttctgtaatcatgtattttctgtactgattcatcacctaagaatcaaagatcccatctatgcttatttggagagacaacatttttgcctgttacatatgatcaagggatgcagtttatattgcacaagatctatattgataattgtcatatgcagcattccctaccttaggcgccaagtgcattaggctagaaacagctggggttatagttaggtatgattgagttgttatctctagtttagtactccctccattccaaaatataagacacaaccaccttaacccgaagaccaagaaacaattattatcatctcctagtttagatcacctaataaatataatgcatgcgtccaatagaattagagatcttgagggtggagtatttaaaaaagtaataatttaatggaaaagaggtcctagttaattgcatgcatgcatgcatgctatatattatggaacatctaaaaaaaagtagttgtgcattatattatggaacggagggagtattatttagattctatgtcttgtggagcgctctatataagggctgccaatggattgaatgaatcaaacaagagttatccctagtctatcctttctctcatcctcctccctacatgcccctcctgtccatacttctgcttccatttcaccatggtaccttggctatcaaggcccagggccagaacccccagttacccacaattactccgtagagttggtatactgtgagcagcacaaacgggtgtcagtggataacatatgtgcagattgaatagaattcatttgaaaattagtacaagtaagctgtggcatgttatcttaaataacagatgcactcacttattgaactactgttgttatttaggtttatttcggtgtaataggcattgctagggcctgagtgatcctagttcatttagttgaactaaagcatggggctggctttcattcctaattaattctactatattgttngncctgtttattatttcctgttgtgggcgtacacattaactaagcacctatttgtgggtgttctactattttgtggttaaactaaagcacctatgcaccatccatgtttgtcataccatttgtaaagaaaattggttctctgatacatccgacaggtctttcaaataaatctacaacaaaggatttcatgaaaattggttcaattgtgtgcttttgtgctgtccatagtcatggttttaaaatgctttttgcactctccgcggttcttcggcatacaccttctactcctgttgggttcactatcttaaaggctggtctgaacaagtcagttctgctgtcagtgtataactcgcaaaattcgcgaaatggtcaagctgatcgaagtacacatggtatgtttccgccatcacacttttctttttttttaaataaaaaattggcaggatatttgtgtataaattctagaacatgaacaagtttaatccacctagatgtaattcacaaatatcattcttcagttgtttattgatattgtaattttattagattggatagatgatactgaattcacaaataacatgaactctaattatctctttaaatacttagattggatagatggaattctttattgatattgtaattttatattttattatgtttaggaattagtgctcaaagttgcatatgatattgttgatatccaaactgacaagtaatggagtaacatgtactattaattgagtctatgtttttatggc

SEQ ID NO: 2383 - DNA, 2000 bp, Oryza sativa
  misc_feature (1173)..(1174): n = any nucleotide
  misc_feature (1180)..(1180): n = any nucleotide
  misc_feature (1195)..(1195): n = any nucleotide
  misc_feature (1207)..(1207): n = any nucleotide
  misc_feature (1307)..(1307): n = any nucleotide
  misc_feature (1733)..(1733): n = any nucleotide
catctccactctggccacccgtggccctccatcgctccggccctccccatgcttctccttcgctctcccctcgtgttcctgacgccaacgtctccccttcaaccgcgtcgccgccgccgcctcctgctctcgctgcgctgccatgtactcctcccacgggccattgtctcctcctcgcgctcttccgccgcgccatcctcctatcctctgtcctagtctcctcctcctcctccgccaccaccctcgccgccgttggacctcctccgctcccctccctcccctggcagcgtgcggtggaggaagccgccgccggcgactccgctcagcgaaaagaggcgaagaaaaaggccgccacagcggcggcaacaaagatacggacctcctcctctccccttccccaccagcggtcttccccacctgttggccgccctgccgcctgcccagatgagcacagtgagagaaagatgatgaagggagaggaggggaaataagagagaggtgatgatatggcatcctgacatgtggggcccacgtgggtcccatgctgactcagccgccacgtcggacaaaaccggagtcaaaaccatcgaaggacctaaagtgaatggttttgttaagttgagggatgtcatatatctagtcttgtggttggggaacgattttgtaactcgataacaagttgagggaccttcgatgtactttttcctaaaaagaaccaatagctaataatgctcatcatccatcgaacatattaattcggcagcggcaatgacctgggcagccggtggtcacccttatcgacctagctccttcctatctccctccaacctccaacctccagctctcaaccttagtttctaaaaccttttagacttgtatccctatattcttcttcaattccaccgtccaaacatttgaaagatgtaccgaatatactgtgtttgaaattggagcaaaaggctgttgacataaacttgagccgtagtttataagccaaaacaattgactaaatttgtgtatgtccaatgtttcttgttctttttcttttgagtacaatgcaccaacggtacttaaacttgtcaggaggtttcacttaggtccacgaatttgcaaagcgcacattgaggtccctaaacttgatttattgtatcatcccggtccaaagccgcgttnngctgtnttcttgtctacgtancacgccacgtgnacaatgacatggaattttttttatttttttctcccttcttccttcttttttctgtttcttccttcttttttctcggtggtgagagatggcacgagggganggattgtcgcagtggtgaaaaaagaaggaagaagggagaaaaaaataataaaaaatccatgtcatcgttcacgtggcgtgttacgtaggcaagaccacggtcaaacgcggctttggaccgggatgatacaataagtttagggacctcgatgtgcgctttgcaagttcgtgaacctaagtaaaaccttccgacaagtttaagtaccgactgtgcattttactcttttcttttttttctttctataattgaaaacgggagactattggtgctgccgtagaaccaaatttgttttaaaatgatcttttatccgctgatctagaagctaccaaccgagaaagatcgccaaaaaggattcctcctgatccgtcatccgtgtcgtgtgtgtgtcgtgtcgtcccttccctcccaaactcgcaccaaccccangcgcctcgcacatgggacctctcacctctctctctgcctcatcctgcgaaaataagaaggaaagaaaaaaaaattccgcaccgcacgtcacccaccccaccccgcttccaaatactcccagagtcccgcggccgcagcgcactactactactacttctgcttcactctctctctctccccgatcccaatctcggagagagagacgtcctcatccatccatcccatccactcgagttgatcgatcgcccggacgccgccgcaggggcc

SEQ ID NO: 2384 - DNA, 629 bp, Oryza sativa
  misc_feature (8)..(8): n = any nucleotide
  misc_feature (18)..(18): n = any nucleotide
  misc_feature (35)..(35): n = any nucleotide
tcaaaggnatcctttaanatggccttcgggacaanaaccttaaggcactatattaccaaatgcgtataatagaaatggtaacacgaagctacagaactgtcttgggtggctctatgcacaaccatttcccccattccgtttccaacctctattaccatacctacccaaaccattttccacacaagagatgtatgtgtacccatcatgccatcaccgtcggatgcagatcggacggcggaggaccctcccaaaaaagtgacagcacagtcaaaaacggcaaaaagtaaagagtagaaaccgaagagggcaagccaggtcaaaacccccctcaaatcggaaacctacaaagcctacacctacacagcctagccttcttgtcctccactaccactgtgcagcttccttcctccgccataaagcagaggagagagagcctcacgtgagaggcctcctcggtctcgccgcgctccccccaaaaccccccattttgccatcatcgcctcgtcgccgccgccatccgccgccgtcgtcgccgtcgtcgccggcgacgagtaggtgggactccctttcgtccatgttccaaagatgtttgtgtttgtgtgggcgggttttgtggtgggttgggtgca

SEQ ID NO: 2385 - DNA, 2000 bp, Oryza sativa
  misc_feature (363)..(363): n = any nucleotide
  misc_feature (553)..(553): n = any nucleotide
  misc_feature (581)..(581): n = any nucleotide
  misc_feature (621)..(621): n = any nucleotide
gaagaatttgaattttagaatcgaaggttcataatataagacttctcggctcttatccatttttcgaatttttttagaatgaatacatgattcaatttggcagacagagtagtaaagattcatcgaaaacttacagcagcttgccaaacaaaggctaatagaaaaaagagtacatatatgacagcataaaatccacgattgggttgaaaatagcggcggcagtcggacgcgacgacaatgggacggcggtggtcgggcgcgacaacgacggaactggagggagaagagtagcacgggtagagaagggctggagatgggatagccagcctaggaggctggccaatattggccagtgggtggacntggatggagaggcaattagcttgaagagttgaatagagagtctgttggagaagtgtttttggtttatttgccaaatttttagcttggagagctgagtagagaagctgttggagatgctctaagtggcagggtatcacctgtggatgcatttcggttgttgtgcgtactatttgcttctcacttgaagacnggagagttttggcaaactggagaagatnggccagcctaactactacttcctccgtctttaaaagattnatctaggagagatgtgatccctcctaggttagtgtatgtgggcacccctatgtccacagtccatatatattgtcttaggaggggttacaccctcctagattgattttttttggacgaagggagtagacaatttcagaagcacggatttcgtcatgtttgagctttcaagatctccaaagtattgatggagatcacggccattcgcgccgatgtactgtacgtatacatgtgtggagtaagaaatttggagtgtcagagaccaaaagactacacaatgatgcattcattgccggtgcttttgttttataatctatagtaacaaaacagcatcatcttcctctccatggagtagaatacacgaataacgcgatcctttttttctcatccacatctctccattctttactccaacatggccatagcatgtcggcccacgagagactgggaaccaagaaaagtcaacacaaccataccatacccgggccacgtggacaacaccaccacccaaagtactaaagcccctactgacccacccctggtgggccccaccatgtcagcatctcagcaatagcagtagcactagatatttccagatctaaaattccccgggataacgagatccgacggtcggatggacgcccacgtcaccgagcctaattaagcataattaggccccgctcggtgtttggatccaggacttaagtttagtctatttatttagacacttatttagagtattaaatatagactatttataaaactattatataaatgaaagctaatttaagagacaaattttttaagcctaattaatctataattataaaatatttattatagtatcatataggctaataatgaattaattagatttaatagattcgtatcgtgaattaattaaaaattataaatgagtttattaataatatacgtttaatatttataattaatgtcaaacacctgatattataggtcaatctaaacagggtcgaaacgtcactcgctccgatctaatcgcggtgcttgactcgtctcgtctcggctcgaatataaaggcagcggcgccacgccacgcacgcgccccgtgctctctccaacggcgcacagcgagcgaaaccccgcgcattggacgcgaatccgcaccgagcaggaggaggaggaggaattccgaacttatccccccacctccaccaccacaaccgccgcccaccgccgattcccaaattccccgcgccgccgccaccgccgccgccgccggaggaatttgttgctgctgctgttgttttggcgagtcctggaggtggtggcgcagtggtgcggtgtggtgagtttggttgtgttggtggtggtggcttgcgtggtgaggctgagccctaggg

SEQ ID NO: 2386 - DNA, 2000 bp, Oryza sativa
ccacattagctttttcgggatggtaatgaatgccaagattgtaatccttgatgagttctaactatcttctttgcctcagattcagatctaattgggtgaagaaatatttcaagctcttatgatcgatgaagatttcgcatcagttgcctattagataatgatgccaaatctttagagcatgaactacggccgctaattccaaatcatgggttggataattgacgtgaagcataagccaccactttgccctcttgcattaatataaaatcaagtccgtgtcgagatgcatcacagtaaatatgaaagctttcatgaatatctggcatcactagcactagggctgctttgagcctttttctcaattcatgaaggcttaattcgcatatctcagaccactcaaatttgtgttctcttttaaagagttgagtcaagggccttgtgattttagagaagtttttgatgaatcgatgataataatcagctaggccgagaaaacttgtgacttcgggaacgttctagtgttgtttccaattaaacacattttgtacatgttggcggtatgtcatgagacccttcgaccggtcctgctgaaaccgtgcaaccaatggagggttgaagctcaagacatcgagtctgtgggggcgaagcccacatggcgaagactatgaagcaaagatggcgaagggcgaagaatcacgctggtatcccacaaggtggaagacattttgggcgaagactatatggcgaagaaggtatggcgaaggcggatgacttcgccatagcaagccgaacttcaaggaggcccaagaggccgtctcagccaatcaagcccgggggccactgggccagcgttcgccagtcggcccattagaggcccatgtacctcaattacactatatacccatgtaaatgtccctttcataagggcaaccatgtaaattcccctgttaaacctaaaccctaataggggaacctgtaatagggctataaatagacccctaggccatgtaaaagggggatcccaagaaaaattctcaatttaatacactttactgctttccaaccactgttgagtactttcgacgtatgccgctgtcgtttcgacaacagctggcgccgaccgtggggacctccgagcgaaatcattgagagcgaatgccaccgaagagggtcgtgaagaagaaggtcgcaaagcgaaaggagaccgaagcaggagaggagatggccgccgaagaaggagcagagcctccgacgtccatgggcgaagctaggggagcaccatcggcttcggcaccggcgccgcaactgccaccttcggctcctgccgcttcgtccgggcagaggccaaacacggtcgacacggcgaaggcagccgcggcggcaagggcgctccagaccagggcggagatcctttcgacaagccagctgctggtgccccaagccgcttcatcacagccggcaacggcttcgaccgcgctcgccgctgcacaagtcaaccccaacctcgaagcacaaggcgaagccgacatggaggccatgcgacaaaacatgacgcaactccaagacatgctttgacaaatgcaagaacagcagtaggcatacgaggcagcgcggcaagccaaggtcgcttcggtcccaatcctctagtattcggcgggctacattccaccccaagtccacccacaagcatcaatccagccccttccgccacaagccatgcaagcgccagtgtacttcgccgggcagccttcggccgcaacaatacacccgaccccttatgtgcagccgcaggctcagccggtcactatccaagtacacccgccaccacctggccggccaaagtgcacccagttggttgccgtcgagccagcctggttcgagggtttcgccttggagtcaaggaccgcagttcgacttcatcaacactgctcaagcaccaaccattcgaccacaggaaccgacatcaggcttcggagcaaaccaagcgccaaaccaggtcg

SEQ ID NO: 2387 - DNA, 2000 bp, Oryza sativa
tactaccctttctgttgctctgaactgccgagttcttgactgtcagattgtggacggccataatggggcattactgctacataactgaatgctgctcctactcggttaagtaagtgagaaagaaaacacagtggatattcccagatttgtagtcgtagactcgtacgtgagaaagaaagcaggtgattgcgactcacttgcactgctacgaagaagctccaaatgaccaatgccattttcctacgctaataacagtctccggttgtgctgaaaaaacgaaatgtctacgattaattagcccccgctacacatcataaaagaggtgttcaaaacaaagaatcgtgctatacgtccgactctgcttctttccacgttggtcggacacaagtcttacatacaagttgtatgtatagcagttttccaaaacaaatgacactgtttggggatcaaattaccggccggtgagtaattggtgaaaatcatgagtaaccagctagtgaaaatatggagggagaatagctactttagtccctaaagtttctctgtaggatcagtttagtccctaaccttttaaatggtccaagaaatccttaacctatgtcataaggcctagaatagtccttgggtcaaccaaaatcatcatatggatatgccatgtcatcattcatgtaaaatctatgatgaattgtccaatttatccttacgtatatcatagaaaaataaatataagggtgaattagacataactataggaaaaaaatacttcttttttcacccttttgaggtatatgtttgctcttacatataccatatattttttttaactttttccttttgttttttattttcctatgcataagggtaaattggacaaatcatatagattttgcataggaaggtgacatggcatgtccacgtggcgattttggtgggaccaaggactatattagcccacatgacaaatttaaagaacttgtttggacaatatgaaagattaaggactaaaataacccatgagcgaaactttagggaccatattagctattcattaggaaagcgtgtaatttctacttttgattaacattttcaaatctatggctaccgatcctcaaaatctgtagtgagatccgagagagtttatagcatttagccatttacaacatcttcaatttttttttaaaaaaagaaactctaaaactattctatattttcaatcagctacaagttatagtgcatattctagaaaatgaactagaaatcagttagacccctatcaaatgctttttagaatctaagggcatgttaagattatagccaaaataaaccttaccaaattttgatatttgccaaaatattggcaagatgacaatattgccaaaattttagcaggatttcttatgtatttaccaaatttgacgataaactaaacgtagacatttttgtggcaactttgcaaaaaaaataatatggttgaaaatggcatcaatctgaacagccctaaagttagtttcttgaaacatgccacgagctgaagggcgcagaggtccaaaactaaaatgaattagagttatagagctaggaaaaagatactgaatttttacaagagattcaagcactctactcttaaaagattaaaagaaaagaacagcaatgaataggttatgacttgagccaaaacaaaaaaaaagagaaggcaattggagagacttggaacaagacgaagatggttgtagctgtccgaagctcctcaaacagggggaacgattgcttggagtttgggctgggctgggctgggctggtgacaaggagtgtgatggatcaaggcccacacaactactccagtagtactacattggagggataggtccctgggcgttcccctcgcgttgcgctctagactgtgcaggagagaccaccccctccctccttctagaagactagaaccctcgccatcctccccttcccccaccctagcgtcgcggcggcggcggtggcggcgg

SEQ ID NO: 2388 - DNA, 2000 bp, Oryza sativa
  misc_feature (1661)..(1661): n = any nucleotide
gagcttctcgccgctgcccgccgccgcccggtccaccgggaacgacccatcggcatccgccttcggctgcacatcacccaggccatcacacatcataagaaggcaaccccaaccttccccatggcggggacaaccagccagtgacttactccgacgaactcgaggtcgatttggggcttgggcggcggcgctgcctcctccgcggaggcggctccggcggacgcgttcggcgaggcggcgttggagcacctgatgcgggccgcccggaaggggccactgccagagctagccttgcggtggcctcgggtggagacgacgcgggaggaagggatggccagcgagaagagcgccgtggaggtggagctcgtggccgccatggctttccttccccttctcttttggcgagcacgtggcctcgaacgagacggtttttttttatcggcaggaggcgcgtccacggtggaagcctcgcgcgccacacggttggctgcgttgcgtcgcttctcgcgggcttctttccgttttctctagggcccaaaccaagacgaggcgggccgcatcgttgccgtgggccagcgcacgcgcgtcttcccgttgttgggccgcgtgcatgcgcgaattgagattggaaaaagtacaccgaaggtccctcaacttgtcaccaggatacaaaagcgtcctgaaccgcaaaatcagatatgcgaggtccctaaactacacaaaaccggtcacctgaggtctttggtggttttgactccggtagtcagcgtgggacccacatgtcagcgtgccacgtctatgtggcgttctcttctttttagttatctttgctgcgggggagtagcatcgggcggcgccgcgcggggctgagcggcggccggcggaggcggcgtgcgatgggcggctggcagagagcagatgggcgcggcgggcgtgggcagcggccggcgagggaggagctaccaccggcggcggcggcgtcaccgcgatcccacaccttacccctccacctccacctccgccgctgatgtagcaaacatgcgcacgccgcattccccccatacacaccccgaacgcggcgcccgacgccgccgaagacgacgcatgctgacgccgctgctgctgaagacgacgacgactatggcgacgggttcgaggaggaggaggacacgcacctccgttatggggatcgctggtatcaagcagcaagcatccatcgtcggcgagccaccgtccgtcggtcttgtcatcccatcagctctcccgtcagcaacaagcgcatcttcatcagcaagcagcgagcatatccagatccacaggcaagccgcaagatccaacgccaagctgttaaatccacagacaagaagcaagctagcagcaacaagtagcaagtgttagcttcagctataatcctgtgccatattatcggttactgtaacgcgtctagcgttgtcgtttcttcagtttcgtcagagtctgtttctctgttttttttctcatgtaagccgagtcttccgggtcgtgcgtcgtgtgcgagtcatccgggtttcagcgtcgtggtcgcgtcatcgtgaatgatggcgtagtggtgttaatttgagtctgtacaaattggctatatatatgagcatcagaaaagtcacagcgagtaagcggcaccnaaaaactctgttcgtgttcaatcgttcttccgagaccagtgaattcgcgtgagagagagatagtgagtttacacaaatcttgggcttggctttcatttggtatcaaagccatgtccgctcccaccggcggcacgtctcgtactccccggcgaacaggccatcggctctcgccgtctcctccacggccacgcaggcgacagctcgtcgtgcagcggatcgttaaggaaggcggctcggtctcctatccaacgctcacacgctcaaattactctgattgggcggtgttgatgcgagtcaatctccaggctcaaggtctatgggatgctgtcgacaccggcg

SEQ ID NO: 2389 - DNA, 2000 bp, Oryza sativa
  misc_feature (949)..(949): n = any nucleotide
gttttttacgttctatttttttttatctttggtgccacgtgagctaaaacagcttacaatactatcttagagttgtatttgtactgaatatgcaagttaagggacatgttatatatggtattgtgattttatgatgtaattcaaactcgacgttaaagttgagatagcttaagtgaacttgttccatataataagatgacgaatcagtttcggaaggttgaaaagcccatgtagctccgaccgaccgagcccaaattctaccggaatccggcctgccaccgtttcgtgtactgcgtaaccgtgccttcttttgctttctctctctctctagtccctcctcttttggtggtctctctctctctctcttctctcgcctcacttcgcatcgcctccaccaccacggttcggctcggctcggctactcctctctctctctttctctcccctcctctcacctagggcacgcgcgccgccgccgccgccgcctccctcctcctccccgcgcgatcccgccgccccccgatcgaccccgccccccgatcgcccgaggtcagcacgctcccccttccctcaaccctcctcctcctcccctcccctccctatcggctccgattatctccgccgccccgttcctcggggctcgttgcggcggcgccgccccccgatctctgcgcgctggtggttccgctgcaggtagatgcgttcgagtttgtttttattgttattattgtttgttattattccgtgcccttgttttgattcggtcgcggtgcctgtagcaatcaatcgaggctggattggttaatgggatcggtggcgccgccgattggttctgggggctgattggatgggtgctctgtggattctctaagctaggttgatgttccgtacaagggtggtttgcttctgctgcgctgctagctcttgattccgttgcctgcagagtttngtttttttagttttggccgtttttgtggtgcttattagagagcaatcgcgtctaggaggtcaaaaggctttgtgatttttgacgacttgtttccttaggaattagtattgaatagtagtaataaataggtaatattagcttagcagaaatcttgatacaatttccttttgttaaggttgctgattataatcatgggtgaattgacctttcatcttaaaaaacaatcgctcttatatctaatcttgctgaagcgtgcagtatctatctccttttctatattacactggatcatttaggttttagtggtgctcattaatcatgacaacacagctgttaagcggcaaatattgctatgctgtatgatcaatgtacatgtgagctgaaatctagtgctatatcagttcattatgatgagtcaccttgtgtttgaagttgaaagtggattaatcttggtaccgtactttatcagcagcgaagttagatgtgtcagttattagtgcttccttctcgatctgcatcaagtaaacagctacatgtttagagccataagtaacggcgaggcgaataaaagatttccagagagtatagcatgtgggcaaataagctattaattacgcatgtagccaaacttgttccggttttatatatttcagtatgtctttttctctctgatgattaggattatcgaatgcaattaatgtaatatttcactttataactgaatcccatttttccccctttgtatgtattggaatcctgtatatgaaggtatgtgaagattgcagagagtatacagaagaagtatgcacaattggagatacttgccatctatgataatgaaaacatagtctttcttggaaatgaattagatatgcattcttttctgggctttaatgattgttattaattttgttgtctagactgttaacgttatgctttatgattatttttaacgccttctgtttctaatcctggaacatattctttgtgtttcagtaaaatatagggcttcacgattgctgggaatctacctgcatagcttagttcaaac

SEQ ID NO: 2390 - DNA, 2000 bp, Oryza sativa
  misc_feature (980)..(980): n = any nucleotide
tggtcaaacacgtactaaaaagtcaacggtgtcaaacattttgaaatggagggagtattatttactggaatgggtagtaagtaagtggaacaactttatagattagtgtgaatgggatatgattgtttgttatgggagtaaaaattggaaagtaggcattggatttcatgcataaccaagtttttgtaaacaaactttttgttcaaaattgtcgagtaaaccagaacggagtgatcagtacgtgtgttagacatctcaacttgctaaaggtatcacggatggtccaaaatacgacagggtatgacacatggatgctaatataacacactcgctaatcctgaaatgagagtagggcctactctttttctggcatttctctcttcttccaccattgaccttggggctcccaaccccatagttgtttacgttgttctcgaggtcgccatggccatcgttctgctcgtgtcaagcagctaccatcgagctccccaccatcgtgatgcgctcgagctctttcacccaaactccattgtttagatcgccctgatcgtcgtcgttcatctctgcccagccgcggtcatccagctctccggcccccgtcgctaccctaaggctctcgctcccagtcaccgccattcctaggggctttacgaagcttgaggtccagtggcccggcgacgtgtggatgacaaccaaacggtggcagaagagggtgttgtgatgggaggaggcgttgatgacgaggatatgtatggcagtgagcaggaccgaggtccgagggaacttcgggtcaaggcaagcgccagaggtaaccaacgtcaagctcggtctcgcccatgggaaaagaaaatggcaaaaaaaaagggaaaagtgtaaaataaattgtggtggcctcacttgtcatttggtgcagggctagtggtgatgttgcatcacgtccgtgtgacacgccatgtcaaattttagaccgaagttggtanatttagcaagcttagaggtctaaagatgtattttctaaatttacggatctagttgaaaccaacacacaagtttaaggaccgacagtgtttttacttttttttttctaagttgtcttttcttccaagaagggtgttgtttcttctaaggaagagttcaccttaacaactatagatgatacccaagagcaagggccaagcaccatgaacaccatgtctgccatgtccgcgtgcataaacaccgtcatgaacgatccaagcaccagctttgccttcgcggcgccgtctccgtcgccactcacacccatggccttgaccgctactagctttgcttcctccaattgtgacagtttgtacttgagtttgtatagtttggcctcctttttcttcaggccgtttagatggtagcctctcagacttgagaagtagagagtgagcgagagagaggccttataatatcttttgcagatgtttgaataattgatacaatatcaggagcgaatatgaaatcaaacttgatatggattaacgttaagatctttccgattgaattggaagctcaagtgttcaattagtatagacggatatagatacagacataaatatttttttccatgaaaagcgaaattgtacaaaataaaagttaaacattcttatattgttcttgaagaggccatcaaatttgaaatgcgtggaaatttaaaagataaagaatgacagcaaagctatcagattgcaacaacggatcacatatgcacatccccttgactaatgcattctgatcgtatccatttaatatatgactggagtgccaggttaatccatatcatgtttgattcatatcaagttgattcataatctctattgatatcgaatcatttattcaaacgccagccaaatcagttcaaatatattataaggcctcgcgctctctctcaagtccgaactcaactacaaaccgttacacttggaagatgcaacggtagtagcaacctacctgaaccagccggcatcacggcggcc

SEQ ID NO: 2391 - DNA, 2000 bp, Oryza sativa
ctttgcgatgcccgggtataactgttggccgtcgaccaagacttttaactatgttcttcacatgcttgtgtgtaagaggcagtacgaagttgtccatgaggtctacttgagcgcgtcaaggttgggagtgacattggacacctgctgcttcaatattcttgtcaagggcttgtgtcagttcggcaaatttggcgatgcgatttcgctgttgtatgagatgccgaagcaaggttgcgtgcctaatgtgacgacctactctacattgatgaatttcctctgtcaacatggtcaggtggacaaagcattcgagctttgtgagagaatgcagaaggaggatattgttgcagatgcagttgtctacaatattttgatcgctggtctttgcagagaacaaagggtaacagaggcattcaatttgtttaagtcaatggttcctaagggatgctatcccaattcagggacatatcaggtacttcttgatggtcttttgagctcaggaaagtttgtagaggcaaagggccttgttagcatgatgagggcagaacgtatgaggcccggtttctcatcattcaagttactgatagatggactctgtagtgtaaactgtttagacgacgcgcatcttgtcttgaagcaaatggtggagcaaggtttcgttcctcgggtgggtacttggacaaaacttgttacatcaatgtgctagattgtggtctcatgccagtgatttatggaacaactcaaatattcaaatagtaatatttctgatatggtagcttggtactattggggtcttataatggccaagaccttttcactagggctgtatgtgatcaggatctaatatagatcgggattgtgtgaagctgggaaaggtattgttcgttttggtaagtttgtgagattagataattatttacaaaaagtaactatcttttgtccactatgagattgaaaatgtgaaatatctgaagagaatgtatataattgcagctgatcttcactcttatagtcttgccttctggccttcccatcattttcttctgaatctggaccttcttgccattaaatttcatgcatgcaacctgaaagatgcacatgatgaggtattttgttgtcttttacatcttatgatattgcctttttttttcacgtccataccgtttctttctgggaacagtgtttacaaaatagtttttcgcctctttcctttactatgtgattgttgaaccatccatcatgccagtacacctatcttcctgccttcctgggtttcactgacatctgagaccctcacagtcttgttgaactgtaagtggtgaaaatttttcaatcacaatgatggacccagttttttttttgttacagttttcagagggtgtactataaggaaaagaatctggtgcggtaaagaagtaacttcatgaagaagtgaagttcaggagtcaggattaaaggataatagtggttgcatgagcaagaaattgcctgtcttctgttttttgcacgaagcaacttatcgggcatggcatgcatatctatatgttcaattcgcatctctggattgcccaacaaaccaacagttgtctattggttgatcaggaactagtctgagatgacttggtcagttgattgcaccaagtaaaagcgactaatgtgtacggcgtactaaaaataatcatgagtttgtgttggacactttgacattgtaaactatgattagtcaactatccgcaccagaaatcttgaataaaaattgcatatcttgcagtacagtgctggtacagaagtacagaactattgcctattacagctaactttagtcttacaatttctcctgtctcattaacttttgatctggtgaaacataaactgaaaaataaatcctttggtaaggcgatttctgtttatgcctccagtgttttagagctagtagttgcaatgtcatactaatggtttgacaaaagtgcaggcagcaacaggggatctgagaacgacgtgtc

SEQ ID NO: 2392 - DNA, 2000 bp, Oryza sativa
ctatttgggcaccgttcttttgccaggttcgggctaggtactcttctagatatttgcgaccatattttttaaattgttaaatattttttcgagataacgtgttatatagaagtgcctttatcaaataaaatgagctcattttccaaactctccaatattaaaacataattaatcatgcttaatagtccacatcgttttgcgtgtaaccaattaactcagctaaacatcataaacaaacgggtttaaaatatcttgacaacattggcctggcgtttgaaagcaagaatttggagcacattcaagaggataaatggtataattttaggaattctaagatgccgcacatgaaaaatgaaagattccttcaatagataactttgcaatggttgttcagagaaaaattctgcaaacgataccgctgtcatcttctagcaacaatgcatgtagctaagaaacaccccgaaagctcaagtgggaaactgagaaacaactaaacaagtgaaccaatcatcatttaaatggtcaaaagaagaagtctgaaaagtatgatattgcattacaaattttccattggcgaattggcctgaagtgaagtgacgagacaggctctcgctgggagcattcctcaagattcaacgactgtcactgaactgaagtctgaataagcccattcccatcatcccatgtaatgtgatcaaacgagcacacgattttcaaatgagcagaagaatccattgtacttctccgaaacctccttatccactagtcaaaagatgactacggttgtgtttattccttccaaagttgaaagtttgggttgaaattggtacgatgtgactgaaaagttgtgtgtatgacatgttgatgtgatggaaaaagttgaaagtttggatctaaacacagcctacttatcatcgacgatgccgtcgaatgtcgccaagttgattgacttggaaaacctaagatcttgtccatttctacaaggtatggttcatgttttagtgagttcctacgggaccattcgcaaattattggatatggttgtaacttggtatagtggatgagcgcactgggccaatgaagaatcattatctttgaccccctgattttgtttttgcggcaagcattatttttggcttcactgatagatttatcccagttcctttcgatggaaaactggcatgtcggtaacatgcaaattacaaaagcatgctgatacggaactttcaggcatcatcacttctctttcagtggaactttttatttagagagattgtgatgttgttacgcacgttatgattttgttagagtatagttggagagacattaaagataaagaaaacaagttggagagaaattaggattggattgattcatatcgagctcttcttatctcccatatcttagggtgtgtttcgttttatggccatctaaagtctaacctttttttaatctaagtccagtccccttcgtcgacacgcacccctgacctcatattttcgcttattttcgcttatacttatgtttctcggccaaaatttgaattttcaattttaaatttagagtagattttgggtttttttaagtttatttttcagcatttgcttttaggtcgctaagaacacgtatataaaatttttattcataaattatttttcgtttgtaaatacactgtttcgcttattcccacgttaggctggagctgacaatgaaggagtttaattggactatatttccacatcgtttagatgggccatattaggctggaagctgacatttcggccggggggtatggattgagttgggccgaagaagcccatagtacaacctgcgcgcgctgacgtgtcgcggtcgcccgcgacttcggcgcgggaagcgggtggggccatatggcagcgagacagccgggccccaccaccccccgggatcgtttgtggcgcccaccaccccacctctccctcgggccgaaagagccgctcgctcgatcggccggaacggag

SEQ ID NO: 2393 - DNA, 2000 bp, Oryza sativa
tcacgaaattttgggcccaaaggctaatattaatgatttttccccaaggctaataatgataaaatttgcggcccaatcctattttaatttattcctctacctcttttacaaacccaaccctctctagtgtggaatatttaatttgtttacaaactttataaagaatagtgtgttgtaaagtggccctaaaaatatgcaaagatttcaaagctacggacgtaccaatgggataggcgtgttgatttggatggtacccacgtcagagtcagtccctcaacatccataaaattttatgatacatatataggatattagtatgcactcaatatgtacgagcttgttcaacagatgtattagaaatgataccttgtgatggatgtaaagccaaacagattgctttcgtgccaaaagaccaaagattgtgtaggttgtaagagatgcgaatttgccttcccaacaaattttttaagtgcccgcgtttatttaggacctgagacagcccgcattatggctcaatctcattgatacattataaaaaatttcacttgaattgtctgattcctgtttaccaaagaaacatgtgctcaaaataatcgcgcacaggttttcctagtcaaaacttatgttgtctttatgactttatcatcagttttttttctttggttaactatactagttgttttgccgatatctgcgggcgtgtcacgttaggtgcggtggaccaacaacaccaagatacggaatactaacgtcggccatttgatttttacgccggccttgctaaccaagtactcctacgtgacatgtatatactttttttttacatgaaacatgtatatacttttcacttgtcaaattcgatcgtacaggttggatggttagtaacacatgcatatagtaagttgtagataattgacagcaataacacagcagaaatgtagaagtatatcgaaaaatcaaaatttgaaaaacccacggattaggctatgatgaacagttgcaatccaaaaatccaatagtagtacactactcctggagtactacatggcagtactagctgctccctccgtcccaaaatataaacatttttagcatgtaaaatttgtaactttgactattaatagacaaaaattaaaaaggatcaatcatgtaaaattgatattagtcatcttttggctaaggctaatacttatcagccaaaatttgaattttcaaccttaaatttaaagctgattttgagattttttttcatctaagtttatttttcagcctttacttttagatcgctaagaacatgtgtataaaagttttattcacaaattacttttcgtttgcaaatactcccgatgttactagatttatcattaaacaaactatcataatatgcaactctttttatttaaaacatcttacttttatggatattgttggtcaaagtattatatcgaaaaccgtgtcaaaatttaaaagtgcttatattttgggacagaaggagcaggatgtttgtttcatacaatgggtttgtgggtgaaatttgggttaacatcatgacatgtgttatgaagtgatgatgggaccattccatatgttaataaattagtatttagaactttcgtcgacttaatattattatatgagatggcatatgtggaggaaatgggggctaatgtgacagtagtgtttgggatcgtggcaaataatttttcttagtactagcactagatgaattaatagaatataaaaaccgaacatgtcgatgtcgtgatcgaccttgtggagaaaatggtaagcaaatggcatggcgagtggagacgatgagagagatagagttggtgagaaggaaggaccgaaggagccgcagctcgcaccagcacaagtcaacagttgagctcctccatccacttgactactcctacttgagagagagagagagatagtgccattgccactgcatccaccattcaatctcacacctccgggctccggcaagggagacagag

SEQ ID NO: 2394 - DNA, 2000 bp, Oryza sativa
  misc_feature (614)..(614): n = any nucleotide
  misc_feature (680)..(680): n = any nucleotide
  misc_feature (682)..(682): n = any nucleotide
  misc_feature (1019)..(1019): n = any nucleotide
  misc_feature (1313)..(1313): n = any nucleotide
  misc_feature (1532)..(1532): n = any nucleotide
  misc_feature (1590)..(1590): n = any nucleotide
ccaatctcactagctacctcctatgtacttgtttccactttatatcgcagaaattgcttggttcttacaaacggaggaggactatatagaaataaaacatggtacgagaaacaaataacaaaaataaaagaaataaacatggtacgccaaagagaagtatccactatgcaatataaaatctactgaaatttgttagttttgaatcaatcaccaacatctatactatacgttggacattgcagaaaatagtccaatcctataatttgaactattgataagaaaaagataagcaaatgcgagattacatgagtaatagttgggtctttgaacggtccatgtttgataagaaaaatataagcaaattgaggttacataaatgctagttgggtcaaaaggaaatcctaagcttagcaaaagcaacctagaaaagaacaagaagaaaaatgaaaggactagaaagtgcaataagattcttgattaataaaaataaatcaaacttgaagattacgtggacaaattatccctaccaagttctccacataaacaattttgtcaaatttgaattggtcctagttgttgactagcatttaagtagctttaaacataaataattnaaaaagatagttcatcccgccaacaaagatcaataattacacataaacacgtcgacggagtaaaananaaaattcctactatcctattaaataaacaaactgtttaaccccaacaaaaatgatctaatcacagaaccgcaaaatagctacttctgaatcattatcatcctcgtcagcatcagtgagctagagctgctaagaggaacatgaggacatgcatgaactcatacgcattggccaccccatagcatggagcacgcactcgttttgacttattttttaattaatttattattaatcaatcaattaaaacttcataccacacacaaacagaaaacattaccccaaaaaacccataaaaattaaaccgaaaaacgcccaaaccaaaaagataaaaaaaaaacncgccccctctctaatcaacccctcccctaaccttaccaccacccaaagccctacccgccccactcacacccacgtgggccccaccacccctggccccacgtgtcagcgagtggcagcgcccgtcacccccgcgttcgctgtgccttcccccttaatcaaatccagcggatatttttgacgtccgcaaggacaaagtctcgccattttctcctccgttttgttttttttttcgttttcttttttcttcctcgctttctctctctctctctcctcctctctcttcttcttcttctntgccaaatcccatcgcgaaggcgagagagagagagagagagaagaaaaagtgaggggattacaaactcgcgagtttttcttttttttttttgtttattgtgtgaatttggcccacgtcggcggcggcggcggaggagctaaaccctagccggaggtgaggtggtggtggtggtggtcgggaagtggcggcgccggtggtggggcgggggggcgatttgncgcgcgcggccgagctccggatcgccggatttgtgcgtgagcgcgtggagtttgtgcngtgtgctcgtgttgctgttggtggtgagttgtgaggtgaggtggggtggtgtggcttctgctgctgctgctactgctgctgctggtgcttaattttgctcgggttcgtggggttgggaagcgagggatgcgatctgggaggtgttcgggagctcggtgttgcttaattccggtgctggtttgcggtggtgcgcgcgcggcttcttctcggggtggatttggtggtggttttttttgttgccctcgttgttgcgggtggatttcggggggagggagagtttgagggatgactgctcgttcttgctcaattccggtggatcttacggtggaaggatggcgagctgagtaaaggcgcgcgatatcttgctgcggtttgtgcggagcttcggagcactttgtcattgctggcaa

SEQ ID NO: 2395 - DNA, 1263 bp, Oryza sativa
  misc_feature (3)..(5): n = any nucleotide
  misc_feature (62)..(62): n = any nucleotide
ccnnncccccaaaaaaaagggccccaaccctaccttatcccaatccgcaagcatcctctctnaccgacatgcgggcccatccccccgtgccgcgtatgacgtcggcttccccttccgttccgttccgtcgccgcaagcccaagccacgcacttccacgtgggccccacacggcccgtgcccctcacgcccggcccacgacgcaccccctctgccacgtgggccccacgcgaccttatgctcctctctcactgcgcgtggggcccacacgtagcgttccgagcgctgccagctggggcccgccacgacccgtttacctcactgcgcgcgggacccacgcgggtctctgccagtggggcccacacgcctctcctgtccgcgacgcaacccgtctctctctgtaaggagagggaaaaaaatacaaggcagaaaggggaaaaaaaaggaaaggaaagagaaaaaaaacgcaaggcgagagagggagggagaggagtcggaggcagcggcgcgggcgaggcgaggtgagagcgagcgatagaaatacgagagccgggaggagaggcgaggagagagagacacagataagctcagccctaaccctagctccccgcctcgccgccgccgccgccgccgccgccgcaccgctccccggggagcgggacgtcgccgccgcggcgcctaggtgggtatctcccctcctctctctctctatcccgctccttgcttccttgtttgcctcgcgttgggttgggaagggctcgtgatcggggcgggggtctcctccctagggcttgcggcggtgggggcgatggggggatggtgcggtggatcggggtggggagggggatgaacgggcggtttcgtcttgtccgggcggccgatctgaggggggagcggtggtttggttggttggtctcgtccgtagtgttgattgcggtattgatgtcacaaagggaggaaacctcgtcctgagctggaattggctgtgtttgtggcgggtgcatcggtgtggatgactcaaaggggtgattgcgtgggttgggatgcgatgggaactctgttctggagatggtttactttgaagcaggaattctgttgattagatttgcgcatagattgctttggttgatccattatagtgcacttgtgcattgtgctggaacggtggaatgctatcttcaggttgcttacatgagtttactttgtttgcaggtgtggttgactcagcatatttgttccgtctgccagccgccgcccctagggat

SEQ ID NO: 2396 - DNA, 2000 bp, Oryza sativa
agccttgtttggtttcactaattcatatgcttatccgattcgattataagcagaagcataagcactataagatcctgcagaaaggactagcttaatttgaaattacgatattataattatatgcattcacaactattagcacattcacaagtagtagcgaatttgcaacaattgtaaatagtgggtggtgatcaatgaccatactctgttttttaatacaaatactgaagaggaaatcatatgatactgtcgagggaaggccctcgatagcgggaggtcgtgagaccccccctttcgtgagtttggccggaggaagaggctcgcctcttagaaatcgcgtatccgcccctaaggctactagctagcttgcacacaatcggattatacaggttcgggccgctgtggagcgtaataccctactcctgtgtttgagattatggttaagagttacaagggttccttaactccggagagatttctccccttcttctcctagagttcaggttttctgggagtcgtccctttgctcggtgggcaagatcctccttttatagttcaaggggataccacatgcaccgcctctacctatccttccctgggagggggacccaccttaccttgaccgggccatgatccgtgccttcgctcagaagctaagcagcagcccgtcctaagtgggacccagcgccaccccccgcctgacacgggggacagccctgtcattcccttataaatgggtgaagacttgtggtggtccttctctcatggagggaaccccgaattatgccctgatgggacgggtcatacctacttccactccgcctgttacagaagcgacgtgggggcacggccgcccgttcaatcggatgtaaccggcaacaggccggtcacagactggttacatccgattgacgtgggtcagctaggcggcaccgcacatctgcccttaccgcattaaatgcggtgagggacagttgaggcgctgcgcattgatggctgttcagcctcggcccccttcctgctcgctccccccgccacatggtagctgggcgagggcctcgggacaaggcagcgggagagcccgaggggcacgacatggcaccccgaggccccccggccgcttttgtgactcgcgaggcgcgggagtagggctaggctgtagagccacgcggctggatggaaaggtaactttcccccacttcgcatacccccaggcccatctccgacagtagcccctggcaccatattggacactgacctcctgaggtcggtctgatgtggtgcctcacgacttcccaagctggggttgtgggcccgacagggaatctaaggaaatgtcgccgagtggccaggttggcatattaaccacggcagcagtttgccgccactgaccacgctgatgatggggatgtttaaggcgtgaaaatcggggggtcggtcaggccacgcctcgattctcttgcccgctactcatgcggcggtagtggtgacggttcactcaggttgtgtccgtgaccgttgtgcgccctactccgagtgtgccgctgataggcgcactaaatgcagggcgtggattcaatgggcgacgtgatgagttgacgcgggaaacgaagagacaaccgtgggcgcgagaatcgtgggggcaaccgtgagggcgtgaaacgaggaggtgagcgtgggtgaggcgaggataaaaggatacggaggcaaggatgttgtctccttcctttcgccaactgcccactcgtcttctcgctccttaagccctaacattctcaccacttcacactattccgcgcgccaagccctccgccgcttctccgccggccatcatggctcaagacgctggcgacacggtgctcccggcatcacgcattatggcggatagacaccttagcctcccccgcaagatcatgccggaaggcgccgtcgtgagggcgggggagttgcggccgcggccgctgtatccggagcgatccgtgcacctcttgtccttcgct

SEQ ID NO: 2397 - DNA, 2000 bp, Oryza sativa
  misc_feature (1052)..(1052): n = any nucleotide
  misc_feature (1424)..(1424): n = any nucleotide
taatcacatcgagaagcacactagccatgccctcctcaccttttcccttcatagtggccatcccatcctgtcggcgtaatttgccacagttctcatgtcctcatcctgtggtaaagcccccgacccacccaggagctctattaaacatcatcttagtgaaatagtgatgtcatgcatggtaaaaaaaaataatgatgatgtcatgggcaactgtagtgtcattattagatcaacaaatacggaagtgaaatgaagttcatccatgcatacacaggggttattgtataggtttgcggctatccatgacgatagatgattaaaaaatagcgtgtatgtcagcttcacaggcatagatatgtaatgttcatctcttatttatctgagagtgacagaatttgcatctctttaatagtgattgacatacgatgtggtccacgcaaataatgggcccatggtaagatccaaccataaccatgactaactaggtgtggctgagggagaccattgagcgagctagctattcaaccatcgagagtctaggggtggtaagcccaatgacgtgacaaaagggtcgcatcgccatattgctcggtggtcttcttcagacacgctcgactagtcatggttatgattggacctcgtcgtgggtccaccgccatgtggatcatgccatgtcgtccactgattcttaagaaagggacacaatgtctgcctcagaaaaagatggtgcacagggagcaccccttgccatcgatgctaacacaattcgaagaaaccatgaaacaccgtccgatgtttttgaataggatcagaagtccgactactcatcatgtcatgttgagatatatagagagtgtttgggagagagggactaaatctagggacttatttttttggagagagggactattagtacctctcccaaacaccctcatagttacaaggaagatacctctgcctagaattaccctgagaaattagcataggctggctcgggacttgtctctgggctgggtcgctcctgctcccgccgtggttaaacagtggaagtntggaaccaacggtagtttcgaactttcgatgaataagaatcagtgtcacataatagtcttgatacaaccattccaaagacgttatagcaagaaagggaaatctcgcaaccttcaaacaccagccgtgatgcacgtttgtctgcgttacgctcgaaaaggaagcgagaagcgaactagtggtccccaactcggcaaaaaccatgatctcatgacatccatcaataccgccgcccccacgcgtctctgctattggtggtgttgacagcccaaggcccaagtgtcacacgcctttcgccaatctgccgtggtgctaaagcgtacaactattctgtcaccgttaacattcggccaaatcagaaagcattaaaaagnaaaaaaaaacccagagggaatcgaatgacggcatgacggagttacaaggcggagaaaaaaaaggtgctacttttaccctagtgatgaaaggagaattttacatagacttgagttttacacatagaccaagtctatctagtatagcgaaataatagaaataaacaataggaatcggccactcgatccgcgacaacgagattccgccgccgagaggtgtttgtgcaccggaaatttcacccctcttttttttgggccaaatccgcgtcggcatcggcatccgcgaggcgtcccaatcccaatcggcaccaccccctcctgccccgtgacgccgccgtgccccgtgccgtgggctcgctcggctcgatcctggccgcgacgcgacgggaccgacccgaactctctccaaccctcctctctataaataccgcccctccgtgtctgtgccgttcgatcgcacccgtaccgaatccgcgcccctgaaagttttgcatgccgctgtcgaagtcggcttccgcgtaggtgtggtcgtcgtgtcggcggcggcggcggcggcgggaggaggaacgaggaggacac

SEQ ID NO: 2398 - DNA, 2000 bp, Oryza sativa
taaatagatgggctaatttgaggctaaagtgaattagccccccttaaaacattagcccctccaaaaagtgctaatggggctaattttgtgtggggagtatcaaaaagcagctctctctctctctcatctctttttactctctcttcaacttttagccttgaattagcccatggatctaaacatacaaccctaaactaatgtttagcctactgatttataactaaacattagctcttataattaatactgggctaatctttcaaacaaactgagccgtcagtcgtcactgtgctaatgaagtaacccacccctagccctagcaagcgtcctgctttcgaattcacgtgttaattgattttgcgacgtcacggtcaggccgtcagggtagagaggtcggtggttggtggatgcctgtgagtgacgaaaagttcctttgcatccaagctatgattgccgcgcgcgcgggcacgttctggcgagttctttttggatgtagctagtttgttcggtgaattctggttttactgccattggccacctaaggtgtgtttagtgcacactaaaattaaaaatttagttaaaattggaatgatgtgacggaaaagttaaaagtttatgtgtgtagaaaaattttgatgtgatgaaaaagttgaaagtttaaaaataaagtttggaactaaacattctttaattacataagtagaatggaatgccgcaccacattctttaattgctatcgtgctaaacatttcattccgagttttacgataggccattatttaattctacgttctaatatgcttgtcaggttgatatacaacttttagttttggtctgagataatttcttttccatttccccattccttttgcagccgttccttgatcagtaaatatacctattctgctcattttgcccttgttggagttgagctcacgtatcttcacgtcccggctcagcggattgcctcctggcccaacacctgctccatccgccgctcctactctgggcccatgcttctggcctgacccatcgtgcaaagtgcgaacgggctatctcaggcttgccgatatacagcatcaattcagcccaaccataacacaactcccggactgcaaaatttgatgggccatactaccactacttccaattacaaatgtaggcccattcgcagattcgctattgatgcagatcgatcacattacgggcactagagagatccagttttgttatccgaatttcgtatcttgagctttgattccggaagataacaacaaaatcttctagattcacacggcgattagcgaagagattgggccttctagctttgacatcgcaacgtatggctacgagtcgacccaaaaaaatcttccatcatttattttcttagaggaaaaggccaaacaaaatttaaaagggaaaaaaaatctccaagcattaatgacgctttaaattactaccccttccgtgcctatccatccaaaatttcccgtttcgtttaaacttcgttgcgagctcgagcccgaacccgagctcaccgcacccgtcgcaccgcaccgcaccgcaccgaaccgcgcgcggcaggaggagaccaccgtcctttcctctccgcctcggcctcgctccctccggccccgaccgacggcgacccccgcgaccgccgcttcctccccgcccccgccgccgatctccgctccggctgctccaggcggcgaccttctccccctcgcgccactggggggatccaccccggagtactgagcatctgttccaggtaatccctaacccccactggcggcgggtttcagcgatcgaatcatcagtatgaccgcgagattccgcgtagttcctgcatgtttcggagtatcggagtaggtgttggatttggttccctgcgcgctgatgtgctaatgctgtagcctccgcttgtttccatctacagggaaggggagcggcggcggcggttttggtttggcgttggtgagttgattttgatggta

SEQ ID NO: 2399 - DNA, 683 bp, Oryza sativa
  misc_feature (45)..(45): n = any nucleotide
  misc_feature (67)..(67): n = any nucleotide
  misc_feature (88)..(88): n = any nucleotide
  misc_feature (150)..(150): n = any nucleotide
  misc_feature (158)..(158): n = any nucleotide
  misc_feature (199)..(199): n = any nucleotide
  misc_feature (203)..(203): n = any nucleotide
  misc_feature (218)..(218): n = any nucleotide
  misc_feature (343)..(343): n = any nucleotide
tccccatggtgagtagatattaaccatccccgttacctaataggngaattcactacggggaaacggngaaaagccccattgccatctntaatccccctcaaaaggagcacgaatctgcacggcccacacagccagccgctgccgcctgtngccgccancaccacaccaccgcctcgttgctgccgttaacaaaccaacnaccngaaaaaaaaaccatngggcctcgtcttttcctccatttcgtgcgtgagcgtgaccttggttgccgcgtacaccaccaccgcctcgcacttttccgccatttgtccgactccacccgcggcttatccctcctttttttttnctttttcccttgctctcctccgctgtttgcttccccgcctcgtcttctcggttttttccgtgcggtcgaagcatcggttccttataccatacctttgcccccgttcttgattcggttcttgccaacagctttgtaacttctcgggcgcctcattggagtttctttgtgagattcgcaagggggagaggaggagtcctttggtcaagcccctgtttctccatttctggttctctgtccgtgcagatttgctgaggaagtagttcttgggttcatcagggagcgagaggtgcgggatttgaaggggaagccgcggggcggccgggcctgggcgccggggccc

SEQ ID NO: 2400 - DNA, 2000 bp, Oryza sativa
aattttgttaagaggggtgagtttcgaatcgggatcggcgagcccatactttaagaggatatcttgaaataatttcaccgtaaccttaatttacgctaaaatccctaaacatatttatattcgtggacatggcgagtacatgccacgtttcttctgctagtaatttttcacataaatttttttttctcagcaagaaaggctggctatatactccagtgcagaaagagtgaaaaagactacaccaaacaagcatgaggcgtgtggaggcatgaaaacagtacgtacccagggcacagcagtgaaaacatcgatctcttcaccctgcatggtgtctccttaaaatctgatcgatcgactcccaaaaatataagtaaaatactcgagtcaaaatgcatcagtttgcatgcatagtgaaacagcagcaagctggtcttccacaggatactttttgacccattcctcctatacatgcatgtaattaatcacaaagttgcaaaaaatacaatactatgattgtgtatttgtgtgtactatatataaaacaaataaattaacctagtagtaactgatcagtatcgatcgagagtcaacaaaatatatgtagactacgacgatacgtgtgtgccttcctgttttcttttgttcttatctttgggccgcactatacgctgcatctatactaaacagtagtgaaaaatctacctctccaccactcaattattacgccggtctataataattcgttgtataaattacggggcaacagtgaattattcatgtgctcttgcgtgtaggattgccaaacaactgtttcatggtcagataaatgaaaaaaaagcgacaaattggtaacaataaggaaatgttaattaatttatgacatgtattactttcattaaaaatataatagtttctgactatacatgtatctcggaggtacataaccaaaaattcttagaggaagtataaaaaaaatgttttcttgttattggctaccgaggtctcccaaaaatccaatgttgtacaaatactatattacatgtcaatttgaaattgtgttaataagtaaaaaaggacactccaatttctccatatcctcaattgaggaaatataaaaacaaaatttgtttaaaaaaatgtttcagggaagtataaaaaatgttttattgttcttggctatgaggtctcccaaaaatccagtgttgtacaaacactatattacatgtcaatttgacattgtgttaataaataataagtcaaaaaaggacactctaatttctccatatcctcaattgagggaatatataaacaaaaattggaattgaaagttgaaaccatgcaccactagtctctctctctctctctctctctctctctccccttccatctctttctctcccctagcaattacactacgccttctccataaatgcgattgcaccctctcaacactccgcggcaataactccttcgcccccctctccacattctcttccacctgtgttccccttttcttctcctcttcttcttcctctcctcctcctgatcctgatcgagaagatctcaccttgatctcttgccgtgtgatctctagctctcgctagccctctgaaccttgcagtttgttgtttgcacccggtgaaacatcttcttttgtgcaggtaggagagacagcaaagcagagataagagttctatatttgcatgtagttcttgtcttggatctcaactggctggctgtctcctctctgcagcaaggttcgttgggctagcttgtgtgctagatctgtttctacttgcgtttgcgttgcttggcaagcaagatgatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtataatg

SEQ ID NO: 2401 - DNA, 2000 bp, Oryza sativa
cccctctctcacctccatcgcacgacggatccgacgacgtttgaccgcggatggatccgaccgcggtggtggcggtcgaggacggatccggcggcggcggttcccgccgacccctctcggctccctcccgcggtggatctaacggcggcggcggcatcggcggcgaccgcatgtgcatctgacagtggtccggtgcaacagcaaatccggcggctgctgctccccatccccggcgtggcgacgcgaccaggagcggcggtgggcttgggagccggtcgtggcggaaagcggcgatgccgacgacgacaatgacaacgacgatgacaacagcgacgacgaggcggctagggttagggtttggattttatttttgatttgggatgttgattttgtggggattgttgattttgatttgggattgcaattgagtgattttgtgattcatgtattttgggaattggggacaaaggtgttgggagcaatcgaccgatttgctcagggattttttttaaagacggatgactcagactcaaacaacaatgacggacgaagcacgtattttttttaagtaggtatatagattttacaagatatttttttgccaggtccgattttttattaagaagaaagggtgcctaaattacaattgtacaacaaacaaggttgttgcggcttcgacactaaacgctttctaatgatagccaggctacagcttcttaattttgcctcgtcaattttctccatccactcatctttgacaagattgacgacagtttccttgacctagaagcaaaacgaacttgtaaaacgaacttgtaagaccaatttgactgggatctttaatcttaaaagctggatgggcatgttcttgcaatcccgtgtccgatgtgatctctgacgataaaaggaagggtgtgtttagttcacctccaactaccctaaattttcaactttccatcacatcacatccaaaactttcctacacacataggctgtgtttagttcacaatgaagtttggaagtttggttaaaattggaactgtcgaggggtgatccactctagcgggagattcgtgagacccccctttcgtgagttcggccgggggaagaagctcgcctatagaaatcacgtatccgtccccaaggctcctagctagctcgtacacaaccaaattatacaggtttgggccgctatcaagcgtaataccctactcctgtgtatgggatttagactgagagttacaagggttcctgatctcgggagaacacttttacttccctcctccacaagctcaggttttctgagagtcgtccactttctcggtgtgcaaggtcctccttttatacctcaaggggataccgcatgcaccgcctctacctactcttctataaggtggggacccaccttatctggactggaactcgacccgtgccttcgcctggaagctaaaccacagcttatccttgagcggggcccagcgccgtccctcgcctgaaacgggggacagccctgtcattccctcattaataggtgaagacttgtggtggccgccgtccgaatgaccccccgatgggacgggtcatacctacctccactccgccggaagcagatgcgacgtgggagcacggttgtccgtccagtcagacgtgaccggcgtcaggccggtcatagacaggtcattcttgaccatcgcgcgtcagtttaacacgccgcacgtctaccccactacattaaatgcaacagggggcagttggggcgctgcgcgcattaaaggaagtttctccacggtaatccgcacaccaagcccctcgtcgtttctccgctggtcatcatggctcaagatgccggcgacgcagtgcttccggcatcgcgcattacggcggataggcaccttagtctcccccacaagatcaagccggaagatgccgccgtgagaacgggggagtcgcggccgcggccgcggtacccggagcgatccatgcacctcctgtcctttgct

SEQ ID NO: 2402 - DNA, 2000 bp, Oryza sativa
  misc_feature (158)..(158): n = any nucleotide
  misc_feature (945)..(945): n = any nucleotide
  misc_feature (947)..(947): n = any nucleotide
  misc_feature (950)..(951): n = any nucleotide
  misc_feature (1130)..(1130): n = any nucleotide
  misc_feature (1132)..(1132): n = any nucleotide
  misc_feature (1139)..(1139): n = any nucleotide
  misc_feature (1157)..(1157): n = any nucleotide
  misc_feature (1170)..(1170): n = any nucleotide
  misc_feature (1195)..(1195): n = any nucleotide
  misc_feature (1253)..(1253): n = any nucleotide
  misc_feature (1257)..(1257): n = any nucleotide
  misc_feature (1308)..(1308): n = any nucleotide
  misc_feature (1311)..(1311): n = any nucleotide
  misc_feature (1317)..(1317): n = any nucleotide
  misc_feature (1322)..(1323): n = any nucleotide
  misc_feature (1334)..(1334): n = any nucleotide
  misc_feature (1355)..(1355): n = any nucleotide
  misc_feature (1400)..(1400): n = any nucleotide
  misc_feature (1424)..(1424): n = any nucleotide
  misc_feature (1433)..(1435): n = any nucleotide
  misc_feature (1438)..(1440): n = any nucleotide
  misc_feature (1442)..(1443): n = any nucleotide
  misc_feature (1445)..(1447): n = any nucleotide
  misc_feature (1449)..(1453): n = any nucleotide
  misc_feature (1455)..(1456): n = any nucleotide
  misc_feature (1458)..(1458): n = any nucleotide
  misc_feature (1460)..(1461): n = any nucleotide
  misc_feature (1464)..(1465): n = any nucleotide
  misc_feature (1467)..(1468): n = any nucleotide
  misc_feature (1471)..(1471): n = any nucleotide
  misc_feature (1473)..(1476): n = any nucleotide
  misc_feature (1478)..(1478): n = any nucleotide
  misc_feature (1480)..(1480): n = any nucleotide
  misc_feature (1482)..(1483): n = any nucleotide
  misc_feature (1485)..(1486): n = any nucleotide
  misc_feature (1488)..(1488): n = any nucleotide
  misc_feature (1490)..(1490): n = any nucleotide
  misc_feature (1492)..(1496): n = any nucleotide
  misc_feature (1498)..(1503): n = any nucleotide
  misc_feature (1505)..(1506): n = any nucleotide
  misc_feature (1511)..(1515): n = any nucleotide
  misc_feature (1518)..(1520): n = any nucleotide
  misc_feature (1523)..(1528): n = any nucleotide
  misc_feature (1531)..(1532): n = any nucleotide
  misc_feature (1535)..(1536): n = any nucleotide
  misc_feature (1538)..(1544): n = any nucleotide
  misc_feature (1547)..(1552): n = any nucleotide
  misc_feature (1555)..(1555): n = any nucleotide
  misc_feature (1560)..(1568): n = any nucleotide
  misc_feature (1570)..(1572): n = any nucleotide
  misc_feature (1574)..(1575): n = any nucleotide
  misc_feature (1577)..(1578): n = any nucleotide
  misc_feature (1580)..(1580): n = any nucleotide
  misc_feature (1583)..(1585): n = any nucleotide
  misc_feature (1588)..(1588): n = any nucleotide
  misc_feature (1590)..(1590): n = any nucleotide
  misc_feature (1592)..(1592): n = any nucleotide
  misc_feature (1594)..(1594): n = any nucleotide
  misc_feature (1596)..(1596): n = any nucleotide
  misc_feature (1602)..(1603): n = any nucleotide
  misc_feature (1605)..(1607): n = any nucleotide
  misc_feature (1609)..(1609): n = any nucleotide
  misc_feature (1611)..(1612): n = any nucleotide
  misc_feature (1614)..(1615): n = any nucleotide
  misc_feature (1618)..(1619): n = any nucleotide
  misc_feature (1622)..(1622): n = any nucleotide
  misc_feature (1624)..(1624): n = any nucleotide
  misc_feature (1626)..(1627): n = any nucleotide
  misc_feature (1630)..(1630): n = any nucleotide
  misc_feature (1634)..(1634): n = any nucleotide
  misc_feature (1636)..(1636): n = any nucleotide
  misc_feature (1638)..(1639): n = any nucleotide
  misc_feature (1641)..(1642): n = any nucleotide
  misc_feature (1644)..(1648): n = any nucleotide
  misc_feature (1650)..(1651): n = any nucleotide
  misc_feature (1653)..(1657): n = any nucleotide
  misc_feature (1659)..(1670): n = any nucleotide
  misc_feature (1673)..(1673): n = any nucleotide
  misc_feature (1675)..(1676): n = any nucleotide
  misc_feature (1678)..(1680): n = any nucleotide
  misc_feature (1684)..(1684): n = any nucleotide
  misc_feature (1686)..(1686): n = any nucleotide
  misc_feature (1689)..(1693): n = any nucleotide
  misc_feature (1696)..(1696): n = any nucleotide
  misc_feature (1698)..(1698): n = any nucleotide
  misc_feature (1700)..(1700): n = any nucleotide
ccgtgccaaccacaagccagcgtggcgcaacggctttaccttttgtatagccatggttcattgcggagcaccagactgagaagtggcggagataagcccacgggggtcgctggggagtccatgccttgtttataagggggtgattatgatccaggaanggtgcactgtggtggattgtgttgtgcgaggggtactgtcacagctcctttccgaggtaccgtggtggtattaaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgtttagctcctggtttggaatggtatattcctggtttggagatagaactgtgcagccaggattggttgtacagaatggttgggcctatgcaacagggtatgttgtatagcgttggattaatattgtttaaattactacttaactattttattaaattctgaaatgtttattaaatgctgtttatgcaaatgaaaccctactatgccatcctttgttatcctgagcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgattatttattagagtaataattgtactctattatcaatttgttattgtgtgcctcggctgattcctggacgagggttcacacacangnaanngtgttggaattttggatagaaattccgggcgtgacacaactgttgtcgaaatgacaactgcatacgtcgaaagacgtggttactcaacagtggttggaaggaaacgaagtgtattgaatcttgaatttcttcctttttctcctcctcccattacatggccctaggggactatttatagncncattacnggttcttactactagggnttaggttatacangggaatttacatgattacccttacnaaagggacatttacaggggtacataatgttataggggctcatgggcccctgatgggcngtcnggcgatcgccggccctatagcccctaggcttgatgggccggaaaggcttcntcngccctngcggnngcgaacttgcnatggcgaagtcgtcttccttnggcagatagtcttcgccttgcacccttcgcctgagacgcctctgncctggcaagtcactcgtacgactnttcgcctcnnnccnnncnngnnncnnnnncnncncnncgnntnncgncnnnntngntnnanngncntnnnnncnnnnnncnncagannnnntcnnnggnnnnnntgnnatnngnnnnnnngcnnnnnncgngcaannnnnnnnntnnngnntnngncgnnnccntncnancnatgctnntnnngnanncnncannatncntnngantgangntnntnncnnnnncnncnnnnntnnnnnnnnnnnnctncnncnnntggngnttnnnnnttntntnttcccgggccgaacggaacagtattgggctttcccttcgtgggctttttactgtgccgctcggacggtgggaatttaccgtttcgcctaccctttgcgacacgtggcgctttattactggtgggtaggcgaacggtcgcccgggtgagctatatattcccaccgctctttccttttcaccgccacacttgccattttaccgcgtgcgttctcttcctccatttctttcttccatagcatctcttgacccctcaagcgtttcggccattttctttcttcgccatcgcaaacgcactgttcg

SEQ ID NO: 2403 - DNA, 2000 bp, Oryza sativa
gtaagaaaggaaaagaaattgaggtattgatcttctcgagacggctattgtgttcatttcacttcagtggcatgttaatgttttagttggttccatgggacaatcctttttttatgttgatagtcggtactggattataaagggcaaggtatgcatttgcatgaattctgagagaagctatggacttcatgagagaagctatggatcaacatatatagtttaaacaaaacttaaaagagcctgggagtacctgttgaatttttttttgagggaaactacggcagacgtttgacgccggcctgaactttattgatagttgtttgtaaaacaatgtacaaagaagggaattacaaaggggataagaaaagcactaaagcgggtttttttttgaaaggaaagcggcaagagtattgcctaatatattagaggaagagaaattaaaagtaaacactaaagcggttttgaactagggattttgtattacaagaagattatcaacccacgaaattaggtgaggtttgaggcgaagggggcatctgtgagaccagaggaggagctcgttgatgcagcactgtcggagacagcgatcgaattcgtccgtgttgttgaaggctttgttgttttggcatttccaaatgttccaagtgatcgcaaggagaattgtgtgccaaatccgttgaattttgaacatgcaggtaatgaaaaaatataagttgaagtaaagtggaatttattggttggaaaaaccagcatgatggaatcatgtaatccatctcgtgtatttgcttgtagtagcaaattatttagttaagccaagttcaatgtctttctgcatattggcaaaggttgtaattgatgatcatctttgatagattggctggggtcagttactctctgctacctgtcatttcgttggagaatggactacatggtgcatggtttgcaagtgtcagtctacagcaaattaagttttagtcccgttgcagtttcatggtacttattcagcgtgtaatatccctgaagacaagctaagagaatggagttccagttagattaggatatatacatggacatcttctgaggtaatgaatcattgcatggtataagttttttcccatttaaattgttcccttttaaaactattttcttatacttgattgaaattgaagctttgagaatatttgtatgagaatcggaggagctgtttagcagcaacctatgagtaacatcagatgattataagttttttttaaaaatgcaacattataaacactttctcaactggagtaataattattgtcatgacactgcagacatgaacagcatggtatttgccttggtatcttacccttttttttatccttgtttgggggcctttttattttagtgcttaaaagtagtaatcgagcaatcatgcaacacatattgtatgtcttagtccctttctagtaagaggcagtgcaacacctaacacttcatttaactaaatggacctccacattacaatttttcattaatacataagccaagttggtttgtttgtcctatactcacctgtattttttctcgttcatgccttgtaattagtatggtttccatttttcaatccatttaagtttagtatggtctcaaagttgtccttttaaccagaatatttaatggttactatatgattggggctcaatgtgtgacctctttacagcccaacttatccatatcgtactgtgattcatcttatgtgtattagtatattccaatgtttctagaacatagtcataactattccaatggtacgcaaggaatgagttcacatgcactatgatctcctaaaatagtagctaacctaggacaacttgtgcaagattgcataatttggattgcatatgtcgtgatctcgatcttctggtgctgcctaccatcctatgtatactaattgcactctcttcagggaaccaactatatctaacacttgtcttgattggaggagcaatctaggcaaa

SEQ ID NO: 2404 - DNA, 2000 bp, Oryza sativa
  misc_feature (117)..(117): n = any nucleotide
  misc_feature (435)..(435): n = any nucleotide
  misc_feature (563)..(563): n = any nucleotide
  misc_feature (1116)..(1116): n = any nucleotide
tggcggaggaccgcccaccagcatctaggcgctgccgtgcagtcatgaccaatttggccacatcgtccagccaacgttgggctggagactccgggtcatgggcgacgggcgggtgangtaggagcgcgcccgcagcttggagcgcgccctggggcgtgctgccgtcgccgtagacgaggaggcgacgctccccatctcgccgcccttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcanaaaatccctcgcagagccccctacctggcgcgccagatgacggagcgtggggctcctcaccgggagaccgcgcaggcccccctttgccggttcggccggggactcagggagagattctaagctctctntatgtggaaggctcgcgagacaggaaacacacaagacacgggtgatgtatacaggttcgggccgctgagaagcgtaataccctactcctgtgttttgggagatctgtgtatgaaggagctacaaagtatcagccagcctctcccttgttctgggtttctaatctggaaaagtctagtcccccctctcagtggacaaggtcctccttttatatcttaaggggataccacatgcaccatttctctctttttttgtggggacttacccccccccctttttcataaatggacggagatttgtatagttgccgtccgagtcaccttctgatgagacggcccacaactacctccactttcgccgggagcaggtgcgacgtggaatcgtggctgtctactaacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctnggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgagccccactgtgctcacctaacccatacacgcggagcaaaaacccacgaggggtcggggcgcctcggccctcggggccgaggggggttcggcccgaccccctcggggggactaagaggagggcgaacgcatcaccctcgggcccgacgtccctcgggggtaccaggctacgtgtgcgattgtgtctgcctcaaacctctagtcatgatactcctgatcccatgtcaccgacaaatatggttacgacggtattgtaagagcaggcacaatagcatactataaaccaactataaacacacatcgagaagaacaaatttgtagccagctgcagcacaaatacaagacacaatgtttgtctgataagtgggaccaggtattactagtgtggtacatatttataaacaactattgtataaattgactgttaaattaactatagatgatttgaatctagtactattaaacttgctctaaacctctttgctcattacctgggtaagaagttaggtccccatcgtttggttttttatggaataaaaataaatttataggtaaaacttttatatagatgttcttggtggcttaaaaatcaatgttgaaaaagaaactatattgaaaatatcacaaaatcaaaaatttaaattttggctttttcttttactgattaggccatc

SEQ ID NO: 2405 - DNA, 2000 bp, Oryza sativa
tcctctcatgtcgcgcgcacggctctctcgcgcttctctcggtcccaggtatgcttccactccctcgtttctttatgcattgtggatgcagtgtatggatgaattagatgtatggatgcagtggatgttttttgcattgtatagttggaagaattagatattgccatgcagtggatgaattttgcatgatttttgggggaaatgccatgttgggatgcagtgggctgtgatggaattaatttgtgatttttgggggaaatgccatgttgggatgcagtgggttgtgatggatgtatttgtgatgaatggccaatgatgattgctcaagaaccacagaccctatacacttgtgattttttgggttttttcaataagaacagaccatctacacttgttcattttatttgggggggaattgcagtatgggatgttttgcaaaatggatgcatttttggccggcctcactcttgttcttgtttaggtttacatgtgggtttttaatgcataagaacagaccatatacacttttgatttttgggttttttcaataagaacagaccatctacatttgttcattttatttggaggggagtggcagtatgagatcgttttactgttgcatagacagactctagacttgttcttatatggttctttgcaaaatttttgggatatttttggtccaatgggatggatgaattgatgtgggctgtgatggttgaattattatggctgtttttatatggttgtttcttttttgcataaggacagaccctctacacttgttcttaatttcttttgggggtgggggcagttgcaaatgatggtaattgatgcataatttctgagcaaaactgaggccaaacttattatatgttatgacttgtgtttttttaggtacaaaaataatatatatgtgacttgtgtagtatgggctgttttgggtcattttgagggaattgagatggatatgcatagaaatctgttattaaatgaagttactgaaattatggcatttaggagaatatgaagtgtcccggttgccaaatctggtttggtcgggttactgcctgcacggtaccgaccaagacaaattggtaaacagaacatttcgttcaaatacaacatttctagaaatctgttatcgttaccaatatcctagattgttttcaaggtcatttctttatggaaccccattcccataaatttattatccaaagatggttgctgtatctatgggaataagggttccataatgaaatgatcttggacgcaatctaggagtttgctgatgataacgttagggatcttggataggaagggttttggttgccctgtgtgttctatctgcgtctgcctcgtcagcagatatgtagcatccatattccttagggccggagcagacgggatctcgacctcgacatccatatcccactagaacttgctaccgttgccactatcttatggtagtgacattgatagcaagttcgagtggaatactgatgtcgaggtcgagttcccgggtgctccggccctattgagcatggatgctatggttccgtcgacgaggcgtacgcaggtaggagatagaggtatatcaaaccaacagagaatgtgtgtagatgcaattttgtgtttaaaaagtactttctccccgtacaacagtgacataggacatgtcgcagcaaggcgaaccgatgtcgacgaccactaataggactacatcaagccggaatcctaggacccagaataagattcctaaggaagtctacaccataacagaggtggacgatgttggatatccgatggctccgacgaaagctgtcaaaaagttccctacgatatgcggagtcctagggaggcggaacttcactattctgaaggaccacgttgatctggtccctcaagaagaaaaagaagaggcctggaagcagttcaaggaaagcttccgataccctacagaggccgaggctggactcaagcggcaggctatccgcaag

SEQ ID NO: 2406 - DNA, 2000 bp, Oryza sativa
  misc_feature (1170)..(1170): n = any nucleotide
  misc_feature (1206)..(1206): n = any nucleotide
  misc_feature (1232)..(1233): n = any nucleotide
  misc_feature (1235)..(1235): n = any nucleotide
  misc_feature (1250)..(1250): n = any nucleotide
  misc_feature (1289)..(1289): n = any nucleotide
  misc_feature (1291)..(1291): n = any nucleotide
  misc_feature (1330)..(1330): n = any nucleotide
  misc_feature (1681)..(1681): n = any nucleotide
gctcacttgtcagcacaaagtggtgttcatagtggctagccttcatcacaagtgcatttcacatttggcttcttttttcagcttagtgattattagttggccagtcagtctgtgaaatttatgtggagaaacggctatgtggtgtgtttttatcatgacttatactataataactatgttagttcaggtataaccggttatcctgataatatagtatgcttggtaaaattctcgttaatcatcgaaattctcttggctctttaatctttttcgtgacggtgtttatcaagcttgcaaagttgcaatgccagcatcttatgagatttcagcagaatgttgctgtttggaaaggtagttgttttagttttgcagttttgtgaagatgggaaaaattcatgtgtccggttaagacctgagctgcgtatattgaaattgcagatttctgaagagaagcttttgaactacagcctgaactgattactgaaccaaattctccatatttcgggacgaagaaaccttaaattttggaggaatttcgaccgaatttgaataaattctggcaaattttggacgaaatagctccgtacagtgtactacctcagtttcatatcatagatcgttttgatttttttaatcgaactttttaagtttaatcaaacttatagaaaaatatagcaatatttctaacactctcaaaatatattcaatattatatttattgaaactaattcggtgtcataaatattactaaatcttttttcaaatttggtcaaagtagatatgaaacggagggaggaaatttcgaacccaagttggaaaccctgctcatatgggcccaaatttcagaccgtcgattcggaaataaacgggccggataagatgattttggctgccgaacacgatcaaagttaaattaaataaaaaaaagaaaaaaacaaaaacaaaaacaaaacaatccgcaacttgcagattgcagaagcttctccaaccttcgattctcttctccaccttcttcttcttcttcttgccccttctccaagcatcgccacccttcgccgccgccgccctaaaatcgccgcgagagcgcgcgcgcttctcccacccggcgaccctgagagtccgaggcgccattgaacccctgacccccccacccgctcgccacgatgtcangcgccaccgccgtgtccaggctcgcgcgcgccgccngcgccgcggcggcggcgcggggccannangttggcggccggganccgctcggggccctcgggtcgctcgctggaaacgcttcngnttccgctggtggtggggcgaggaggcccgcgtggttcgngccgcccatgggccggctcggtggaggcgggctgctggttccgccgccgccgccgcagcggaggctgttccaccccacgcaggcggcgaggtacagcacctcgtcgtcgtctcaggtctgggttcgcttctctacgcccgtgcaattatttttctcttgtcagttggttgctatagtggtggtgaattcaatctcgcggatgctgtacatgtgtcggcaatgaggctattgtgaatgaaactgttagtttagttgcgaatttgcgatacatgtttgataatctactgcattaattggatactacggtttacatgtgtaatgttctgctatgctcagtgatcatgttgcagntgcatatgcaaaagtgtttagtttcaggcaatttaggatgtgcaatgtgtcagtgtttaacaatttcatgcctagaaaaccttgaaggaaagcagttgctgatcattctataggtttggtgaaaactgagaacagctatgtatcagatttgataaaacttggtgattactatgaaaactgagaacatatggtttgcagtttgtggatatatagtcatatatagacaatatgggaaagttccctcttgccaacaacagctgactaatagatgggtaatttttttcggcgaccaaacagataactccaggagaatttactg

SEQ ID NO: 2407 - DNA, 1303 bp, Oryza sativa
  misc_feature (14)..(14): n = any nucleotide
  misc_feature (166)..(166): n = any nucleotide
ggttaaaaaactgnaatatagacatagttttagcctagcttaaaacttgtcaaatttaaacatacaaaatttaaaaagtgccttctctaaagattcataactaggacatgtaagttttttttttaaaaaaaaaaaagactatacatgcggttacatgtaattaatngaaaaaaaaccaaagatttaattgaaagtcatcagtctttgggaccaaatgaaaacccattgcagacgcaatgggcaaacagactaaattaacttcgatccttagatccctctgccttgggtaattaaacttgggtcaattcagtcaagactatatgagcatgatgatgttactacagattgtttaagaggtcaatatccctgtcaaagatgctgtcacaatttaatttggtagcacagacaacacttgtgataactagcctacacatcaggttccttgaatcctaggcaagcttcaacagtcataactaagaaatatttgttcatacactcaacatagcattcattaatcatgttcttatttggtaggcctgaggtcgaagaagccgtccacaacagcattaataataaaacttttattgctgttcattatttgcccttcttttaataaatgaatgggaaaattctcctattttgagttcagccctttgcttacgataccagcctttctcaatcaaatggctcaaaattaataacagtttcaaggaggccccctgatgcaagtgcctagactggtctgaaaaagatgcagagatgaaaaggagagaggcagctaattttaagtagtagaaagtgttccttttgcaacaggttctttatttttttattttataaggcaattaactactgagggagcaatacatcattgaatgaaaacaaacttgaaaaataagagcaagcatgcagtacaatttattcagaaaatccagttcgagaatggttaaaaaaaatgtgagtgacaggaaacattaaaggcaataacctgaatttcccctgaaattattagtactctattaattttggacgctctgcaacctgtagataattattcttgttcagacttcagaggatcctttaggagaccctgtccaaacaaatttcgttttcagtatacctaattacttgtcccagatcataacacctatgggaaaaagcagatagtagacgactcccataaaaccaagccatacctacggcctaggcaaatgcaaaatataaagtgccaaatggagagcaagattcagtactagtgaagcttttcttgcattttcattgggtcactgaagctcatgctgcc

SEQ ID NO: 2408 - DNA, 2000 bp, Oryza sativa
ttttaaaatcaaacatgagtattattggttttttttacttttacctctaaaaattggacctatagtttttagagtttattgtctcgttggatttcattttttataacttttacaaatcctgtcaaacgctgcactatactcctctacgacccgtccgccgcttactctttattgccattaagattgtaaaaatcgaatataactattgtttgaatttatttttttactttctaaaagtcccaccaaccatcggcggctctgccattgtactcatgtatgactcgcccattgcctctcatttttattgtcattgagattttaaaaatcaaatatgattatcattggattttttttttgctttctagaagtcccgccgaccgccataaccgattgcttgactatctgcccgtcgtcattccttttaattgtcattattattctattttgtgttttattaatagtatttagatgtcccatcaaccaccaccattctactccattatagccctgttacttaattaatttcgtcatgtgttttaaatggccttttctttcagtagtatttatttttttattaccaaatttagttatttataaattgtgttcctacttgaaatcttatttttctttttctaatttcagaatttattatattttttgttttgaattttaactaatattgcattgtgttattttttattttcaatgtcagttgtttcaaaattgtattcctacttgaactctctttttaatttgtctaattttggattttattttattttttattccaaattttaattaattttatattgggttcttatatgtactcttatttcaatattgcttaattttaattccgcattttagttatttttaaattgtatttgtcgacgggtgatacccgtagaccggatatagagggtattggggtacgttggtacaaggatctacgtagtacaacatcaagcaaacagaagacaaagattgtactggttcagaccccttgataggtaatagccctaatccagttgatgtgggattatatgatggaaaaacacagattacaaagggaacggtggaactcaagggatccggcgagatcgtagtcgagttggttcgactagatccctggcggtttggctcctgcaggctctggcttcgtaggctgtgggggttgtgttggctctgagattcgatgccttaggtcctccccaggggtcccttttatatcacaggtcaggcggtttccaagtcgaacttggagacatcagaccctacacgatacattgacgacctagtcttgttcgagtaggactcttttcgtccgtaaactccgtgaaggatttccttaatatatgcagagggtatccgtatgcgcgtgggtatgccataccgatatgcgacgtatatcgaagggtaaagggtatacctaacccgtaaccctgacagtagcccccgacttctgcttaaatgaactcgtgtaaccattcgcgacttcttgtgtcgagactgttgtcgttcccagtgtgaggaccgtagagacatgacgtagtcgagaacaccatgtgaagcccaatggtcacgattgaatttaaactgaagtctaaaaaactgccgcgcgtaacagacccagaaatttccggcgggcatctctctcctttccttggaattcacaccgtcggtagtgtgtctatttaaaggaattttggggatccattttgaagtccgcctattgtgaagaaaacatcccgcctgcaagcgttcttcgtcttctccgctcccacaagaaaccctagctcgtcttaggtcgcatggttacgatcgaggactacattctctgcggttttctccctacaccttccgaatttcttctcttggtattgaacttctatggtctttctccggcgatctccgatcggtgatggatcttggcaaatcatcctccaccagcgcgtcgctgaagaagcttcaggaagacggcgcccttcccggtcgtggaa

SEQ ID NO: 2409 - DNA, 2000 bp, Oryza sativa
  misc_feature (215)..(215): n = any nucleotide
  misc_feature (1400)..(1400): n = any nucleotide
tggacgatatgcatgttggcggcttgcctctttttttgttgttgttgttgtgtttgttcatgatgatcgatcagtggctgtctgcgtcacagtcactactgatgctccctccatttgacaaccaatgcaaagaatccagaagcatgatcgatcagctgttactgctttatgaaaaaggaagaggggatcgatcgctttcttgctttcattttttnccttcctttctttctttctttctgttagttccattcaagtatgaatgattgcttcgttcaagatgttttattacccgtgtctcttgagagtgttagtggctctagctaattaattcccactactgagtgctaataactcccgctaaagctaagctaagctaagctagctgcatctttgtgcatatactgtctgcgtctcctattgttggcaacgtcgtaattaactttagcatcttatgatggtgcctgtctgcctgctcgaaatcgaaacggatggatggcaaattggcaatatggcatggctaagcaagctagcttgatgcagcagcaagaaagcaataattacttatttaaggtggttggatatcctcctatattcttatcgtgcttggatctgctctcagaatatccaacctagctagcctgcaagcaagagagtgtagctactcgatccgatccaatgtctctcatcacggatgagtctcctagggattgctcctcctacaagcatcagcatcatcatcgcgccatccatggtcgccgaattagccgccgcactctggtggtggcgtcctcagcggtggtgtctctggcatcgctgtcgctcatcctgtggctcgtcctccgcccatcccccccgcgcttctcgctgctcgccgccaccaccaccgccaacgactctgcctctgtcgtcgccatcaacgccgccttcgccgcccgcaaccccaactcccacaccgccgttctctacgaccgcctccaggctagcgcctcctacgccgggctccctctcaccgccccctcgccgctgatcccgcccttcttgccgcagcagggccagggcgacgccatgctctccgcgtcgctcacgtcgccaccggcagcggctgctgtggcgggagggcgggcgctgctgaggctgcgcgtggaggggcagctccgctggaaggtggcggcgtgggtcaccggacgccacgcgctcaccgtcgactgcatcgccgttgtggagctgcagccgacgccgacgccgtcgccgagcgcgatcgtcggcgtcctccagccccaagatcaggccggctcccgctgctccaccaccgtcgcctaataatataatatccatcaaaaccaacaccacaaaccatgcaaactgatcgatggatgcatggaggaacagtcctagttctngtacatgtacatgtattctctctcgcgttatgtatgtatatgtcctgtaccgcgcgcggtaaacaagtaataaatcaaagcaatctgaatcgtacaacgtatttcatgtgttgctttgatttttttggctttcagctgtggtgctctgtgtcccaaaagtaggagtgccgtacttgcattttggttttaatttcttttgttcaccacaggtctggtctggtcactctcactcactctaattaaatcgattttttattattactccagttcattcggtgtgtgaatgtgaatctgcctgtgttgtgtatgcgactatgtgcttatgaaatttcctggagtacacttaagggcggccgattttcgtcgtcataaggaacggcgcaaaggaaatttcggcccatacatatggcccatccataggccatctcagtgtctaggccagtccagtccagtccagtccaggacggtccagtccggtcccgtagagcgccggcgcgtgtagcttcctcctccgctccaggctccagcgagggagggagggagaccaccgtctccgccggctttgagagagaaagagaaagagagagagagagagcggcg

SEQ ID NO: 2410 - DNA, 2000 bp, Oryza sativa
  misc_feature (1913)..(1913): n = any nucleotide
aatcgctcattcaccctctctctctctctccccttctctcttccaacttattttgcagcctgctgatatcttactgtacatgctctaatacgaagtacttcgtctgctccaacagttttcagttaatccctcgtccttttttaatgctcacgcaatcgtttcgagatcccacaccgggcattgatcttagctccagttccatactcctacatccatacttcttgttccatggatcttagacagggacagcactctctacctttccctagcagtaggctagtacagctaggatctcgtttccgcgcgatcaatgcttctcactgattggacaatgattgccacatcacttgatcaacaaagcatgctggctggctggatgcacgaaaccagatccatgctttccatcacgttacacagtgcccctacgtcccaacaaacgcagccaagaacacacacatcaaaaaaagcattaatcgatccatccatccggcaataaactccaagagatcttcgatacggttgcacgcctatatactctataataaaactgtcgtttatcgcacaaaacgacggtggatgtgcacatctaccaccgattcgtaaatcctaaaccgcgttttaggaggatgcagacgacgaagattatcatcggttgttgatcgcactcaacagaatccatttcggttctgcaatacaatatacgcagcggttgaaggagccccaccatgtaaccatgttcatacagaaggtcagcgtctccacggccgtagtgttggcggatgaccaaggtccaaatgacccccaatctttagtcgtttcggattctttttggcagccaatctccggggtctgatctgtattgtatctgtgctttaagccatcctgtattacgcgtcaagaagccagacaaaaagctctcttcctgcccaaaaggtgacacaaaaaatgaaccaactattgtctactgcgggacttccatttgcaagtgaaagttttgatctaaaaaaaagtttggtgcctaggtagtagttagattcacataagggaatatatccagcaatggtgacaacttgtacgtggtgtgtacagctgatcactgcaggagaattgagaccactctgtcgtagctttgcgtttttttgtgcgtgtctgattatcagtcgttgttcccgttggcttaagcgagccttaattctgtggtacagcaaagataggtaagttggtgattcaatattactgataaataaagccttttgcaaccatcgatggttgacacaccgctacgataattacgccatgatggcatctacaggccaccgaatctgtcgacggttacggttccaggacctggtcgtacgtccgttgtttactctgtcgtgtggcatcgcaaaaaagaaaacggaaactctgcatccagctttgtgatgtcaacatgatcctaccttcagctaacctgaattaaagattcttgatcaccgtttacaggtaaggagtagctccagctaacacctgtgttcgtgaaaacgaccggtaatacgcagatggtaaaacacactgttagccttgttgcaaatctaagtcagctacagttctgtgcaaatcttctcaggcactattgttgtacttctggttgttatgctatcaaaatcgcaacatcaacactagtacgtactgtacgtaggagggagggattcaggatcaacgcccggcaaggcaaagctttgtcaacgtgcatctctcgatctgagccgttggaaatgtaatcggacgtacgagatcgcgccgggatctcgtagcgcggttgcgaacttgcgatgtcatttgtggcatcctccgttttttctccttgtccgtaaacaaaagcaatggaaagtctcctttccaaattccaatattctgcttcgcttgtttgnttcttccctcctttcctcttctgcttctcctcctcctcccaccgccgcatggtgtgatcagccaagaaaaaccatccatccacgcag

SEQ ID NO: 2411 - DNA, 2000 bp, Oryza sativa
cgggcgggtgcgggggcgcgcgcgcttctcccagttcccatccaaaaaaagaagggatccttttcatttcattttggtagcgtggcgtggcgtgtggggtccggttggcagtgagtgcggggcgggggacgcgttcacaccaagccacggcagctgacgcgtggggtccatcatcgtctccctccggcgatccacagatagatagagacgcctgggctggggctggggggctacaaatagcaaggacgagtgaagaggaggagaccaccccactccgctgtcgggttgggttttgagatcgaaaatttttgagatttcaaaacctcctccattccctcccttcctcgcccccaaaaaccctagccgccgccgccgccatgcctgatctcccctgcgacggcgatggcgtctgcatggtctgccgcgtcgcctcccctcccgaggtcgatctcctccgttgctccacctgcgccaccccgtggcactccccctgcctctccaagccccccgcccttgccgacgccgcccaatggagttgccccgactgctccggggactccaccgacgccccgcccccggccccggcaccgctcgcccctgggagtgccggccaactcgtcgccgccatccgcgccatcgagtgcgacgccaccctctccgaccaggaaaaggcacgccgccgccaggagcttctcggcggcgccgcgcccgccggtgccgacgccgatgatgacgagggggacgacgtcctcgaggtcatcggcaagaacttcagctgcgccttctgcatgaagctgcccgaacgccccgtcaccgtcagtactcttgcggggcctttcccccattcttcctcttactacttgctttgcttatatgtacgatgatttatcttaacgctagggtgatgatgggggctatcctatcccctctcttcacacatttatattcattacttacattagagttgtatcatccctgattatccgtcaatcttattttgagttgacgctgccatttattcttttctgttggttcaatttgcatttcctgttatcgtttaaggtttctaactagttgaaatgaccatgtaccatttctacatgatattgtttgcttttgctactcatttcttatatttcttatttacgctaccatttgaattccaataacggaacaagtcttctaaaaaggcacccacataacctgcttaggtgctaggcttacatcctcccaccagaccactcttaactgattatcatgaaccagatcatcgatgttacgcacctcgtagagtgatgcttacatttctttatttctattaattgagactgcaatgcttgttacaattcaagtttaacttgttgaacacatcgattgcatgccctttctagatgataattgtttgctttggtaatgccaactggtatgtcactcctaattttcaccacatgcacacatttactatgcctagatatgtttgttttagctcataccaaatccaccgtacaattctgataatgcaaacagtattctaaaaaggcaatccacgtaacctgcctaggctctaggattaggcttacaccgtcctgccttgccagcctagctcattacatcacccaagcggctgcctaatcagtcactagacatttgtatgtggtacagctagcttctattgccatcacatgcttgttcttctggattgatgcaataccttgcattgttaaaagtgctgtcttgttcttttggggtattggtttaaccttccagtttctgcacataattcttattttgatccatgcattgtaggtaggtaaaagttcttgctattctgtcaattcattggacccttttttttttgggtagcgtttctaaccatcagattctacttttgtcttgggcagacaccatgtggccataacttttgcttgaagtgcttccagaaatggatccacagcggaaaaaggacatgtggtaaatgccgggcacaaataccagcaaaa

SEQ ID NO: 2412 - DNA, 2000 bp, Oryza sativa
ttcgatcgatcttatcatgcccagattcttccctgctcttgcatagtgttcctggcatattcgcgttgtgctcctcatgatggatctcctcaccttttgacggctttgttacctaaattattcatcagagcgtgagctaatgcgtcggccgcgttggacactttggcaaaattacctgataataactgtgggttggtttggtttgtgatctaaatagaccttaccaaattttgtcaatgccaaattttggcatgactaattttggtaaggtaaagttatatttggattgaagccaaaatagtctaagttcactattgaaacggcctattttcttatgcatgccaaaatttgtcttcaaaccaaatagacactaaacactattgaaattgacaaatattggtaagcctaatttagacctcaaaccaaatcagccctgtattaaaaaaaagatttgaaggaagagatatccctccaaacattttttaagaagaaattataaacatgttaagaattgaatatgataactcataattgaaaccacacactcccatttctaataataactgtattaatcatatggatgtgctgtgacatggcatataaccttatttttttggagaggtatgttccaaaaacatgagaggattaattatgtgcaaaaaggagaaggcagtttgtcagtgatcacaagtgttcttttctttgccaggagaagaaagcagcttgcgttggtgtttatgtatcaggttgagctgcattgatagagcccctcttgcaacttgtctgattagatttatgagaacatggacagccacttgaaatttaagtaggaccttgaaaccaaagaaatatctttccttggcaccatgggcagaaccgcagaatcttccagaaggtcctagatggcggagcggagcctgttggcgagctgtcagcaggctgcaactctcctggccttctggggtaggttaggtagactggtttgtcattacagtgtttttcttttcctaataaataataaagacacctcgggctcctttggaacaaagggttttaaaaattttgaagaaattcaatcatatggaaagctttccactaaggccctttcatcgaagaaatagtaaatacataggtatttgggaaaaaatttaacataatacctaacgtcttgaaaaaaaaaccccctgcctatctctctatagtttgtgtctgttttcgtgtgctttatccaaatagtcactcatgtggcttttcttcaattagtaggatttgaggtagccctcacagcctctacattttacttgtttcataatcctgtgttctttttgtttactatggttttgttttctttaaaaaaataatttcgttgaaataatcaaacttaactcgaatttacatcatacaatcaagggtaagaacaacacatcccattgagtaggcttcactagaaggcctcatttccaaagctgagctaatgaaggagggagtttatcattgacatgtgaggttcatcatttttttttaagattgaaataatctgacatataggtcccacgctatctcagtcgccacatcagctaaaactatgatgaatattgtcttggaaccaaatgtgacccagttgtgtaagttgagagacgggcggttcagggacgaatttcaaactcaacaactaattaagggacataaggtaaacttaatccccgagcatatgatcagcccaatccaagcatggttacatacggcccattagagcaactcgcgcggtgtccaacccagcaagcaaaggtaaccgaagccgcgttcgcctccttcctcctcgagtcgtcaactccgtctcgcaattcccaaaccgcaccttccaatcctccgagcaggcaaaccctaaccccgacgacccgcgccccacgaaacccctcccctccgcccgaatcactcgctgccacccccaaattcggcatgcccgtccccggaaaccctaggcactgacctcgccggag

SEQ ID NO: 2413 - DNA, 2000 bp, Oryza sativa
aactccaaacacacgaaactcatcttcaagttccccggaagtcactcggggatccaagttgccaacatacaagcgggccatcgtgaacaaatccctgaagtaagaaaggaaccaattatagctcttccctaaatatatttctacatgaatgcaagaggaccaaaagataaatgttacaccttcagaccataaactatgacttgctacaagctaattcaagaagcttttcaagctttttactaagagtgcagttctgaattcatttcatccacatagtagtaaagagctaggtgtcagaaatctgaagctgatcgacacaacatgaaacagccataatagtccacagtatcgactttggagattcttacctattgcagtaatccttaacccaacctcggacctttcaggtttaatcagtactacctccgtcccaaaataagtgcagccataaatatgcgtgctcggcgttttgaccatccgtcttatttgaaaattttataaaaaatatttaaaaaaatagtcacacataaagtactattcatgttttatcatctaataacaataaaaatactaatcataatcttttttcaaataagacgaacggtcaatcgttggatatgaacagtgctaaaactgcacttattttgggccagagggagtatgagttaaaaagaacatatatcgcttaaagtgaagcatcacagattctccacaggacagcaacacagaactaacaacatccaatttcatacccttgcgcacaaaccaaaaatagcccaaccaaaagtagccctaatcgagagccgcccaaaaaagaaaaaaaaatcacatcccgtcacgagatgagctttcctacggttcctcaactagaaccggctgacggatcgaaccacataagcaacgaaaccgacggaatcaaagtggagatgggtttctagggttccgaaagcggaggggatcgagggtcgtggacactcaacgcatgaggtgaaacttcaaggtgcatggagttacctgcgcgggaagggtgcgagcgacgatggcgtgtggacttggcaccggcaagtccccgccgcggcggccgcggcggtggcggtggcggcggcgctctaggggcgaggagacctccgctcccgagcgatacgagggggaggagagtgacgcggccagcgtggtggtcgagcggagccgatatatattgggccgctggtttcacgcgtggcctcggatgggcctagcggatgctatccatgaatttccgtgggcttcacggcccaacaggttgcctatttttcttttggaataagttcattttgcctccttcaactcatgtccgacgtcctgctgctcctgtcgctccactgaggtcccgccgccgccgctcccgctgcctcgccgttccggcgaggtcccgtcgctccggcgagctcccgccatccgcctcgccgctctcttcatctcgctcgtcgtcgagaataaagagggaggagatgagtaactgacatgtaggctcaaaatttcttttcctttctatttaggtttctttttactttagtgctacgtaagcgccacgtcgatgcacataggataaagaccaagtcaacccgtcacgtaagtgctaggtaagagaaaaccgcctccgaaaccaccgagggagtcgatttgcaacggtctggttttacggttgaggggtgcgattcaaccagacgcatgagtcgagggagataaagtagacttattacttttcttttctcttgaccccctgggcgaagcaactgccaagtgggccctcacctcgtcgtccccgccgcgtccgggcgcgtcgcgtcgggcgcacgcacgcaccaaccgaccatcacggcgccaccgcggccacgtggcgttctgtacttatacccccctctcccgcgatctcactttcccctcatctccgctccattcccccctcccgtgtcgcagcgagaagcatccatcggaattctcgtcgaccaccgcaaccg

SEQ ID NO: 2414 - DNA, 2000 bp, Oryza sativa
gaatcatactcgggccatagttaagcgagtcaaagtatactttttcctaccaaattcggggagtgtattaaattttggcaagttatcttttgaaattttttgctatgatccattcattggctctttgcagctgagttcgatgcggttaactgtcaagcgtcaacaagagagcacattttttacatatgaatatgttgtgtcacattgtctttcgttatcggtttgatcaaatatagcgtggcaaccatatatctcttctgaggtttaaaaatatgaaacatgtttgttttatgtcgataaatctttgttccatgtaaaaacagggttctaacctactaaattagtgcttaatagagaaaatcttaggttgggcctgatatttttatcaaagtttcaactttttttaagataatgatcaaagttttactttagaatatttcatattcggtgtagctctagctctaggtgactaaagtagatattgagtatggggtcttgctaacgtcatcaatatcctcatgtactcatggaataggagtacgaggcagtgtgctagcggttttttcccaattctcaacattgggatcaaaaggcaggtgaatgcttggggcaacagaggtagtcgagcttcatgtgcagctgaggcaaatcttaagcttaaaagagatggcgagctagcaatggttgtagtggtggggaaccagaggtggagaagagagatataataaggtggtttaaatccaaaaaagataaaagtacccgactagtaaagatattgatattggatagtctattggatatagccctggtttgaagtgagaaaaagttatgtataaacataatttattttataatgtgagacggttatatggttttttgtgttcagctcacccttcttcttcgtcttcgatggccccctcaccatgaaaaagtaccacataccttccccatagcccttgtatttctatatgcatgcatattgtgttatcacaaatcaattggttcatagatatacataacttcaaagcgatcaatcaactaaagaagattaaattaccaatcatttcagaatcatgacgcatgatattgacctcattgatgaggtagagaggcggtttgcgtctcttgatcttaccgcggaggtggaagtccacgagctccttgtccgtcggcacaaagtggaagctaggacttaactgtagccgtgacaccagctcatgcttccagctcaccactagcaccgccgacccatcaccgtcgttgccgccattttccattatcggataatgtacttatgtggcttctaagttcttatggcaatcaaattgaaaaaaaaagaaaaaatatagtggggcattgctataataaactagtatttatatacgctaaaactaattgtagttattaactttttttggtaggttcttgtaaatgtttggtgtttccaagaagggaaaaagaaccaaaaagaatacttcctccatattttaatgaatgacactgttgactttttgacaaacgtttgacttttcgtcttattcaaaaaatttatgtaattataatttattttcttgtgacttgatttatcatcaaatgttctttaagtatgacataagtattttttatatttacataaaaattttgaataagacgagtggttaaacggtgggttataaagtcaacggcgtcgtacacgggagtacagaggagttgaacccgaccgaggcaggaggttacgggttacctggttcgagcgacggaccgagaaaacaccgacccgagcctagggtttggccttccccatccccctccgccgcgccgcacgtgtccaccacactcccaaagccaaaggagataccccctccctcccttctcttcctctcctcctcaccgcagctatcggggagcgccgccgccgccgccaccgccgccaccgctaggctttccttccccttcccccaccagaagcttctcgccggagaaggaaaggaggaggagag

SEQ ID NO: 2415 - DNA, 2000 bp, Oryza sativa
  misc_feature (1135)..(1135): n = any nucleotide
ggaaagcttcaatcctttgaatcaaagggccaaataggaaaatttcctataggatttgaatcctatgaaattcctatataaatcctttgattcaaagggtccttacattttactttctacttctccagatatttgctgtccagtccttaaaagtttggtccctacatggaacagagttcctacaaaatatcaacttgaagctaagtcattgaagttacctcacgttaaggcaatatatctgaggtcaacatcgaagaaatcctgtcctactaactgaaaggaactcccgtgtattttttcccttttcgttgtcgtccatatacttattctgcaatattgacgtatcgaatacttttgatcaccgatgacatttcaacgccgtaagaaatatgttcaccttgggtgtgtttagttcacgccaaaattggaagtttgattgaaattggaacgatgtgacggaaaagttgaaagtttgtgtatgtagaaaagttttgatgtgatagaaaagttggaagtttgaagaaaaagttgggaactaaaccaggccccttttccatggaagaacacaactgagctgtccaaatcaagaaatcaatttccacaaagacaaaacctgtcacatggaattgaaggtgccaggtgaagtttcaaagttaggcagcaccttgtaagtcgcatggaatctgatggtccttttgtggtattccattctcgcaattaatttctatggaataatttgttatgtgatgtcaacatcttctacactagcacagattcttacatctgtaacgggtccaataaaaccgttatagattatgtcatctgtaacgggtgacattggcaactgttatagatgaccagaacattcttgagctgttactgaagccgccttatctataatggctcctaatcaagagccgttacagatgtaagctcctttatctgtaatggcttcctcattgccccggccgcacaacccttccccctcccgctcttccgtgccaccacagtccacatcatcattacattcctgcaacgcgacgtcgatgtgctgccgtgcagtggccatcggtagagcagggatggccggagtagcaggaggctagcagagatgaaaccagattggatgtttttngttctttctattataaatctccacatatgtaacagcttacgagtttagtttatattttttttaagctgaattttcacatatgtaacggctccacgttttgagccgttacagataactttcatctataacggctctctagcccttacatatgagtcttcacgtctgtaactgttggtctgtaatggttagtccaaccattatagatgtgatttttgagcccttacagatgtagtgttctgtactagtgtataattgtaccttaaaccactgtaatagtttgaataggtcaatgttttattaaatttgatttctctaaatagaaatttgattgtagatttttttagaagagatgcaatacattctaataattaagagtgttttttaagagttaccaccctttttagtacaaatttgtgcactaaggtggtgaccataaaaaacgtagtaattagatagtgtaaaccagaagcttatcaaatccatattatgctgtatgggtagaaagatatttgcagcacagactgatgtcaggtcatgtttcttctttcaaaaaaaaaaagtcaggtcatgttttgccaaaaaaaaaaaagaaagaggaaaagccccaaccccctaggatgcagacagatatataatcagagaggcatagaggggaagagagaggacccaaagtatccatggcttctatgtcttaaactttgtctactcaatgagcttcagacatgtcttggacaaagcccatgtcctccctcctatgcaccatcctctccccttgttcttatccttgaaggctttcacaaactagccatggcgagttcgtctacccatggcttttctggtgttaacctcacccttgatggaaatg

SEQ ID NO: 2416 - DNA, 2000 bp, Oryza sativa
aaatttataataattaatacttaattatgcatacgataatggccttttggtttcacattcttttgcctaatcttaatttttatctatctcaaatagggtctaaaccattgtttaccatcaaaattctatatccgtgcgttctaaaggtgcctaaaatgatcaatattagagcacaccttcacttgttccatcttccatctcccccatgctctctatatttttttcatttctagttatttttattcaagacaagagaacaaacgtacaagtcaaacaaatgcacatgagcaaatccaatggatatagggataggttagtttaatcatgtgatacaatatcttattactactagtagcttagtttatgattccccgtgacctctcttaattcccctccctcctcttgaccaatgtagcacagcagcagcaacagtgtcgttatgtcagacagtccagtgtacagtacacaaccattttagtacagactgtatccactgttactgaagtattagaataaggggcagttgagattgacgttatttttaaccctattttcttttaaaaaattgttaaaaatatgtttgcgtttagtttgttattaaatttaaaaatacataagaaatcatattaaaattttgataatattgtcatctgaacaggctcaaaaagtctgatcggttgcaatagaaataacaaaacccataatttaaattttagaatttaattataaagttgatatttaacgtagtttctttagcattgatttgattttaagtcgctaagaacacatatataaaagttttacacgtaaattatttttagttaataagctattatgttttataataagctttttggtaactactaaagaccatatttttttccactttaacttttgttgtgtactactcattttgtgttgctttacttcaaaggtagcctgcggtactctatttcagatgctctccgtggttcataccggtgagttttcttttttcttttttgcctgggcaccgtgattatttgagataatgccgaactccctctgtttatttctttatgatattcgatgaactaactatcaagttttacattcacttccatatctttgatattcctctagatacaacattagtgggaaaaaaaagtaattaagtttagagtaaaaatttctaagcaaatttttaggttataatgctacacatttcttttggggttctattccgccttatatcgggcacattcacaataacatactaatacatttggagtataattttaaaggaaaaatatatatgctaatacattttagaaaaaaaatcttttactgctattgaaattgtacgaatatgcgaattgcaatcacatgtttcaaaactgaaaaaaaatacgatggcatggatggaattaacccccgaaagttgttgccaccaacatctccctgttatgaagttctccatttccctccatccccacaaattacaatcaacagggaatattctgtgttaaaacaccctttttcacttttctagccgttcacttttttttaccacagtagtttttttttttaactctaccaccatcagtttgaactggacaaacggacactcaaaaccacacacgcgtcgcgcccgcagcaactgtcggtcgcgaacccccgggagcgtgtggggagacgaaaatcgcgggggacccacggccttctcctttttttcactgcaaccccctaaccccacccactgacacatcctccccacgctacgcgcacacacacccaaaaagaaaaagaaaaaaaaggaaaaaaagaaagaaaaaagcttgcacccgtgggccccaccagctgagctagctcccctccgcgtgtgtgtttataggcttatagctgcctctcactccccctctcctcctctcctttctctctctaaacctctctctcctctctctctctctcttgagttcttggttgatcgccattgccgcggaggagctagaggagatgag

SEQ ID NO: 2417 - DNA, 2000 bp, Oryza sativa
  misc_feature (1309)..(1309): n = any nucleotide
  misc_feature (1479)..(1479): n = any nucleotide
  misc_feature (1482)..(1482): n = any nucleotide
  misc_feature (1485)..(1485): n = any nucleotide
  misc_feature (1545)..(1545): n = any nucleotide
cgacgatttcgccggcgagagagtgatcacgatttggctgcaggggcgtccccgtctgcccccctattcatttttctgatttctgtggttgctgccaattgaactccggtaggttacaaacgaagccacctaacaaagcgtcatcttctagtaactgaatttttctgtgaccgagtcgaagtcgaaatcgatgtgcaatgatttaacagacgagagcacaccggtgcttagatttccatattgtttagtcaactaacagccggtaggattcgagtaatttcaactaactgcatgtttgagaatttccattagagagttttgttaccattacatcgaagtcctgtttagaaagtaaaattaatgaaccagagattgtgttccaaacaggtctcgatgaatttggttacaaagaatacaggctgcaatttaagtagtctaattttaactcttaaactatgctcgaagtctatttattatgatgaaaagtaaaagataaactattttttatatctttgggttaaacgcatatatgtattaggtttcacctattttacattctgccactttttttttgctaattgctatataatcccactagtttagcatgaagatgatataatgccattctgttgtgttagatgacaccaacaccattaatttattgtgaattgactttgttaggcactatgaattataaacgcacattgctactaccttcgtcctagaatacttgattctttagaattcaaattttatcccaaaatacttgtcattatggagtactagttgtcccattaatcactttctattcaaaagttttcccattttaccctcaataaccattccacttcctatcatatattatttattaagggatattatatttttttattaaaccttaatatatactaaacaatctagaatgacgactattgtgggacgaagggagtaaaaaatatgctcctacctcagtttgagatgaggggtatttatgtcgtaatagaatgccacggaactttcaacaatttttacttttcctaatttcaaaatttaaagatacattctccaatccaaggacaccgtgacagttagctggttttcggtggtaaattgacaattacaacatgccctaatagcaaatatacaattgtttctacaattattacatataaaaatgttgagtcatatttttgtcacggaactacttttacgtcacatgtctgatacgttttacaaatgtaaaaaaaaaaaacaatggccaatggttactacagagaaccgagctactagcagtttttctcccggtganacaggaagtaaaagaaaaaaaaaacgacccactgccaaatggttgtatcaaagcatcaacaattcaccccccgcatgtgctggtagtatgacggcgtataaaacagcacatggaaacagatgaaccacaatcatatggtaaaaaacaaaaacggaagctcaccttcccancgncangtcccggctccccatgcgaccgcgcctatggacgggcgccctgcccacgccactgccccnaccgtcgcacgacggccgcgtcggtcgccacgtctccatctccctccacaccacctggtttcctcttcagtttcctcctcattattcctcctcttcccccctcgccgcttacaacatccatccccaaacccgcattcaaaacaagcaaccctcctcccgaatcgaacaaggaaacagatatcgcctctaaaacccccatcgtctcgtctcgtctcgttcccctctccatcttccgcggctttccgcgcgatccaccgatccggtttccccgcgccgtgcccggagtcggcgctccattcccgcgccgggttttggggtggtgtgttgatgcggcgggattcgagccctggcctgtgagttgggcgtcggctcggcggctgcggggtcggcgcgggcgcggacgcggcggatgtctgctatgaggcggcggccggtgctgccgactcaccaggacg

SEQ ID NO: 2418 - DNA, 2000 bp, Oryza sativa
ttgagcggtacttttagccttgtcaatttgtaaagttcacaatctctatttatagatccgcacccgcctttatcgagttagatatgaaattatccatctttgcaactggtattaaggtggtcgatcttttagctccttatcggcgtggaggaaaactcagactatttgggggagttggattaggtaaaacagtactcatatgggttggaaagtctttagtccaatgacagcaaaacaaaagcgagcgtagacacttgttttgtatttagcctccttactaatgtatgtaccgaagcagtccctttgaccattccaacgtttgttcggcctttctttttagaacagggagggggcattgatccgatcgatttctgtatcgatcatgatatacgtaataactcggacatctatttcaaatgccaaataaaacgcgtcccaagcagaaatatcacaagtaccgccgtgacctggaccgtcgcaaggaaaactatatccaaaatcttttttatccggcattaatttggaaccgagtgcatctaaagtatcctttactaaaatcaatgtagttgtatgcaaacctaaagcaatagcatgatgaaccaagaaatctccaggtcctaccggtggaaaggggagaaagaaaatatgtgcgaagaaagcgagagggttcgacgacttagccgagcgttagcgaagcgtcattctcatagcgaggtgcttcgagttagcaaagcgttgtagtagcgtcagagactacatagttttggttcgttggaaaggctcgcagcgaggcgtaaatttctaaataggtaaggtatcctagggtgtatcaccggtacccaagtaactagttgatagtagatgcccgtaattctgacagttgtgcttctagcacagctattaccatatcatctttcttcttcatgcaagttgtccccaaatagtaaccccggcggctacacaactctctcagctcattcatattcttccactcgctctcactctttggactttttagtaccatagattttcctaatgggagtgaggtatgtcttgtgataggtatcatatttcttaaactgtaacacctattagtgcttggcgtacttagagcaagtttaatagtatagacaactactagctccaaaacatttataatcaatttagtcaattcttaccataattacctataagagcagttacaataccagactactctctccgtcctattttaagtgcagccatgattttccgtgcacaactttaatcgtccgttttacttgaattttttttgaaaaaaatgaaaaagtaagtcacgtataaagtactattcatattttatcatcccataacaataaaaatgcaaattataaaaaaaattcaaataagacggacgattaaagttgggcatgaaaacttatggttgcacttaaaatgggacagaggaagtataagccagttataacgcaatgtgtgtatgacagataggaccatgtacatatactacactattaatatctggtctcacgtatcataaacacattacatcttgaaatccgtgctgcagcttgctataaatctgtagttcgctgctcttctttttccttctttttcttcttagatgtgtttatagctgactgctattggacctgctcttagatgaagatagtcagctacacagaaaaaaaatgcttatattggtagacggaggcgataatccttgtcatacggtgattgatcgtaaggaaatttccactttgccaaacaagaccttttaagtgggcccgggaagcggcggtaatcgcaccgggaatgggccggggcccgctcggctaatccgcttattaaaagggcccatcttaccccggcccccaatactcccccgtggccgcccgcgcctcgaggccccgacacacccgctcccccaccacctcgcgctcgcggcggccaccggcgcggcggcggcggcggcgtgccttgccttgcctagctcgctggtg

SEQ ID NO: 2419 - DNA, 2000 bp, Oryza sativa
cagtaagaccgtttaagtttcttaattagtgacatcatgtaacatgaattttgatgtttcttaattaattaactggaagatcgagaacaccatgtactactagtaccattttaccaggcctgtttgaagttgaaggagcaggtcaactgacgagtagaaatgcctctgttcgttttcagtccttgagaaattcagactttcagagtaggaaacgcattgattacgcggccaaatgaaatacggcgcccctataaacgagggatgcatacagtagtacagtactcgggatctgattgcaccgtcaaaatcaaaatcaaagcagttgaattctactcggggttaaaactaagttgacgattcacggatttgtttaagcaggcatcgtggtcgccatgacgcatgagcctttgaccctgcaatgcaaccaccgttttgaacacaagaattttgcgtgtcactacggtttctcgtgaaaggctttgtgtaccgcgtaggattgctacactcgtcggctgtgaagaaacatgcatggtagagcaacactactcctagcatgtttgtggtagagctccaacttctaaatttagtttcaggagttgagtctagagtggagttgcggaactgtctaaagtctaaattcagcttcaactctttagtttattttgtaagagcactctacctaactccgctcttattttaggtagagatgaaactgtttggctgagcttcagttacagaagaggtggagctggagctcctgtgccaattgccaaacaggcccaataatctcatccagaatgttaatgtagagagtggagttgtgagtgcatgatttttgtttggaggagctttagattacgagaaacatgggtaggaattcaactggtgagaatatggagaagttgtaaaaaccaatttttctttcctagtttattttttattctacaatcacaacttctcataatctgaaaaaaaaaagtttatggagctttggattcaaaggagaaaacgcaacccaaaagttcctctaacagaaaagcccataaatattgtgcacacacgatacttcataggaatctagtgacatcaaggtacttcactcttcggttgtgttaggggggtggagtggtggacacaaacatatgtgtgcgcatatattttctgcgtaataaaaaaatctagtaataaagtttgggagtacctatgcatctttcgaaagatttttatgatcatatcacacagatttttaatctttagattaaaatctaatgggcacagtaaaatgcaaaaaagcaactaaaaaacaccataatggacactaaattaccatatcttcaagaaaaaaaccaaatctaatatatatttcaaaacttacatgcaaagattcaaaaattacactgtaacttacaaaagttacactgtaaatttcataaattacactataatttacaagaaaacacactgtaaatttgagtgagaaaatcaagtgagagataagaagaaatctttcgagtgagatatagcaaaatcgataaagttttgcattgaaaccaaacaatctcatgctccaatggaagggaactatggaagtcctatgtaaatgggccaaagcccaaagtaatacacaaaggcattccaaattcgggcctgcacaagtaaaccgggcgatccagaccgtccgatttggcgcgcagaaacccgatccgcatcccgcgccgtcgcctcaccgctatccctcatcacccactgacaagttgccccacacgggaggatggcccacacgtcagtgatagagggtccgttccagggggcccacctcatttggtcccaggaaggtccttcctcgctctcctctctgtcttcctccgatccacccaaccaaccaagcgcccgccggcctcgtcgcgcgccgcccctccaccgcccgtctccaatgccaccgccgccgcagccgcagccgccgccgccgtcgtccgcgtagggtaggggcatcccgccgg

SEQ ID NO: 2420 - DNA, 2000 bp, Oryza sativa
  misc_feature (1374)..(1374): n = any nucleotide
  misc_feature (1435)..(1435): n = any nucleotide
aactacactgctccgatgatctatttgttaactttttttaacgatcaattaatcagctaaagatttacttagcttgttcggttggaaatgcagattctggaccacgaagacaacgagatgatgaggccgatgaagattgtgcgctagtacgtgtccataggaattatgtatgcacttcagtaacataattttgtgccatactcctacataggattgggatcctctgacgttctgacgacgtggtgactgacatgtgagccccaccgcttgtgggcccacctgtcagtgaccacgtccgtgtgcagttcacgttagaggatccggttcctcctatatatgtgtatctacccacgtgaacatacacatgtgcatttcaaagccatgtcaccatctcaattagacattccatttgcatttacacgcacgtattagtgtactaccattctagaagtactacattcgttttatattataagactttctagcattacatgctaataaatctagacatatacacatgcctagatttattaacatctatataaatgtgggcaatgttagggcagtaacagtgcaagcacctcgtttgagttacctcgtatgtcacgtaagatagatacacaacgaatctacacctcccacgatacaggttactatacgagatccccaaaaccaaccacccaacccattctctctcctacttttccctttctctctctctctcactttcccctgtctctcagtctcacacactttcccctttctctttacaggagtggtacacgcgatggtggtggtcgactggtcgttgtcgtcgtcgccgacgcggcgtcgtcgttgcccgcggcggcgcgtgccatccccgccagcccgactctcccttttcccggcgcgccgcctgccccaacaccaaacagcggcggcatccttaggccttagcgaagaagcggcgatgcgtcctcgccccgccctcctcaccgacggcggcggcgtggatctggagcggatctggcctagagctcgacagcaccgaccggacctcacccggcgcggggtggtgccgactggacctcgcccggcgcgggtggcgccggaggacatggagctctggcggcggtggaagaatccgagctcggcatggcatcctcctcccccggctttgtttcaacttttttaagaatccaagctctgcacatgtgtttgtttcagcttttgaagcatttgttttagctttttcaagtgagttcctcgcgtccttgttaagggacgaaagccttagcgaaggaacgagggcccacaccctctctcctccacgacatcacacagcctatgtggagaggttaaagcagcccgccacggtggtacactgtgaanggccttagaaagtcttatcacctgaaacgcaggtagtagtattctatactgcagttttgtnttaaattttttaaaaaaaccataatcatgtgaacagaacagatagtactgttatctgttggcacttagggctttttggcgaccagctgctttgagattcggacaggacacgagtcgcacgaagggacatgccccttccggatcagaggggtcccgtgctatccgtgttaaatttccttgcaccacttgcgttgttcgaacgcgacggcgcggcactgatcgtgtctcctcccctcccccatccgcctcactcactaaacaactccgcgtcgatcacccaaccacgcccgccgccgccgccgcctctcgccggagacctcctctcaccaccaccgtcgtcatcgtcgtcgtcaccctcctcctcctccaccgctccgggttgatctacttcgaaggtgagaaagcggaaccctagctagcttccttgtggttttgagggttttggtgtggtttagttaacctgccccgaaatccttctctctcccgagcttggattgatttttcttttttcattttccaacgttttcccctccgattgctctggattcggggttccagccgagcct

SEQ ID NO: 2421 - DNA, 1991 bp, Oryza sativa
  misc_feature (65)..(65): n = any nucleotide
ggccgccgccttcggctggcgttcccgctctcgatgatctctctctccctctctaatcttccctnatttttgttccttaaggtcctcttgaagcccgtccgcctctcgccgtccgccgtccgctgctcgccgcggcattcgctgtcggtaaggaaccccctcccatccctctctctctctcccatactgtcgacgctgttttgtcgcgtcgcctcgctttggggccgtgccgccgtgcgtcgccgtatagccgccgccgccccgccgctgtctgccgcatcgccgccgccgtccgccggtcgctgccggtgccgcgctgtcgccgcgtggccgccaggaacgtgtcgtggggctgtgtcttgtgggtacaggtgtacacatctgatcagagtaatactattcgaatagccatgcccgcggttatgggcggtcaaccagattcaccgtgattagtctcaccctagtttagtctaatggaattgattagttcaagaggatggttgggtctgttgcaacgtggtgtagcgttggacagtggatggtaaatattgtttaattattacaactgttttactgctttcaactactgtttataaatgctcgctttatgcaaatgaaccgctctagctaccctttggttatatcctacatcataccccctctttcggtatgacttgctgagtacggtggttgtactcagtcttgctctacttttccccaacccctgagtttgagtatgcgtcagatggtgtgttttcggaggagtaggcttcatccgtgccgtcgaggatgcctgtggagtggtgttcccgctgcaatctaagtcaaggcttagctctagttatcttttattttccgctgcatttatgtaagacttttataatatttgtaagacgtggatctgtatgtcaactttatcgtttgtgtaccccggccggtcctggacgggggttttaatgcacattctacttggcatcttgggtacctacctcgccaacatggtggttgaggcatctggaggcaccgctaaccacgcctgctaggaggcggcatacctgatgatggccaggcttcgtgaccgccacagctacaccttccgcagcacggcataccgcttccaccctcgccgagcagatgatgacgacttcagtaccttccacccgacggctggcgagaacgacaccaccttcagccacattttgtgccgtgatgaaggggatggacaggatgcactctgacctggacaaggcatccaaggccttgaatgatggaaaacttgtgaggattatagccttgaaggatgagataacgcgcctgaagtaggagaacgctcagctgaggggtctcccagctccaggaggggtccggatccgcaccacgcccggcaagactaccactgcacccgtgcgcactcagcttgcgcccaggaacccacctcctccagcaccttccgcatcaccagcacctctcgcagctccagctctagctcctgctccagtgtcagcccccgtgtccgccctctccttcgctccagcttcagcctttaggggtccagccagtggcaatggaggttggttgcctgctactcccagtggcagccgcgaccgcaacagcagttccagcagcttagagccgggcagtggcgagacgtacctgcaggactccaagagccgctcagagggaccaggagacgagcaggaggacgccttcgactccactgaccgcaggagccgttccgagcattaggctcattttcagttagcatatcgttctgcttagtaattgtctgttagtttgtgtgtttaggtttgttcacttgtgggtcagtcgacggtcgatatcatatgcctatgatatggctgtcctaataaggatttgcttgctgttttaagtgttttaatttagatcagaacaattgcagtttaaatttctatttaataaagcttagttcctgagcatctactcttcccctccgtctgctcctccttcag

SEQ ID NO: 2422 - DNA, 2000 bp, Oryza sativa
tgatcgagtactgcgacgagcacgccaacgagaactccgacaccgacgagcagaaagaggaactcaagaactgggacaaggccttcatcgacgagctggacgaggacgacggctccttcctcttcttggtcctcctggcctccagctacctcaaaatcgatgggctcctcgacctcacctaccagagggtcgccgacaatagcaaggccaagaccaccgaggagatccgcaagaccttcagtaccatcgagatcgaactcagcgacaaggaggaggaggagcagcagcaggaggaggagatccgcccggagaacgtctgaatcttgaagtatagtactcacttcgatctcttaacccgcagtgtttctcgtcgtgtgatggcgccatggcggctgtctcgtagttgtgtgtgttgtggctctggtagatttagatcgaattggggagttcgtgcatcctgtccaagaagaacagagtcgatcggttgtgtcgttgaatgagttgaactgctggatcgcttgcatgaagtgaatattttgaccccaaattgtttgctacgtgcctctatccgattggttttcatgcagtttggattctggtgtgagttgaatttgaatatagaagggagaactttctctgaaattctgaatgctgcgtttcgtttctgatgcatggactgatccgtcagtactgatgccttagtctgttgtttggttaactaaaccaactacctgcatgtctgaattcttctgcatccgaagcattttcgtttcagatatgcatgtggactgatacccagtatattgcattcttcagcatctgaagaatttcatttcagagatgtatggacttactgatttggtagatgaagaagaagacggccacggcgatgatgatcgtgacgccccggccgaccgtgacgactgtgcccgtggcaggagaagaggtcgccgggggcacaacaacgaccaccccaggggctaatcaaaactggcgatgcagggattgagacgacgacgattggaatgaacggggacgagactttgggcgtggccgcggcgaacaacgtgcgattgatcaagactaccgccgtgaacgcacacgctccccgcgccagcgcgacaggggagggcacagtcaccatggcggccggcgtcatcacgctggtgccaccgacgtggacaacgtcaccgatcctgtctaccccgagccacacctggcagagatctctctgccttcccgccagcaggagcttcacaccgaggtttgcatatttcgattgctgcatgctttgcacacttccccgttcaagatgcaggaaatcccggcgtgatcagctgcttcgcctcgcgcttgtcgctgataaggccatggctgcgccacctccgacggcgatggaggacctggccatccggtcttccactgggactgaagcctggttcagcggcacggcatggaagccagtgcctgttgcgcgtgtctttggccgtatcagggaggccttgccggccacgccagcggtcgaaacgccgacaacctaccagcaaattgaggaggcgctgatgcgccttgagctcgctgccgctgcagctcgcaccccaggcgatgacactctcctaccacagcccatgtcaccggcacctctcgcagcgtccccgcctcgccgcttggaagatctggccagcgacgctgtggccgacaagattctgccggcgccgctccccggggcgctgcttccccaagagatgacccatatgccagccacccggcccctgtcggcgctggagccgggctcgctgccggaacgcgcatcctcgccatgcgccatcgcgggactgttcacctcgcctccgccggctatcattgcgtcgccgctgcgctcgacgcttccatgtctgcggccggtcgtcctcacaaggaaggtgaagctccggccgaggcagcatagccaggcaatccggcggagtgagcacctcgccaagcaacctgcaagaccgatg

SEQ ID NO: 2423 - DNA, 2000 bp, Oryza sativa
atccagatttacaccttaagacatgatgtgacaaatgttcaatgcctaatgccaggattaattctggcaatacggaaggtgatacgcttgaaggtaactggcgccaaactttctgttgtgcagatgatataatgcattttcactgaagaaaaattctatcttttgcagaacttgatttatggtctggagaagttcttgtaggattttattagaatgctggtaggaattttcatcccacatatcaagagaaatacaagctatggatattcatggtaaggataatgcaaaacagtaagaaagccagcaggtattacaagactatgggacaagaaagatgcgaagaatggctccaccaaacatgactgaatttttttatgcagatgttacccaagatacacaatcttgctgcaagttcaaggtggaaaccaaacacatgtcagcaatattcgggaaagcaaccatggtgataaccattgtcaccaaaattgagccaattaataaatgagtggttgaattgactcaaggcctcaagcatatgagttccatcacagaacataagggaactctagctgtaaggaactatgtttggtcctgggtgatgctgacgcaaaatgtttataacaatgcatggtgcgttgatagggaactgttttgatcccttgagatgaagtgatgtccccttgtttgtaaaacccatcaaaatagttatgagtaacctttaaaccaatttgcgccattcatacagcatacatataccactccacgaaatcttaggtctaaactcaactcgcgcattaagacatataaaaaagaagacaaattcagcgtatgaataatagtggtactattgttctttttcccctcaatgtataggtcgaatttaaacatgatttttggtggagagatagatgttactaaactctacattgttaaaaaaaaaaactagatgttacccgtatatcacatatgcacaaaggcaatcatcaacaaggtgacgcagtctctagtctgtacaggagagttgcttaccgtagccaaaatgtgatgactgatcaaccggggtcaccgtcttcactcttcagttcttcacgaagcaatcgcgaccgccaagaaaccgaaattctttaagatagaaaaccaaagaccgatggttcggtctaaaccatcggtctgattgtggcgaccgatctggcgtggaggtagccggtaggcagcggcgcggcggctggattgcagtgcagaaggcggcggcgcggcggagatgcgggagtaggacgaggtaccgcgcggggagccgcttgccgtcgcggtggactcacggaggacgccggagtggtcggagcgaaaaggcggcgctgattcctgctgctactagacgccgacgggcgacggcaagcacgaagggaagttagcggcggtggaggtcggactcctccgggaagcagtccacggagggttttgctggccgctgccgacgttgagctcgacgccatggctgcggcctttcgagccttcgaggaatagtagatttgggcccaataattgagtgatttggcccagtccaggaactagtaagtactctgcagagtacgcagaaaaatagtctccacgttggtgaactcgttgcttgatgggaacgcatgcaaaggctctgatcgacgctgatctcaaatatttcgaccaccattgcccgtattcctcggtgtccatctttgacatctgctgcaccctaattggtatctactcctcatctaatcgaatcgcaactcgtcatgtataaattaactccacacctcctcctttatcttcaaatctcaagattactctgccaaaatggcgcctggtcataggcacggctcagtgccaccagtggtgttactcctactagtagccactgtgcttggctccctctgccttagcctcaccgcttcacccgaaggtacatgagaaatcacgtacgtgttgctcatgtgttgtgttttttttatagaactttgaca

SEQ ID NO: 2424 - DNA, 2000 bp, Oryza sativa
atgcacgtgggtcagtgaaatgggagagctggctccggagtccgggaggtgccgctgagcaaggtggacattgccggtgacgaggttgacctctacggtagggtgcatttctcagatatttaaatatttatcacttttaaaatatgatgtttaactatttgtcacttgtagtctatgacatataggctgaatgataaattcttaattatcatttgtatcatttgtaagagcggaaaatagttaaacatttatacattttttgcgactacacccgatatatttgcatgtaaactgaccaattttctcactccgggctgctttttgttgctcataccaccgatacaaagagcgtcacatgtgtactacaacgggccgcggtgcttgaagaaaggagaggctaaggatatgttcagaaaaacttaagattttaagagatagcttattgatctaccttatgaggatctaaataagatggatttcttatagcttttaacttttactccatccacttcaggttataagatgttttaactttagtcgaagtcaaactttttcaagtttgactaagtttagagacatatataataatatttataatactaaattagtttcatcaaatcaataattgaatatatttttataataaatttgtcttgggttgaaatgttactacttttttctacaaacttgatcaaacttaaagcagtttggctttgatcaaagtcaaaacgtcttaaaacctgaaacggagggagtacattatttttgaattatataatcataacttcttataatgtagaataaaagctactacattcgtcctaaaatataacaatctataattgaatggaaaatataatagtagagtatttgaaagagcatctcatttttaaaaaagaaggggcggtgggccatcaacgttgcagtagcgaagtcagtcattggtcggaagtcttgagttgaccgacgacgatatatttccgtgcatcggacatctgacaaagaaccatgcctcatattatcagtttcgaaatagagatatcgtcgtgcacagtggtaattaaggatgtgtcgttttagcgtgttgattcattgccgagctcatattttcctctcttaagtctcctatcggttttttattagatttggaacaggagacggcacaatcaacatttagtggcttctaccaaggaagcaaaaaacgcagaaatgcacctgcgtacgcatcagctgcaactgaccacatatgcagttgcacatgagagctttgatagtggccattcgcccattcctgttggtcacgatcaattcacgaactcacgatgcgtggtgctggtggtggctccaacgaccgtgccgctgccggctggagccaacatatcgtgtgaattagctagtcaggcagtcggtgagcagtcagaaaagtatggtcctctgatttgcaggagcgggctattggtacgggcgattaatcatacacagcccatgcttacaaataaattgccgatgtcttacagcgacctgcattattctcgtcgctccctccgcattgcacgcaccctctaggacctctatgagatgcatgtacacaccttccgttgcattgcaagcatatatgcatctatgccaagccatcacgtatcgcatgtgtagggattagagcataattaattacaccggccgaacccatgcacgcatgctacctaccactgttgatgacataatttgctaatggtgccatccaggatatcactatagagagataatagagatacatgcaaatgagcatcttcggatcatcatggacacaaccaatcaatcaaaccgttctgttaactgttggcagcgatagctagcattgattgattgtgccatcgatcgaccttggccgcgcgtatataagcaccgccgcatccccatgagatagctccacacacaaaactgttgcactccactgcgctatagatagctacgtgctgcattcgcgcgcgtgtgcatgc

SEQ ID NO: 2425 - DNA, 2000 bp, Oryza sativa
  misc_feature (1660)..(1660): n = any nucleotide
  misc_feature (1665)..(1665): n = any nucleotide
tatctctcagtacgacacgtacgtacggtagaaagatgtgcatcccggactattgagacggtttaggtatcatgactcatgcggggctatttggttgccaattttgcaccctgatagaggattttttctgcatttaatttgacaatcggacacttttcaaaaactaatttcacaaataaactgtagccaaaacttatttcaaaaataattctttttttcaacgccaaatcatatggtgctgaacttaagacatatcaacgctaaatagcacgtcactgaatgcatgttggcacaccgactcagtctcccatccgtggtggcacatcattcagcatcagttgacgtggtgttgaggtatctaagttcaacgccgtatgatttgacgctgaacaaaagggtaatttttaaaataagttttggccacggttcatttacgaaattagttttcgaaaagggtcaaattatcaaattaaatgattttcctaggcggagacttcccagcgttggtttgcgtcctgagtggctgaagctttgcctcatctgagctgctcagacgacacaaaatcatccaacaagcatgaaataaaatcatctaacaagcatgaagataagtgcccacgcaaaacgagataaatcattagcacataattaattaaattttaattattaaaagcttgaaaaaatgatttatttgattttttttatagcaacttctatgtagaaagttttcgcacgaaacataccgtttagcagtttaaaaggtgtggtaacgaggaaaaatctgtatcttgttggagttatatgtatcatgtgagacgtgattcgtcattcgggcatgttactcgggttgccaaccattgttacccttgtaatgaccaaaattttgttcaacggccgatgtgagcctcaactattagaattttgtccgctgctctagaattttagtaaagttgcagtgttccatttccattaaagcgaattgaagacaaaatcttgggagagttgcttatgctattgtttagtttgatatatcaataaaaagtaccaaatcgtaatcgaagaagttttcaacaagagataaggtctaaaggtgtaagtggcgtatataaatgggaattaactaggaatggttagttatgtattagttgttgctcaaatttttatttcaatatgcaacttgaaaccttcatgtgtgattctcttcgtacacttcttaattgaaaagagctcataccattttcctttctaaaaaaaataccaaaccttgggtaaaggcccccgcttactagtgcagcagtaacccgtaggaagtacttcctctgttaaaaatataacgattcagtttaggttaaaagtcttttgaatcacatcagttgtcaattttttaaattttgaattgcatggattcccttttcaagcatcattggctataaaatcattgaaatacttagaatcataagaatattataaaatttgaatcctagaaatccttatattttgttttggcactgtggtgagcttgctattaccaaattttgtagtaaaacaaacagtaccattaaatggtaaaaaaatgtaagaatttgttaggcatcaattcaaataatcccttaatccaaaatggcttgatgatttttcgaaagttggcttgaacacaggnagacnggagacaggatatatactgctttggtgggtctatttaaagcatttgtcagaatggttggaatggttgcacacgaaaggagcacttggtatcggtagcttaaataatcaaacaatggaaatttgtgataccttgaaccttgttacaaatagctatctgtctgatcctcaaattcaagctagtggggttaagagcgagttgacactccatatatatctttcatgtacacctctgaaacgtaagaaagctcatctgaccgcagtttagctccctcttagacagaggccagagggagaaagagagagagagagaggagaaggctgagactgaacattca

SEQ ID NO: 2426 - DNA, 2000 bp, Oryza sativa
  misc_feature (1464)..(1464): n = any nucleotide
gtgtctgtaatggtagaacataatggcactaccatcagtatatgtaatggtagtgctattatggtagaacacaatgacacttttattacagatactaatgtgtaaagcaataagaggatgtgaccatcgccaataactactgtcgatattttcttgttgcgttcggtagagtgagattgcgagtttgtttgtttcgttttccgcgcgcacacttcccgaactactaaacaatatgtttttttgcaaaatttttctataggaaagttgttttaaaaaatcatattgacccatttttgaaattaaaaatagttagtattcatttaatcatgcgttaatggctcaccttgttttgtgtatcttctcgatactcttctcctcgaactcagtctcctctaaatttaaattggagaacactcgcccctcctctttctatatcatgactcgatcaatccatcttgtttaaccactagtgggacgctactatatctaagttttacgttaccgttggtaaccgcgccgttaccggccttaccgcgggggtacggtaatagaaataccgcggtaacctccttaaattcaaataaaattaaaaaataatttgaatttttgataaattttatacgggtttgtacggtttttcacggttaccacgcggtaaccccggccccggcggttttggaaaccctgactatatctcatagagcttatcggaggtcgccaatgcgcaaaatctatttaaaaaacatctaatagtgtatcggaaacatatacaagtgaatggacaaaaattaatcacatataataaaaaccaacaattattcatatataagaagatttcaacgtgtacttaaaaagttaggtgagaatttatctggttgaaacaacaaagtgcttgacaactaagagttgaagcctcaattattgcaccaacgataagttcacctactttttttctctctcctcccaccttccatggaaaaatgtgctgcgcacaaaaggaatctatggccactttggtgtgcagccaaaaacatccagaaaaacctcttgtaggagggcggaaatgcgttcccacagctcacctctccgcagaagatccttgtgtctgtatcgtccacagagccaagcccttacaccgccctgtgaacagtcactgacaatcctggcccacgcacgggtgggtcccacccgtcagtgaagtggctcaggcgacatggtcgcaggcgcgcctgtgggtttcgtctacactagtcgtcgtcgagaggcgcggaggcaacgccgtgtggtcgccatcgccatcgccttcctcctcctcctcctccgccgccgcgcgcttcctcgccaccgcgcgcccagggccatcggcggcggacgccctcgcccacgcgcgcgagagaggggggcgagagattatcggacgagtcgctttgcggagctttctagaatggtggtaagggctcccgntccccccctccgaagcctcctcttcctctctcctccaatctccatcctgctgctgctgcatgatgttagtttggccgtgccgcggcggacgaccctcctcgtcgttgttcgtggattgctccgtgcacgattaggttgtgggtttccgtttgggattgggatggaggggctcctctggtctgtttagtcgcgaaagaatgatactttcttgtatgttttgctgcattttggatcctaaaattatctgatactgtattgatgtcgcgcttgagaattcgattttgcgatgtcgcgtgaacagttcgggcttgcggagcgtggaggagcagaatatttccccccttttgatttggatttagggtttaactgtttggctatccccttgaaatttgatgagggctacgtgatataggggtgcagtatgcctcatacaagatgctacattcaacccgattcagtacttgcgttaatttttctcctctgaatcgccttgttttcactgttagtcgggatatttcagacgtgttgcttaattt

SEQ ID NO: 2427 - DNA, 2000 bp, Oryza sativa
  misc_feature (800)..(800): n = any nucleotide
  misc_feature (1742)..(1742): n = any nucleotide
tcctttttctattccttaaattatatatttaattctgaatttctattttttcctaattgtatttctatatggactatatagtctacttctaatattccttatttttaattccgaatttcagttatttcctaattgtatttctattatggagtctatactctacttctaatatttcttatttttaattccgaaatttcaggtattttctaattgtatttctatatggactctagtctcctcttctaatattccttattttttaattccgaatttcagctatttgtaaattgtatttctatatgggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaattatataatagatgtttcagcacttagaaaaaaaaatgttacagttcttaaaaaaaagtgaaacatagtgagatagttagatgaaacaatttaattcaatatatacaataaacgatttaagtcattgaaacacttaaaccttgtatacatcaaaacaaaccccgtgtatttgaaaatattaaacactatctaaaatccaccttcaaacatttgatacacacacacaaagaaacatcacaagtacactaactgaaacattgtttttgaaccattgaaacatcaacaaaacctgtgtgtcgaaaatagaaatatagaacactatcgaaatatccantgacatttgatccaaacacaaaagaacatcacgagtatactagcttgaaacacagaaaaaaaaacacacagaacctagtatggactgcatcttccttctctccgatgaacacaggcttgctcgcgtaggtcttctccaccactcccatcatcggatctgtaggaggagaagggggagggcggcggagatgaggagagagtgctcctgggggagagagggagccggcgagcctacaccaccaccgccgccgccatcacctcaccgcacgtgtgtcgtcctccgcgtcggccgccaccacggggacgaagccgccgtcaacgtccaggaagacaaaaagcggcggcagatccaacggagaaaacgacgctggcgagattgacgggagaggagactgtgcgggtgaggtcggctggggagagacggcggcgcaagcgagagagctcgtgggagaggaggcggcgccgaacgggggagaggaggcgagccgagcgaggtgtggggagccaagtgacgtggaatgagacgtgcgagcgccggatatttttctctctcatcgggcacccgtgaacgggataagcattatcggacacattggcgtggccttcattcaacatggcgcctacatgcagctccaccaatagcagctccaggagcttcacccttggtagtggccgacggcagtacggcacaacaaaatttcagagccgatagcacaacaaaatttcagatggttgcctgcatgcaactagaaaatccccacgagcaaagcaaaaacaaactggcggcatccgtcgtgtggctctccattcacctcggcctgtggcgacctccgacgcccatgcgcaaccaccgtcgtttttcgccatgtccaaagttagcgcgggctcgtataagagatgccaccgccgccgccgccgccgccgcctcctcctcctcttcctnctcctcctcctcgttgctccaatttttagaccgaataaaccggaccccttccgctggtaggggacgacgcatcgatcgatcccgacgcctttgcgcgcgcgcgcaaaatcgatcatttgatacatatctcgcgtgaatcgtcgactggtggttgcattgtgttgcaatgagcaaaggcgcgatcatcggcgcgtcgaccgtgctggtggtggcggtgtgcggcggtgtgcgtggtgtcgttcaagaacgggtcgagca

SEQ ID NO: 2428 - DNA, 2000 bp, Oryza sativa
  misc_feature (33)..(33): n = any nucleotide
  misc_feature (37)..(37): n = any nucleotide
  misc_feature (39)..(40): n = any nucleotide
  misc_feature (43)..(46): n = any nucleotide
  misc_feature (48)..(48): n = any nucleotide
  misc_feature (58)..(58): n = any nucleotide
  misc_feature (233)..(234): n = any nucleotide
gagtacgtgcgtgcgtacgcgtgacgacaatgngtangnngannnntnttgctgctgntgatgccgccgcgatgagagtagacagccaggggtctggttatataggcaggcaggcacgcggtgaggcgacgaggcagtcgacgattcgagcgcggagtccgtgtcggaaccgaaaagagctcggcacggattatgttgggctcgatctgtctagatgtactggctaaggcctnnacgcccgtatccgggccgccgtcaggggttagaattttgaaaaagtatatactccctccatattttaatatataacgccgttgactttttaaacaacgtttgaccacatgtcttattcaaattttttatgcaaatataaaaatacgtatgtcatgcttaaagaatatttgatgataaatcaagtcacaataaaataaattataattacataaattttttgaataagacgaaaggtcaaacgtttgttaaaaagtcaacggcgtcatacattaaaatacggaaggagtacgaggttccttatcttgtcatccctcgactaacaaatccgggttagtctgtgttcctttgaaggggttgggaatccctcccctccgcacgtaaaacggagcgatagattaaaacatgattaattatgtgttagctgtaaaaaaaaacttttaaaatagattaatatgattttttaaagcaacttttatatataaactttttgaaaaacacgcaccttaaggttgtcagtatcccgattcgtattcgaatatcttacgatactacgatcctatcaagccgaaacgataccgatcacacatagaatcctaattttcataatatctcgatcctactattcattactacacgatccaacgaaatcttaggtagtatcccgatgttagggttacagataaggcataccttctatcctacgacttatggaatatacgaatatggtataccttcacgtatacggatcgttcccgtgtacgtggtagaaatccgttccaaattatggaaattatctctacgagtcaagcgatgtccaaagtcctactcggaaatgtatagagtttctgttataccgtaccagatcaaatatcctcgaatctttcttaggggtcaatacgatccacggtataaaagggaccctcaaggaggggtgtgaggacatccaattccatcgccaacacacccaccatagtttacgaagccggagtgcgcggagccaagtcgccgggagatctcgtcgaactcatcgactacgatcttatcggtatcatccgtttcgtctattctctttgtaatctgttctcaccatcatcaatctcatataaactggactatggctattacctgcataaggggcttgagccagtataatccttgtcttttgtctgcttgatgttgtactacgtagacccctgctccaacgtaccccaatactcaactcatctggtccgcgagtatcactcgtcgacacccgattctacgatccctacgacactacaaaatattatttaaaataacatggtttgaaaataatgtaaataaatatgctcaaatttatataaaaatcagttaaatatatcaaaaccaacgtggtttttctttgataaatgtctctatttgcatgacatatatcattactacatttattttatatagaatggctatatataattaatataaatattaattaaacttaaaaaagaaaatctcatattattccgatactacgatacgatattactttaaacaaaacgatactacctagtatctcgatcctgacaaccttggataagttaggaactaggaggattcttagacggttttaactcggttttatctgatatagcagctgagtcagcgtggaacccacatatcaggaagaccacatcatcaccctctttctcctcttctctcccttcctcctctctctcactctcctctgggcaagtgaagtctgccgcccggcggggcgaggcggaactcct

SEQ ID NO: 2429 - DNA, 1906 bp, Oryza sativa
  misc_feature (142)..(142): n = any nucleotide
  misc_feature (250)..(250): n = any nucleotide
  misc_feature (279)..(279): n = any nucleotide
  misc_feature (290)..(290): n = any nucleotide
ggcaacctcaacacagtgggccctaagtctttttgctcattcctaggcatcttgatgtccactctagccttcaaactgtactctgttatggcctttctaagtacttctactgaaggaaacaccatgccaaccttaaaaactnggttcttaacatcctctgccatgaaagccttaaactttaatctcacttcaccatcatcatctgaatctgggagctgcaaatcttcatcatcagtggaaacttcctccncatcagaatttctaactactatttctttncccttcaactnactgcccttagctttcttccaaaactttgccttgcagtcagataagtcttcaacacccacatcaacattgtcaacatacaagtcatcatctgcatctgatatatcatagtcactatccacaaaatctgggtcatcttctaagctaccatcactgtcactgtcatcttgtttgtttggcaccttcctatcagcagttgacatcttcctaggactaagcaccttaggcaattcactaataggattagctactacatcatcccaatctacacctgcaattgtgtcaccctgatcaaagtagataataaaattcttaaccttgtgcacaactgatttcatcacttcaaagtcagccctagtagatataaccctaaggccatcttcaagagtctttccagggagcaaccaataagccttaaaatctggagtcatatcatacccaagcatagctaaaaattcatccaaacaaacaatatcccatgttcttgcttcacagtggtcaatccaatttatcgtttgatctacatatgccctgttgctaccctgaccaacaaaaaaaccaccatgggtgtacctcagcggtgaatttaccatcatcaggacctgcattgcaatcctaattagtggtattactcttatgttctagcctactcgagaacaatgtcaggataatcatcctaatggaaaaaataacatctttttgcataatcaaacgccatattcctttgtatctatctaccaacatcaatcaatacatgctaaccttgcagattaatggatgaaattgaagttacactcactgtacaacggaggcccttccccttccaggcggaaaatcatgccgcctccccgcgattatagccggtgggaggccgcaacagccaatctcgcctctttgcgctttcgctggaaccctatttctccggcgatcactctcctcacgatctccgctgcactctgcactagagcactctggggaagacgaagcagcagtggatgttgaaagaaaatgagaaaaacagaggggcctcgatgaaaaaaaacaagtgtggccggtgtcacacacggtgcgcgtgagaaaaggcatggtgcgggccagctcagctgtgcacgtggcatgccacgtcggcgcgaccgcggtcaaacggcattttggaccggcgatggtacatttagcaagtttagtggcctgattacacgatttgcaagttaatggacctggataacatccacccacaagtttaagggccgctactgtattttactcttgataaaacataacacaaactaaacaaaaattacgttgtcctttgtagcttggagtcatccgttttgacgttcatgaaaacagtaaaatctcaactcagaaagtgttgactcggatttgacgattgggtcgtggttgccgactcctccgcccactcggtttccacgcgtcgtttattacctttgcagacggtttcacagagctggaaacagctccgacctccgaaccgacccaatcacaaaccaaccagattcacccaaacgccgaaccaaacttcgcatccccgaatccccgatccccaaatccctaaccctagcctcgcccgccgccaccgccaccgccgccgccgccg

SEQ ID NO: 2430 - DNA, 401 bp, Oryza sativa
  misc_feature (20)..(20): n = any nucleotide
agacaacttggtcgcttttngtcgagatctcttcctcccccgttccgttttttttctctctcttttcaaactccgcccctcctctcctctttctctcccacatcagcagcagcggcggcggcggcggcagagcgaagagctccacttgtacgcacgggaatccaatccgctcgaagccctcgcgccgtggagtgcgtgccggccgggcaggggcagtgcggaggcccgcgcgcgggtagctggcgcctggcgctgcggcttttagcatctggtgctttgcgcgttcgctggaagctttgcggccaccgcggccagatgcggttgattgtgttgtagtggttgggtttttttgggttggaacgccgagtcgccgaggaggaggaggaggaggaggggaaggg

SEQ ID NO: 2431 - DNA, 2000 bp, Oryza sativa
  misc_feature (605)..(605): n = any nucleotide
  misc_feature (723)..(723): n = any nucleotide
tctgaatttctgagctatcgctgcttctttattgcatatcatgcaactaatcaataatcatgttggcatgcaatgtaggatataatgaccagtactgtccaagatttttagtggcggtccccgaactcgattttagaataaacgattaatacttttaaaaaactagcttcttctaatatattgatacacaatccttttacgtgctaacaaaaattaaaacatgttctctgaaagctggcttcaacttaaatatccaaagtttcaaacaaactgcaaatttaatttcaaatatttccgctcctacatctttttgcaacgagatatttaaaagctcgaaatgacatttgtatatatcgatatgggtaaaatattcgccaccagcctcgtcttcactgctaatatctctcgcaaaatcaaatcccccaataactacgcaacgtgcggggctcaaacggtgtacaggatcgagctcccagaagaattgagagctgacagatcaccagatacacgcattgattatcagatttaggagttctggtactactgatccagtgatccgtgttgaaatggtacggcgcgtacttgctgtgtgatgtgaaattctntttgtctacactctctaagtttatttttccactcgtcttatttatttcaaaataagtttatttataaataattattgaatcagagtttataaaagagaaaataaatatattaagaatngataaataaaagaataattgcataatgcattagtacttggagaaagtgagggtattttttttttcattaacgtatggggacgcataaaaaattgaacttatttagaaacagatgatgtagagaataaagcaacagaatgaagcaacttaaaaataatttgtgtatagtagtatctagtacctagtagtatgttcttaacatatttagaatccaatggtaaacacaagctacgcgttaaaaaaactttaaaatttttaaaatgaagtttttgaattccagttttggctattgttgcgaagacaagtaagcgacgagagacttcaataaaatcatgtgctgcgattaacaaacgagaccatagataaggggtgaggatcatagctcatgttgtttgacggtttgactctcctagtttatcatcccattggtactaaattaaaaaagcaatcgcgtcgttacttcaaggatccaaatgatatggacaatggtttctcaatggtaattgtttaacacgttcttttatatttatgaaaaaagattatgtaaattctttcatactaggccagctaaacctataattttcgccccaaatttgctagtgtatggtcatgaggatgtataaatagtttgtttttttaactcaataatcatttaaaatacctttggcccaaataatccagccagccacaagtagtactaatagtaattgacaactgacaaccgacagttattgactcattccaatttccaagtcttaacagaggtgaaatggtccatagccttttgctacagagaaaatcaaatataaaaatatatttcagatattacaactatctctctgcacttaaaaaatatctcgtggcatcaataacatcaccatcaaaataggaaaaaaaaagtagacattgtcttcatgtccaacttatatccattcgatttaccaaaccaattcgtccaatttatcaataactaccattcctttggaaaatcaaataaaccaaaaaagattacacgaaaaggtgagatcatagaaggggaaaaaaaagatgaattgagtattgaactttaattctctttttttttcctttttgcaaagtgaaatgatgaaataccgaaacatttgttggttgtctcctccgcctcgagccaagacccacacctacacaagagaagagaagacgaaaagccaaacgcatcgccgccgatttccccaaatcggaaaccgcccctcctccgccgcgcggcgaccctcgcgtcccccagcgcagtcggcgccg

SEQ ID NO: 2432 - DNA, 2000 bp, Oryza sativa
  misc_feature (1050)..(1050): n = any nucleotide
  misc_feature (1183)..(1183): n = any nucleotide
actattgtagtgctcaccctgatgatacgatctatattggaatcaaaacaaaggaacatgagaatgtatgtccttttactgccagtattagcatattagtttaaaacagcagaacacacattaacttacaaatgaatcatactggtagcttcacgatcagaaaagtttcttatgtaccatcgtggtgagttaagctgcaaatcattcagtaatggtacaggcatcaatcaaatgttacagtacgttctcttctatagaagaaaggctataatatgaaaatgagtacgaaaaataacagagaaccatcaggggatatataagcagcacattgatctatatcacccatgtgtttcaaaatacagactaggcaaggctcaactgcctagcgtgttattcataggttgaagaaatcatactgcaaagcttgtattgaaaattaccatgtggatgcatatgttttttctcttgagaatagaagctgcttgcaactccatatgaccagcccaagtcccatcctcaagcatagagtcacaatatttctcaaacggttcctcgtcctcaatgaatggctcaaaatccacacggtgctcctgtaagatgcatacaagaaagattatgaagtgtaaataggccaatgcttgcttgcagcatgtcttttagataaaagaacaacccagcctggcagcctgtactctacgcccagatcagatgtacacagccaaagtttgcagcatgtgcaataccttattgattcaatggcaccctaattacagttcttaagtcacagtgttacaagatgtttcttggtcatagccaaagcttgcagtatttctaataccttattgattcaatggcaccctaactacagttattaagtcacagtgttacaagatgtttgttttggtcatctcatctgatgcataccttaatgtattgcacaatcattgcacggtacttcatgtgctcttcctcgttgccttcgagctggtcgcccattgccctgcagactacgatgagtaaccatataacacaagactgcataaggcatanactattccccctttcataaactaacggtactctaacatatcgtacaacatcgattagcctcttcttgtaaaaagtggcaagaatttgagtaatggaatcgaaaagaagacctaaagaagcagttgccatccgnactaacttcgataatcttaaaccccagcgagtccagctgcgcccggaactccgtcatgtcggccttcttcgcgaacttcttctcctcctaacaaatcaatcaccaaaggaaaaaaaaacgagaaaatatattagctaaagctcaattccccttccaccaaaaacgatccaatctccagctgactgaaggcccggggtattactgcatcacgcttcggcttccgggctttgggcgccgccacggctaccttcttcttgttccgagccattacgacacgtgcggtagtagtggagtctcgcctagatttccccgcggcggcggcggcggcgagggggaggggaggcggaatcgcagatagtatcaaatcgtactctaccagaagcccggagaagaaatcggatgggaaaaggaagaggagaagagaagagaagtcgtcaggtgatatttcgtgggccaaatgggccgggccgtaacacctcaatccccaatctgctacggcccgtgtgtgaacgtgacacgtcatcctatttagaatcgaataccgaacctgaacgtgacacgtcagatttaggagtagaaacgagtacactctacacgatacagatccaatacgagaccgacacgtcgtcagcgaccaagtaaaattcggtcacgaaccgtacgccaccaacctgtataaattcatcgaccgccaagcctctccagaacatagcacaagccaaccaaacaccgcacgatttcgtatccacacatacttctacgtgatttcgtttcgacgatctcgaggcgccgcggcgtgacgtgacgtcgacgacaa

SEQ ID NO: 2433 - DNA, 2000 bp, Oryza sativa
aaatattgaccaataggtaatacaagtaaacattctcctgagttaacccacaaaagtgggggctgaacaaaagttctattttaacatttccgtgttataatgcagatattagaacctttgaaattcttcttcgcacctatgaagtacgagaaggtggtttgaagggtgccacaaccaatgaagagtctaatgcagtgcctcttgctcagaaaaaaagaaaacttcttgctgctgcagaaactttagatgttaagcagaattcttctagtgttatggttaggccttgtagcactgctagaggacacactggctacctgacatttgcgaggcttcgtgtgcatggaaactaaactgatcctccatacaggtgagtaggtatacaagagtagggatcaaaattatgtcctgtttaagacctataaattgatacaaactgccaatttatttctacctagccacacttttattactcttttagcgtagtgcttttgtgttgagttgtaactgtttgctcttgctctgtaacttgatagggaaacttgtggactcacaccttcataatagaaggaaattgagtgtgcaaccccatgttcaggtattctctcaagattgatttggagatgatcattctttttctgaaatactgttatggccatttgctgccattgctgatagtcaacccaggttcacctgtactgaactgcatttacctgtacgtcgagctgtgggccttgcatttgttgtaatggtgtagaagtatttccccagagttcctttttaggagtacttgaggaagtattgggaggagtacttgaggaggtattgggaggtataagatgccatacttcctgaaggacagtaaaaacgctcttgtttaacctggccaagtgggctgggcatgtttggatttcacgtttccatgcgttgccagaaaaggaattcaaatatctatcttttttaataaatgtgttttcacaggttgccgaaaaaaggtgtggtatgtttctgtttgattgattagcaccgcctaacctctttttcctaaaccatgtaatacagttaatttaagtcctattggatgaaacaaataaaccagagcggtgaatgtacgaatatacttagacaaagtcaaataagagacatgttgccattgcataagtttaggtgatatcgccatccaagtgattgagtagttgatatagatcacacctaaaattctaaaatagactagttatgccattagcctccatgcacaagccataaataacttgactagatggccagctaattgattagtaaactatttatataggactgttgttttaaaaaaaatacagattttgttgtagtacatggcgactttttggtttacttcctgaacatcttaaaagtgaatatttggaggaacacactcttaaaaaaacatgattattcgctactttccagtcgcataaacctagacgttaattatgatgttttagactaggttgaagttaaacttttataattttgattataaatgacttcaaaaatacttagtttaaaggcactagaacaacaaatatagttgtatatatatcatagaaaaacatagtcaaagatatatttccgagactgttattgtgcaacacgtcaaggataccatggacattaaaatatatatttatgattaaataggagagtgtattcttcctacatcaaaattcgcacaaaaagagaactctaagttgcagtgtttccctatcaagtatcaatcgcgagctgcataacttatatagtgataaggagaaaccgatggggatttaaaggcttgatgcgatgacgctcttgcaggagaaaccgatggctctcccgcgtgtctcgcgtgacgctataaacaaaccgaatatacaatgcgagcaacgcagctataaaagttggcgaacgacatgtagcatgcattccaagcagagccagaacagtgcgtgacaccgtaatgccgccggagaagcaggacgcaa

SEQ ID NO: 2434 - DNA, 2000 bp, Oryza sativa
gcagctactgtaataagagcatgctctgcgttccatcagtattggctcgcgctgtttgcaacaataatttagagttcaagatgatgaagtcatgaaactaagttgccaatatacaaagatgtagtatcgttcatgctccttgccgttcatcccatcattattttggtgcactctcgcatggatactgtaaacttgaacttgcatggttatgtggcgatgacaagaggcacagccaaagttgctgcaaactgctacagctcggattggctgaaacttccgggggccgtttcgtcttgccgtggttaaactggtacagctcggtttggcctgaaaggctactgttcttcatgtgctcgagttcatgcctcccgtagatttatttatttttactatccccttgcccaacaaaaaccggagattttactataccaaaatgctaccctggtttcatgggaacgaaatggaaatggagattttggttaaagataagcagcaacattttacgattttctgaattgtgtgctatccaaaattggcttggcatccgtcgtttcctccatcgcagtaagagcatctccaagagactggctaaatggctctccaagctaaaatttagtgaacttgggcaaaaaatctactccaatagactagctaaatggttctccaagccatccggctggctaaattctccacctcactagccaaagttggccagctaggacggctggctatctggtgtgggtcccaccccctctctcctctctctctctctccccctttccccatcccatcccggctccttccctgcccgccgcatccatccgtccagtgctcgccgttgtcctcccggcgccgccgccgtcatcatccttccggctccgccaccaccgtcgtccgtggcgagatggcgcagcccatcgtctttccccgaccctccgggatctggagcggggcggcgacggcaacgacgacgacgagccagtccttcgcccgcacaatgccgtctccatcgacgcactccgcgccgccgacctcgaggcaatggcggcagggtggggtcagggcgacgactacgcggagtcccccgacgacgacagcacggaggacggcgcggagtccgccggcggcgacgacggcgcctcctccctccctccctccgctgcaagctccgcccaacctccctcctctgcagcggacgctccgctgccaccgacgccggccaccgcgcattgacgagacgccggccaccgcgcatcgcgtggacatcatcgagatggttgcagtgggagaagagaagaaggggagaaagaggaagaagaatagataatagaggctgacatgtgggccctaattgtcataggctcgtaatagagagggtagatggagaggctgttggagtgaggaatgagtttggtttgccaaatcaattggagagctggttatataggtgtttggagagtccgttttagagagtctgttggagatgctctaagccaaccagtcgatatcatcgccgtcatattcagcaatggacgatgactgatgatgactctcaagagaatgtgtttagtccaaaccctatgccgctgaatgttgatgctgttgatgcatgcacctgccgaaggccgagtttagttttaaactttttcttcaacttctaacttttctatcatattaatgtgtttagtccaaaccctatgccgctgaatgctgatgctgttgatgcatgcacctgccgaagaccgagtttagttttaaactttttttcaaattctaactttttcgttacatcgtttcaattataaccaaacttttctacatacacttccaacttttttcgttacatcgtttcaattataaccaaactttcctcgacacaattccaaagtgcacttctccacttcactcctcgtctcttgccgtcttttgtccgcaagtctcgtgctctcactctccaccttcttcttcccagcttctctcgtctcggctcaaggctctag

SEQ ID NO: 2435 - DNA, 2000 bp, Oryza sativa
cgtctccagcattgatctggcactttggcacacacatggtagatgatcttctccccgtcttatgttgtgtcgtcatccgaggtgcaacagcgatagggtacagagatatcatcgggcgtcttgtgtgccaagaagttgatataggagcgtccaaatctagctagatacaagcagcatgacatcaccaaccgctgttgtgccactggcagcgtgctagttgacgacatcggcaacggggcctggcttggggcatcacgcctacatccgaccttgactgctgccacctaacgtgtacttctaaataatgttttcatcgatattcaaggtcttccacaccaacctatagattggtgctatcttggttttgattgacaatatcgcttatgtccacatcttactcgttctctagatggacactatggatttgtgagtgtgtgcctatatattggtttgctcgcagcgcgattattgtagggtatcacgtctaaacaaggttataggttatggtgtttatggtcgattggattgtgctaatactgggaggcattatggcactagctcggaacaagagaataacaatactatgagacttcgcttaggtggtgctcgtcgagtaccgtttcctcaactcctaggttatgaatatccagatatcacctagtgtttttccctttgcaggttggctttttggctgaccctgtacatatttctcttgtatttctgctcctctattaatatacgaggcaaagcttttaccctcctttcaaaaaaatgaatatctggatttagccttagctagttataccgggcaaatagcagtttcctcttccttgttgggggtgttgtctagacttttaagaattgctctctacagtgaaaacctatggtttagtctttgttgatcggatcatgacaacatatgaacatacctgtgttcttatcttaggtgctattttaggggaaccttagtcgtagtccagtgttactttggtccacgacgaggaaccttttaaaaatctgttgtatataaattacaaatatatttgcataattatagaagtcaaaagttgtatgaaaaatccaattccaattatatataacccttcctatatagccccgttcacttctcagctgggccttttttacaggtacctttcagttgggccgagcctgatacagctccaggctgaactggccgaaattttccgggacgtcagatgcgaaacgaaaggacaggatcagaactcagaagctgactccaccgaccttccctgccaatgccggtgcgtccccctctcaaaaaggttccggcccaaactcgagcagatttgggtcctccctcctccgcctcctccgccgccgccccctgtatcccaccggctcgccggagagtccgcctcgccgccgcggcctcacgggcgcgtatccagcctcgcggagagcgtgcggaaccgcgacccgtactagggcagcgcgagagagaagctgctgcgcctgcgctgcaaaggtatggctgttactgttcttccgaggggtctctaaatttccggcgattcgaagcttctaaagcatcccggatactgtatcctgtaggctgtaggtagattccgacagtggaagcgttagccgtccccttgcgctccgctgccaattggtagtctcagaatgtgtagatgcagcgtctgcttggggaatagggatgctccctatttgcgctagcctgataggacggcacttcagttgcaatctgatatcctgcttagtgcagaaaagccaaacatggcatgtgaagcgtagaaaatcagaagtaattttgtaacttctcttgctaggtctacagttggagctcttgctgctgcttggaagacttcggacaagaacctaagatcatggtgagttcataaattcacttcaggtcctgttaagtaaccatgtgcaagtttgtttactttgacattcggttctgttcaggtatgtttcttctgttctgtggtcatgtg

SEQ ID NO: 2436 - DNA, 2000 bp, Oryza sativa
taagacagttgcagggcttgatgcgtcagggagtgtggtgaggaaccagcttgcacagaacattgtacaggagggtagttccagtgtgatttcaaggacaccatgtcaggagctaccgctctcaattaggttgacggaccaacaaaacgagcatcaccttgtgaatggttcgtctaattctgagaacttagtgaaggtacctccatctcagggtggccaggtaactggtgccaagaagcgtaaatctggaaatgtgaggaggtttgagcagaataaaccaacacaaggacaaggagaatgtggagcattagtggtggctgaggatgttggttccactgaaggagaaactggcgataagaaaaagacagagggctgtcctaaccgagttcatatcaccaagatcatcaagccagtgcgatttgcagcagctgtgaacaacgatgtgcagcaagtttcaattacattcaaagcactcaggtattttctgtaatttcttttcgtagttataggcctaaaatttctaaatctcagacatgttttttttgctagctgatattgctccctttctgactacttttattacaaaaaggaaagtgactatatctagcaatgaattattatttggctacaaattgagtgctttatgtttcactcatttagagatgtcgcaaaaagaatcctctggtctcttcactaatcaaataatatattctgcatttttttatgaccatttttatgtagttattcatattgttagtttgatatgtttgaactgtttttctaaccaagtgtttcgacaggtctgatgggcaggaagtcatggtggacgacaaagtaattgaaagcaaataatcccttgctggtacatcccattgtcttctcctattacttggatgatgagggaaacatctaacgccaaaatgctctcatgttttttttccagcttattagctactacgagccagtgccttcgttataatccgacttcgtgagagatgaactgaaggaactgggtttagctgcctgtgtatttaattagcatttgtgtgtttagaagcttgtagctctatgggcttgataatttagtctggtcttgcagtaggttgctaaatgcaagaaatgtattgcttggtctccccactgattgcttattcgcgccatcttatgtgtaacattttgaacagtggggagatatgtgtaatctatgcttagggatcttatgtttcttttctctatgtttagttatttgggatcgtcgtgacctgcatgcatcttttctctatgtttagttatttgggatcgtcgtgacctgcatgcatcatagacggtaatgactgagaagctcgtgaatttcgtgtgatgaatgcatatccagtagaactgaataaactgcgtaatgttcgttctctgtggatctgtgatgttggcgggtcaagcttgaggtctatactggagactatttcagactgtttaactggttttcttcagagtcccttctcatttcttccgcttgatacttgtcttgttcaattgacacgcttcaacatttgcaacttgtcttgtactttttaaaatgtgcttgttgtcatgttacgatttatctttgtgatttctgaaggccttacccgagtcataactcataaatacaacgaaaaaaaacagatgatttgggccatttggcccatagctatgtcatgtggtgattcctttttggaataagttcatctaggtcccttatcaacgaatccgattttcgtccttcaatcgaaaagataccctggtcctcaactattaaaaccggtgtagatgaggtccctcggtggtttagatggtggttttggctgacgtgacgcctgcgtggctaatttgactcaatcttcgtctgacgtggcattgacatgacgcttacctggtaacttgatccgaaaaaataataaaactcgtgggacccacatgtcagtttcacatacaaaataataaaaaacaatggtgggacccac

SEQ ID NO: 2437 - DNA, 2000 bp, Oryza sativa
  misc_feature (421)..(421): n = any nucleotide
  misc_feature (452)..(452): n = any nucleotide
  misc_feature (454)..(455): n = any nucleotide
  misc_feature (465)..(465): n = any nucleotide
gcaaacaacgcctcctttccgtcgccgggtcgtcccctgggagagaggcgcgacccctagcagaggaacgcgcgcctcggctgcttttttggagccaccgctcagggctacgtgttggaggagggcgtggctcgtggacacgactcccgctctacaaatttccccttccaccctcggtctcgtcgctggcagtggggatgagtcggaggcgacggcgacggcgacgacaagcgacggccgccaccatctcctccccgatctggccggggcggggagggggggcagatccgcccgctagggcgccggatctaccgtccccgaccggcgacggcgcgaggcggaggagatcggggaggcggacggtgcaaggcgaaggagagcgcgcgaagcggaggaggcggatggcgacgacgtgtcggcnaccccgggcccttacgccgctcgctgtcgancnngggattcccntgcgcggccctccgtcggtcatcgcacggagacgggcggcggcggtgggagcggcctcacgacgagagggagaggcgacggcggcggagggaggcggccctcgcggccgccggcgacagtgagcgggctcgcggcgagagggagaggcggggaagcgaggacgggcggcgacgggagaacgggagagagggagacgagaacgggagagatgggagtaaagggggggggagagagaagaagagaagggtggtatagtaaaataaaataactacgtcgaaaatacttctaatcggccgtccgatccgaacataaaaatcggatggctcttgactgccttctctaacactcgtgaccgcacatcagcacatgcgctgcataccacctttgccagtgacttgctactgcatactccttgcttgcatgcattcatttaacattattcagaacgatttttttcctaaattacttatccaatctataatccgatcacaccattgtattcgttgtaattaaatctttataacaaaatgtcatgattatattctaataaaaaatagtcatatgtttcaatctgttaacattcttgatttcatacgtaatagcgatatgtttcaatgtgtgtcttcaacatgtttcacaaaatttccaaaactaactgcaccactctctctccacctcatccatacatgcatgcatgcattttaacaagtttcaaaatatttttttctcctaaactaattatccaatctacaatccgatcacaccgttgtattctttgtaattaaatctttacaacaagatatcacatgattatatttcgatgaaagaaaaacatatgtttcaattcattaacattggttgttgcatatgtgatagcgatatgtttcaacgtgtatcttcatcatgtttcataaactttttaaatgtttcagttgctgattttttttgtttcacactaaataacttgatgtttcactcgttagttacctggaacatttaactgactgatttttttttcatgctgcatactcaagtggtgtaatgacgcgcagcgtccgatatttggtggaatatcggacgtccgacgcggagtcttgtgggctttctgggttagggacactcgttaagctaccagtgatatccttcattgtggggagtttccctacgagtgtcctcagttagtaaaaacactctagaaatggctcacattgtagatgccatcactgcctcaccaccttatattagtcacgtttgacggatcagtagcccaccgctaaccactctcgcctcctcccccgtctgtactgactactgagatggaagcgagcaagtgaaagagagagattcctggcttcctgcctcacgcgcacgcacaccaacctcaagccatcgggctctctcaccccgcacttctcccaccgccaccgaggcacggctctcgaaccttcccactgcttcctccctccctcccctcccctccccgcgacgagacgagacgagaccggcggcggcggccggagtcaagagccttccct

SEQ ID NO: 2438 - DNA, 2000 bp, Oryza sativa
  misc_feature (724)..(725): n = any nucleotide
  misc_feature (733)..(733): n = any nucleotide
  misc_feature (738)..(738): n = any nucleotide
  misc_feature (750)..(750): n = any nucleotide
  misc_feature (782)..(782): n = any nucleotide
  misc_feature (784)..(784): n = any nucleotide
  misc_feature (786)..(786): n = any nucleotide
  misc_feature (806)..(806): n = any nucleotide
  misc_feature (821)..(821): n = any nucleotide
atgacggagtacatttgcggttcccttaatatttgtatcaaccactgtatcaaactcttccgctggaacgctccatgtcttgttattcttgtttattgtaccagcgttgtttactgccacaaacctcaacggttaagacttcttgaaagattgctttaatgtatattgtgaaatggcgtacaaatatgtgattccacaatctattccaataaagagaacagattatgatcatctactaccaaatagcctgtatttgccttcgagcagaaaatgtaaccaacctatgatatcaggaacttgtttcttttccacaactgcctttgccaactcggccatgttgctgtcagacctctacaacagaagcacaaaacattacttgagaactcaaaactgttaaaaagagtaagataatagaacataggcaacttatattaggcgttgttctgacaaacaaagaattaaaagcaccattgataagctattctattggcatccataccatgttgtattgtttcaacccgattcactcaagatcaataaaacaataaatcgtgaacaaatttagcatagtccagtcaactcatagcacaattctcaatcaggaaagcaacaaattctcaatcagcagagccccatcggcttctagttcacgattaagccgctatatgactgctactacggtagcggaattcgatatctccagcgagcaaaaaaaaaaaaaccnngctctagngttcnctcgctatccangcacagcccgactgcaagcaccacggcgaaancntngaaaagggttgaggggggtnaagtgaggttaccangtcggcgacggtgaggaagtggcgggccggggtggcgatctcggcctcgagggagcggacgtggtcggcggagcggccgcagccgacgacggcgtggccccgccgcgcgagctccagcgcgagcgcgcggcccagccccctgctgacccccgtgatgagcaccgtcctcggccccgccgccgccgccctcgccgctgccacgccgccgccgccgcccttggaccccgccgtcatctcctcctctcgtcttgcgcgtggaggcggaggcttcggtgtccagatattttttcgcttctctcgtgggccggaatcccagcccacgtaaggcccggctacgtacggtcgatccggcccggcccatacacccgccgccgccgctatctcacacgtctcgcctctctccgcttcggcgcttggtggcgtggttttggggttccagaaccttctcgatccctcctccccctctccgcctccgcctccgccctcctccgctccgatcgccgccggctcgtcgccggtaacgtaaacgagtcctcatcctccctctcttctctcttcctctgtagctctctcgattcgtttgccctctttttttttatttttgccgtagtaggcggtctatttcttgtgttggtgagatgctgtgatttctttgggatgttgtgctaactcgagaagaaggagacacagtttattgtgggtggattggattggattgctgctttagcaattttgattttgttggtgctcctagacctactactatccaatccaagaactagatgtgcaaagacgggacgtagtcgttttgccggcggattaggatgagagctattagtttgttttaactaggttaattgtactatccctaggacgatattggatggctttgaactttcaaagttatgacataatcaatattcttggtgatttgtgtgatgtggtttttgttgccatattaccatgtagtaggagtacaataaggtccgcatatttcttctcttttctttgcggatagtcggcattttcttcttccaatgtgcctatattaacttaaaccctactgttgcagctggctaattttcgttgttcctcggttgctttatttttgctcctatttttttttgttcatttctgcatttagatgacctagtcaatgtatggttcaggtttcataag

SEQ ID NO: 2439 - DNA, 2000 bp, Oryza sativa
  misc_feature (1651)..(1651): n = any nucleotide
  misc_feature (1838)..(1838): n = any nucleotide
  misc_feature (1840)..(1840): n = any nucleotide
aataggaaaaatataggattctgataggaatacaagtgtaaaacagaggaatgcaaaacacaggaaaaacatagaaatgaccgtttgattgagccgcaggaaaaacacaggaatttgataagagataaagactcagggcttattcggaatgcaggattgaaaaaatataggaataggaaaaatatagaaataggataggaatgtaagtataaaacagaggatttgaaatatatagtaatttcatgcgaataggtgtggatggagtaaaggaaaaacataggaatctttagaagaaaatagatgcactattacaaaattatcacatactactaatgtgctttagttgattgatggcatgatttggctcgttcccacgagaagggagagaaaaaagaggtcaacgtggatgtttttcttcctgtgatcttccagtgatatgactagcgcaggaaatttccctatgtatttcctacaaacgtttttctgtgatccgaatgacgccacagtaaagcaatccataggaacccaaatccttcatttttcatgtgtttctcctccattccgaataagccctcaaaggattattaacatgaggtagaacctcatgttaaatttccttcaaaacttatataggaagagacatttcataggaatccataggattcattcctttgattcaaagggctatataggaaaaattcccataggaataaaatcctttaaaatttctataaatttcctttaaatcaaatggggccttataatatgaaacggatgaagtgggattttaatcctatgaaattcttttataattaatttctttgattcaaaggagcttttaatgtagtattgctgcattttaccccatttctctccaaatttcaaactaaaccccaaaagtctcccaaccaaaattcttgtggcaaacatgcccagaaccagaaaggcccagaaacctgcactgcatgcattcatggcgagaggtcgagcacagcgcaggcgccacacatcgcatcgcatcacatgccatgccatgccatgccatgccaccacgtttaccacccccaccgcatcagtgtgcatgagcaagtttaatagtatagccaactaatatatctaaatcatctatagctaatgtaatagctaattcatataatacctggtctcatctatcatacacacatttcgtcttggagtccgtgctactgctggcgacagaatcgtagtccgctgctattctctttttctttatctatttaaaatatgtttataactggcttatagcctgctatatctgctctgaccccaccaccacaaccccaaacccgtcctcctcccgctccggctcacattaatgacgccatgcgtccggcccccacgttacagggcgctgcatgctacagcatccgtttccgtgccaaccctgcatgcgtgtctcagatatgtgtgatctcgcacagccccacggctgcaattgcaaactggggggatttgcatatgcaactacactatgcaatgcaaagcagagtacgcgacatcgatctgtatcgatccgcagctagcgggtggccgctagtccattattacttcacctgcatcgttagttcctattgttcccaccgagccacatgccagatacagtagtaccccnaccccggttgtactgtacttcaggcccattgaaaccgattcttcatccatcatggcgtccatgtagtaaacccaagcccaattacgagaccatcataccactgtactcctactagtattatccatccatccattgcgtagaagccacttacgaggtaatcatggccatgcgatagcatgctggcgtntnggggcgaggcaggcaggcaggcgcggctttcttgggcgtaggtttaccggctttggggttcgatggggtttcgtttcggctcggtttacggtgcggtgtgtgtatagcggccgccatgtgggggcccggcaaaaagggcatcacgagggggcgccggtgg

SEQ ID NO: 2440 - DNA, 2000 bp, Oryza sativa
  misc_feature (1736)..(1736): n = any nucleotide
  misc_feature (1743)..(1743): n = any nucleotide
gaggaagacaacgagcgagggcatctaattgctgccggcttgagaaggagggcgtggcgaataaggcccaccgaggcaagggggtcgctggcaccattggcgacttctagccaagcgcgaggtcgagcagtggacgggcatgctgatggaactaggactctaggagcgaggaggggggagaggtggggttagagttagagtactatacaaatctcaaagcaatcggatggtgcaaaatttataagattttcttggagtgtttttgtgtgaaatgcaaataaattatcccttttttaagtaggataaccaattgattatccatggattccatggatgatctatactactattaaaagatagtattggtggtggtgagtctgccaccagcaccatcacttacatgtggcccatgatattaggattttgggcagtcgtttatattatgtagactgcagatctttaattttctaagcatgatatttttgtttgtttcttttagatgaaaggttgtgtttcaaccaattaaaaatatagttttttttaaccaggacttaatattgctattttcaatactgttgcaacgcacaggcatttggctagtatagtaataaatatataaaaaggcattaaaatgttgttttaagagtaatattggagacaaacaaaaaagggtttgttggaactatgccaccctatatttgcaaaatttgagatataccacccgtatctccgacatgtaggacccacatgagtcaatgacatgtggaccagggtggcatatcacaaatttcgcaaaatttgtgtggcatggttcaaattgtcccaacaaaaaatgtgtaacatagaccaaaagagactccatgtattataacatcataggagatgcaaagatactctatacattataatatcgtaagatcaaagtactctatatattataacatcgtaagagatgcaaatagacgagcacatcacattgactactctaatatatgcatgatcatattgacaagaattggtaagcagagttgtcaagggatgtcatcccgacgtcaacacgatggcctactactagagaggaggaagaaatagatctagcctattgcttgttttcaatttttgatggttcaactcaacgtattagatgtttcactagttaggtaaaaaatgttgcagtgattttttttggtattctttttgccgaaatcattcggatctactgatgtttcagtggtccaaaaccgatgtgtcatatgttgtaccaaaatgtttcaagtgtaagttgattgtgtttcatcgtttagattgttgatgttcaaaagttgagacatttttgttcgaggaatgaaaccttttttttctaaaatgataaaacatgcggaacactttgcaacattttacgtctgatctgtagtcgccaccgtaaattataaattaggttaaaaagtgagctactcctataaattagttcaggaattactctcatatatacatagccctctaatattggtcggatggaatgttagattttcttttacctcaccgcctcaccggtaaacgagtcaccggctatcctggccgggcaccccggtctaaaaggcccaatcccatatgtggaacaccgaacgtccctttggacggaccagattgctccgacctcaccgtctctcttctttctccccaatccctatagctctcgcttcgtcaaattctccggcgtttccagttcaaaaatnaaaaatnaaaaatctccggcgcaaatcctcctctccgccgccgccgcctccacctccaccgctcgccccctcgccgcgcctccactcctcacaccacgctcctcctgacctcctccctcgcgcttctccggcggcgcctcgctcctctgcgcggaccgttgcccctggccgagcgcggcgcggcgcgggccgcccgcggggggatcgggctcgggtagaggcgggcgacctggcgggggaagtaaggggtcgcgcgtggcgggg

SEQ ID NO: 2441 - DNA, 1804 bp, Oryza sativa
  misc_feature (8)..(8): n = any nucleotide
  misc_feature (22)..(22): n = any nucleotide
  misc_feature (37)..(37): n = any nucleotide
  misc_feature (41)..(41): n = any nucleotide
aattttgnataaattaaatccnataccacccccgtcnatgnttttccatccttcccgtcacactttccgtccttcccgtcgctctttccaggaggctgagggcacggaggctggcgttgtgggcggcagacggcggagccgccgggtcaaggaggcggagcggcggatttgccggcggacggagacgacgggtcgaggaggcggagcggtggagttgccggccggcgtcgtcctccgctcctcgctgccgacccgctcctcacccgctacggcgccgtcgtggtggacgacgcgcacgacgggatggctctcaccggcgtcattctcagttagtcggcccattcatcttgaagaaacagcaaccagtcatatccaatttccatcccagtccgtcgtcccctagctgccggcatgccagccacaagcaaccctcgtcatgctgcatcaaatagcaacctcgtcgtcgatctgcatcatcaagcaacaacagccgtttcggcatctagtggttgacattcacccagcagaagcccggccggatttggcgctggatgcggtgctcgttgaagccgcccgtcacgtacggcgcctcttcccgtccccatcgcatcgctcatcctcaccgtctcctcgtcctcatcgtcaattgcggtaacctcatccaagtcatcgcccgtcgtggcccatcgtctacaagcagcaacaagccagcttcattccggcggtggcggcgggctgaaccacggtggccgtggctttgtgctgctgatgctgcgccgcaagctgctctcaaccacgcgtcccctcccatggaactcgtcgacagactgcaggcacttggccgtgtcctcctcggcagacggcagaccaggcacttggtcgaggtcctcgagtccgcaaaaacgcgcgtgccggtcttgacggcggcgccgcggcggagtgggccggcgcgggacgagttgaggaggccgaagtcgaggccagagaccatcccccgagaggcgctggtcgtcgagttcggcggtgctttcaacggcgaagtagaaagacggcacgtagttaggaaattaacgggggaaggacggaacatgcgacggggtggtatggatccaatttaccaaaattttagtggcacctagccgatatcacgaatagtaatagcgttttattaatttgccacatttgcagtggcatggatgcaattaaccccattttcaatcgcgcgtccctcaagcggtaaaacaggactccgtaggtagtcaaacggcctggaaactaaccagtgcagaatcgcaggataccataacctgaataaatcatacacacaaaccggaaaaaagaataaagaaagaaagaggataaatggtagccaatttgtgttagggcgcagcagccagagccgaaagcttctgaagctgatgcgatcaaacctcaaaagaccatgggcagccagcacggaagttacaaaccgaagccgcgcggcgcgcatacgcatcagaaaggcgcgcaataacggaccacccatacggcggccgcgctctgttcgcggcgtccctgcgcctgcatcgcacgccatccaaggctgcatagcacgacgcatacatatctcacgcgccctttttatctgcttataaatgagatagcccacatagcagcgctgccgtttctcctcttctctcgttgggggcaaccgaacttatccaacaacgatccatccattggccaagtggctgccgtgctgcacctataaattcacatgcaccggcatgccactccacacaactcagctactcgaaagaagcag

SEQ ID NO: 2442 - DNA, 2000 bp, Oryza sativa
  misc_feature (517)..(517): n = any nucleotide
  misc_feature (519)..(520): n = any nucleotide
  misc_feature (522)..(523): n = any nucleotide
  misc_feature (542)..(542): n = any nucleotide
  misc_feature (785)..(785): n = any nucleotide
  misc_feature (795)..(795): n = any nucleotide
  misc_feature (808)..(808): n = any nucleotide
taagtctaatttgcctccatcaaggggagaggtgagagaagatatgatggatgaagacactggcacgtgggattcacatgttgacttagctagtcaacggggtcaaagttcccacatcgaacgaaacgcctccgaaaccagcgaaggagacgatttgcaccggtttttaaaaatagaggagatgataaaccaagttttacagttgagggatacgattcagagcaagagttgagaaatgcaaaatatacttattctatctcctcaagccgagcggtactctctataggtggccaaatgggccaggccgagatatgccggcccgggcacgatagcactgtagccggcctaggcacgacaaggcatggcccaagtacgaacatgacccgtcggctcacaaaatttttcccatttgccctaatattttcatatattctgtctattttctctcattttcctcaattttccatatgttgttttctatctcccatttacatcattttcccccatattttactgntnncnnctttacttttcccttttcnattccttttcacatttttcttttttggccctcatattcaaattttgtgggccaaacgtcctaatgggcctacaccagcccacgtgccatatttgggcccgttccggcacgcacggcccgtggcctcctgggccgtgcttgtgccgaggccttagcacgtaggtaggccggcggcccatttggccacctataagtactctccgacaacctctcggcccttctgccacaaattctcaccgacatnaaaaaaaccnaaaaaaaaaaagnaaaatcagaatcgaattttgccctcagaacgaaacgcctcgtctccccttccaggcgattagggtttcgcccatcttccggaggcgcgccttgccgccgccaccgcggcgatcccgctccgtcccctgcaaccgacctcccgctcgaccagggccgtcaagccttcatccacgcgcgagcggcgtcgcgtaggcggggggtccgagcgagcgctgagcgaggcgtccggaggggatcgatccatcccgctctagggttcgcgagcgtctcgcgtgtgagtctctcttatctaatcctctcaatctcaatctgtctaggctgtagatttatgtaccaccctgttgctagtttttgtgtcccgtttaggtgcttgaaattagtgatagatcctttaggggtggaatcgaatcatgtaggtaacagcggaatttctggtgaaatttggatggttggtggtaggctatcaacgaggttatctaatttttttgttcagctagctagaattgagggaactgtgcagcatcgagatgtggaaggtttaattgttttaggaagagtaaatgaaaaatcacatcgtcccattgggatgcagtctagggcagacaagcttgtacaaaagttcaaagtgttgcaatagctcgtttcgttggcgcgaaacaattaaaacatgcacagaccgctggcaatgtggtcaatttggctgattcggctgccagctcagcaagcatgcaaggggtgggcacgaaagatttagaaacttggaaaagcctccctacattcctgttccgtgccatatgtgcgccatttgtgcgggctgttttggctacacgacacgccagagtgagtagtaatcagactctgggtcaacctaattaatgctacaatttccattggtttaggtatataggtaggctatgctgtcattactggtttgatctactgatattgcaatttcatctcatgtgtaacatgagaaatgggatttagctatttcaggttcaggctagtttacatgtgattaattggtgtctaatgaaacagaagatcagcagacatacacccaatagctatagccatagctttagcctgtagaatattctgcaaaataggttccttatgtttcaattacgttaaggttgatcaaactaacagtaccttttgtgcttttgttcaggtttgcattcgctgaaag

SEQ ID NO: 2443 - DNA, 86 bp, Oryza sativa
  misc_feature (25)..(25): n = any nucleotide
  misc_feature (28)..(28): n = any nucleotide
tttgtatatgccgattgcaaacgtncgnaatgggtgtgtgtgtgtgtgtatacaagttttcagacttttagacgactgaagcaagc

SEQ ID NO: 2444 - DNA, 2000 bp, Oryza sativa
  misc_feature (58)..(58): n = any nucleotide
atggaagtttactaataggatatatgcttgataatccacatatttactttatagttgnttccctttatagcatttactgctttatggtgaagttaacgagtaccacatccacattattgtaataattaatggatctgtgcatcacatgatgcaaggatttttattccattatctaaaaaataaattttgtatatacaaatcgatgaagttaattattgcattcaattgcattaaaatagtaggcttagaataactttttagaatatttcaaacacttgaaattgggacaattttacacatataagtagcgccacgttgttacataagcctatatgcatcaaaagccttaattttgataagatacctaatggacaattgaaacttaggcgttatcagttttgaaatattctaaaacctagctaggggcacataaatgaaacattaatattgaactcattcacttgatccattactcaacgcacttctcacctgttgagtaatgatcttaattaaatgagcccctctaaagtttgaggcaaattaattaacacattttgttcatcatctccgagctatatgtatcctcatgaaactgatctgctggtcattgaatcaaattaactttaatagataactaatgatttctcttcttttacccatagtttttagccaaccccaaatactttatcattgatgcttcacatgacatgatcaatcccgcaggttagatcaattgcatcagagtttatatgtttgttaaaaccttgctcaattagtacgtataagatagagtaaaacagttggactctatatatcacattaactctactttaaaagaagaaaataaattacccgtgaaacgacaaagggctggttaattagtagcacatgttaacaacaggtatgtacctcgattattttaggaaaaaaaagaatgcaaggttaattttgaataatattagagtaaatatattaataggaaggaggtagtgtgtacctcaatcgctcatgcttttaggtgaggggtcatcatcaattatgtttcttctaggaatgaacaaacaaagagagatcaagccggcctgcaccaaatatattaccttttcaattctgacactctcacaaaaagtattaccagaatggcgacatgctctgaccactgcgctaatgtatgaccagcaaccctggttaaattactgtcaattttggatctttcaccagcaggcacacagtgtgactttctgagcacagtgacgattattaattatcatatggtccttgcagtgataaataatggtcaactgcttgtcactttctctgtgtccacaagtggtgaatatggtaaacttgtatcatatatatctgtctttactgtccttagcaatgttttgtccttgactacttctgattaagggcttacgcgtaacgtaccctaatttgcattttacagccaaccaagcttaataagcaacagaatcaaactgtagcttgtttggtcaaatcaaaaccagtgatctcgatcagctaatcaatttgacatctgaacttatcttttagaaatagctcacaatcaagtcactatagctgcctacaagctttttgttgctcttatatatgcgtacggcggctgccctcttgcagttgcaccttgcaaccttcatcaaataaacaagaagctaggtcgaactacacctcaaaaacaattcttttgagtgcacatacacatatggcatcagatccctcctccggccacactaatttctaccgatttgttcgccggtggctggcaaatccgctaggtcaccaccagcaccatcatctccggcgaagcaccagtactgggatctcatcatcaacctaccctaggatcatcccaagatgcccatcatcatcatcatcggcgcaagaccgggatcgccttcgagacaagacgatgatcctagatgtagaaggagggatcctaatgtcatcttctaccttcccttacttcatgcttgtgg

SEQ ID NO: 2445 - DNA, 1462 bp, Oryza sativa
  misc_feature (467)..(467): n = any nucleotide
  misc_feature (557)..(557): n = any nucleotide
  misc_feature (568)..(568): n = any nucleotide
  misc_feature (572)..(572): n = any nucleotide
  misc_feature (615)..(615): n = any nucleotide
tctgtcattcacacataaatatattgtgagacccactaacatatggggccacatgtcatctttctccttcccttcttcctcctccctctctctcccttcttcctcttttctcttccccttcgacgcaccccgggagcgggagccgaatcagcggcgacggcaggcgagggccggagtggcgacgacggcgacacaaatgcagatcggcctctccgccagccgacaccgcgcgcagctgctcatcttcgtgtaggggagaggggagaggaggtggcggaggacatggcgacgggatagaggataccgtcagcggcggtaacatgagagcggttggtgaagtggagaggcagcgcggcggggcgaggaagctgcggcggtgaggaaggcacaaggagcggctggggggaggtggcggcggccggcgcggacggggagagagagagagggggtggatggggctgaggtcnccggcgaggtggcgcggacatcctgaagtggagaggctgggtccttcctctcgagcgacggtggagagagagagagagagagaggggggnccccccccatnttcnccaccaccaccaccccctttcccactaatccccctgcccttcnctctacccttctccaccgtcgccgccatcaccggatcgtgacgacggtgccgcgccctccaccactgttccggcccctcacaccaccacctccgctccagcgcgcacactcccgcccgtcgccgccgtcgccaagcccgacccctctcttcctctcgcatgcaacgccggcccccaggagggagagggagagggggccgccaccgtcgccgccaccactccacccggccttcgcgccggtcttctccaccgccgccgccatcactggatctggatgagaagaggaggagggacggccgcagtccactgctaccgacgcgcacgcgccccccggtgccgcccaagccgtcgccccatcggtcaatgaaaaaaagagcccacatgccagtcctgatctgactgagctcacgatggcccactgtcagctatctatttctcaccatcctcagttgagttagcagtgttgaccacggtcaaggtgccacgtcatcggataccgcccacaatactgccttcggagtcgatttgtaccggttttactaaatgggggagtcgtcttacccggttttctagttaagggtcacgaattagattcggtgaacaattaagggagtctaagtggactttttccttactgcttaattatactcacggcccatttccaaaaagttgcgctcttttgggccagaggcctattcccacttgacttccgctcctcttcctccagcttcgagagaaatctccgaacccgccgcggcgcacaccggaatccaccgccgacgctccggcgccaccgagggagggggtgaggaacgcgggggagaagcgtcgtaggcgaggtgccggcg

SEQ ID NO: 2446 - DNA, 873 bp, Oryza sativa
  misc_feature (10)..(10): n = any nucleotide
  misc_feature (12)..(12): n = any nucleotide
  misc_feature (34)..(34): n = any nucleotide
  misc_feature (43)..(43): n = any nucleotide
  misc_feature (47)..(47): n = any nucleotide
  misc_feature (66)..(67): n = any nucleotide
  misc_feature (70)..(70): n = any nucleotide
  misc_feature (73)..(73): n = any nucleotide
  misc_feature (76)..(76): n = any nucleotide
  misc_feature (80)..(80): n = any nucleotide
  misc_feature (82)..(82): n = any nucleotide
  misc_feature (88)..(88): n = any nucleotide
  misc_feature (98)..(98): n = any nucleotide
  misc_feature (114)..(114): n = any nucleotide
  misc_feature (121)..(121): n = any nucleotide
  misc_feature (123)..(123): n = any nucleotide
  misc_feature (129)..(129): n = any nucleotide
  misc_feature (134)..(134): n = any nucleotide
  misc_feature (137)..(140): n = any nucleotide
  misc_feature (142)..(142): n = any nucleotide
  misc_feature (159)..(159): n = any nucleotide
  misc_feature (165)..(165): n = any nucleotide
  misc_feature (170)..(170): n = any nucleotide
  misc_feature (176)..(176): n = any nucleotide
  misc_feature (179)..(179): n = any nucleotide
  misc_feature (184)..(184): n = any nucleotide
  misc_feature (188)..(188): n = any nucleotide
  misc_feature (191)..(191): n = any nucleotide
  misc_feature (195)..(195): n = any nucleotide
  misc_feature (197)..(197): n = any nucleotide
  misc_feature (204)..(204): n = any nucleotide
  misc_feature (208)..(208): n = any nucleotide
  misc_feature (214)..(214): n = any nucleotide
  misc_feature (218)..(218): n = any nucleotide
  misc_feature (220)..(221): n = any nucleotide
  misc_feature (223)..(223): n = any nucleotide
  misc_feature (226)..(227): n = any nucleotide
  misc_feature (229)..(230): n = any nucleotide
  misc_feature (237)..(237): n = any nucleotide
  misc_feature (244)..(244): n = any nucleotide
  misc_feature (249)..(249): n = any nucleotide
  misc_feature (259)..(259): n = any nucleotide
  misc_feature (269)..(269): n = any nucleotide
  misc_feature (271)..(271): n = any nucleotide
  misc_feature (276)..(276): n = any nucleotide
  misc_feature (282)..(282): n = any nucleotide
  misc_feature (294)..(294): n = any nucleotide
  misc_feature (296)..(296): n = any nucleotide
  misc_feature (302)..(302): n = any nucleotide
  misc_feature (304)..(305): n = any nucleotide
  misc_feature (312)..(312): n = any nucleotide
  misc_feature (315)..(315): n = any nucleotide
  misc_feature (317)..(317): n = any nucleotide
  misc_feature (320)..(320): n = any nucleotide
  misc_feature (327)..(327): n = any nucleotide
  misc_feature (331)..(332): n = any nucleotide
  misc_feature (337)..(337): n = any nucleotide
  misc_feature (339)..(339): n = any nucleotide
  misc_feature (349)..(349): n = any nucleotide
  misc_feature (360)..(361): n = any nucleotide
  misc_feature (363)..(363): n = any nucleotide
  misc_feature (367)..(367): n = any nucleotide
  misc_feature (375)..(375): n = any nucleotide
  misc_feature (384)..(386): n = any nucleotide
  misc_feature (388)..(388): n = any nucleotide
  misc_feature (395)..(396): n = any nucleotide
  misc_feature (402)..(402): n = any nucleotide
  misc_feature (406)..(406): n = any nucleotide
  misc_feature (426)..(426): n = any nucleotide
  misc_feature (430)..(430): n = any nucleotide
  misc_feature (432)..(432): n = any nucleotide
  misc_feature (434)..(435): n = any nucleotide
  misc_feature (439)..(439): n = any nucleotide
  misc_feature (441)..(442): n = any nucleotide
  misc_feature (445)..(445): n = any nucleotide
  misc_feature (449)..(450): n = any nucleotide
  misc_feature (453)..(453): n = any nucleotide
  misc_feature (457)..(457): n = any nucleotide
  misc_feature (459)..(459): n = any nucleotide
  misc_feature (463)..(463): n = any nucleotide
  misc_feature (466)..(466): n = any nucleotide
  misc_feature (481)..(481): n = any nucleotide
  misc_feature (486)..(486): n = any nucleotide
  misc_feature (493)..(493): n = any nucleotide
  misc_feature (495)..(495): n = any nucleotide
  misc_feature (499)..(499): n = any nucleotide
  misc_feature (508)..(508): n = any nucleotide
  misc_feature (512)..(512): n = any nucleotide
  misc_feature (515)..(515): n = any nucleotide
  misc_feature (517)..(520): n = any nucleotide
  misc_feature (522)..(522): n = any nucleotide
  misc_feature (527)..(527): n = any nucleotide
  misc_feature (532)..(533): n = any nucleotide
  misc_feature (544)..(544): n = any nucleotide
  misc_feature (552)..(552): n = any nucleotide
  misc_feature (555)..(555): n = any nucleotide
  misc_feature (561)..(561): n = any nucleotide
  misc_feature (570)..(570): n = any nucleotide
  misc_feature (573)..(573): n = any nucleotide
  misc_feature (582)..(583): n = any nucleotide
  misc_feature (594)..(594): n = any nucleotide
  misc_feature (602)..(602): n = any nucleotide
  misc_feature (615)..(615): n = any nucleotide
  misc_feature (629)..(629): n = any nucleotide
  misc_feature (634)..(634): n = any nucleotide
  misc_feature (649)..(649): n = any nucleotide
  misc_feature (656)..(656): n = any nucleotide
  misc_feature (663)..(663): n = any nucleotide
  misc_feature (682)..(682): n = any nucleotide
  misc_feature (710)..(710): n = any nucleotide
  misc_feature (715)..(716): n = any nucleotide
  misc_feature (718)..(718): n = any nucleotide
  misc_feature (728)..(728): n = any nucleotide
  misc_feature (736)..(736): n = any nucleotide
  misc_feature (759)..(759): n = any nucleotide
  misc_feature (774)..(774): n = any nucleotide
  misc_feature (806)..(806): n = any nucleotide
aaaaaaaaananaaaaaaaaaaaaaaaaaaaaanagaggaatntacntctgttaagaatgtataannatnagnggnaagngnacaatnttgcataaanaaaagagggggtggtnttttttncnaaaaanagaanaannnnanatatttttataacaatntggttngagcncggggnttnttttntttnttngagnanacggggngganaaaaanaaananntnttnntnnaaaacanaaggggngcgtnttttttgatnaaaaaaagtngnaaaanatgacngggggggggggngnagagtngnnagaattnaananaanaaaggtntctnntgaananagagatgtanggggggatctnnanttanaaaaaaanagagggggnnnanaataaannattttnaganttaggtttttttgaaaaagngatntntnntggngnnatngggnntgnaaangnattnaanatttgggttatactnaaaangggggananaaantttggtttnaaanggncnnnnanagatnggganntattttcccanttccaatnggnaaaaantaaattttnacnaaaaggggnnaaacgtaatgngttataangggaaaagggaangggggggttaaccnaaaanaggggggggaacaanaggggantaaattncggaaaaatggggaaaggnaccccaattttcccgaaaagttgaagtnacccnnanttttaaaaangccttttnggaaaggaaacccggaaaaaggnagggccccgaaattngcaacttgaatttttccgggaaaaaggccagnattaaaaccccccccccttacctacggggatagtgatacgatggcgatggcggccgcttccgcttcg

SEQ ID NO: 2447 - DNA, 2000 bp, Oryza sativa
ccatcgtttttaggtggtgtagattgctttaaggcaattttatcattcttaaaaaaatacttagagatcttgcttcaatatttatgcaacacctttgctatcgtaagtcctaccccacctgttggccacacctccccaaatggtcgtttcctctctccttttctgtcactgttgttcctcaaaatgttcctatgctatgtctttaagagactggattttaaactcttgagaagatatcccctcattatttgcatatcactcaaatagttataattttctttaatatatcactccacaaatatatgaattaaaatttaactttcacaaattgcaataaaaaacaaattaaactacaactaacacatattcatagtcaaatttatttttctgttgtaacatgtaaaagttaaatttggcattgcatgtatgtttgtacaatgatctatcatatcatatattgatctatcttattaaaaaaaattattaatatttaagtgatatgcaaataataattggacgtcctcaggagagtgtagaataattttccacgtctataccatctctcaccgcctaggacaatgatatagtcctaagataagacctaactttctgttgagagagaataaggtgtatctttgattcttctataggaaaacatgtattattaatttattagttaaaaactagctaacatttatacgcaattttcagcagagttaaatatagaatttgaactggattttgtataccatacattttaggacatgtgcaaaatagaatctaatattagctcttaattaatacatactcatttagagactatccttagcttctacaaaagttaacacagcaaaatctcttaaccattagtacaccaaataattttttattactctcattttctcaatccacgtgcaacaaaaatttctttaataaatgctataagagtcgactttaaaccgttgtcatctctctctttcatgtttccaaagttacttgcatagaaaacggagagagccgttaataagcaccattgtacataccctaagtagaattggatttgacgtatacaactattggtttatgtcttaatttagggttgtatacaactgtatgtctttatttatcgttcatatcgctacaatttagaccactataatataatggtcaaaatttctctcgattaatgtaagagtttctagcttctagaacagatgtgatggagctatctagctatataatacaataatagacagttacatttattattttaaataaaaattagtacatattattataacatattttcacaacgatctagtaatgtcaatagtattggatacaccattaaaaaggtaattggatctgccaattagcactcaaagcagtgtaaagagaacacaaaactcactataaatacaccaagactataaacgtgagcacaaagctgtcaccaagtagtatgtgaatcctccacgactataagcgcgagctagtatcttgaaaggaagatatgcatcccaaatggaaacgagatgcatttcaaatttacagtaagcatccctatggttgcattgacaacaagagtgagacccaccataaggagcaatagctatggcaatgcctacaatggttaagtctttggtagaatataagatgggtcccattgaatcccaccgaagaaaaaaaaatcaattcctaaccatcccatacaaggcagaaagctagagaaatgaatacaacagtgaaaaaaaataattttatattttcatgtgatcacacttaagcttaagactcttttggattgcatggatcttaatgtgtgcccctacaatagctaaagttataacatttaatgtttaaggcttacattttactaaattgtggttaccctaacatattaatccccccaacccagggatatataggcacatgggctaggggggtcaatcgtcgtgacgtcgtttacacgtaggacgggagaagactcggcccggtac

SEQ ID NO: 2448 - DNA, 2000 bp, Oryza sativa
  misc_feature (168)..(168): n = any nucleotide
  misc_feature (551)..(551): n = any nucleotide
ggcggtgcatagtgtggcaattagtggttgcgggcggtctggggagattgttgtcgacacaatctctaaaaccgagtttgttaatattttttctttaaagtattgatgttacgtaggccaccatccgtcataaaaagaaatactccctctatcggagatatgggcccnggggtatgtgaggtagaggagaattactcttcctctggccacgtggcttggccggatggccccactcacacgccacgcgtatcatagaagcagcggggggggcctcggggtacgacgtcgccccctcggggtacgacgtcgccccctcggggtatgacatcgccccctcaagccctatcgcaccttcgccccgaggccctcgcctggccgccacgcggcaaaggggagcacaggctgaacagccgtaaatgcacagcaccccaactgtccctcgcggcagacgtgtggtgcgtctggctaacccctgccagtcggatgtgaccggtctgtgaccggcccgtttccgtcacatccgatggatagggtaatcatatcatcacgtnacccttgaccccggcggaatgggggtaggtgtgacccgtcaaatccgagtgctgctcgaggaagggctgttgcatgtcttcgatcatttatgagggaatgaccgggctgaccaccgtgtcaggcgggggacggcgctgggttccgctcaaggatcggttatggcttagcttccgagagaaggcacgtcttgaaggccaaaaaggtgaagtgggtcttttcccccctttccccggtggagagtaggtagaatcggcgcgtgtggtatccccttagaactataaaaggaggaccctgcccacagtgcaaggaagggaacccgagaaaacccaaacttcggaagagaggaggcaagagtgctctccggagtaaaggaacccttgtaacttcatcgataatcccaaacacaagagtaaggtgttacgctctattgcggcccgaacctgtataatccgtttgtgtactagctcattgatagtcttagggacgagcaaacgaattccgagagacgggcctccgcccccggccgaactcacgaaagggggtctcacgactctctgttattgagggttctccctcgacaccctccgtctcacaatataagggattttcagtttttgcttgcaacgtttgaccactcgtcttattcaaaatttttttgcaaatataaaaaatgaaaagttgtgcttaaaatacagtagataataaagtaagtcacaaataaaataattaataattttaaaaaattttgaataagacgagtgatcaaacgttacaagaaaaacttaaaatcttttatattatgggacggatggagtaatctctaagtagtcagttttaaagtaataaaaatactgagataaagttggagtagtcgagtatcgcgtaaaagaaagagaaatctcccgtcacttcgtctcctccgctccttgcgccgccgccaagacgagtcgcggctgaacagaacaggggaggggcggcgatctccatctggcgagcgagcagagcagggcaggggaggggatcctggtgagcatccacatcctctttctctttctgattcatctctctcccacctcaccgggactacttttgtctggaatttgcttgcgcgcgtgcgttcgtaaaccctagcttctcttgtagatctggaagaaagctcttcttcctctttaatctgagagccttaaacctctattcttaatacaactagtaacagtttgtttgttcacccaaaaagtttggggatccgcccctgttagtgttaaggggttttccgtcttgcccttgccaaagtctagccttcaatactgggggtctagggatggagctgtcgggcagcctcagatgcttgcacaaatcactgcattgtaattcttttgtttcttttattctgcgacaggtcgtatattcacctaccttggagtaattcgcatacgtcacaagttaaa

SEQ ID NO: 2449 - DNA, 430 bp, Oryza sativa
ttttttctttttttctttttttgatgtgtgggtgtgggtgcagcagtggtagctgtttttgtttccaaaaggtgattttttttttgggtggggggtgttgttcagatgaacacccaaattgccccgcgtttgggcgagcgagttgtagtgcttgttggaaccaaatctgtgatctttgcggtttatgctggtactatgtttggtgtgatctcagaaaatcgaattttatttgggttgcttttatggttggtaccgatgattttggcgaagaatcgtggtgtgattgtaggaatgggaagctttgatccgttcggtttgctgtaggagcatgcatgcttatgatctctcttggggttcctcctttgcaggtaattgcttgccttctgaggaactgcgggagggaccgaggagtcgtggagcgactcttgaa

SEQ ID NO: 2450 - DNA, 2000 bp, Oryza sativa
agagggaaatggtgcatgtggtatcctcttaagatataaaaggaggaccttgcccaccgagagagggggtttttctttttcttggactgaacctttccagattaggaacccagaacaagggagaggctggctcatactttgtagctctttcacacacgaatccaccaaaacacaggagtagggtattacgcttctaagcggcccgaacctgtatacatcgccggcgtcttctgtgcttcctgtctcgcgaaccttccacatacagattgggagcttagagtctcacccagggtccccggccgaaccggcaaaggggggcctgcgcggtctcccggtgaggagccccacgctccgtcacatagaaatatatataatttacaaataactaaaatttgatattaaaaataattaataactaacacgtatataaaatacaatatgaatattacacattagtagtttcataaagttattacaaaatttaaaattatgatgtcattttaatatatttgaataatataatgagaaaacatatatgatattatataagagaaaatataatgatgctagctgtgcaatctgcgcgggccaccatgctagttttaacttgtttccgttaacatgttttcaaactactaaacgatatatttcgtatgaaacttatgtgtaaggtaactttcaaacatcagataaatctttcttaaaaatttaaaataattaaaactcaattaatcatgtgctaataacactctcgttttatatgtcgtgcttaatcttatctttagcggatgcaggctaacgggaccatatatagagacaccgacgtgcaatcccaaggcgcaacgggcacagattgtgactggatggatgacaattaagcgcaggaactgcctacaggaaccgtgcgcaaacatttggccatgagtaattttacggtttactattttttctgttataaatttaatagtaactcttagtatctacatactgtaatggtacctttaaaaaaccgtagaattgctctttggccattgcgcagccgtaaattcatttcatcagcgcggacttcaagaaataggccgtgtaccggccagactaattaatgctcagcgtgctgtggtgcagaggtccagagtttggtcttcggtgtgtgataaccgtcatgtaggcctcattttgatgggcctcaatttccaacccatctacgtgttcagactacagaggtagcaagcagcatacggtcgcatcaggttgaggacgccgacgccgtcgccgttgccttgttcaccagaggcgagggacgacggaggtcggatcgaaggaggggagcggtggtgacgactgccgagaaaaaaaaggctgtggcttcgcgcgattgtcgacggcaaggggattgtcgatcccgatctcctcgacgatggctgcagtatcctccactccactttggcaccattgtcccacacgattgctgaccaagtgaccagtgtccgttttctccgacaaactcggcgtggccacagtcctccaccgccctccgcatggaaacgaacaaaccccataaaactatagcagagaatgtacactggcaggctcacgagtccgaggtgcatgcacgctcttttttatacacctagcgccccgacgcgcctgtctcctacacggggccccggccccatctgatatctacgatgcaacgtacgaggccggcaatggccacccgccggcaagtggcactgttgctacgtgtcgcccccgcgcggcaaagcgacgacacgggcggcagctccgtcagtcaccgaagccttggtgtctcctgccgcccacgcaccctctttcccgtgcttcgtgtgcccttcgatcgacacagctcggctgaccccatgataagtagccagcgatggcgaggcattggaagtgacagttttgaacactgcagcgtgccagtgcgtgtgtgagaaaaatcgcaggggaagtgaggatggaagggcacatgttgggga

SEQ ID NO: 2451 - DNA, 2000 bp, Oryza sativa
  misc_feature (164)..(164): n = any nucleotide
aacttgatttacaaatggtttgaaaaacttgacacctgggtcggtgccttgtgaaagaaaatgagttttaaaaacaaaactcgcgacacaaggccattcctgggcgggatgcttgtgcggtcactttaaggaccgattcctttggaattacatccgaacatatnacaagtgcgaccacatgggtggaatgggacacccctagctgagtaactagctaggtgttgatgcgaaaaaaacacactagcctggaagatctgcttaactccagtgcaggtcctaaatcttactttcgggttcaaagacgtgctagttgatttgatcctgcaatcaacaagaaggaaaaaaaaagatagccgatcggctaagggccgatgacatatcgttaatcattaacccgatgttattgacattagatcggcaatgaagattatagcaacataaagttaaaacgatatataatctttttctcgaaatatatttaaaccatgtgattggaatagatcgaatagtaagtcgagacagtataaatcacttatgtttaaaagtactttaagacgaagattatatagacactcatagcatagccgatcaaatagatctaacatgtatcggctaatactccggataccaccctatatcaagatattaaaacaaataaaatatatcaaacagtaagcctaatatactttaatgctataagatcttaatataaagggtaggtttagcatatcaagtgaacatgtaaagattaaaggtagctaaatcaggtaagatcggctgaaaccccggatactatctctattgatgatcataagacgaactagacattatggttatgaatattacttaatagatcgaactcaaccgatgtagtattaagcataagaataaacacaagatctaaacaagttgatgaacacctctatgagatggtaccgatatcgcagtctcgttggaagtggttcgcaccgttttttctacgacacgctcctgtaagatgccattgtatagcggtgccggattggggtgtgacacatattttggaaaccctgtattaagggaattcgttttattttttgttccacaaaaaatgtttcacctaatgtactcacaatgtttcactatgtatagatctaatgttgtagtgaactgaaacattctttcgctattttactgaaacattgtttttaatataaggtgaaacaacgcccgatttaaacgattgaaacattttcgatctacttagcgaaacaattccaatatactttgtggaacatcgtgtaacatttaaaaataattcaataataagctaaaaaaattttgttggaatatatgcatgtgtggtcttgttttaaagatttaattgcaacgaatttaatggtgcaatcggattatgatttggataaataatttaagagaaaaattagtttaataaaattgctcagcagttaacccaccgtacaacaaaatcaatcagtttctttcacgtaaacaagctcacagccattgcgtacaaggatagagcagcatgcacaccggagctcgtcatggactccaaccaccggcgccggagttcagagccagggccggtgcaaccagctggcctcgcgcgtcctcctcgtccgatctcacgagaagagaccgcgcgatgaacgaggcgaccctggattcgggcttcgttatgtaggggctgtgagacgcaacgcaagcgagatcagttcgaaatgagaaagaggagacgaagaaatcgagtcggagaaggcgtgggtcgggacggacaggacaagacgaggcgaagctgacaaatcaacacgtgaattctgatccgatatggacacgcaaggactaacgaaaatctactagaaaaacatcttaaatttttataatagtatatatagagagatagccacaagaagaggaaaggaaggagattagattagattagcgacgaattcgtcaaacccatcatctccttcgcgccgtcgtcgaccaccatcacc

SEQ ID NO: 2452 - DNA, 2000 bp, Oryza sativa
atatgtaaaagaatttgttcccacgacctccattttaccaaaataatatgttacaaagagatttttgaaagttacatacaagttacactatagttacagtgtaattacatacaagttacagtgtaattacactacgattgtactgcaattacatctgttaaatttttgagaaaaaatttgtcgacaaatatatagcaaaatcgtcccggaaatagagcagacggcgcagaggacggatggctgaggattacatatagacttttccagtttcagccaaaaaaggaaaaggatatttaattaactgttccaattaaattaaccaaaatgaaataatttttcaattgttaaaaatacttccaatactcaaataatttcaagaaaaatcctgaaaataattggacactcaaagtatttaacaaaattaaaaccagatcatttaatgattaatttattgatgaaataattgctgaactcttcttttgtattattaaaattaataattaagctctaaaaaatccgagaaaattccagatagtataattaatcatggagaattcaataaaaattaagtccagccaagttttttatttaggaaatattatttcccctatttaacttcacttgtaaattaatgaacttttaatataaattctattaataatttattaaataatttatacatcctgaaacggaaaatgcggcgtgtggcggcgtctgtgaggcaggttctcggcatagatccgtgaacttagccagaagtggttgtggctcggcaccttcgacaccatcgaggaggtcgttgccatgttcgacgttgagctgctgatagctgattcagtgtcgctcctcctccccacatggtcgtgcgcaacgcagccatcgatgtcaaagtcgtgggctagcgggagaggagaggagacgaaggaggcgagaagcaggtggggagagagacgatggtgatgggtgcggatgaggacgaacagcggcgaatggaccagggtcgcatggcggggttcttccacctgttcaaccgtcaggcagatccaactttgttgacgggttgaatagcagtgaagaagagacatcaagaaaggcaaggttgggatgtagcgaggcctaggaggtcagatctggtggccacgggcactgcgagcgatggatccggtggcagcaggcctcgagagctccagtagcagttgatgccgtgacgacggtgggcttgggtgcatagatcttcccttttttccaccacgattgtatatgtgagtttgcgatctgattttatatacgtatgaaccaaaaattgttgaactagatccaaattattgaattgaatttgtgtaacgggatccaaactgttgtgtgtttgaattgaattaaagttgttgaattatattttttagcaattggtaattgcgatggaactattttcttgctaaaatcatttccagaataagccacccatccctcaaaagtaatttgtgcagacggacggctttaggccggaccgcacataaaaattgatttttccctaacggttccttaggtggacggcatgtaaaaattggacttttacagctgaactgcctttgaaaatcaacattcccacattgtttacgtatagtggtaaaaccgcattcacaaatcatagaaagctcttttgtagtatgaaaaggaactagagttaccgatcaacgtgagaggagttgtttaacaaaaaaaaagaaaaaacccggaaagctgagaggagttttttaaataaacaaaagggggaaacctgagagttgtgatacgatgcgtggacacactggacagtggatatcgaaaaacttttgctgtcgtgaatccgtcgtctcgtctctctcgttgcgtctccttccaccttaatttgcaacattagttcctttcttatctccagcgcttaaccatatacgcgaatccagcagctatagcgtcaagcagcaaagcaagcaatagacgacgagcccaccttgccgtcc

SEQ ID NO: 2453 - DNA, 2000 bp, Oryza sativa
  misc_feature (824)..(824): n = any nucleotide
  misc_feature (1083)..(1083): n = any nucleotide
  misc_feature (1088)..(1088): n = any nucleotide
  misc_feature (1536)..(1536): n = any nucleotide
  misc_feature (1543)..(1543): n = any nucleotide
  misc_feature (1989)..(1989): n = any nucleotide
  misc_feature (1996)..(1996): n = any nucleotide
caaaagccgtttcggctgtgttgtgcatttggtgggtaataaagcaacgtgtatggctgtagtttgtatacgatggtttgttgtatcgatcacagggtgcacgggggaggggatggtacacgtgctgacaatcgaacatgacgtgttactttgatcaagtattcctttttaaaaaatggatgcacgcgcgttccttccttttcttttcaccacccagggtggatttattctaacttatatggtgatatttgagcaagttttataatgggatgaatatcgcctttaatttaaatcgggttatctactcattaatgaagagataacaaacgcaaaatatcacatctaataaacaaacctcaattataaaacacagccttacactattattgagagttaggtagaggttgccccttacaaaatggatgactcgcgcttttctaacttctctcctccacctcattatctaatcttatgtggtaaatttaagggcaatatgtaggggtttataatacttgctcttagactggtctctttcgtccatgttctgaactttttaccccctcttttttcatatgcacacactttctaaacatttaaattgttttcgtgcttgggtatggatttccaatccatacatctgaacatagccatataggtagtggtagatctattaatccttggccatatattgcattctactaattattaaatatgtatttactagtaatgtatctgtacatcgtaaatattaatttatgggtttatagtgctactatataattgggagtaaagaaagtatagtttacttctttcgagagagggangggtggtttcatgtgtggaagtagggtgtagtgatggtgggaagggagtagatggattactatgctttaaatatacaagttacatgttccatgtgttagtgttacaatgggattgaataaaaatatgatttactattttttatattggtttcttataattttagagatatgcatacatcttaggccttccttgcaaaactatagaaacgaacacaacacaaaagcatacatagcattattttaaaaagtagcaagaatnaaatnagaataggctagaacataattatattagagagatagaatagaggaaagttttctacgaggaattggccatcttaaaagaattttataggatttgaatggtctagcattttttttttcaaatataccaaataaaataatttcttacatgatttgaataatataaatcccctctcctcctccccacatcatatacaataagtaagtaatagtctagaacaattttggctctcattaccaatagtgctcaccaccgactcattcacttgtgcatgcaatggcactacggctacctcaccattatgcttcaccatcgactcatgcacttgtccccgtatcaccctatcctatatatcgagctatcactacctacctccacctcccatgcccactttgcattctaattcgacatcgccaacattttctccctagcaaataagagaaccacagnaaatagngcaagaaaactagtctcaagatgtacctctctttcaatttttttaaaatgtaactttcatttttaaacatataataatattaacttttcaatataatatttgatcattcatcttatttaaaaacacatgttacatttattttactgcaatttgttttattagtaaaagtaactaattctattagtaaaaatactttaaacacggcttgtattttttttcaggcgtctgctaaattattgaataaggcaaatggttttataattgttaaaaataacattatatatttaaaaatagatgtagtaatagtaaaccttaaatgcttttttcaatgaagaataaatcaatattaataaggttgccaagggaagagaactgtgtgaagcgcggtggtatgtgccagtcactgtgcaaaaagcctctgtttcagccccaaccacaaaaaaatnaaaaatnaaaa

SEQ ID NO: 2454 - DNA, 2000 bp, Oryza sativa
  misc_feature (705)..(705): n = any nucleotide
aaaatgtcagtcgactgtggtgaccgctatggcagcgctgtctttcatcatccggccaaatatataactcaccctaaacaccgacgaccatcccgtaatcagggtttaatatttcgttttctccatttctgaaattttggaaattctactccggaattgtttgccttttttttaaaacaaaatttggtcaaattttttaaaagttaccaaattcacaaaaaatattaaaatatctaaaattttggctgaaataatatcatatcaggtccgatagaaccgaaaattctgaaattttgaaccctgcgtacaataatgcaatgcacctatgcgcccttagggcaagtactatgatgcttgatgtggtgcccctaaaaaagttatatatgattgaattatgaggtggaagaaataagttaggatagagaaggtgaaccacccctcatacaaggagcaacctttgcatcaaacctaagaaaaaggagataaaaggaagaggggattggacaaataaataaaataaaattatttaggttagtatactataggtagtgttaatgtagatgtggtgtactccctccatcccataatataagggattttgactttttgtttgcactgtttgactcttattaaaaaaattgtgcaaatataaaaaatgagaagttgtgcttaaaatactttggataataaagtaaatcacaaatnaaataaataataattttaattttttttaataagacgaattgtgaaacagtgcaagcaaaaagttcaaaatcccttatattataggatggagggagtattgtatactccctccgtactcgtaaaggaggtcgtttaggacagcgactcggtctccaaaagacaactttgtcttcttttttctataaaaatatttattgaaaagtgatatatatgcatacttttatgaaagtatttttcaagactaatctattcatataacttttatattttcaaactcaacaacttaagagttattaatgatttatattcccaaggtttgacttaaatattgtcctaaacgactttctttctttatgagtatggagggagtatatcacctcttatcttacatgaataaaatttagatatgacaactaccctttaataaaacttgcccttaacaccataacgcctcgtcggcatgatgttagcgccttcttagtgacgaggtcggcgaggtgcctgcggcctgcccaggtcggatggtggcagcgggactgaaagagtcacggtggtggaggcgatggtccgggcgtccgtacggaacctcgtcggagacgatacgtcgcacaggatgtagactggtgtgtttgccaagagcaagttttcaacactcctctttcgttttccgcatgcacgttttttaaactgctaaatgatgtgttttttttaaaaaatttctatataaaagttgttaaaaaaattatattgatccatttttttaaaataatagctaatacttaatttatcacgtgctaatggaccgctccgttttatgtgcatgggagatgattccccagacccacctccaaacatacgaaacgtctaagagcacccgcaatggtaaaataagatgctctctacaaaacatgtacatctaagcaatagactagattaatagtaaaccacctcaatagtatgtctacatggatatctatagctctctcatccattgtctcgtttttctctatagactatctccagattagtagatagatttactctctctctttatttaatctcttccaagtaggaaaatatgctgacatagatctcttgtagagaacctatagacaactattgcgggtggcctaatgagcgtccagtggattcgcccccagtctccacttcagagacggtcccacctgtcatccgctcatagaaaccctcgcgaaactacaaaaacccctcgtctcctctctcttctctcgccgtctgccgccgccaccgccgccgccccacctccgaatccacgc

SEQ ID NO: 2455 - DNA, 2000 bp, Oryza sativa
  misc_feature (1488)..(1488): n = any nucleotide
  misc_feature (1560)..(1560): n = any nucleotide
ttatgatgtaatggcttgtctcggttcaattatgcattacaattagatttggtctttatatcagagtcaataggtgatattttgatactcctttcatattagtccggccaatctaagtttgagacatttatctcacgagctaatggtccaatctgtacaaaaccacatgaattttgagatatggtacataaaccaaagtattatgatcataaagtttcacaagaccacactattaatcattttaactgtgatgttgtcggagggtgaactccactagcgggggacagtgagggcccccctttgttggttcggccgggggcagcggcgtgagattcgaggactcggtgagaaaggcagtctagagggggtcgaaccccccgagaacgatgagacaaaaggagtttatataggttcgagccgctgaaaagcgtaataccctactcctgtgcttagctgattgtgtgagaaattacaatatctccttattggagtagaaggtgttgatgatgatgggcagaggactgctctaaaaaaaagggctcatcctctccctaggtaggcttggacctccttttatatcttaaggggttaccacatgggtctacctagcctatctatggaggataatctcattaaatgcatgtctcattgcttgccttggaagtctcttgcacgccttgccatggcgtggggcccgtcaaatttatctggctgacacgggggacacgcatgtcattcgatatttaatgagtgaagacttttggatcctcacttgcgtcgggaaacgtaaaccctatcctaaccgggttaggcaaaccgtcttcggctgtgatgagaggctaagcaacctctcatcatcgtgacgtgacaggggatgtcagatggcacaccgcctgacatgcaaccagtgcgcaggcgcactaccttggctacatcggtcattcgaccggtcacaatccggctaggcgcaccacgtgccgcatttaatgcagcgtggagcgctcggtcacactgccttaaaatgcggttaggtgggcgctgccctacacacgcggcactatgtgaagggggtcggaggagcccgacccccagacttggagggggcggccgtcgccctgcctcgggcccgacccccctcgaggagagggccacgtggctaccgggggcagcctcctccctatggttctgatacccccggaaccatatcactaacagatgtaccactgttttataaattctaaaatgagtaaagtccatcaccggtccctaaacttgtaccgctatgtcatcccggtccctaaactcgcaaatcgaccgttcaggtcctcaaacttgttcgactgtgtcatcccggtccctaaacttgcagatcactcgtttaggtcctccaacttgttcggttgtgtcaccccggtctctaaacttgtttagttggatgatctaaacgagtgatctgcaagtttagggaccggtgatggattttactcntctaaaatcattgcttaaatttatgaatttgttatcaatcacataaatattacatctgtttttaaatttttnatctataagtatatcagaatggttaacggtgtggttttgtaaaactttaggatgataatacctgagattatgcgtcgcgtgctaaaattaatgtggttttgcgtaatttgcattatatataatatgtagtgttttatgaaaattattattattcttttgaaaaaaagaatagtgttacacacacgcgtactccgtgccttcccgtcggaggaatccccggtattcaaccgagtcgccccccatctgaggattaccaccacctccacggctccacctccgcggcggcgtaatccatccaactcgcaatagatatacagtccccccaatcgacggaaccctaattctctcccgcacgcgcgtcggcgatccgaggggaagtagggtttggaggaggaggaggggagaccaccggaggtaggcgaatcccccaaggccgggca

SEQ ID NO: 2456 - DNA, 2000 bp, Oryza sativa
gatacaggtgcgcacggccaatttcagaacacgaaaagcagacatttttttggacactttttagctgaaattagtcaagattcatctgaactgagactgatggaccgaacaggacacgctgagatcgccaccgccggagagcgagacgatgcagaagggcaacgtgatcgcggtcctcgccaccaccttcttctacctctgcgtcggctgcttcggctactccgccttcggcaacgccgcgccgggcaacctcctcaccggcttcggcttctacgagccctactggctcatagacttcgccaatgcctgcatcgtgctccacctcctcggcggctaccaggtgaagctgcgactcaaacttctccaaaatcgcattgcttttctctgaaaaaactatcctgatcgaatcctgcatgaactcgatgcatcagatgtttagccagcagatattcacgttcgccgaccggtgcttcgcggcgagcttcccgaacagcgcgttcgtgaacaggtcgtactccgtcaagatcctcccgtggcggcgcggcggcggcggcggcggcgcggggaggtacgaggtgaacctgcagcgggtgtgcttcaggacggtgtacgtggcgagcacgacggggctggcgctggtgttcccctacttcaacgaggtgctgggcgtgctcggcgcgctcgtgttctggccgctcgccatctacctccccgtcgagatgtactgcgtgcaccgccgattctcgccgtgaacgccgcggtgggccgcgctgcaggcgttcagcgtcgtctgcttcgtcgtcggcacgttcgcgttcgtcggctcggtgaaggcgtcatcagaaagaggcttggctagctagctagctagtagcgagtaatttagcctggtcatcgagaacgaaatgtaaagctagctcagtgtgccatttcatctgaagtaaaaaggcgcggtgaactgtacaatacatatgcagaaaaaatgataaacataagatgttggttattacttcctcggtttctaaatatttgacgccattgattttttaaacatgtttgaccattcgtcttattaaaaaaattaagtaattattaattcttttcatattatttgatttattgttaaacaaactttcatgtatacatatagttttacatatttcgcaatttttttaataagacgaacgatcaaatatgtgctatgtcaaacatttagaaacagatggggtgccaaagtatcagctactcagaaattctgacaaataatgatagctgtttgttactgtcccttccgtttatacccatttcatatttcatattgtaagtcgcttaattttttaagttatttttttaagtttgaccaaagtcaaagtattatctaccgctttgaaaatatgtaggggctaaattcgatcgatgtactcatgcacgcacgtggaaaacacacacaattatagttgtgaacgcctactctctctggtttttaacgtttgacgcgcttgatttttggtgtcttcgatatatgtcttattaattttattttaaaaatacaaaaatataagtcatggtaggagtatatttaacaataaaaaattatagtaaaacaaaaaaacatgaactttttaaaataaaaagaactagaggttaacggcgttcaagcattaaaactagagagtaacacttgccagacctgaggtggtactaatcatgggccgaactcgagtccaatgtggagttggactccgattatagacgtcgacgcggctgggccggcagctaatccggtctttggggccccatgtatataacgtcgtaacagaaagggagacagattccgtgtccggtttcacatcccatcccacgctgtcgacacagcttccgccgcatccctcccctcgccgtcgcaaaatcccccccgccgctcgcgccgccgccgccgagagcgagacccgcacgaggagccaagcatctctgcgttctacagctccgggccaccggcg

SEQ ID NO: 2457 - DNA, 2000 bp, Oryza sativa
ttgaagaaaaattttgcaactaaacacggccttagtactccctccctttattcgttttgattttgattaaaatcaaattgctttaaatttaattaagtttgtattaaaaaaataaatgttttcatcccaaaatatatttaattactagaaaaaatacccgtgcgttgcaacgggtgaatgctattttagtcttattattgttatacggtttagctatgatgaaatttaatgtgggaatttgcttgtatattcttttttaagaaaatcatgagctacaattagaagtccgactttcatctcaagttttatgtaagtttttttaaaagaatatttccaaaagcaaatgaagttaaaatccaactcatacacgaatcttaaaccgtatgaaccgttggatctgcatttccaaaagcaaacgaacttaaaaaatcaactcaaatacggatgacataccaaaaagtaaaacctcttcaatttttataatagtagagatagctttaataaaacaaaaagtaaattgcatcgtcggtacacaaacttgtcaggtgggtgcaatctagtacacaaacttgtaaaattctcgtctttgtgcatgaacttgtctattgcgtgcggaggaaggcgaaaaagacactatatggataatcttattgatttagggcatatatttgagaaggttgctattagagatgtacctcttcaataaaaaaaatagaataggatatagtgatagcagaaaaagattaaaagacgagcaatgatataaatgttagaaatatatgaaattcatcatttccatgatgaaggatacaatatagaccaaatttataaatattgaatgtcttatgcatactcactacacgtatgcacgtcacatcctaatcaacgtcaacttcgtaaaattaacattgccaacatattttggtcctcattcgcacaaactagacaagtttatatactgaaacgagcattttacaagtttatgtactgaattgcacccaccaaaatagtttgtgtaccaccaatacaatttactcaaatttagatcaaaatcaaaacgactttgtaatccgaaacagatggttgtaatctgaaacggattgagtaatacctaatcagcctaaaaggctggggggccggcccttcagattcttctctcgtgatgggccgtagtaggcctgatgggacacatgcccaatcttttcggataggcccaatctgatttgtatctttttggttaatttttttcagtttatcacttgatgaattcataaatcagaaggttaaattggatccgtgaaaagaagaaaacaaaagtgaaagcgaatgtatttttgtagtcgaaaatcgtttctatatttgcatatcaaatttgggttgcgtgttcatggagggacaccggacacgcgatgaaatcatctgcgcatcctgtactttcaatttttcctgtgtcatccaataaaaaaaactaattcaaacaaggaaaaccaagtgttgaaacatggtaaatgatttaccgttggatcgaccgatcccgttctctcacttcaacagccatatatattatattaggcccatccacgaacaaatcgaaccgtcgaagtgactctgtagccccgtaactggaaatgaattcatattcagatttgctagtcctcacggccgcacgctctcgcatcctcgcgtttcatcctcctgtccgtgctgtggatggcctcaatgtttttgttcattgtttctcggtaaaatttctgcaacttttgtttgcgaattcaaacttttgtttgaaacttttcgtgatttcgctgacccccgaaatttttcccatttccgataggttgaaccattttgatcttcaagactccaactcgtactcggtttgtagcccatctccgactcggattacacgtaggcgcgcgcctatttatagctgctgccctgcccgtctccttactccattagcttgctagcgcgcggcacaagagcagtaagcgaggcgc

SEQ ID NO: 2458 - DNA, 1665 bp, Oryza sativa
  misc_feature (6)..(8): n = any nucleotide
  misc_feature (10)..(10): n = any nucleotide
  misc_feature (13)..(14): n = any nucleotide
  misc_feature (18)..(20): n = any nucleotide
  misc_feature (24)..(24): n = any nucleotide
  misc_feature (42)..(42): n = any nucleotide
  misc_feature (50)..(51): n = any nucleotide
  misc_feature (62)..(63): n = any nucleotide
  misc_feature (78)..(78): n = any nucleotide
  misc_feature (89)..(89): n = any nucleotide
  misc_feature (114)..(114): n = any nucleotide
  misc_feature (117)..(117): n = any nucleotide
  misc_feature (119)..(119): n = any nucleotide
  misc_feature (134)..(134): n = any nucleotide
  misc_feature (145)..(145): n = any nucleotide
  misc_feature (148)..(148): n = any nucleotide
  misc_feature (154)..(154): n = any nucleotide
  misc_feature (1355)..(1355): n = any nucleotide
  misc_feature (1558)..(1558): n = any nucleotide
gggttnnntntcnntaannnattnctccgggggggatctaanccacccannggtttggttcnncctggcccaaatttngtctctggccnccgttgggcgatccccatccggggncanangtggccccggggtcnccttttccacngantgtcgntcgccggtggcatccttcctacccacacctcatcagttattctgcgttatccctcaaaaagtttgggggttcaaccgaaacagggttagatctccctctgcccagctccacctactttcaagttgttaattttgatttccgtttttagcagatgtaatttggttactgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactgtgacacttggcattaatctaatttaactttttttctttatcaggttataaattttctaagacatttgtgccacttggcatgaatctaatttaacattctttctttatcaggttataaattgaaaccattgaatgtactttgtcttcccgtctctaaaacattgtgatatatctataatattttaatatttttaagtttaaaaataatttagactaataatatagatatttaaattaggtaattaataaattcaaatcaactatagtttagaataaaaaaacaaaataatatatgccaagtacaatctaataacaatagaatgttagaaacaatatgaattcaatatttttataaattttaagtacgattcatacataaaattaaagaaaaatataaatttatatataagtgagaacataataaaatgcaagttaaaattattaaaggaaaaatattattaataaacaatgatgttgatgtatttctaaatattttcacgtattatttattaagtgtcaatgattgaaatggatgatttaccatgtaacagattaattattaaaattatattgttttcatccgttacaatgcacgggcattttactagtctatataattgatcgctctatcaataaaccttaatatcgacaagtaaccacaacgttaagccattgatcgacaacctaaaagctacaactgaccataaatttcactggcttagatgagatgtaaacacataaataaaccataaaaaacgagaattcggagatgatggcaccccaagtccccaactccaaaccattttccggacaaaaaaaaaacattcaactctaaaccacagaactncatgagaccatgtaactcaagcaaatctgactaacaaagataactcgaaatcaaatcgagaaataaatgcagatttgctaaaaagacgtgtgtgaaccggtcccaaattctcacaaatctgatccatgaaaatctgcagccgttatgaacttccaaatttggttccaaactctgaacttttgctcgccctactaacccccctncacaaatcgcccaaaatccgaacgacgccgccgccggaatccgccaccgccgccgacggaagcaagggcaggtcaggccgtcgtcgggagggggggagaggagaggc

SEQ ID NO: 2459 - DNA, 2000 bp, Oryza sativa
cgtttttctctatagattatctctaggttagtaaatagctttgctctctctctttatttaatctcttccaagtaggaaaatatgctgacatggatctcttataagagactatagataaccattgcgggtgccctcataaacagggcccaattttgaccaacagttagttacagtaattaatgaactaaattgagcttgttgtaaacgtggacctaatctttctgcaactccaagtccagagactgcctctttcctgcttcatctcctctagctaccaactcatgcgtcaaagcataattatgttaagaattcccattccttttggattccaaccgacgcatcctcctctcctgttcctctcctgctacactttggtcagtcagtcacagcacacacaaaaacaattgcaacttgtgtggtgtttacttgctaacacctcctgacagcaacatgccaacgaattgattgctcaacctggattaacagctagccacatatatatatgcaagtaaaaaaaattgtattttatataatgggcgaatcaaatttcaacctatcccttttcatggatttaattttctgtcccttggttaattttgtaggtggtgatattttctttgctagctaggtctcctttttttttgttcgcaattgggtctaggagagttttcacctagaaattcgttagctgaccttttccttgagagaactatattgccatgacatgcgctctaatagaaccctacttgcttccttgaagttccttccctgcaccttaattctcttctagagggaataacccaacagaaattatttctcacacaatcacaagtagggcttcaacattttggatttttcatgagacaaaaaaatgaaagaaaaaattaaagcataatttgaattgcaggggacaaatctgcaagaagttcctgccccaaaatccacacaattcatttctagattgaacatacatataaacccaatttcttctcttttaaagctccaccattgatcggcgatcggacgacgctccaagcccggggagtcccgtggaccagcagggctggacctaccaaaaaactgaccaccggagcaagctagctataggaagtgggggccagtccaaccagaacaaaactcagcttaggaaaggaacatgaggatagctttgttgcaacaccaccaaatcagccttgtggccttgttgcaaccaaactgcagagaatgcagaatgcaactccactgtggtgtgcctgtctttgtagtttgtaccatatgggagtaccaagcagacccagtagattcatgtccctgtcctcctcttctcaagacactgccatgccaagccaagccaaaccaaagcctaccttctcaacctcaccaactcaccttccctttccacacacatggatggcagtggcacccacaccttatattcctaccccattttgattgcttcctcccctcctctcttgatttgaagcccaattcttctccattaatctctcctccctctcacatatacccaaacacacatgcatatatatacatatatatacatgaatgcagctaactagcatatgtgtctgtgtgtgttcatcagtgatcagtagtgttcttgttcttgttcattggcagctggaggttcttgttcatttgccttagctggaagtgattaaatcagtagccattgttgtttagtggcgccattaatcttcagttatcagtttccattccgggagatcaggcggtggtcagctggcacctgcatgcatatgcaggctcattgattgattcgattttgggaagagagttattagtgatcgatcttggctggatcgattgagcttgatcatccggtggtgatatttctggattcttgtatatttgtgaggggtgtgagctgtttgatcgatgtgctgtggttgggcggcggcgtaggatgagcgacgtctccggccgcttcgtggtggccgcggccgtggtcgccgtgtcgctgg

SEQ ID NO: 2460 - DNA, 2000 bp, Oryza sativa
atccgccattttcattgaatagaaaaagagtaaaattgtggacatcacatttttactcttttcactttgtacacttgtgtacgtaacatttaattgaccagaactttatagtattaatcttatatttgaatacaaaatattactcaggaaaaaaagagacgttaaagttagcaaatggccatgaaaaaaaggaatgttgtaaacataactcaggataggaatagttaggatatgtgtcaaacataatcatttttactgagtttgtagatacatttttcaaccggatcaatccaccatgagttcatcatatcgatatgttatttagggttacccaaatggatcatttgcattattaatagaccaataaattcctaatatatgcatgtaaaactttaaaaaaaattaagctcgtgttcacaccaaaaaaatttatcaaattcagttaaattttgttggaatgatttattatacagagaaataactttatgccatttatacatgtgatgtccacaatatattacaaatagatcgagaaattctcgctacgtgtgtgtaaaactcagacccaaatttttgaaactcatgttcacaccataaaaacttgttaaatttaattaaatttggtaactttgtacaaaccttggccatctatacatgtaaaaccatttttgggttgaaccctttagacctaggttttaggggtttgattcttttatctttatattttaaagcgattctgaagatttgttagagtatatctatgaataggattaatagataagtggatcgaacctaaccgttctcatcgatcatcatgaaacataatcacgctaccaatatatacttgtagcgaaatagtaccacacaatctcgataggaagatgatcaaactgcaaatataatcacgctatcatttgcagtaggaagcaggagatgaaaagaacagatctactataagttgaaaaatcattcatttttccaagttaaagtcgatcgtggccgtggtcgtcgctctcctcggcgacttgatctcggagttcgccgttggagctgctcttggttgagggcatcttaaagtaggagtgcaagctggtagaccaacggatccactaaccacttgcgaaaggtaagtaaattaactaggcctatctcttttcttaaacttgggcctactttcctttcctgtatgggcctcaaatccagctccgctggatttcggcggcccactcgtctacttcacgtcacgtcctcctctctctgtctcccaaccaagaactcgtccacgtcacgtgggccccaaaaaagtgaccggggatgtagctggaccatgggccccacgcgtccgacgtggcacgcttctcctctcgtcgccgcctcgtcttctcaacttccctcggctcgcggcggcgtcggccgtgaatcctccgccaccgccgccgccgccgccgccgccgacgagccctaccacgatcgcctcgccgcattcccggggagattccgccgccgtcggcttcttccccgtgctcccgcggcggcgttttgagctctctctcccctgcgggttttccgccctttttgggcacggatgagtgggatcacattgcgcgatctctagctcaagtctcggatttccggcggttggtaggctcgtactaagctgcctaaatctcggatatcctttttttttctttctaataatgctggattaaccctaaatttcggcgagttggtatccgattcctacgctgattgagtgattgggttggatcctgacacggaaggggaaagtggttgtacaagtcgggaggaggagttggccgtttcgggaactgattccttgctatttttggctacaagttcgccgccccgggcagctgcttggccgtcgcgacgcagccgcgtctgttcgatcagttcagctcgcgcggttttaggtggggaggaatcctgttcgatttcgccggttgcttgtggtttcgtgtcggaggcgggggcggcga

SEQ ID NO: 2461 - DNA, 2000 bp, Oryza sativa
accccgacaaaaaactcgatcagtcgaggcatcaacatggcggccgtccagcactccagcctcgcaggttaggtacagcgtacgtgtgagattctgttctcacttcgtcaaacaatgcaagacgagctagcgagatcgtagcacgatccatccttcgatctcctgtccatgttcagcctcgcgtgcagctttgcatgagcacttgagcgatcggagcgagactgccacagatatggatgtagggtggtggtggactggtggttgccgcaaaccatgatgcaccatgttaattgctaagctaggagtagattggtgcgtgtctgctgctgctacaccgtgcatgtggtgccgttagcagtcagcctgtccatgcatgcagcggatcccgtgatgtcgccgcaagccccatatcgtggttagtttctgtcgagaatggaagtcaaatctcgcatagatgcttagcgctgacaaagggaagagcggcttaatttctcatccgtctgaaactctgaatttcgtttcgtgtaatgatcagagatctgttgggctctctgcatctctgtacagttggacgtgcaaactggagcgacaaacgggatgattaaaatgcacattgcagcaatgcagctggcaaatcatggttcaggataaatcgataaaggcagatcgagatgctgagatgaatcaggaggcgatgcttcctgagcaacctaaaaacaagttgaaaagcatgttgctgtcatctaccaaacgaagctagatataagtttgccccccttgacagtccagggaaggtcggtcaagaattagatagtgatgcgtccgtcctgcagagaaaggggttggtgaggaaagcatccgtttgacctcaggttcggaggtagatggatgtacatatcgcttacctgtgaacgttggttccaactaccactccactagttccgagtatagtgctattgttcaaccgaactgccctttttctaacatgaaagagggactgctcaactgaactaataccaccaacgactgagctagactgagtgtgtgtgattgacaccaacatatactcgattccaacaatccaattctcaaggtttacaaacacagttggtcaccggttacgggttaccactccgtcgtcgttaagcgaggttactgctcgatgtgtgtaatccttttacgcgttggcgaaaatactttacgatgaagagaaggggcaaaaccaagcatatatttgtcaaacaatttgaatactacctttttttcgattttgctttatatgtgttgataaattttctcaaaaaagatcgttaaatttatatataacataattataacttgtacttatgtaactacaacgcaaatttcacgtataattttaatcaattagaatttgcctcaagatttgtatactcgaggaaggaaaaatcacaacacacgcatagcgtgagaggattcggtcctacactttacggaaatagcatattatgatgggatttttaaaaattacatacacaatacaatataatttatactgtgattataatatatttacaactgataaatttttagatagataagagagaatttatgtatagatagtctcaaatttttttaattaactgacaaacctgataataagaccgataaccgcaattatcgacccattttaatgttggatcaattgcgtgtcacagattgagtggagccggaaacgctgtgggcctgctcgagcgagaggcccggcacgtggtgggctgaggtgttgggccgtggtcacgtgggcctccgtgataggcaggccgatgcttccgtggcagctgcaaaaagatccctcgcgaagtcgatctgacctcctcagcctccttccccaacttgttccacgcagaagcaaagcaacgccggtaatctctctccgccggccccgccgcctgccgcaccgttcgccggggatctagggaaggatggagagcggaagctacgagggcgtcctcctgggc

SEQ ID NO: 2462 - DNA, 2000 bp, Oryza sativa
tttcctccccctgtgtaacggattaattttcatatcctagcggtaaaaatattcaaaagttttcgataaatgatataaaatttttctcactttagattttgcctgcgtttgttcaagctcctttgcatggatcttctcttcagatttttggtagaactgaaaacaagacagcactaaacctggtcagcataagggggaaaaatgtaaatgaacatatggattagcgcaatgcatttttgggtataatataccttcttcctcttctcagcacgctcctgcaacctgaaactaaaaccagtggcagtagcattctagtgttgagccacttctcagggagtattagtactcctgcaagtataaatgagcatgtttaatttcttattaacaataacacaggagataaaaaggagcaactatgaagaaaataagaatgctttacgatgtggtggagtgcacatcatcctccattctctggcagaatctgttgcaaagcattcgtggtgttctcgtttgacctgatatgaaagatcaaccatttcaggccacgcaaacaccaaacagcgccattatgaactatcagcggagcggcaataccattttctttttggcaagcatcacaacttggatgcacattaattgtgttgtgctaactaaacaacaactgaaattgcaatccagaagaaagaaaaggacggccaaaattggttggtgacagattgacactcgctcttgggcttcagaagaagcatcatattgaggtgtgcccagtgatccagatttaacaggctatatcacatcacagaaatctgtaattaatttttactaaattgcaactaaaaattgacaaaattgtaacttgtagaatatcattgaacttgatgtctagattatgttcgggatcaggatgaaacaacaaaacaaaaagggagcacacaaatccgtattatttccatgccaaattccgaaattggcttcaaaaaatcaaggaaaaggaataaattggtaggtcaccatcgatgtcgtaggagattcaggatcagcgatgttgatagacgctgggatagcctcgtcgcctcctatttaccctcatcatggttggggaggatggccgacgttggttggtatggcctagatgccgcctaggtcagttcgtcctgggagcagcggtgcgagcagcggtggcggcgacagggaagcggcatggcgaggaggaggacgggatgagcaacggctgggaagcgcagggccggccctggccctatgaagccgaggcgatcgccgggggcccatgatggtggaggggccaacacctaatactagtagtctagtagtctagtacctcatccgatgttgagatcaatgatctttattcagaattaaaggtgtgattcttcgatgttcgcgcatgagattctgaagttcgttatggatgcagattgctatccaaatgctttagttgcctattgaaatctcttaactgtacctatgacggtagcttcagctgaaagaagtttctcaaactttaagttttgaagaactatttgagatcaactatgttacaagaaaggttaaatggcttggctatgtgctcaattgagaaggatatcttgaacactattgataccgttattgatgattttgcatcaagaaatgcccgaagaaatatcttttcatgggagcaacggatatgatggggttttgttcttcattaagttaatgaataatgatattagttccaagttacaaatatattgttatttttatttcttcataattaccagacatgttaaatttaatatatggatgtatttgttatcgttttgcaagtaaaattattatctatatatcataaaattttatatatagtttaggggcccatcgcgatgagttcgcttagggccctcaaaatcataggaccggccctggggaagcggggggtgctgggatggaggcgtaaatggggaggcagcgcggtggatgcgagcgcagcagcgactgag

SEQ ID NO: 2463 - DNA, 2000 bp, Oryza sativa
gcttatagtctactgtgcctgagcccactccccggcacacaaaacgaaacagcgttttaatgcgtaattaattaagttttagctatttttttaaaaaaatggattaatatgattttttaagcaactttcgtatagaaactttttgcaaaaaaacgcaccgtttagcaatttgaaaaaagcgtgcgcgcggaaaacgaggaggaggagctgggaacttgtactaccgaacggagcataaaggcaagttttataaaagaggtggatgttgcatctaatcttgaccacatcatcaactaataaatgtagaggtaatatgtacaatatatcacatctatactaattctaatacactagccccaatgtttgtttgcctaatctactcttcctctctctccttttgtcttgaattttgtgtggtggttgcatcttgcatgagatccaccgcaatagtaaagtaaggtgctttctataaaacatgtacatctcagcaatagactagattaatagtaaatcaccttaatagtatgtctatatgggtatctatatctctctaatctattgcatcgtttttttctatagactatctccaggttagtagatagttttactctctctcttcatttaatctctttcaaataggaaaatatgctgacttggatatcttgtagagagcctatagataaccattgcggatgctctgagaggtggctgcatatctctttcatctcttctctcctccacctcactattttagcttatgtgacacctatgagactatgctttatgctcatagtacttgtcctaagagtggtaatatctcgttgggtggtgcactccattccagtccacactccgcgctcccgtgatcgcgcatcatacttaaccacccccaccccgaccccgcgcttgacccggcatctttggccggtcatacacgcggggggcctttgcctttggcacccggcgcgcgtcccgtctcccacgcccgcacccgcaccaccgcccaccaccaccacgccacggcagccgcaccgcaccgcaccgcaccaccatccttcctaggaaaaccccacccaccctcaccctccagttccaccgtcgtctccactctcgccctcctcacgtcacccccacccccaccaccaccactctcccacctcggccggcgccacctccccaccccagccctcgccgtcgtgcccaggcggcgggccctgatccgcgagcctccccggttgttgggggctgggggtgcatcgatccaggttggttttcttctactcggccaaagatcggatttctctactacctaatctttgatgtgaggagcattaggtatacggcggcgatctgtgactgttcgtgctcgaattgcgggtgttcgttctgtgttgtgtcgtgctactaggattgaagatgtagtagtagcaattgccaccgggattgtttgcgttgacgtgatcttgactcggctacttgtcttgtaaaatctgcaagaaacttagcgttgccggatctggctcatacggtatatggtgatgctactttaacttagtgacatcttggatggtcaatttaacttaagaaatcagtttcgggtcgcaattttgtcttctgtggaactgaatcggctggtttttcagaagcacggccttctgaattctgtgaaatgcttctcatttaggatactgctcttccagccacgtatgaattacatgcggtagcagctagctaaccatgtactgatatcagtttaaagtagcatttgttgttactttctgttatcttttgtatgaaactgaatttttgttaacggcaagtttttttctcgcacctgcctcataagctgttattctgttgtttagttcagatggttgccttcatacaaggaagctgaacagaaagtagttcgtgcatatttagtactcttcagatgtctgatgatatttattgcttttcagttccgtatctagtggacccttctctgtcgaggtactaaa

SEQ ID NO: 2464 - DNA, 2000 bp, Oryza sativa
  misc_feature (546)..(546): n = any nucleotide
gcttgattttgctatgccatttaaactcatgatctcttttaaaattaaatggccaacatgatacaagaaaccgatcttaataagatctctaatgcttgattttacaatgccatttaaactccctttgaacttctcttttaagatacaaccaacggaatactagaaaccagacttcataagatctatctccttcagggagttagtggtgttcagtctgatgcgcttttgcaatgccatttaaactccctttgaacttctcttttaagattacacgaccaacggaatactagaaaccaaccttaataagatctcttttaagagtatctccttcagggaattagtagtggtgtctgatagctattaaagagggtaacgatcaaatgcaaagcacaacgcaacagtgccatttaatgaagacacagacagacaaatcagaagaaagaccatgtggtggagtaaccctatactctggaaagtagtgaaacttaccatactatcaagctactaggaaacaatatttgcaagcaataaaaactcaagaatccnaaaacacctacgcagcaacgatttctttcccaattttactgttgcgcttcatctttttcaaattctgagcatcctgagaaaatgaagcaactggggtaagattatatatctcatattacgaggttaaacataattacattcaggaagaaacaaacatgaattttacataaatttatttagaccatttcacataaaggatgtgcatgaaaagttagcactagcagcatagcaaattcagagacaactgggaaaaaaaaatgaaatgtgctttccctataatggaagagggaacctggcttctctatttttaaaaaaaaaactgaaaaaaatccattacgctaacatttttactcaaaatacaggctagagcttgccaaaaatggcataattactaatgaattatcactaaggccaaactcattcatgatgtggggcgaaatggcaagaacaaatcaccttccttccggcgatcttgcaggagcgccgtcccatgcaaagcggctggaacgtcgaaatcctccgcctcgccgcgtgcctctggaacaatctggcgctgccgccagcagagcctctccctgaacacaccaacgcatcaatcgctggatccgtggagacggccagacgggagacgagtgagcgagcgagcgaggactggttaccatggaggacggcggcgctcctgagagcggcggcggaggaggacagcgacgaggccttgtggacgagcgcgcccagagcccgcgcggcggacgccatggcggcggagcgcgcgcaccaggtgctcgacgaattgcccgcttccggcggcgcgggctggcggaggaggagaggagtcagcaggacgcgacgcgagcctggatctggtgggattagcgggggacggctcggatctctccacgccctcttccctcagccgttggatcgaccatgtcctggttggtagccttggctctgacagctgggccaggtgactcgccacgtggcctcctcgtagggcggaagtgtcagctgcaatctgattccgataaaacctgacttgactgagttgacccactactacactactatgactcgtgggaccccacagactcgcagagcgggcacacgcgtcgcccatcggatgcgcgccgcttaagatccaacggtgtaggaggctcgtgggccccacatgtcactggaatattcgcgcaccgtctcgcctcttctcgtccttcctgccgctgttggcgtcgggcattttccatccccttctagactcccgccgaacaatccactccgcccttcatatgcgcgcaccgctcctcccgttgtttccatcgacagaagagagagttcagatcaaacgccgaagcaattcttccgcaagatttcgagtgatcccatctcaatccaagctaaaccgagagattttgatttgttgctgtagattgattgtgtgaggagaggaggagcag

SEQ ID NO: 2465 - DNA, 2000 bp, Oryza sativa
  misc_feature (1698)..(1698): n = any nucleotide
ttaccttaacttaggttgcaactcagaacagcccgagaatgcaaccgacaacacggacgaggcaaacaccaataacagcagcaacagcggaaccaacggactaacacccaacaccacaggcgacggctgggaaccaggacgaaaccctactcttcacttcacttcatcttcagcttcagggcggaggaactatatatatttatatagagcaagggtgagtactttcgtactcagcaagtcatgggaacttaggtgtttaatgcaagtttggaagagaggcaagattgttttacgaatcttttgtttgaaagcattttggactcactaagtgatttacctcctttttaagtttgggtcgaaaagagacttgcgtctcgattcgactttaagagatgcttttcaacaactcaaatggtaatgtaccgacctcccgggtcagatcattacttctcggctcctcgagccatttcacttgattaatcggctcccagagcctttttcattttctcggactcccagattccagctgcccagtcgtacaacaatccgcttccactcgggaagcctagtctatgatgcccgtagacatcccgaatcacacagattcgtttctgaccactcaggtcatccatctgccacataggctgattctggcgacgattcccaatccacaacaacttttcacaaagcacaggcaaacaaatctacgcaacgggaaccacctcacatccgcccatgaccgtgggcatggctgttcgaacagttagttaacctctgcagaggggtacactttacccacaagacacgaacttactccagacaatggccggtgtcagaggttcgtgacaaagcctttcctaagccgacccaggattacctcatgccacatagaaggatcaaatcctcccataaatataggccatttcagttttcacaaatcaactccaaccacctcgatcggtaatctggcaagcttcgcgttcttgccctaccaggaacccgggttggctccaaccgaccccgccccggcgttccccaactattggcatgcgaggtttccctgaatcgactagttacttagccagggtgtcccattccaccttgtggttgcactttgttatgcttgatgaatttcccacaggaatcggtccttatatgcgaatacgggacagtgccacgcaggcacaacccccgcatcgcgagttttcataattcattttatttttaaacacaccgacaccacatgtcgggttttcaaggcttctcaaacccatttcccaatttttcgacaatcaacggtgtatgtgggatatttggtatacgcgctcagagagcacggataccgaggtaccacaagggtggagcgacaaggaatcagggtagtggctcggatcgaagagaggaggcgtgacggcggccggcggcggcggcgaagctcgtcggatcggggatgtggtcgcgcgagggaagggacaagggggcgcgaactcgggcttagccgaaccggtacgcgaccgcgatgcgcatgcggtgacgcgggacccgatggtcaccggcgacgcatgcgcggcggcgttttgcggcggcggaaggggcgacacggtgcggaggcaaaggagaaggccggcggccttggggcagccaggggaaggtcaaggggattcccggaaccttggcggagagaggaatcggcccaanaggacccgatggctgtggattgcggcggcggcaatcaccggcgagcaaaagagggaaaacacgacgagacgacgagggttcgattcaaaggggttggaacatctccggggttcaaggaatccgtttccggcatcggattgggtggagcggcaccgagagggctagcgacgagaggcggcctccggaacagagcatgacggccggcgagctagcgcgcggcgcaaaggcggcaagcggcggttcgggggtttccatggggatcaaggaggatgacaacgagaggaattaggcggagagctcac

SEQ ID NO: 2466 - DNA, 2000 bp, Oryza sativa
  misc_feature (339)..(339): n = any nucleotide
  misc_feature (701)..(701): n = any nucleotide
  misc_feature (778)..(778): n = any nucleotide
tcgactcaccatcgatccatctgacggttagttccaagggaaagaagaaatggaggcttcacgcaaggtgttctcggccatgcttctcatggtgctgctgcttgcagccactggtacgtttgattgctcctatggcttgggttttcaggtgagagttcagtaccatttttgatcgtggttgggtcgattgcaggtgagatgggcgggccggtgatggtggcggaggctcggacgtgcgagtcgcagagccaccggttcaagggcccgtgcgcccgcaaggcgaactgcgccagcgtatgcaacacggagggcttccccgacggctactgccacggcgtncgccgccgctgcatgtgcaccaagccctgcccctgatcgatgaaccagcagctagcgcagcagcttgtgccgccacctcgcgcatgtgtcatcgtgtcgatcgatcggatcctagctgccctatgaatgaataaaagtgtgtggcttatgcgtggttttctcttggagaactttggcttttgtggtgttaagttcgatcgttttgtgcatccaccatccatccatcctcccattctgcttgttctaagattatactactacttgagaaggtgatgcaaattgtgctcaacagttaacagctagtctattaatactgcaccgttaattttttaagcaaaaattaaataattacttattttttnatatcatttcgttcattgttaaatatactttcacatacatatatagttttacatagttttacatgtttcataatttngtttaataagacaaatagttgtggtgtcaaatattttaaaacggaagtaataattattactacctgagatgatgttttaccacacacgatggggtatgtgtttttaccccccgttgggttgaagtgttgtctagcgattgatgctgcccggtgtcacttgctgacttgcatatgatgcgtacacgtgctgaagcccggcgttgtgcgtgtatgtattggagggggctgaagactggcccttaacgctaaagcatttcttgttaaaatgggccgggcttcattttaactcgaaaacaacctcaatgcaaaatgcaccaaagtcatcaaaggtttgttatggacctattcgtaaacaaataggtccaacataatttaaccttcatagagtgaacaagggattgttcgtaataaacacggaccaaaatttaaattaagggaattgacaggggccgcgcgaacgcgtaccccctctatcacaaattatgacgtccactctcccacttggggagatggtaaaccaacgcgctcaccaagtgcaatgtgagccattgatctaggccacggcccttcttgatcggccgtcgaccccgtccaggtaagtatgttgcaacgaggcaccaccagcctattatatagcaagcgctcccacccccatcgcgtcgatttgtcgaggtggtactaaacgagagctggccgtgctcgagaaggattgctattgcggccacagggttgggccttcgttgcgtgggccttactctttttggtgggctttcgcttcggactccgcagcggcgtgtggaccggcaaggcggagtgtgcactagacgcaaaggccacgcgcccacgtgaacccaaagaaagcgtggtccaccgagcggtggaatattcccccgcacccgcttcggaacgagcacgagagatgcggatcggtcggacccccacggtgactgacgtgtgggaccacgcaccgtacggcgagtcgtgggccccggcgtccgcatcgccacgagccggctcagcgtgaacccgttccacaggaagttgcacacagacaggtgggaccgggattgggttcagtatggaccgggtccacgcctcacctcgcctcgggcgccttcttctccaagccgccggcgtcgtcgtcgtcgtcgtcgcatctgggagctcctacaaataggagaaacagtcagggagaccaaaccctaaaaccccgcatccactg

SEQ ID NO: 2467 - DNA, 2000 bp, Oryza sativa
  misc_feature (499)..(499): n = any nucleotide
  misc_feature (1064)..(1064): n = any nucleotide
catttccaagttcagtcctgacattgccccctccatggcaacattcttgtcctcaaggatgaaaatctagatacataccctgaatcaccgtcgcatcttcccaagttgcatctgctgggctcaagttttgccataacactaaccactgagttactgctaccatcttctaggcaccattcttctttgcaaaatagcaacaggttctgttttaatttgtccatcaggtccggcagcaggaaggttggccataggaattgcatgagtcccaaggtgtcttttcagctgacttacatggaaaatagggtggatctgagcttcagctgtatcgaggagtgatcctctctagcgggggatcgtgggatcccccttttgtgagttcggtcaggtgaaagagctcgcctctagaaatcacgtatccgccctgtaggctgctaggaagcgtgtacacctcaagattatacaggttcgggccgctatgaagcgtaataccctactcctntgtgtgggatttagattgagagttacaagggtttctccacttcgggggggcgttcattattctcttcttctagagctcaagttttctcggagtcgtcccctttctcggtgggcgaggtcctccttttatagctcaaggggatactacatgcaccgcctctatctactcttctatatagtaggggcccaccctaccttgatcggaacatgatccgtgccttcgcctggaagccaaaccacagcttgcccagcggtgggacccagcgccgtcccccgtctgacacggggggcagccctgtcattccctcattaatgggtgaagaactgaagacttgtggtggccgccctctcatggagagagcttcgaatgacccctccaatgggacgggtcatacctacctccactccaccggagacagatgcgacgtgggggcacgggggctcatccagtcagacgtgaccggcgacaggccggtcacagaccggtcattcctgactgaccgagccagtcgggcgtgccgcacgtctgccctaccgcattaaatgcggcaaggggcagttggggngctgcgcgcattaaaagtggttcagcctaggccccctccccgcttactcccccggccacatggtagctgggcgagggcctcggggcgaagtggcgcgagggcccgaggggcatgacgtggtaccccgaggccccctggccgctcctgcggttcgcgaggtgcaggggtagggccaggctgtagggccacgcgacaggatgggaagatgaattcccttcactacgcatacccctgggcccatatctccgatagtagcccccggcgcctcatcggacattggcctcctgaggacagtctgacgtgacgcctcacgacttcccaagctagggttgtgggcccggcgaggaacctaaacggatgtcgccgagcggccaggttggcgcattagcaataatggcgatttaaccaccactaaccgcgctgatgattgggtagcttagggtgcgaaaatcggggggtcggtcggaccacgcctcgactccctcgctcgccatgcacgagatagtaccgacggtgggcccgcctagcttgcgcccgtgaacatcgcatgccctgcgccgagcctgccgctgacaggcgcactaaacgcggggcgcggattcagtgggtgacgtgatgagtggacgcgggaaaacatgaggcaaccgcaggcgcatgaatcgtgggggcaactgtgggggcgtgaaacgaggaggcgagcacgggagaggcagggataaaaggatatggaggcggggacttcgcctccttccattcgccaactgctcgcccgcacactcgctccctaagccctaacactcttgccactccacgctactccgcacagcaagcccctcatcgtttcaccgccggtcatcatggcccaagacactggcgacgctgtgctcccagcatcgcgcatcacggcggataggcaccttagtctcccctgcaaga

SEQ ID NO: 2468 - DNA, 2000 bp, Oryza sativa
  misc_feature (1915)..(1915): n = any nucleotide
ttgcagtacaatcaccttgaatttatatatggagaaatggaagaacgacgacgtgcagttttcagagtcagaaatgtgtgcagattgcaacaaattaaggtagagtggttcagactgagcatgagtgataagaaccaggcaactaagatttaacataataatataagcagcccatacagttgccagaatgggaccttttaatttgttctatcggaattccactaaaactaaacaagaagtatatgcattaattaatttattcttaacctgaaaatgcacgtggtgacatttaaaacggaaaaaaaaaacttgctaactgaattaaagtgtatggtcggcataactctgaaaagaacacatgcataacataacttccaagttcctatactgcttaagtgcttatgtcatatgtacatactactatcaaaagtaatctaacctagaatgaacaatccaaactctagaagagcaatattgcaaaagttttagttgacatataaagatttttaatatatacttccaactgaacctgtagattggaatgttagagtatcagccccattgtatctgcaaacaaataataatttttgaataaaacttttatatatgtgttcttaaggatctaaaaccaaaggctgaaaaataaacttcgatgaaaaaaccccaaaatcaactctaaatttaaggttgaaaattcaaattttggctgataagcataagcataagcgaaaagatgaggccatatatatggaagttggagatatattacgatatgattgatttgcgtggactcattccttataccttactgtgtaactcctatatatataccgccaccggccatcttagactcaatacaacgtgtgtatctctctccctctactattcaacatggaatacacaagtaaaccgacggcacaaatacttggtacattcgcacacatataatatctgcataaaatacagttataagttacctaccaataagaagagatgtgcatgttgaaaatttgcagcctacaactggcattttggggggttcatcacctgcctaactcacataaaggctccctatagcatgagaaggacaagctcacatgagctcaaccagataattcgtgggccccacactcctctcacaatccctaccatctctttccctctcctcccccactcctcctatccctctctctcatctcttcaccctttaaaaagcaagctagtgtattgtgcccacccttgccctcctaggctacacctcaccctccctctctgatacacatgcatacatacacaaagatacataaatacatatatacatatacatgtgtactatacctacaacaacacacatctgctccacactagtatatagctactaggtaagtagctaggccaattacctttggttgcaagccaaaagtaagtatccatcctcatccttttcctcctcccaccaagaaccttcatagtaccaccaccaccaccactcatcacatctcacactcattgcctctttcttcttcctccccatctagctctagcccctctcttgttcaaacaccttcatctgaatctcttgagcctgaattttcccaacacaagcaagcactacaattgagctaagctatagcacacacacacacacacaaaccctgaattcccacttcctaagttcctatagctaagcatatagtagccacaaggagctagctaattcttattagctatagctccagatccctcacaattctaaatttccaatcccaaaagacccaattaaacaagagatagttgcctcctaatccatataataagccctcaaattaactagtagccatatactatcaatagtaacaaggcagcacaagcagcataccataagcatacatcgggtcaaagccgaggtcaagtncaccggcaggaggacaagccggcggccggagcccagaggaggagctgaggcatcatcgatcgatcgatcggcatagtgcacgtac

SEQ ID NO: 2469 - DNA, 2000 bp, Oryza sativa
gccatggagtctcctcagagttctggtgcagaagagtggggcttggagagaaggccgtcatatgtcaaggatgatgaggacaattcagcttctcagtcagaggaatcgagtgaggaaaatagtgaacccatgaacgaggagtacgatgagctgctcccagattattcaagggacaattctgggtccagccctcttcagatgatggatgatgggagtgacgataatgaagaagatgccgaaggggatgaagatggtgaggaagatggagaggactacgatgcagaacagcatgttgacgaagacaacgacgatgctgagatgggcgaggatgatgtcgaggacaatgacgatggcgatggtggcggtggtggagcggagaacggtgacgaggatgaagacggtacatcatattcttccgagtatagcgaataaaacgaatgaattaagaagtctggccttttgaaggtcacgtggcaaccaagtgatggtacggtttacatctggttctatctagctcaaacagatggtttatccatacatagtagaggattatcggttttgtagaagtgtattggtaatttaccaacatgtagcaggatgtatacacagtatattcaatgtcggaaatcattcccgtacaaagttacctcgtacggcaggaaaagttaagaggggaagcccgataaaatcccatccaatatggaacccgctgtctgcattgcattccttgctgcgagttctaatctcgggttggcctaacatgatcgtactattctttatgccgaaggcgatagagatgtccggattgatactcccatgcatgccgagttcatctctcctttggttgagttgctgggcagatgtagcaatgccgagtagtcgatccggcttgatgagaaggcatcgccggtaattggtctcggtggcgctttcgttatgggggttatgggctgttaattttgttaaattaaccatactaaaatttgacattataaaaaattgacatggtagcaatctaagaattgccaaaacttgtcaatgtcgaacaaaatttgaagaacagaaactcaaactctaatccgagataaaaacaaagaccacatgccaaatcgaattccaaaaacgaaacgccctttgaatcatagaaattaaaaaacacgagattctgatatgaatgccagtacaaaatggaggattgttaaacaccaaaactgatatatgaatggtcgtttgattggaccacaggaaaaacacatgaattagatgagagagatagattcaaaggaattttttcaaaaagttagacctcttgtcaaacttactgcataacctacgtgcaatgagccattccatagtcccaccaacttcaaaaccaaattcgaaaattcaaattttagctcttatttttgagttattaggctaaccaatgagactcatagtaatttttggtaggattttggaaaactccaaatccttaaaatcaaagctctccatggaaaattttatataacattttaatcgtataaattcttgcgtaaattctctcatcgaaaagtttggacccaagctgcaaacgtggcaggctggcagctgacgacggatgagcgcagaatatttccgacccaaccgaaccaactacgcgtccgtccgtctcacgtgcaccgagatagcgcgcgcgccctccaggacgttctggaagcttccacacccatctccacactcctcttctctcctccctctccagactcttctctctcccctcttttcttcccccctctctctccccccagcatcgtaccaaaccacacaaccgcagcgacggcaacacgaagctctcctctccggcgagaatagccaagaacgcgacgcgaccacacccaagaggccgaacagatcgagctcaagaaggttttagcccatggggatggattactacaagatcctgggcgtcgacaaggccgccagcgacgacgacctcaagaaggcgtaccgcaagctcg

SEQ ID NO: 2470 - DNA, 2000 bp, Oryza sativa
  misc_feature (86)..(86): n = any nucleotide
  misc_feature (126)..(126): n = any nucleotide
cataagttcgaaaagtatcctagtgattccaggagatcatgcagtagttctgtcatgcagtctgctcttcaaatttgcatgtctgntcatagttgttcatagctctgtcaaatctgcatgcttgtncatagttctgtcaaacttgcatgtgtgttcataggttgatgaactgaactctatatggagtggtgggggaatgtggatattttttttccctggtataggtcttctgtgagcaactgcttttgaattttttagtaataacagtgaacttccaaggctggaaaggtattttggttgcgttctgagttctcatgctgatgaaattccgtggttggtttagtgacccgatctgatgatgatccttagagttgggctgatgcaatgcgaggacagtttcgttagtaaaaaactgcaatttgtagttcacaagattgtaacagtttgtcatggttccctgtcgctttcttagtggtctggatgtgcttgaaatagttggatatatgcaaaatgggctgatgtgaatatgaaagatcgtatctttatgattaaatatgaggtatgccctttgatgttgactttaaggttgctgccagggtgcttttttctttctttcttttttgttttagctagttttgaaagcaattcttggcatttgttgatagaatttttttgataggaaaatacctgtacatttttttgttaaaatatgattttcaaaaccttaaatgagccttgcatggttgtttttctcaccttaatgattcctcggtttagctctgatatcattgctttgttcttcatatagtgtgcttctaggagactatgatgccttttgttttcaataatgtttttcatgcaactaaacggtattcttttcactgcagcaccagccgagaccattgtcactggaaatgatgtccctctcttgtcttttgctgaggtggacttccttgtcttttctgtgtttgttggcaccactttcaataccatcttcgcacaatatttgcaagaagaagttggattctccttttgttttagagagatcgtcttgttctgattaccattcctcttgtcttaattaatcttcacttgactgatacctgattatctacctcatatagtacattgttatcatccactcaatttacatccatactagtatgtattaagattttttagaaccattttgctgcaaccacagtatgattagagcagcccaacgtttcaaaacactgtttcctctaggctttttttaagttgactacggtttaacagtccacagtagtgtgcaaatacatttgtggattacattgctgactttttattcaagagcaaaaacaacatatcacccttatatggagaatcggataaaaaaatttggagtaatcttcttttttgttgtaaatatatttgtatctttttaataatcatgtaccaaagtaggactactgttttccctaaaaagaagttaactctgtatattttctagcatcatttatattgctacaggtaagaatgtccaacaagtcctagttgaagccatgtcctagtagttgacatgagggtggtaactggtgacaacctttgagtatttgtttagtaactttgatcttgcagtttaacacaatcggatttgataggactctgaataacttaaattatgcaccaaaacactgataatctgaattgagccctttaacaagttccatctttggatatagttccagtcatgctgattactgtgtttcctatctctttgaagtattaattacaagtattactagttttcagagagaaggggtattcataacagtatgtggtttactatctgtctaagaggtgctcacgattcatgaaattatcaagcagagtaggatcttgtcttgaaaagtgctatgacaacagatatgtaaagtcaaaaactttttctcttataggttgcagaaaggcttgatgaattccatgcatctggaaccagaaatcaaaattacatggcc

SEQ ID NO: 2471 - DNA, 2000 bp, Oryza sativa
gcctaacatgcaagtatgccagatcaacttactaaacacttaaaactcaacatgcaaacatagtaactattacattctaaaactcggcatatacattataaatcatcattctcaaatcattttaaaaatatttcaatccaaatccatccatcatttgtacaatatttaacatatactcattcatatattctaccgcaaagcgcggatgccatccagtataactcaaaaatagcccatgacatggggttttagttatctattggattgtgctgatgcgaaactgataaagccaagccacacatgtatttttgccacatggtcagggacagatagaacgaaatagagggagtgtcactcccttactttactaaagagggtgtttggatttagggactaaactttagtctatgtcacatcggatgttagaacactaatttggagtattaaatataaactacttacaaaactaattgcataaataagagttaatctgcgagataattttttaagccaaattaatccataattagcacatgtttactgtagcattacataggctaatcatggattaattaggctatagatttgtctcgcgaattactctagggttatgaaataagttttgtcattagtctatgtttaatatttctaattagtgtcaaacatccgcccccagaccgaatttagactgattcgggtgcttgagtttggactgaggtgatgtacatgcggttagaatagataaattatagtataaaaagaatggattaggctactggacacccgcacctctcctatgtagctccgcctacacacaagtcagcttagatgcaacatacaaatttacttgcaaaacatacacttcattttcttaatttgtgtgaaaaatttctactttgccgttagtgttgaatcttaatccctaactacccagattgaatttccaatctttttattgaaaaggaggcaagtgttcagctagtcaatcaattaaatgaaggttggaaagtataggtaggaaagccgaaaggggtgaacccaatgggaacaaaataaacagctgagagaaattgcgagctgcaaccttacaagttcaaaatgggaatgggagaagaaacaactgtgagccaaacatgaaaagaggggttgatcatcaaatattgtatgctgagactctctagtatgagaagcagcttcgagcaccatattttggctggctctacaatctaggtagttttgtttttttattatttccaaccgtttctacattatatagtcatatagatgaccacattgttgaaatagcatcatagatcattggggcataggtggtttctgcggctgcactcaactattgaccgatcttgtcaaaggtagagcgacttgctagtcatagaacgttataggtgtacttttttattacaaacatatggattcaaacaataacggctaataacagaatttaacaatcattttattacggttttagataatgaaagtaatttctagccattgcgatgatcatgaattacttccacctacatgtttcaaatgacttcttaattaatggattgtttcactcatttctacaactttcacttccatgttgcatgattgtagacaaaattaacatgttcaattcatgcgttccaagcatgcgtgccgtacttattttcccgcgcaaaaaggcaaagcgtgacctggcaatctagcaaaacctccaagtctcataccgtgggccccacccaccattccccccatccgggcccacctgcagccgcacattgtccccgtgccgttttcctaattatatttacctccattgccactcctctttttttttctcctaatatttaccaccattgccattctccccctataaatacacgcacgcaccctcttcttccacctcgagccagccatagcctcctctcctctccacgcgacgagcaagtggaggagcggcggcggcggccggcgatcgagctgctcgatcggcc

SEQ ID NO: 2472 - DNA, 2000 bp, Oryza sativa
gcgagaccacagcctaaaaagaggcctattggacgctgtacattttgacagcaaagctcgggaaaccggcgaaagtgtgaagctggaaacgctagaaatgaaagccctaaatactagtagtactgcaccatggagttgagtactttggctaaagatgagtgtttgtcatgatcccatcgatggctttggaagaatccaaaggcaaagccgtccgacgcggggcaagaatcagcaacgaacgagtagcgtccagggggatgaaaacggccacatgctacgggtggtttcgcccattacgaggctcgttcgttcgtgctcgcgccatggcgcggtgtcgcgttgtcggatgatcagcgagccggggctgccgttgtgatcggctggatttctctgcgattgcaactgaccgagccatccgtccattgtcttttgtctccattccattacgcacattgacagacatattagtactgtggtataaaagcactgcaactcgtgatttaagattcaggatcgtgatttaagatgctatttaaagatccaggatggcatccctgttccggtggtcactcacgggaacagcagccttgctgatctctcttgctgcagtcgtattcattgaagacggtattcacaatgctcccgggagaccaactaccatggccacgaggagcaaacgacctgtcaggccgccaatttgcgcgtacgtccggacgccagtggccccgccgctactacgagtcgtgtgaactgtgaggctgtgactgttccggtgggcccagcttgacccatgtgctactgttacgatgcacccgtttcttggcccacgttactaatacagatattgcaattggcccacgtaatacagtcacttgggctcggtccagtctagtactcgtaggaggccctggctgcagcgctaggcctaggcgacgccggctagaacggtccgctgctttgcccatctccgtgtgccgcgagaaggcggcggcctacggaaacggtgaaccttcacgtgccgcgcggcccagccattgcccgtgccggccgtgcgcgtgacggcccgagacgacagtacgccacggtgtcggtcgggcggccgcgcgcgcggccacgtacacggcgcagcgtggcgcggcaaaggcgcaccttttcccgcgatgccgtggatattccccggcaccgaccctataacttggaaggcgtattcctttaaaaaaaaaaaaaattggaaggcgtggcgggcgacgctaccacaggtgtggaaaaaatctcttctacctaccggcacgcgcgaaacgagcagtttctatcagcacgtgatgcatcaaactcgttctatggcggcaagcatacacacagcgataaattccagatgtacacgcgcgtataatatactagcgcttgttaatatattttattataacgtcgtttgattttaaacatacatgaatgcaaaatctacaatagcaaatacatatttttgtaaataagatgaatgataaatatatttctaaaagtcaatgactccagacatattaaaaactgaaatgagtaccactgccatcgtacattcgtagtacaagataagagtggtatgaagtaaaaaaataattgtggtcaaaatattgtactatgcaatttgaatactgcatcaccgtagttttacaagaaatgtatcactggcacttcttggagtgggtcgacaacgacagtatagaaaatacagtgtctcgacgggcatcgtgtcgttttattcgcgggcgccgacttcatacacaaaggagaaaactaaagaggggatcccaaataatattcccaaaccctaaagccctcctccccttcccgtggcgattcgccggtccgtcccccaagtctagggtttatgttcgctttctccccacgcattcctcccacccgcggcgctccctgatctggtcaagcccaccagaatccgctctccagagttggtgggggcggagggggaagggaggggcggc

SEQ ID NO: 2473 - DNA, 2000 bp, Oryza sativa
gtatgatgatttcatcaatttcaagatacatcgtccaatctctcggacatatggttatttcgtcaatattgagatatacccgtccaaatatgatatcataaatactataaaacgatataccgttcgaacgaaataactaatgtcaacataatacctaggtaatagatctgatatgggggtattatgtttggtattggaatccggtacctactataccatacggacctcagcatgatacccacgtaccagatctgatactagtaggtatcatgtctaactgtaccatgatgatgtcagttattttattgtaacagtatatcgttctgtagtctacctcctatgatatatgtacatttgcctcctatgatatatgtacatttgcatttgtgtgtgtatcaaatttggtagaaaagaaaggaaaactttacttgcatgcaattgtccaattgaccaaaataactgttatctaattttacctcttaggcgtagaccgttaagcatgtatatcgcccgctttacggctttagacgctagcttatctagtacgcagaatatctgacggacgcagaggattgagacctggaagctaggctaaactaaacaggtagcgaaacgcaaccctttccttgacagttatccgattacgcgcctttctatcaggcacagcagcacgggcagccacaagattcaactaaaatttagttaactgcacgcctctttttcgtttacgtcgccgtcgccctatccaaattcgcccacgtttgatatagatgcataactgcaaagcgagaattccatttcttcatgcgtcaattggtccctctcgtcttctcctaggccacactattcttgaccatacctatgaaatcacaaaacgtatacgaccttatttggaacaagtttttatcaataaaccctttttgattttatacacgacaggaaacaattattctaaaattttctctactgtattgctaaccacttattttagctagaactttaaaaattttaatatattctcataattaagtagataacacgtgacaataatataaatcaaacgatttgacaagttttccggaaggaaaaaaggctgcaaaagccgatctggctgagtgcggttgtgtaactgtaacttttttcttctaatatatcgacgtacaatcgtttttgcgcgttcacgaaaaaaaagctgcaacctgcaaaattcaaaggtttgcgtgggagcttagctgaattccgccgatcaaattctgtttccacaaaaattgtccgctccgacggcgtccgcgcacacgcgcacgcacgctccccgcgccacaaaaccgggggaaaacgagagaaaaacgcaacgaaacgctcgccccgcaccgcacggaacatcatcatcatctcgcgctctcacgcggaccccgccgttgcggccgcctcacgacgcgagcgcgccacatggacatccaccatggcgccaccctttcccctctcctcgcttgtatatattcggcgcgatgccgtcgcagccggtgccttcgtttcaccctgctcggaaaaaaaatcctaaaagcttaatttctttctttgttcttattactgtctcacgtgagacgcctgagctcaactgaatttctggccccctcttcatctccgtgagcttcgctgccctttttctttgccttctcttggtggtttaatttcatcagttttcctccatttccttctttagccattgttccgattgccgtctcttgttgcatgtgcattccttctctgaaccgtgcccccccaattcgtccgcgagctatacaaatttggattcgttttgttcgtttccagctcaccctgtaaatcgtttctcaagtcattcaggcatactcacatcgcacaaacatatatataccccaagattttgaatccatcaatttgcagacgccataggcgtacaagttatccattcaagcgctccaaaaatttgccaagaagtttgccttaaatttggattc

SEQ ID NO: 2474 - DNA, 2000 bp, Oryza sativa
  misc_feature (1926)..(1926): n = any nucleotide
tttcttgagtcaatgagatagtaaacaatatggtgcgcattaatcattcatgtgatacaaaacacaatgtaaaaaacataagataagtacactctcatgaagagggaacataaaccttttaagttgcgattctctttttttaaaaaaaagttacacggttctgcaaaaaccatttcttcagacgccgttctttcttgttgtctaagcaaaaggactactacatgggccagcacatgtcccttaagaagtcttttggaacctatgaattttgtaggatttcacagtaattggtttaattcatacgaaaattctctaaaatttctctattccaaaggatgcctccatcattttttttgtaaccatgttttctttttactaaattcatttatttattcttctaataaaaaggagaagaaattaactcatcggcccattctcctttagctgtttactgatttaacttctttaaagtagtgcattttcctgttctatagcccaatctgcttttattgggtttactactttactctgtattatagctttcgatgacgcagctttggcttttttcccatgtcctgatgatgcagtttgttctgcgccttttgatagtaggtcattgctttccatggtaggtatgcaccatcaccattgtgctctctgtgtacctgccaaaaagatttacttgcagataaaatttttcattttagttttgatttttacaatacaaagaataataaaagttacaccgataaattatttttattcagttgactcgtttatttttctatggtttattagccgtagagcgaactgtgagagccttcatttgcgaatgaatatacgcactgctatgtgggctctctctttttccgtataaaaacataaaatctttctgtcaagtcatgattaacctttaccttttctatggagaaaacagatagcaaccaacaaccatggattgtttttgaaacactttttaaaattttgaaaagaaaccatccaaaaacctattgctatatttaaacatctctaatcatactattttaattggcaccagtaaaaaaaaccatgacatggcacccgcaatgacgtggtaggctactgcccttgcggattgatgagatcctctgcagtcactttaccgtgcatttatcacatgtcagtgataacagcacggagcagtcaactgcataggatcctgatccctgcctttgcattgtcttgctactccccttcggatggcgtggtaaaaaaagtttactttttcaataaatttgggggtttatttttagaatcaaaaatttaaaatggtttagtaataatgaaaatccacgtgcatatattctactacagatgttcaataatgtgtgcatggaaaatctaatggtttggattcctgcacaaatttgattgcatgccttccaaaaacgtacgtctaaatttcaaaaaggaaatactttatttggtgcaatcgtttcgcttattcatatgcttatcgacaggtttattagcaattagaaaataacttatacgtataacctttatatacgtgtccttaacgattaaaaacaaatactgtaaaataaatcattataaaaaaaatcacaaaatcaactctaaaactaaattttaaaatttaaattttgacttagcataagtaaaaagatcttattgtatccattgaactttactccccccgcattagaaaaaacaaatccaggtacggatatccgtgtatatgttttttttatacttctctccacttcgcaccaaactattttatccatatacaaatatcgtccttaattatatttttttatctaaaaaaaatcaaaagaatagcttctcctcgagtccacctcgacgccgccgccgtcgaaaaccaataaaaaatcctctccacgcccgcaaaccccagccccccantccccccacctcaccgccggcgaaccctagggggggatcaccggagtcggcgaccggcggcggcggcggtggcg

SEQ ID NO: 2475 - DNA, 2000 bp, Oryza sativa
  misc_feature (954)..(954): n = any nucleotide
  misc_feature (1354)..(1354): n = any nucleotide
aaaactccagacacccctgatgtaagcaacgtaaaggtatgtgacattgcagctcaggtgtatcttggaacagttgattatgcatatagttgtcttggctttaactcctgtatctactgtattgcaggcaaagtacatcaatagatattacaggcatgcacatcatctgatgtaattgcatcctatcttgaaatgagctatccaacttggagagctgacaccgaaattttgaaagccgtgggagagattcctggcgacatcttcaaattgggtctcttatagacccggggtgaaaacttgttgcaccttaactctgtactgcagttttcgtcagatcctgccattccttagagtatcgcttccttcggcattcttttttgttgtgcgtcgtgtaacattctgggaatagattatgtaaccatcaggccgtacatcttgtaagagcaaaacaattggtttaggaaaaatgctgattcctttcaccgtcctgtgaaggttgcttgggtgcaaaccccttgattttgtcttaactggtcttgcttgacatgctatattgctgtttgtagtatccgtggcctgtcgagcaccgatcttcctcagcttcgacctcgcctcccctcgtctaacttcattgttcttttttttttcagataatgtttgcattgttcttttgaaatgttacattcgagtgtcttttcaaatattcctatgtaaggggatcaattagtccacgtaaaatgttgaatctgactcggcagtgtaggttccggcgtttttttcgttcgatgttggtttggcgttgaaatcgcatgattttatgattatgattattatcagagagataaagctttctcatccaagtagaaacttagaatttgccagggttgagccgaatgggccggtgaaacccaagttagcaagctacaggcccatcaacattcggccgataccatnaccaacaccaccgttactctcttccccaaatccccaaatcttcctcttgactcgtcggcgcggaagggcctggcctggccgggatgggcggccggcggcgaggctgagcgtcgggcgtggccccgcggtggagcggcgcgtcgcgtcgaggcgtcgggcggtgtctagcagccggtctcgcggcgcattgggccggccccgcgcggtggagcggcgcgtggcgtcgcggcgtcgggcggggctagaagccggtctcgccgcggcgcaccgggtggccggccccgcaggtctcggcggcgcatcgggccgcgcgcgcgagccaccaggagccccggcgacatgcactgggtggcgcatcgccgcgtcgtcgcggcggcgggcggccgggcggcgacgcgcngccccgggttcaagcggggatgcgcccatcgccgttcgttgctcgaacagatcgacggcgaggatcgaagcgtgtggtggcgtagccgatacgcgtcgtgagctggcgagccacgtgggcccgcaccgcgtccacgtggcttccactttccctccacgtctcctcctgccccttgctaatccttccttgcaggggaggggaatctgccgctttcctcatcgtcggctccacttccacttcctcttcctcctcctcgaggacgaggaggaaattggcagctggaggcttggagcgcgctgcatcatcccgcccgccctgctgctgcggcgatcgccggagcagggctgcaggggatccccacggccgcagcagctgttgttatctggtaagcaactaaagctcgctatctgctcgacggaatgccgcaccgaccaggaaccaagtgttgcttctttctcgcttgatcttctctttggtagatgagtaaatgaatgcacctgcacttggactcgagtttgctgtgttactcggcgttaagcagcaattttctgttcctcctacttcgtttttcgcctactattcctccttacttattttgaataatagaccttgaactcatacttggaagcctgcagattctgtgtgg

SEQ ID NO: 2476 - DNA, 2000 bp, Oryza sativa
  misc_feature (362)..(362): n = any nucleotide
  misc_feature (368)..(368): n = any nucleotide
cgattactataaacttatagtctattatgcactactctgcaagctctacgcatccatggttcctgatcgcctattcgaataacagtttaaaaattgaacttttgcacgtttgtgctaatattccctgaaatatagtaattcgaaattcggggcattacagtagagttcaagtattcacacagtcagaccgtcgagctaggtggtctgactggtcacatagtcaacaacccacttcgccaattgtctttgaatatcaaaacccagttatctcacatgccaattgtttatcacaaaataataatcaaacacgatttaattttatagaataaacttgagtataaaacatttcattctaggtgcantgcacntaataattaatttatataattatggtcttatttcaaacaaatattaattgtttcaaagaaaccatgaaaagagaaagacaaagaacttagcttcaaacaattgttgatattttgcactaccaagccaagctaagttctttaaaagtgtggagaaaatataaaattatggaacttttacagagagaaaaaaaatccaatctttaatgtacaattaatttggttgtcactatatcatatgagaggatttaatcacaacagacattgagtttctctcgcaattttcgtttgtatccataatttacggtacaattttgctatatatttgtcgacaaattttttctcaaaaatttgacagatgtaattacagtacaatcgtagtgtaattacactgtaacttgcatctaattacactgtaactatagtgtaacttgtatgtaactttgaaaaatctctccttaacatgttatttcggtaaaatggaggtcatgggaacaaattctttcacatatatgtgtgctaggatttgttttcttcctcaccaaaacaaatcttgtaatagatctaacgattcaaaattatgtgaaacttagttacagtgtagttacatataagttacagtgtaattacatataagttacaatgtaattacactacgattgtactataattacatctgtcaaatttttgaggaaaaaattgtcgataaatgtataggtagtccgtttacggtatgtataaagctagtgtgtataatatgtagctagcgatagtttattatttactcgaggaaaaaagatgatccaaaagtcgtactccctctgtcccagaatatagcaacctagaaccggatgagacatatcctagtattatgtatgaatttggacatggagatgtcccagccggttctttggaatgagttggcgacccagatcatgctgctcttgagctttattaggatacgtcccatctggttataggttgctatattttaaaacagaggggtatgaactaatcaatctctggctcaaaaagggtagagcccttagatttccccttaatctacgagacaacggtggaagcgcaacagcaaggagaacgtggcgctgacgcaaaaagcagacagcttatcacttatcactacaatcatccggcaaggaaaggaagcacatggtttggaaccgtacttaactaccgaatcgcctgatcccaaaatttactactgacaatactctcggatgcaaaaaaaggtacggtcacatgcgcgattcgtcactcgtcagttctcaaaacttttagctttttgtttggcttcttgttgaaagtggatataaaccttgtactccttggttcttagcaaattagctacctactaatccatagctcccacaacaagtaaggatgcactgcgttcgccgactcgagagtgtgtgctatcagtgtttggctttgactgccaccagctctcgctctccttgttcccaagcttcatagccaattatgcgtgatcgatcgtctagctagctcatgtaagtttcttcttgttgttaataacgtggaatgcatacatatatacatgtatataccttaatcttcaagtacagcaattgcaggatttccctgacccatcagcag

SEQ ID NO: 2477 - DNA, 2000 bp, Oryza sativa
  misc_feature (61)..(63): n = any nucleotide
  misc_feature (69)..(69): n = any nucleotide
  misc_feature (72)..(72): n = any nucleotide
  misc_feature (76)..(76): n = any nucleotide
  misc_feature (84)..(85): n = any nucleotide
  misc_feature (87)..(87): n = any nucleotide
  misc_feature (91)..(96): n = any nucleotide
  misc_feature (98)..(98): n = any nucleotide
tataagatttcacacattatttaaggagaaaacccgacatacgactaaaatgaacctccannnaattcntantcangagtacanngnttgnnnnnngnggtgcacaagttagtcaaaaccgacttaaaatgggaccaactcgtcctaatctccataacgacccaccagtcagtcttctggctaaacgataggccaggaggtagggcccaggggtcgcccgaacctccattggcgcctctgatcctggccttccatgtggacgtccctgatagttccccaatgacggtcaagggcgcactgacctccacaaccgccatacaaccgtcatttcaagatataaaacgaggaggccttcacacttcacaacgcataactttgagctcaagtagagtacaacacacaacttgataaggtggtcttagtcccacgcccgtcatcgccatcttcgcgcccgctgctctagcggtgggtgcgggtggcagcgtggttggggaagagagaaggaagaagacagaaaaagggaggagatggatggaaaatatgatggaagtggtacggtcccaattttgtagaattcaagtggcacgactacgaatagacgaattgtaatggaatttatctaaatatgtatatttgtaatggcacgggtccaatttaccctagtttttacgtgtatgtatatagtttatatgtgtacgtatatagatggcacctgcatatataaactttgtatgtataaaattttatatatacgtgtataaactttatatgtataaatttaaaacgaattgaaaaattacttgaggagcagggccaatctgaaaaggaaaacaagcacacatgcctcataccccatgtttttttctcaagtaaatttttaattcttgggtttaatatttgaagagttattataccaggtattgtggttgagggatacgaattagatgcgacgtatattttgagggagttttgttggactttttccatcatacacgaatcagattcagttcactagttaagggagtcaaagtggacttgttcctgacttcttcccgtagtggattcagacccgggcttctgaaagcccatacagacaacagcccagcataatttagccccagtcctcgagtgacgccctaactaaaccctactttactactagtcgtcgatctcctcgcgactttgcccgccgccgccgccgccgctctccatcccgcgagaagctcgtcgccggcgtcccgctgcatccatcctctccggcggtgagcgcccgcacgcgtgcacatcctctctctcatccctctcgttgtacccaacaccccctattttttgttttttttttccctcgaatttgccttaaaccttagcttctctcctagatctggaagcgttcctctgtgccttgtatgtgaaccttagcgagctaacctctctcggcagtcttgtctgctagcagtccgatcttcttcgtcatcgataggttttgatgctgtcgcgtgcgcttctcgatttcgatttctccatgcctgtgactttgtatcgaaatccttgtgttgcggataggatactcgttcttggatgataatccttgtagctagattcggtgccgatgttgctgggttggggatttcaattcgtagcttgtagggttgatgggtttcattcttgttctcatgatttgttcaggtaaaaatgacgcctcatgtgaatttgtgtgtgtaagtaccattgcacttcacctctgcttacaatgtcaatggagctctatatgaaatataggtatgattagatctgtattgatagcacaacgtcctggttacttgttagtgattcgatggttggttttttagacaccattttttgcttgttggtcagtgagatgtttgtttgatgctatctttgctgcatgaattatcgttaggtctttcttgcaactttctgtcaatttattttcgaacccatatgcatatagatcacctgatacattttgttgtgaccag

SEQ ID NO: 2478 - DNA, 1974 bp, Oryza sativa
  misc_feature (7)..(7): n = any nucleotide
  misc_feature (10)..(10): n = any nucleotide
  misc_feature (12)..(12): n = any nucleotide
  misc_feature (25)..(25): n = any nucleotide
  misc_feature (32)..(32): n = any nucleotide
  misc_feature (38)..(38): n = any nucleotide
  misc_feature (47)..(47): n = any nucleotide
  misc_feature (53)..(53): n = any nucleotide
  misc_feature (68)..(69): n = any nucleotide
  misc_feature (76)..(76): n = any nucleotide
  misc_feature (79)..(79): n = any nucleotide
  misc_feature (89)..(89): n = any nucleotide
  misc_feature (93)..(93): n = any nucleotide
  misc_feature (539)..(539): n = any nucleotide
  misc_feature (542)..(542): n = any nucleotide
ttcccgnggngnctgtcatttagcntgtgatntattangtgtttggnattatnaatatgtgtaaatgnncatgttnaanattttatatntatntatatatatatataaaatattgtttagcagtctgaaaaataccacaacctaataagaacggagctttattacatttgacaaaaagaaaaacgtgtagcgttagatttaaaagcttttgttttgtagaagtgaaataatgaggagatggtggactagactggaaaaaaagcaagcaatcccatctcgtatagtcctacacttcctattcatccccaaacaaagcgccgcgctaaagccgtaacgtagaaaaaggggggacagaatgagagcggcggtaagcgcaccccctccccacagctgctactcccgccgcggcgccactctactggacgcgcgccatgtgctcgaccatatgccgcagaggcgcgagccgccccgggccgctggcctccgtgccccgccggcggccgcggccgcgtcctcccggaggacaccaccgctgcgcntgnccgggcgcgccgccgccgccgccgcctgtccggccgcttcaggtactagaagggatggagccttttttcttggttgttccctcatagccacaagacacgtcgtcctcgatggctctggggtgaacatttgcggccttttgtctggatatctgtgcctgggtgggcgctgcgtggttagatggggcttgagtatcgggagattgtggtttaggacaaagtcttttggtggtcactaggtggggaagtgaacgcttaataatggcatgaaagtcttgggggagcttgcaactacaaaacaaagtacggaatgaaaccaaacgattgctccattgaccattaggatacatagtacattttggttaactgaatcttgcaattggggacaaggacactcctagcgttgattttggagcgcatacaagttaattgagtattggtgccaaatgccaaagggattttgggagaaaaagaaggtatatgaagggataaggcctaaggggaaatgtgaaggcttataagatttcaatgctctcaatgagttgtaatttcgtttctgaaattcttacttgccttcagaaaattgttcaaaagtatcctgctaattcatataatgtgtatagctgtacttatcaattcttcagctttatcaggggtgtgacttaaatttagcttcacctcatcatcaggactgcacttgaatagattgtttcagtagtatacaattatacgtgaggcttggattcatgttaaatactgactgaagtatgctctgcctatataatttgataacacatagataaaagaggcaggagacaaatatcccttgatcgaactgtaaatggaatctttgttgtccggcataagaggttagagctatttgcaagttgtcgtttttcatcttcctggagtttgcttcattgtagtatatactccattgcttgagaatccgggatctcttagcccagacttttacttgccccaagcaagcctgcttcctaaaatcaagcaaggaataaacccttgctagttgcttgcattattcttgcaaaaagccaagcatgttcatcatataaaaataagtatagcttttcatgtatgccacattcagaggttaaccattcttgttgagcacttcctgcatgctttctcagctatgctatatttatccagactgcaccgtcatttagcatgatgtctaaccattgctcagttccttatttgttcaggatactcctgccaattccaacagcctttcgctcaacaactcgtgtgcggttgacctcacctgcattcttgccatcaagacgaaattttgaaggctatattcctcagagctgctcaggttcatcattgcagatctatagccggtcatccctgctatctctctcaccatcttcagctctcatggtgtcctcccagctgaactcttcgg

SEQ ID NO: 2479 - DNA, 2000 bp, Oryza sativa
  misc_feature (127)..(127): n = any nucleotide
cggtagcacggccggccaggggcgcgcagacggggcggcgtcggcccctagctcctctcgactgcgcgcggtcaagtgacagcgacggcagcggcagctgggcgagcgcgcgccgacagggcggcgntggcggcgtcggcccctagcgtgccaagaagaagtcgtgagaaagagaagagacgcattctccagatctaaacgatcctaagggtatttcggtcatttcgcgagcttagtgtgagaaaaaaattaaaaatataaacaaataaaaaatgtctcaaaatagcccaaagtagcattttattaagaaacagtctctattgagtggcatttttataagaacatcctagagagcggtcttctgttaaagccacatctactaagtagcatattgttaagggcatgttcactttgaagccattttcaaccttaccaaattttggtaaagttaccaaaaaagtggctacatttagtttgctgtcaaattttagtaactatataagaaatcctaccaaaattttggtaagtcaactataccaaaattttggcattaccaaaatttggtaagttttttttttcgcataaagtgaaccggcactaaatttctccacctagatctgcacctgcaccagtacctgtacttgttctacttcttgttgtgcgaagtccagacccaattccaggctcaatcgtatcggcatcggtctcaggtaatgggcctaattccaggcccaacagtaagcaatgcagttcggtcatgggctcttcctcctcctatgcgtatagccgtataggaatagtcgtgtcgcgcctggattaggaccgcgctataaaatttaaaaatcaaggggttttttcgcaaaacgacgcgccctaacaacccaccccgcaagtcggcaaccctagccaccgccgccagtcccctcctcccccgcgctctccctctccccatcacgccgccgccgccgccgtcgcgtcgccgtccccgacgcctccgcctccctctcccgccgttcgccgcctcctttgccgaccgccaccgccccgcgccgccttccccgcctccgcctccgcgcatcgcaacgcaacctcaggcgcagaggcggcgacttgactccccccctccccgccctctcgctctagggtttcctcccttccccgtcatcagccgccaccccaccccctcccccgccgggcttcgccatgtacggtcaccgcgggtaagccaagcccctcctcttctctcttattcctgattaatctccgcaattccatcccgccgattcatccattgctttctttttttcctacaatacttgcttgcttagcgatctcatcaatttctcgattcttttagggataatttctaagtaggtcactttgctttgctaccatgatatgatatgatatcatctgcctaggatttaggatacatgtacagcttcccccttacaagaccaaacctctctccccccaataaataaataaataaatcggaggcagtaatacatccaaattgatgtttcatcaactgcaccagcatcccaactgtggtttgtaagattcttttctactgatatgtgtcatccagtagtttgagtatttcttctattcatatgctgtcaacatttaattagtttttgtttatgtccactaatgcgttcgcatttcgactccattcacctttttaagccttaagtcatgtttagattactagtatttcttatctgtgcagttatctttatgtttgggttattttatatgaaatggggattgagagatggggggatcgtctcctttttttttcttttctctttttgggactctggattatctgaagggcaatgatgggaggcgggggggtttcggatgggtacgagggatcaaagaggccacgaatgatcgaatccaatccatacttcgcagtgaccgcaggcagtcccttggatgtctcaaagagggccaggatgatggaaccagcccctccctatttcggagcc

SEQ ID NO: 2480 - DNA, 2000 bp, Oryza sativa
taatttagatgaaagtttaccaaattttaatattacccatattttattcttatatatatttttctattgtattatttaaatgaggtctaattctaaaattaacctagataattttggaggctcgagggctctaaaattaattaaaatatcctaatatggcccttattattacaatagcacattgaatgaacttatttgcatagcaatatattttacacggataggtttaatccaattattctataaatagtaaattgagacttggtacaatattaatctaattgtttaattaaaactcacatattcttatttatatataatcttaatgtatttatatgaccattattttatatgagtgattttcatgtcatgaggaagttggcgaaatgttgtgagtatcactctatatattccggtgaattacttatttataaacacgatcattataatggtgatcatcatttcatgtgttcttatatttcatgtgagattggattcaaatgaattggatttaatcttactatttctttagctaattgtgacatcaagctatcaatcatggttcgaatatttaatatctgaattgtaatttataatagaaattaatatttgactttactatcttgtgcataaatattggtagggttattaataaataacatattctcgtaaattatatctattgcttaaatttagatcttttctttactttctttgtgatcatttacggtttggcaaccaatagcaatcataacaaccagcatggtgcaaaagttttaaaaagttcaaaattttagtgatttttattgtcaggaattttcaggatattacactctctccacactcttcaagctaagctctctcatactctctcaagctttagtttagtattctcaagctagtggagtaggaagagttcgggtatggctccagcagctctcatttcttcttttgtaagacttgtactttatttagaatattcttctttatacatttctagtattgtaatactttccaagtatatgaatgctaactttactttatatccgaattatattgtttatattgctagcttatctgggagatgcaatggaacatgtatagtgtttgcttatgcaattactctatgtgatgacgatgatattagattagtatctggtagtttaggcgtagtgtctagattacaggatatcattatttggggttatatgctgcagatgagaggtgggccgctgatggtgacatctcagtacgggtactcctccgcgcgtgtatatagtcctaagttaatttcatggggagggtactcctccgtatttagtcccggttgtatggtcatgaagggcagtcataaggaactcgatagtcaggggtggcttcttgaagcaccaggagggcattggaaagagggtattagctagttaatcttatagctaggatgtatatataatatgtatactagaagtatatgaatagattcttttctattttctttccacttaactcagataatttattatgagaataagtagtcttatgcttgtgtgtcactctaccctttgcttatattaacccactctacaagtaatatataaattattagtacggttctctctgctataatcatcccacgggattaaacaaatacgatacccttggaatactctcgggtgaaatgctacactggtatatccgtgcgcttgcggataaactctgtaaccgtaatataccaggagtatttcgggcaccattgctgtgaattatatttctacttatgtcgttaaaaaataccaacaaccggctcgaattgagccgaactcactaagcaccatcactcccaaatcaaattgaaaaccccaaatcatccacaaatcatcaccaaaatcgattgacatcacataatgaacataactcaacaacaaaatcatccacaaatccaccaaaacatctaaagaaaatctacaggagacgtgggagggagaggggctggccctcgggct

SEQ ID NO: 2481 - DNA, 2000 bp, Oryza sativa
ttcctattttctaactaacacattaatataaaaacaatcgatctaattttttattcatttgaactactaatttataatttggtagctaaataatccaatactcatattactcatattttactatacaaaatttggaataaattatagatccatatccttaatttgcatggaaactaatatataacattcgattggtttaaactggtatattatttataattaaataaataaatccagatctatattaccatagtatataaaaatgaattacatcacagatccttatcctttatacgacaaccaaataacagtgaatgattaacaaaaaaaggttacatatataatcttaaatcattatatgtaataaagatacattaaaaaccatctaaataactcttaagacatctcacgttaaattagaaaaaaaatctaagaaaagattaaaagaaaatcatcttagcatcagttttcacttactacatctattttctaatcattttcgagcgatcaattattttcagcaattagatatattttgaggaaaaccttaaaccgtcaaactaagaaaaaataaagcacctaatcattagttttcactcgtatactaaaaattagaaacgcaaagtccccttcacattctgctcccctcacatgtgcacatcacgatccacagttgacccatgcactttgcatgtcatccaaatagcaatgaaatacgagaaaaaaaattgccagcatatattatatcattataagtcactctataaacatatatagctaaactaaatcaatagtaaccaaacaaatcatagaagcatgtaatacattacattccaatataatgatgcatgcacagttagatatatttagttgtacgattgtgtttacgatcggtgcgtgaagccccgcatactctacatgatacattcatagatgtgtttcacagcacggaatcttattgaagaaatccataccatccaattcatgtgtttattgttaataaagaatgaggacccacatcagtcttaactacttaatatatcaccaagggtgattgaaattttctcaaagttgagatgaaaggtgtaatgctctatcattattcataatatcacaaattttgaacttatatttgcagttgtattaaataaaatagaaaaatattattagagagtaaatctaaccaattggagaaaaaagttagaaaattttgcttcttacatttcacttagattgaaaaggctactgccataacaattgcgttagataattgaaacaactaactaataggttagaaattttacctaagcaatgctgagaagaaaatttatggagaaattatacttttgaagcatgccagatattctttgattagtattccgcactcataagtgtctcaaccgtagcctatgatgcccgcccgcgcgaatgcgcgggctaacttcctagttttattaataagctattagtttagttataaataaattgaagctagtagttggctatactatactactataaaatgaaatcaaatgaagtttcataaatacactggcagacttaatataataaaatatatgctcatgaatggcatgcacgcagaaaaccgacaccgttgcatggagatgcatgcaaagagacacaagaaacacgttgtcatggatctcggtgcatccgatccacaatcgtaggcgttgtctgactttgatcacgcatgaacgccacgtaacgcaacggatatgcctcgctgcagccgtagaatataccacatgaaatcacgagcagtcaagctcgcatgtgatgtgcaacccggcccccctgcagctcatcgatcgatcttacacgtggtagctatccatcgattaatttcatcgtctcatctctcgccgcctgtatatataaagaggcctcactctcagctactccactcaggcactcatcgagctacattttgctaactatccagtaccaagaacggagctgcaaggaagagacgtacg

SEQ ID NO: 2482 - DNA, 2000 bp, Oryza sativa
aactgtttctgaaccatgttcggactctcagtcatgtaatttttataatttgccttcacaagtgtcatcttggctgccaggaacctggagttgaaaaagaattggccagtcttgacttgaagagattcttcaaattggccttgattgttcaaacaacaggatcttctgctatgtccattaaaaaaatgcgggcaaacaacagggaagtaacattgcctccttggctctctgaggaagatatcagttatgtagcaagtgtgtatgcaaaaactggcttcgctggtggtattaattactaccgatgttttgacctgtaagtatgccatttttaaggtaccaaatcattgtgtgcagaattcatacatgtcaaatcactcgaattatttttctccagatacctaaattctatccaaaagaagacacacatacaacctgtttaacgttgcaatacagtttttgaactccctgacaggttactagagagagaaacatgaagcacaatatcacattttttcctttagatttacctgttgtcactgattgctgtgtatcctgtttgtcttactgcatacgttgcttggaattaacttttttttttagataatggtgttgcttggaattaactgttgtccaattcaatacctctatactactatgagatatcatagcatctgttgtgtgtttttaaccaggagctcacaacctatatgaactgcagttaacagatctcggagagatgaaattcttgtttgcataacactttgtgagggtggatatgtatgggtgggtgactgggtgtgccgtgtgctgtgcgtctttttggtttctcagtcttgtagtttgtcgggaccttttccttttccttcttcttaatataatgatgattcgcaattctcctgcgtattcaagaaaaaaaacacttatggtaaatatagaaatctgttctgaactacacagattatttattcagtaatttccatattgaatattttgtcaccagtcatgatcacaagcatgcactcccatggacttgagaactgcatcaacatacgcagttgtgggttgcatgatatgatcatataatcctatgtagcaggaactcataacctctgacctgcatgcacaggaattgggagctgatggcaccatggacaggtgcaaaagttctagtgccaacaaagtttattgtcggggatggtgacctggcttaccatctcccaggagtcaaaagctacatacacaagggtaggttgaagaaagatgttcctatgcttgaggaagtagtggtaatcaaaggtgctgggcacttcatccagcaggagagagcacaggaaatcagtgatcacatctataactacatcaagaagttcaatacgggtgtttcttctccaaaatcatcgaggttgtgagataatttactgctgtaaagaataatttcaagagaataaaggatgtaatgctttaggctgatggtgtggttcttttgtcatgctgtgtttggctaatgctgcagagcttttgtaatgccaagtttggctatcttggcaaacaatgaaatttcaagggtctgaatgaatttaaaagagcttctaggatgcctataaactaattcctatgctccctccgttttatactaccacttttgattttctttttctttttttaagtcaatttttttaggtttaatcaaatttatataaaaatatagtaaaattttcaacaccaaacaaatgtactatcaacatatacattcaatgttaggtttgatgaaactaatttggtgttacaagagttgctacaaaactttgtcaaaattataaaagtttgacacaggaaggcaggtgtctgtcttgtgggccatgatatgccggtttttgtcttatgggccgtatattttgtcacttgaccatgcgctggagtccatttcttccccgtcaccaccacctccacctcctcgatcgacgcatccctccgccgctcgcagctctcctccggcggcc

SEQ ID NO: 2483 - DNA, 2000 bp, Oryza sativa
  misc_feature (88)..(89): n = any nucleotide
gctggtacttagcgtgtgaccaaatccaatcatcatttctagctctctttcagcgtgtgcacagcttggagctttgtccctgggaaanngtggctgcataggattatcgctgaggaggacttggggcccaatgtttatgtcatgacagtgctcattgacatgtatgcatagtgtggaagcatttccgaagctcggagcatcttcacttcaacagtatggatagcaagaatgtggtctcatggaatgcaattagctggatatggccttcatgggccaaggtgctgaggctttgaagctctacaaggacatgctggatgcaaaccttattccaacaaacgctaccttcctgttggtactctatgcatgcagccacataaggttggctgaggaagggcgcaaagtcttccagtcaatgaccgatcattttgcaataattccaagtattgagcatgcacatgcatgatggacctccttggctgagctggccagctcaaggaggtttttaagctcatttctgaattccccaagaccgctgttggacctggcttaatattgcttggtgcttgcatggtccataaggatagcgatcttgcacaaattgcacccccagaaaacagcggctactatgttctgctctctaatttacttgtagtcaagaagcaaatctctgaagcagcggcaaaaggcaggaagctggttaaactaatcgagatagttgacaagccaaacttcctcatggccggcgactgtgcccatccacagtgtgaggccatacttggaaaatcttaacttcaaagacgatttgacgctaggtatcgacctgagacagagctagcattgtacgatgttgaggaggaagagaaggagcatatgtttgaaagtgcacagtgaaaagctggcaattgccttcggatttctcagcacagaaccgagatctgaaatcaggataatcaagaatcttagggtgtgcctggagtgccacaacgccacccaagttcatatccaaggtgacacagagactgattctggttagggaatagggatgcttcacggttttcatcatttcagagatgagtttgctcctctggagagattactggtgtgattcacctgaaatgcctcgggtgtctaagcatatggtgattcaggcctccactgccgcattgccgcgatggcttcgtcccccatctctccctagaaaactatttaaaaaaataaaaattgtagataattttagaaaatgtagaggaaaatcagaaaaatgtaaaagaatatgaatcatgtagaaagttttggcatgatatttgctatattatggacattgaacaaagtagaaatccatttccccctcaagtgagcctaatggacttaatgaacagtgctcactattggcctagcctttttgtttttttttctattttaagtttcaatttcggcttgtctgcaaaatatggtgttagattttatttttcacaaactagtactataaattaggtactacctatatgatctttttttccattttttacaattttgaatttgtccaaactaaatgaatttatggatagatgatagctcttaatttgttgatggatgacataaattgaagggaaacaaccacctctattatagaagcttcttaggcccaacatttaaggcccagccgcccagctggcccaacgcaccaaaccaatcggaatattccattcactcaccgcacgacctataaaaccaatagcgacgtgccacgttagcccatccacgtcgccccccctcccactctgccctcgccgacacgtgggcccaacatagtaaccggtcccacgagccagggaaagaccagaaccagctcttcctcctttttaatccacccaccgttcccactcctccgctccttcctcccctctcccgattccccaattcggaggccaagcctgcaccggcaagcggcggcggcggcggcgacgaggcgagagggttcccttccgcggagccggcgg

SEQ ID NO: 2484 - DNA, 2000 bp, Oryza sativa
  misc_feature (353)..(353): n = any nucleotide
attccatcgcgtttcgtccacagttaattattagcaatttaaaaaatataacttgtaagatgtgtttatagttacttcaaaactagtgttaataaataaattacgaaaaaaatttaaaatcaactctaaaattaagttttaaaattatagattttagctgcggctgatcctacgatacaggagagagcaaatgacatagcacgagtacatattggactgttagttatactgatgtttttttttggtctgaatatgcatgttcagacttgggagaggacagcatgtgaatgtttgggagcagcaactgtttgttcttacatggtgagtagacgactgagcgaccaccttaaagngatttcctttttttttcctcctgtcaagtactcatatgtagtactgtacaatatatgacactgcacaacgacctacatgtgagggcacttgtcataccagccaaagaaggcctaccagagctagctacagtgtcatttgccagggccctcggtgaaatgtatttcccgatgacttccaatttaatgggaaaaggggagccccggttggcaatgattaaggccatgttcggtttagaggggattgagggggaataattccacaccacaataaatcccctccaattcctccctcgtaaggattaaccaaataaggactaaatgtttttcgctgggagcaatcaataaatgttatccggataaatatatattaagtaatataatgatgaatagatatgttaaaatattatggaaatgatgtaaggtgtgataatcacatatgctttgcatgttgatttgtagaattcaatgaattgtaaataatgttgaatacttgtatgagtttttatatgtaattattgttagtgaatgatgagctagtatatttgtatgttgagttttaaacttagtgggttataactatatagaatgtatagatgtcttagttttgacatgtggaatatgggctcgagtgttattgagagaacgagggataaataagggaatgagcacttttggggggtaaataggcattttatccacagcaatcctcatgttacaagacaggtatgaaaggttactcctaccctttgtttatttaaatcaatgttgatgatgtagcacttttgaattcatggttgttatactttttcaccttttagaaaaaaagctaatataattcatggttggtttttaattatatttccctccttaaaaaagagctccaatttgcttgtgaaaacaaagtgtttggtatgtttgcccaaaccaaccatagcaaatttctggaaggtagcaatccaaacaaaccctaagtaccccactataccaaaaatgtaatacgaggtaccacatcttggaaggcatcaaaccaaaaatactatcacatccgcattcacatacctctaccatacaagttccttttttgtcacaattcagaattacatttttgctgacgcaacaacaaaatagaggaattacataatttgatttatcatgattgatttgggtaacataccaaacaccaaacagttcaaggccctatttgaagagtttctatcacctcccgcttctcccagagcttttcgtccagattctaagaatctatagttgtagactaaaaaaatgaactgaaaattagaagttgaaaaacctatttttttttcattatcaaaaactggttaccaaccaattatttcttacaatcttaacattccccagagaggctcctgtaattttgaactttaggaggcaaaatactagcgaaatagtgaatcggcccatcatttggtctgggccgagtaagcctcgaagagcccaaagcccaaacggcccaaaactcgagcctgataaaaccacctcctaatccatccccgacgccggtgggtcccctcccctttccccctcccctccggcgaactccgagctcttcccggtgagcgccgccgattcggccggagaggctcgccggagtcgcctccgccctgccca

SEQ ID NO: 2485 - DNA, 2000 bp, Oryza sativa
  misc_feature (1476)..(1476): n = any nucleotide
cggtattttccaatcgaatggtcagtgtataaatgatgtgatatatattaatccgattgtctaaaattatttgagatgatgacatggctgagttatatacataagtttacaagtatccctcatatatcaaaatctataaatatttttttacaaaatcacttattcaatatatatgcatgtggtttgctacgggtttagttgtgttttgatagttactttttataaatatgcacaatggacgtggcggtattaactcttcaaaataaccttgttgtcatagtaatatgaaagttatgccaaaacaacataggggaaacactcaacctaccatatcgctcaaatgattgttgacctgtaacacccaacgacctttatttacagttgctatcgaatagtaaaatacatattatcgataatatagattgagaatagtaaaatactaattaaaaatgatttgtaaattgcacaacgcatggaatatatttgatgttcaaatccaattattgaattagacaatgtattggatgtgagtcaagagcttcgatgcttcattccctcgaaaggatacgatatgcttgagcgaacaattaataatgaaagatacatgcatatcgtcatcttgatataaataatattttagagagatatatatcgttcaatgacccaaaatttacaattgtttttgtttgcatccatgaatcaatatatcaattgattccacggatattgaaaaggacacgtagtcgtaaatgtgtattatagatttattggctcattttaaagtacaaacttgcaaaaaaaaaataaaatccttggatgatgtcgcatgggttatttgggtgctcctcatcactaaggacaccaaagaaaacatattttttaatctgattttgggggcctgtctgtcattttcaaatgcatttgttgcgaagcaaacaagcaaagagaaagtggaaatttgctcttacccctgcaaaacatgtatcctacctagccgcatcctccgatcgaacaagacaaagcaaatgctccacccacagttccacacgcaacggccagaacaagatcacgtatgccatggcattgccatgcctctgcttagcgcttacgcttcccggctgctggtgatcgatcgagctgggccgttcgctgcatgtgttcacacgggccacctccactgcaaccaatggtaaaatcccacgtcatcgtaaccaaggtgcgacccacacctccacgtcatcatctccagctcgtgtaggtttcgtacgtgcgcgtagaaaaaacgcaccccatattcctaatccagacagcacacaggtctcctcccgaagatggcgtccgttcgatcacgcggtggttcggatcggacggctcggaaacaccggacgcgtagccccttagtcggcgcggacgcgacacggacatcctacggcgcgcataaatcgctacgcgcattaaaccttaccactgtaaagntttccttttgggtcccacatgtcattggaccacaggcaagaacgctcctctccctccccctctgccgcggcggtcaaaaccagcacgcgccgaaatcccgtacttcccactgacacgtaggccccactgtcattgaccgttacaactcaggaaaaaaaaggggaaccccacccaccagaaacgcagcccccagcaatgataagtgggcccagaggaaatgtggggcccacgggtcagtgggacgtggccgtgccgtgcggggggcgaaaggtacggtcgctgaggagaggctggcgtgggcggtggagcgcttcccacagccctcggcggccgccacgtgtgggccgcagccgcatctcttctctctctactctcccaccctccacctcccgctgcttctcctgttcgtctcctttctcagtaactgcacccacctccacacctacacgcacacagacaaacaaagccaaaccccccgcctcgcctacatctcgcgctctccgccccccgcccgcctccactct

SEQ ID NO: 2486 - DNA, 1275 bp, Oryza sativa
atatcgagtgcttaacaatcaccaaccatgctgggagagaccaaaagatggctggatgaaattaaatgtggatggatcctttgacgctagctccggtaaggggggtcttggaatgatcctcaggaatagcgctggtgatatcatcttcacttcttgcaaaccccttgaaagatgcaacaacccgctagaatcagagctgcgtgcctgtgttgaagggcttaagctggcgatccattggactttgcttccgattcaggtggaaacagattgtgcctcagtggtccagcttctgcagggtatcggtagagatttttctgttctagccaacatcattcatgaagcgaggcatctgctggtgggtgaaagggtgatttctattaagaaaatatgtcgtagccagaattgcattagccatcatcttgcaaatacggctagagctgattttcttgctggattttggttgggagagagttgtaatcttatctcacatttattaagcgagaactttatgagtgagtaatatatttctttccccccgcaaaaaaaaaaaaggggtacgtgttgatgtgcatgtgtgtgtctggactctctctataacttgtacaaacttgaactatactgtttgcccgttatattattttgtcggccgattgtacaggccggtttttatatggcccaagtccaaagcctgccttttggctgcgtgaccacactcatgtgatgatgtgataagtctgctagcactagcagacgccttcacggaccaacacaaaagttacgacccaaaaacaaactctccgaccgaacgcaacagcgcactgcatgccaaccgaccgaccgaccgagcccgggccgcggggtgggccaggtggccatccttccagacgcttccgccccccatcccacccactgacgcgtgggccccacacccacgtgggggccgccgaggagggccatcggtcgccgctttgaccggggaggacaccgtcacccactgacgccgtggggcccacacgtcagtagccccgtactagtacgttttttgcatgctttgtccgggatgcgcggcgcgaggcgtggctccacgtgtcctcctcctcctcccccacagcctacgtgtgcctgctccggtgatgtcctgtgtcgcgggtacgtggcggccggcgaccgggcgcgccctcgatatatcaggccgcgccccccctcgccgccgcactcgcctgcccccacggcgagcagccagatgccaagatcctccccgcggctactcctccc

SEQ ID NO: 2487 - DNA, 2000 bp, Oryza sativa
ataggtttgataatacaagggctgacatataaatagataggggctgacatgcaaaaacgttttggagtggctttcactgtgggtagtgtgacctttgtgtggttctatcctacgtggcgtcttgagaccatagttacttgtggctaccattgtacatgccctaagggaagagatccttcgagtgaaacagctaaagtgattgacagttggccgcgaaaacaacaagggagaaaatggtttaaactaaaaattagaaatagttcgcatggcttaaatgcgtgggccgaggccttatctcatctcgaagccatcagcccactccgtcgtcttcacatgggcctccgttttgctttgtgctcacgtcgtcttcaaacgggctgggcgggccgcttgtatcttgagttgctgaacaaaagagaatagggacatttacaattttaccactatttttttcacttttacaagtatgtcactcgaataacagttctggtgatattttttaatacttcggtggtagccttacaataattattcaaacttctaatagcgtcccataaatagagattacacttatactctctctgtcaaaaaaagaatccaatcttcgagatgaatctggacacaatatatgctcatatttattcttagaattggatttttatgagatagagaggagtatatttgagtggtgagaaattgtaatagcagcccataaactgacaaacagagataggggactgctaatgcgcgggtgatcgctgggaacgatcacccgcacccgctccccctatacgtacgtccctcttctccccctctcttccctactacagtaaaccacaattttttttaaaaaaaaataaaagttagaaaaatttatgtaaagaaatactatatataaaaaatttgaattcaaattcaaatttgaatcgggtatataaacttttgacttacaaactttgggtctataaactttaggtgtataaactttagatgcatagaaatactatatatagaaaatatttgaattcaaattcaaatttgaatcggatataattcaaattcaaatttgaaactggtatataaacttttgacttataaactttaggtctataaactttaggtgtataaactttagagtatagaaatactatatataaaaaaatatttgaattcaaatttaaatttgaatcggatatataaacttttgacttataaacttttggtctctaaactttatatatgtaaacttgaggtatataaactttaggtgtataaatttactaaaataggaaagtaatgcggtaccaaaaaaaggaaaccaggtggagggagggaggggggaggtgatcgccaccccatccccagggcgatcgatcgcccaacagcatttccgacagagataacatttccatctatgattgacgagagtatgaataatcattgtttctgcgcagtgacttgtaagttagactgcttcctccagttttaactacctgtcaatgttgatcaatataatttcagcttggatcatcaacaaattttgattggtcagatcataacgtgataagtatttcaacccaaaaattggtagtcctacatgttattgagatatcgatggtatatctcaaactttgcaaaattataatagcatggttccaatttaaaaaaaaaaaagctacagtacacttatttgccgtgagactacatcacgagacaaatttatagctacaattatcattgtactcaaaagttgttgcgacttgatcacatcccagatgatgtttacttgggagccaacaaggatttctagaattttaaaatccgcgcacgaggagcgcgagctgcaacgttgcaccttagaatgacgcgcgacaaagctgaaagctccttaaaattatggacgcccacgacacacacggacacgcgttgctacctcgccattggagaaccagtttgctctagctgctccggccgcgacgccgccgttgcaccggccggca

SEQ ID NO: 2488 - DNA, 2000 bp, Oryza sativa
ttgtacgaagccatgcggcggtgtcccccctcgctggcgacgaagtgggcggccaaccggtgcgggctctgacgctgaactccatcaacgagtcgaggccaccgaaattggaggtgcggcgtgggcggagtgtattcccgacggccggcaagagcaccgcggcctcctccacgcgccgggtgcctccccactcgcggtggcgcgcctcccagccggacgaggccgaccggcgaggcgaagcgcggctgcgcgggcgggtcgcggcggcaacgctggttcctccccattcgcggcggcgcgcctcccagccggacgagggcgaccggcgaggcgaagcgcagctgcgcgggcggacgcggttctggagcgaggccgtctcaggctgcggggcctcctattaaatggcaattgttttgcctgcgtgcgggcccaactagagcagccgttcgattcgttttggacggctttgatgcatggtatgtcacgttgtgacttgcctacactaaagctgagtccgtgtggacccaacttcctctcgaactttatctccttctgtagaatcctccgcctccgcttctctctctcgtcgctctctccgtctttaccgtctctccttcgccactccccagcggcggcgcgccttctccctctcccagcgacggcagcgcgccatccactcccttcctcccagatccgactggatgaggggagggcagcggcgtggaggcggcgctcccctccccttactttctccccgctcctggatcaggctgtaggaggggagcgatggtgggggcagccaccgcatgcgacggaggtggcgctcctccctccctagctcccagatccggctggaggagggagcgatagtggcaaaggcggcgctccctcccctccctcccagatctggccgaagggggagggcagcatcggctctagcgacggtggcgcgccttctccactctccgactcctcggcgagcagcaggtgcgacgatcttaccatggatgagcagcgggagcggcggtggcctcggcctcaactagcaacaggagtgacaccgtccagtggcattggggcagcgggagcgacgtcctctaccttgacaagcagcgggagcggcagcatccacgtccttagctagcaacaggagtgacgctgtccagtggcgtcggagcagcgggaacagtatcgtcttcgtcctcgacgagcaaggaggagcgggagcggcgatagactcggcctcaggcccagcggcagtggcggtgtccccgacgagcagtggcctcgacatctggcgagctcagcattctgttagtatttaatttgttgtgatttcattgatgtagacattgttctttgattagtcttttttgctcgtcaacttttttttctggaaccgagttggacccaatgaactatatggactaacaaaaatttgtttggaagcatacctagggcgatttttgatttttgatttttggatttgtttttgtctgttctttttctgatattttctgatctgattgtcatggagacggataacgcgtacgcgggctcacatattacggacgaaaatcgtgtgtgaatgatgtgacgaaaggaaaaatacgaatagttatataagattaaaataagataagatataccgaaagaaaacaaactaattaattaatctctccaaaaataactcctacaggggtacgattaaactgagtaggagtagctaattaagctgtgttggcgttatggcaaagtaacgcagaagcaatcgaaaactaattagaatcagattggatttggagtacgaatcggagttgctcggcctggttctcgcaataaatacaaagagcaccaaacagctcgccaagcaccaataaacgtcgtttcaacagttgagctcaccgcgcaactagcgagcgagttcgtcccgtccgtccgtgttcaagctcaacagcaatccccgggccccgcgtgttcgacgagaaacaaaccaacat

SEQ ID NO: 2489 - DNA, 2000 bp, Oryza sativa
ctgaatacccgatacaagtagcaggccaatatgtggatccagcccgaggtagaacgtgcttggggctggtgggcggcgctagccaccctggcgccgtggtgggaggggttgcgccagcctccagcccgaggtagaacgggctgcgcgcggcccacccaggaggggtgcgccagcctggctggcgtcgtggtatgaggtacggcgccagtatggctggcgccccccgttgccacatcatacattgcacgtatgccctaggtgccacggtggcatggagacggcgccagttgtggccggcaccaccatattggaggacggcgccagccactctggcgcaccaaaaaggaccattcctagaataagtttctactaggggttcatttgtaaaataagttttcaaaaaggaccaaaatataaaaatttcagtcacacaccccccccacccccacaccccgccgcgcacaactaggacactgttgacgatgaaatttggtaaagcatgaatcggagtcaagatccaatccaaagcggatttgagagatgtgtgataatttcgggaacagagtttgactaggacactgttgacgatgaaatttggtaaggcatgaatcggagtcaaaaatccaatccaaagcggatttgagagatgtgcgataatttcgggaacagagttcgcatcagctgggatgatattggctgagtccgagttggagatggttaccgattggagttggaattggatgagggagtcgatatagtcggtatcggtttcaagatgaaggcttcaatgatattgctgggcaaggatgaggtccgtgattagacagttgtatctattaattaggatgtgatgtcattcctttagtgatattttggtaagggtctgcttaagggacttgtttgtcggttagagttaagttagggaagtttgagtcatgtccgatatggacaagttgtattttcgggtataaatagatgcccaggaccatgtaaataattaacaccagttcaataaactctcggtgcattgccacacttttactttcataattctcgatgagttcttgtttcgagtcaggctacatcggcttcaatcttcggtaagaggtaagacttttctgttatcatatatcttagctaatctaagtcgatatatctatttaattatattgattataccttatgaagggtaatatcaatataacttaaatagatctcgtcgattcagattagctaccatcctgaaaaggcaatcatcagcttgattgtctagatattatgtttcttttcatacttagtgatgtatcagttaggttcgatctactaagccctcgttagttagtcctggaaagtgtggattaatttttggattaaagtggcacgcttttcaaactactaaatggtccatttcatgtgaaaactttctatatgaaagttgttctaaaatatcagattaatctatttttcaagtttgtaataattaaaactcaattaatcacattttattaccacctcgttttgcgtgaaacacttaatatttatcttcatcttcatctctaggagattcaatcaccacctgagtcatgtttagaactataatctctagcctattttatgattgctaatagagatagtatcgggtttcagctgattttatctggtacaattgttttacctcaatcttatcttgtttaacaagttgtatctaccccttatattgggatctccagtatttaaggcaaaatttgctacaagacacgcataaaacgtgtaattggctgagggacatcgcaaaaacgtgacactgctcatggacgttgcaaaagttgtgtaattcaccataggacacgggatgcattgttttattatttttgggatgaaagtggtgagatttttttcgaaatgcctagattgcccctgagtgtcaacggcttgagtgttctacgacatcgccattgtttgcctgtccatcttcctgtttcgtgtgtgcgcctacgccg

SEQ ID NO: 2490 - DNA, 2000 bp, Oryza sativa
  misc_feature (365)..(365): n = any nucleotide
gagagagagagagacaatctcgacacacattatattcctagtgtgtatggtgaactactgtcacatctccggttcgttcaagaaaaaaaaaactactatcacacgttaattgcacgagctaccatgcgacagggtttcggactttcaacagggaggttttgaactaccgtgcgactaacgttgacgctagaaatcagtgttggctagctgtaatagatgaacttgctggtaattccatctcggtcattacatgtaccacaaaatcacatcgattatggactaactagcccgccgtaattcttttttttcccgggtcaaccaaaggttgtccgactaatttcattaagatttggggggaaaatacngtaaaatgttacaacgacattacaatgccgcggtagatagggaaggaccccagccaatcaagaatgagaaatgaaagcagggctaaaccccgtaaacagtcatacgattactcgcgaaattgggagaaaatcccagccaccctccagacagcaatttcctcttgaatatcctccgcaagttgttccggtgtcttggacacgtgttggaaattttttgcattacgctccttccaaatcaaccaacaaattagcatgaatgcactgtcaaaatccgtcctatagctcgtccggaaacaacgtcttgtgccagccactgacgccagcgagcccgccgtaattccattgcgcgtacaagatctagattaacagctgaccaaacaaagagcatgcatggtaatataccaaactagtaataatgacaaattaagtggcgatcaacatgagctcgctagtcttgtgcggcactatctccggcgtctcctgtgcggcgcttctgtcgcggcggctcctcctccgtctccggcgccggcctcttctgcacgaacacgagacttgctgctgacaaggttgcggagaacgcttgtgcttccgcgatctccgcctcggccgttgcggcgtgcttctgcagcgcctgcacgagctcctcctcgcccgcgaaggccgccgcgcacgcgtgaacttctccttcaacgcggtcatcttctccaccacggcgtcctcgaacttgatcgcgctgtccaacaacccggccctacggacggcatcaccgccggaggagtcctgcaggacccgtgatttggtggactcgcgcatggcggtgatcagcgccgcaagctccggaatgacggggtggtctctcgccgccatgcacctgagctccttctccagcaagcggcgcgcggcggaggcgatctccaccgcctccgcgcggcgcgcgtcggcccacgcgacgttcttcctgagcaccgcctcctcgggcctccctgtcccggcgaacacggccagagccctcctgagatccagcacataggacgccatgttatccgccgccgactgggcggagatcactgcgccttccgcccatcccacctgctccggcgagggagggtcggggtcctcaaggtactcggtggcttcagacagcgctttcgccgtgatttcctcgcactctcggtcgtcggcctcgtcctccgggccggcattcatcagctcgtcgatgaggtcctggaggtcatcgtcgacggcgggcggcatgtcgtccgccatgatcgatgcacgcaccttgtggatcgatctgagtaggcgggtgtggatcatgcggcttcattccatttatagaccccagcactgcatgcgtatccgactcggagtagctctgttctttacgcaatcggagtcggactagctagccgccgccctagatgggctggccctcgaaacattccaccttgggcttcgatttgtctgtgggctaacaacatacatttcggcccacattcatatccgtttttgctcgggtgggctgggttagggactcatctgcaatttcgaggattcgaggaggggttgtttgtctctaatcgctctcgttccccatttcgctttggaggcggcgacggcgagaggcgagaggag

SEQ ID NO: 2491 - DNA, 2000 bp, Oryza sativa
  misc_feature (362)..(362): n = any nucleotide
  misc_feature (419)..(419): n = any nucleotide
atagaaaaagacgacggctaattgattcgtaattcaactcatcagaagaaaaaagatgtagaaatccaacggaataattgaattgctatttacacacacacatcattatcatctaaacacataactaatccctcttacatatatcgtaattgctaaaccatgttcaattgaaaaattgagataaaatcttgcgaatttctaacctttagagtttcacaagatatatatatatactccctctcttttttaaataaataacgtctttaaacacatgtttgatcattcctcctatttaactttttcctacaaatacatcatacttaaactatattttataaaacaactaaaaaataatatttacntaaatattttaaagaaagtcaaatatgtataaaaaaaagggacactctgaatctacngtattaactaactatagatcagccggcgtcgtcccgctagtggccaacgccggggctgggcaccgacccgagcatcctgctgctgcgagctccggtggtcgccgccggcggcgacagcggcagaggtggtctcctcgggagcagcatctcctcctccggcggcgaggacgacgccgtgcttcttcttcctgcgacggcggcggcggcggcgccggcagaggatcccatcatcatcgtcacggcctcctgaacaatctccccgccgtctcccggcatcatcctggcttgcaagaacggagccgacgatgtcagcagcaagaagaccaggagcaggacggcggcgacggcggtcatggacgccatggttgtcggtcaagaactcagaattggatcgatcagggctagctatggctgaattcttgtgtaagattgatcaggttgtacagctgaattcttgtgtttggctcgtgcaggagaaggagatagcagagcatatttataggcagaggaagaggaggatgaagaggaggagatgctagtcgttgccccagtgcccgcgaatctagccggcatttcgattgttttgccacgtcattatggtcccgtttgagttcactgaatataaagatttttttacgaacacataaaacgagaaaatcgttaatgtacgactaattaacttctagttattataaaattaaaaatagatttaactgatattttgaaaagtaacttctacataaattttttatatgaaatataccgtgtagtagttcaaatatcgtgacaacaaaataccgaggtaaaaggtttatcttaattagaaacagagctatgctaattgattaggctatgtttggcaacctgggttaggaacccatgtgctgcgcacggaaaacagagcaatctattaatatgtgattaattaagtattagcttcttttaaaaaaaagggatcaatatgatttttatgcaattttcgtatataaacttttagaaaaacatattgtttaacaaattggaaaacgtgtacaaggaaaacgagagaagtgagttgaaaaaagaggggaagaacatagcctaaagactattagaccctgacttgttaacccaaaaatcatgcaaaggaatagcaagtacggcctcggctctattagacggaccctgacttgttaaccaccgtcctcgtcaaaaactagtgcttagtactaccccctacgtgtgcgacaatggtgcgtccccgtagaacaggggaatcgagtcaaacgagaggggctagagtacaaaatgtactaagatgctactgtgtaggaaaaggaaaacgagggggaatgcgattcaaatccgatggaaatattgaaaccgtgccggaattgaaatttggagttcggtcgccgtcgccgccgcctgcctgccggccggacggacggcgagtttaattgccggcgtatttggaaacttcctcgacagagatcgagagtcagaggaagcttctagttctgcaagttgcaggtggctgtgcctagttgctttcagggtatatttatttctgtttggcaagctaatacccagggcgaacac

SEQ ID NO: 2492 - DNA, 673 bp, Oryza sativa
taatgtaattggggggatcctaaataaaaccccacttgcattgggccatatatgtatatgttcaaaagtcccaaataatttaaggtacagaaagtacggaggaaagaaaaacaggacacaataagcacacgacacccagagcaaatgcatatcgatctaaccttagctacctacattgacaacatgcttaagcaagctggcccctgctctctgctgctttccgttggttcgttggttgcatgagctaatggctaatcacgatggacgtaagtctttggactaattgaagtcccaaagtgagaaatcaattagtgccaggcataagagtcagagctagagacagaaaggaaggatgtttgcttgcttgagcccacaattaatctcacttagcttagctagctagctgactcgatatgatcgatcatgcatgcatgctaatgctatggtctttgtgtacttgtctagtttatttatcacttaaattaattagccccgttaaataatattagggctctctcttcctcttctcctataaaaccacccccaccatagccgtccatctaacctatcatccaaattaaacatactcttgtggccatcgtctagcttagctagcttcttcctcctagctcagctaacgaacgaggagtagtagctaggaagagagatcgag

SEQ ID NO: 2493 - DNA, 1924 bp, Oryza sativa
  misc_feature (317)..(317): n = any nucleotide
  misc_feature (319)..(319): n = any nucleotide
tcgcttgtttgacgctgttttggagcggtgcaaggatttggctgcgtcattcgatcgatctcggccgttgatttgctagtgctcgcgtggtgcgggaagcacttgggcgtcgctcgagcgatctcggccgttgatttgctgcgctgttggatttgaaaacggcgttttaacacagctctagcttcagccccgtttagcacagctccagctcccaactctaacttacctggagctggagttgtgcccaacagtccaaatcctccgttttttggaccggaattggcagagctgctccaaaaaattgtactagggggttnanctgggtttttgctgctccatagctccactccaccccaaaggacccactactttttaatttttttagtgtatttacacaaaaatgccaatgaactacccctacccacctcctctcctccagttatctctcatcctcaaccatcctcccggaggcccaagtcccaacctgtggcggcgtcggcggtgacggcagcagcgacggcagcaaggcggcgagcacggggacaaggcgcaagaggcggccggccggcgggcagcgagcgcgacaatgaggcgcgagaggtggccagccggcggtgggcggcgcgcgcggcgacgacgtgcagccggcagcgaacggcgcagctgggattgggctgccggccggctagggttccccttttttttcaattttttttcattttttttccgatctatagctgaaatctagccaaacacttctcaacgattctctaactccaacaggagttagctcccactggagtaggagttggagtttagagccctaccaaacggggccgaatcatctccacctctccttagctagaaaccaacaaaacagtttcagctccatctaaaatataaagtggggctggttgaggtgctcttaccggatgaaagaggtggaactgagtttagacggttccacaagtccactccagattcaacttctagagttaaatttaagagtttgagccatacgaaacggccctgaagaaaaccgcattacctacaaatatttttacaaaagaaatgtttatcttggaaccaaatgctttgtcttagactccgttcgttctctcgatttggagagatattttcagcgcacgagaaaattaactaaatactattaactattataaaattgaaaaatcgatttatttgagtttttaaacaatttattacatagaaacatttttttgaaaatataacatttaacagattaaaaaacgtggtaataaaaaacgaagaaattgaagtttgtagttgagaaagaccagagcaaaataggacacagaggcccttgacgatttaccagagcgaaatggagaactcaaagcccaaatcaaagcaacattaaggctgtccagcccggggatgggccctatacgatttcagcccattatatgatcgtcggtcgcagcagctaatgggcctccatccggcaccttcccgttgtccgcctgcaacgtttttgcactaatttcgctgaaacccgagttccgagacgctcacaggtagtagggtactctactccgtaccgatcccgccggctgcacgacgccgacccgacacaccaccgtgtcaagccgcccgcgcgacacatcctcccggcgccgcccgtgccgcgcgcatgcaaagacgaacgccgcgacgcgacgcgtgccgaatgccgtggcgcgacgcgacgcgcccaataaatagcaggtctcggctctgctggtcatggctggctgccggcgaccgacgaccgagatgggggaagtgtgcaagcgagtggcgccgagcgtgcgggaggaggaggaggaggaggagaatggcgacggcggcggcgtcgacccggcagcggagtcgtcgtcggcgaagctgtacgaggacgtgccgg

SEQ ID NO: 2494 - DNA, 1466 bp, Oryza sativa
  misc_feature (2)..(2): n = any nucleotide
  misc_feature (5)..(5): n = any nucleotide
  misc_feature (9)..(9): n = any nucleotide
tntancctngtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaggcaatctcagtgggattttgagatttggtgggggattgttggaattaataaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctggcctggcctggcagggcagggcagggcagggcagggcagggcaggcggcgcgcgtgcacgacgtacgcgtcgaatggtccgaaaaattggctcctcacctttgcgcagatgcagcctccttttgcagttttgttttgctgcaaattcggattcgttttgttttggaaacgttccgaaaaatccggtgcgtgcaaacggcgtggagtccggataagattacgcgcggacttatccggttcggttacgcgcagtagagatcgtgcggcgccctgatcaagcgacccttctctatataaaccgacccgccgtcttcacgcaatatgtgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacagaaatagctagctagcgctatagcagcttgcttatagcaagtgtggtga

SEQ ID NO: 2495 - DNA, 2000 bp, Oryza sativa
aaatgaatatgaacaattgaagcacataaattatgccaattgtttaaattctgtcctactaaaagctctcctaaaagaaatattaagtgaaacaagagacataacatttgcaattgaagcattcctcctacgaactatagcatataacgacggatacctatctttaaaagaataattccctacccatttatcttcccaaaatttgacttgtacaccattattcacaatccaggaacccatatttagaaacttactcttaactttcataagaccagaccaaaaatgggaatccccttgtttcttctcaacctgactttaggattgattataaagatatttcattttcaatagatcctgccacacaccctgctcgtttatgagcctaaacaaccatttactcaaaagatattgattttgaatttcaagattatgaactccaagaccaccctaatctttgggttgacaaatcatatcccatttagtaagcctatacttcttcttgtgttcatccccttgtcaaaagaaagtgatctataataatcaatttttttgaagacctccttttggaatctcaaaaaaagaaatcataaacatggctaatctagaaagcacaaaattaatcaacaccaacctccccccctccccatatgtttacctttccaactactaagtttcttttcaattctttcctcaactgttttccaatccttgttactaagttttctaaaatgcataggaataccaagatatctcatagggaaattcccaagcttacaaccaaaaatagtagaataaagctcttgacattcctttgcctgaccaaaacaaaataattcacttttatgaaaattaattttaaggccagataatttttcaaaagtcgatagtaacaattttagatttttggcttgtagtagatcatgttcaaaaaaataagagtatcatctgcatattgcaaaatagaaagaccatcatccaccaagtgtggaataatcccactaatttgaccatcatccttggccctcttaattaatatagtaagcatattaacaactatattaaaaagaattggagataatggatctccttgtctaagacccttataagtttgaaaattagaaccaacttgatcgtttacttttatacccacatgtcccccctagataaaagaggcaatccattgacaccattttgaccagaaacccttcatccttaaggtttgttgaacaaaagactactttaccttatcataagttttctcaaagtcaatcttaataattaccccattcttgtttttgcgatgcaattcatgaatagtttcatgtaaaataacaactcttttcatgatatttctcccagtaataaaagcagtttgagtactactaatgactttttgggcaaccccaattattctgatctttttcatatatatatatatgaactatatagtatatatacctattttttgtccaaaaatcttgggtatacatctgaatgccctttaattatagctgggctgcccctggtagaacctcgtgtggttgtatttattgcttaaaccagcgggagataattaaactccgagtaggagtcgtattttaatctcattttacttctgtaataatgtaatttaatatcgagaaataattagagtagtcgtttcgaaaaggagtccaattagaccatgggagaaggtttcgaaaatgagtccagttaaatctcttcacgacgtacgtacgtttgtacgtactcaaaactaacgcggaaataactgaaaatcaattgaatttggatcagattcggactccggatcaccgcatccgtcttgtttttgcgcggtttcacgcaataaaaacagaccacctctcgccgtgatccaagcaccaaacgctaacgttccaagagtcttggggtccaagacaagacaagacaagaaacagttgagctttgcaatccgcgagttctttcgtccgtgttcaaacttcaaagtagagagatca

SEQ ID NO: 2496 - DNA, 2000 bp, Oryza sativa
ataaacctatgaggttatgagaatagttttccagacaaatctacatatattacttttatgttttgaaatgaagtattttagaaattattaatagttaaagtttcgaaagtttgactaaaaagtcaaacatcatactgcaggatttatgttttgtgtttttttgtctaaccttaggtgtgctcatattcagtaagaaaaagaactttctaactctacccctattcagttatgtatatgcagcgctctttcagatttcgttcaaaaaagagagagaattttcagaatttttctctctaaaaggcataacttttcaatgctattaccaagcccattacaaagaagatcatgttacatcaccgcggtttaccacagagaagaggagaatgcagagatgcagggtcttgcagttctcgttcaaaaagaaacacaaacatttcagaaaaataaatttctgaaaggcataacttcccaatgctattaccaagcacattgcaaagaagatcatgttacatcaccacagtttttacagagagaggagaacacaaagatgcagggagaaagtgagaaagttcaggccttttaggggggagggtgagacaggtgatctgaaggaacaacaaatcataaaatgtttgcgtgcatggggtgctaatcaagcgtccataatgaaacagtccacaaatgacgcaggcaattaaccattaatttctcaaagcgatggaagagtgaaagaaagaaagaaaaaagatcgatttgttggatgatctgatgggaggagttgctgctgctgacctcggattagttcagtttctctctgatcaagtagtagtaaacacgaagactcttttgacaaaagcttggcccaattcagttccttcaccttgactccagtgcaggcagctgatgccaaactgctaggtgacaaacctgcatgaactcatccaatcattatatatttacgtgctacgtgcatgtgtatgatgcttgcttgtcacctaaccatcaatccatcaaacatgcagtcaaggtgtattattcagtatatccacttctgaattgtaacagtacatacaattagtgtgttttacatgactgaatgatgctttgtagtatgatgcagagaagtgctaacttccttacacttagatagttacatgtatgaaggacagaaatatacgattgcaaatcttcaaagcatttctaattgcaaatttgttggtgtacatgaacatgaaattctagttaatacctgaattttctgtaatgggacatacacaggccacagtgttgcagtcacggacagggtttaccttcccgttttggaagtgataaccgctccccactggtttgccgaaaaccagtaaaaaccaataacttttggtcaactccgtaaaaatactagctaaaatccatcggttttacaaaccgaccatcggcggttccacgaaaatcgatcggttttgttaaccctggtcatggaagcatcaagcatatttcccgtacatgtgtacacaatagagttgtgacatgtggacacaacagttaatctactactatactagtattctgaaactctgaatttgtggagctagtcaagtagacagatcatactattccccaatttctttcagtgggacacgaaccatgctatgctctctctgggctaacctagctagctcttggctgaaatttccaatcatcttgcgtgtgcaagacagcaaagtctcctctgcacaaagtaagcgatttagctgcaaaatcccaatagaaaatttgcaaaaaagtttgatgcactcctactacatatagagagacaaagaccacacgtaggggacaggttcttcaggtcccaggcttcaaccagtatatataaagcattaagcaggcagacatcttcttcaggccaccacttcaaagctaaggatcagaagcactgatcgatcagcatttttcagctagctgatcgatcagttgggcttcagttcagtgaagttcttgac

SEQ ID NO: 2497 - DNA, 2000 bp, Oryza sativa
  misc_feature (655)..(655): n = any nucleotide
  misc_feature (1835)..(1835): n = any nucleotide
tgctgcacacacggcctaggcacggcccaatacgactcgggccatgctggactggcccgaaggcatgatagcccatcgtgcttctccacagaataagtctatttttcatccctcaactatgtgggctatgttcatatggctagaaataaatctatttggtatttctctcctttttgggtgttgccttatatggttatttaagtctatttttcatccctgtactatttttcttcgatcgtgccatgccgggccaacccaccgtgccgagggtgcagcccaagcatggctcggctgtgaccgggccaaaatgacgtgccttgggcgggccgtgggcctcgggccatatggccatctatactaataatgacttaaccgtaacctgatctttatcctcatctttctctccagggttatcttcctttcacaacaacacggacacgcggtgatggaactccttgtgcgtggctcgctttaggctgtgttcggaactcaagttcccaacccctctcactcgtttttcgctcgcacgcttttcaaactgctaaacgatacgttttttataaaaagtttctatacaaaagttgcttagaaaattcaaattaatccatttttttaagaaatagctaatacttaattaatcacgtgctaatggacntttggtttttcgtgcatgggagatgggttcccaaccccctccaacgaacacagccttactcattccagcggcatggaaaaagaaggcaaagaagaagatggttctaacgtgtgggtcttgcttgtcattgagggaatagtgaggctatgagcttgagattggtccttctggaccagccttgctgtagcagaaaaagaagagaaatgagaaacaacagaatttacatatatattacgtactttttttattatattagtataatcacataaataaaaaatattcttaattgccaaaaaggtacaaaaattttcagaactcagaaaaacgcagccaaacctcacgaccaaatgtaatcttacatgaatacaaaggatggacatagctatcattatctgctctctacctcactttccgtgaggcaaatacgcatctaatggcatttaattcagctaagcatcatgcttacattaataaatgatgacactaaattccccttggactcccactctttggatgaactagtaaaagctaccaccggtgtccaggtgacaccgacgactttcggcaaaagttatgcttaaaatgcttattcatatattataacattatattctaaatataattagcatactataatatcgatagacgatacccaaagatgattcgccaatgtatctagtacaacatatcttgagtatttttttataaaaaaataatgttacggcaccagtgcaccactgataaatctgtttgattattgaagaggttaattaaactaatatttaagtgatcatcatatgaatatccggataaaagaaagtgaaaatgaaatgaggtaattttttaatagaaaatggcagtactccgtccgtaaaaaaaaaatcaacgtaatattagatgagatattttctaatacaacaaataacacatcaaatctattacttaggttgattttttttttatggagtacagcctatctggagtagcaggctgaacggcatcgtaaattgaaagcctcgtcagagcaggctggtcctcgaacccttccgaaccatccagaagaggagcctcccgacggctaggatgcatccacatccactcatcaacggctaagacgcgccctcctctctccgaatttttaccaacttttactgctcgcatcaaatggagcgcgggccangcgggtaaaaaaggaagcgaagaaatccggtggtatttatattttcgagacccaaaaagaaaaccacgaattcccaataaagaaataggcaaaattccccatctcctcgtctcctcccaactccaaaccctagctcccaccccctctcgccgtcgccgtcgcgtc

SEQ ID NO: 2498 - DNA, 2000 bp, Oryza sativa
  misc_feature (1351)..(1351): n = any nucleotide
  misc_feature (1366)..(1366): n = any nucleotide
  misc_feature (1378)..(1378): n = any nucleotide
gctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaatcagcaccaagacagatggttaaccccagattgttgaccagagaacaaccacaacatgctgggcaaaatgtcaatcggctgactcaggagcaagttgctgcaatgttcttgccaaatccgacaatagccgacccaacacagccgttgccgactcagcaagcacagccgaggtagcagacagttcatccgactcagcagcaaaacttacaacatgcgtcagcgagattgagaacacctgacaatcggccaatgcagcatactgtgaaccaagttattcctgaacacttggtccatcatgtacaggccgatcaatcagttgtgcctcagattatccctgaacatttggtacgtaatattcaaccgaacttctagaactatcaaggaagaaatttgaattatcaatatcagcctctgtcacctcatgtttagtatcagcaggcaggatcgcctcaacctcagtttgctcctcagttcaatcagtttgagctaatgcagcaacaaacacaaggagtacctcagcaaacatcatgggctgatatgattgccgatgtaatgagggagcaggttgggttcaaaccaaaagatactggaaatttgtatcggcatccttatcgaatatgcggcatattttttggaaattcggtaagtggtctcctagtagggaaggtccttatcgaatatgcggcattgttcgagggaacgcatattttttggagacacttcaaggggagccttttcagcgagcaatcaacgggaaatacttgaagaaatacttcccgagcgtttggcaagacgcttaggaggtgctatggccagtaattggattatcgccctaagaccaaaaacatgttctatgcttttggattcacgttgttcataaaaaaggtagggggggcatgtgtttacacccaaatttggcacctagagattaaatagaaaaaattgccaaaatttggaagtctgccggtttcctccgagtagggccagtctgaccgccgtgcgttgggcggtcagaccgccggtttagggctggtcagaccggcggcatgtggccggtctgaccggcaggtccgagtccgactgtgtttcgtcgggtctcgaggtttccttgctcgggaaggcatgtttcgggtttcatttganttctaccccgagttngacgtggaaganggcctgtagagggcaagaccaacccctatataagggacatggccggttcaattgtaactaatcaatctacaatcaatcaatcgaatcgtttttcatattgcttttaattttctcttagtttatccatctttgtcaatttgcgctgtaaatcgtccgccgccgctgcgagagtgcgacacccctttataggtttgtcctgaaaaccttccgttttgcccacgagacgggtagttatctagaaatcggctccgctagccgatttagttatcaaaacccatcttggtctagcttttggctagatcgaggtggttggcgactccatatcaccgcaagtcgtttagttgctgcgatcgtgcttgtcgactttttacgaaaagttgccaacaaacccctctggatcagagcaaatccactcaactgcacgcgtgtgcatgtttcagaaacggattcatcgcaacagttggtttacgatttcgtaataagttgaaattagactcggattagatcggtttcatgcaattaattaatatatactaataaaatagatgatcgacaaagcatattactaattgatttctccgtgcaaaccggtcgctagctcgctggacagttgtcgtcatca

SEQ ID NO: 2499 - DNA, 2000 bp, Oryza sativa
agttaatactacgtaaaaaaaatcaatttccgtataaaagaaatttgtaataaacatattgtttagtaatttgaaaaacgtgttaacaaaaatcaaaataaaatatactccctccgttccaaaatatagtaatattgtagtaaaacgaatctagatatacccctgtccagatttgttgaactagtatgtgtcccatcaagtacaagagtgctatattttaagacggagggagtacatcagggatctcggtatcgaattttctcattattcgggctataataggcctggtttagttcccaattttttcttcaaatttccaactttttcatcacatcacaattttcctacacacgcaaacttccaacttttccgtcacattgttccaatctatgttaccctgatacggggatacggatacacgatacggggatacatggatacgtcatttttcataaaacacggatacatgaatacatctatatatgtatatataaaacagaaaatacaaaaatgtatagattctagcaaggaaataaagcccaaatgatctcaagttggtgaagctatgaagcccaaataatgaacaggcagactgctaacttgccaataactgagagcaaaccaaaacatgcatgtttttacaactaaaagagtaatgattagacaaatcggaggtgctagctgcattagtacttccaataacaaaatttattagatctaaatagagtacttgtggtaaaaataatacataaaaaatatataaaattacttgtggtaatttaataaaaaatttattaaattacttaaattttttgaataagacgaacggacaaacatttttaaaaaagctaacggcgtcaaacattttaggatggaggtagtagcttcgttcagaaaaaaaggaaaagaaaatggaaaaagttaatcccagaaccaatcatggagaggtagaaatgggccaacgaactttcctcaccgaggaacgaaggaagctggtgtctagcgacggtggcgttgtgccctgtgatggtgtccgcgttgtgtccagtagagatggtggaacgccttgcagaggtggcgctacagccggcgtccaggcgtatggcgacggcggcgctacagggcgacgacggcagcgctacgttcgatgttcgcagcgctgacgctgggagccgcgaatcgagccccagccgagaaccacggaggcaatacgcagcgcagatgattaccaggatgaaacaatgaatcgattgtgtagttctttgatcgcatctgggagttatcagaccgtatcagggacgtatcctgctttttttctttttcggaaaatcgcgaaattggctgatacgtacggatccgatacgtatccgtatcctattacgtatccgatatggatacgtggttttttaccgtatctaaatatcatagattttaatttcaatcaaattttcaattttaacgtgaactaaacacaccgacatgcagcacttcaaacttcctagcggtgaacattcaatacaccgcaacaaaaaaacggcagcttcacactttcacatccagcgagacctgctatagcgagcgagtgaacaactgaaaagctgacagcccaccaccactccaccagtggaccagcaaccaaatcctcacatcctgaggggcttacccgcataaatcccctcctctgtacgcgtgcgctccgttccgtttcgccatttccaacccgtcgtctcgccttcgcctcgcctcgtctgctccaccatccaccaccaccacgctacgctttcctcctccccctccactccagattttgctcccctcgagaccaccaccaaaagcagcagcaccaccgaaagaggaagcaaagcaaagcaaagcaggcgaggtttcagtctcccaggaatccccttccaagaactcccacccgattcgaagcgctcgaggaggttctttgctcaatcagagtggatcttctgctgggaggattgggaagagcgggggag

SEQ ID NO: 2500 - DNA, 2000 bp, Oryza sativa
  misc_feature (473)..(473): n = any nucleotide
  misc_feature (499)..(499): n = any nucleotide
  misc_feature (569)..(570): n = any nucleotide
  misc_feature (580)..(580): n = any nucleotide
  misc_feature (584)..(584): n = any nucleotide
  misc_feature (592)..(592): n = any nucleotide
  misc_feature (595)..(595): n = any nucleotide
  misc_feature (613)..(613): n = any nucleotide
  misc_feature (616)..(616): n = any nucleotide
  misc_feature (620)..(620): n = any nucleotide
  misc_feature (622)..(622): n = any nucleotide
  misc_feature (828)..(828): n = any nucleotide
cttcaacaccctttaaaggatggcgcatgtaacatgctcccgagtaataaatcttccgggtgatatagaccaagtgtagctcataagaatagcttctgatctgagtgattatctcttatggggtactccaaaatagatataaaaattgaatcccgactggcgcaagtagtcggttgatagcccttgtggggaataatgaatagtccagccgttaagcatatgaaatcgactcgtgaccataaattcatgttgaatgtatccggaacaagtccaaattgaagatatgatccttgtgattgagttgataagcccctaagcatatatggcttgtccttctgtcatagtcaaaattgtccattggcaatagctgatgcagtcgacatgaaggcaagatgatgaacatggggatgatatcgcccgtcagaggtgacaaaaatgttggtggtggtaaaaacggtgacaccaatcaaagntgatgaagtcgcatagccatggaggngaagaaaccagtcggcagcagttaggtcagctagcagtgaagatgaagacgcccaacaacaacgacagannagtcggtggngacnaaagcaanccnacgatgaagacgtagacncgnatcnanggtgatggcgaaatccaccaattatgaagatgaagaaaatagtcggcgatggcaaacgcatccgacggtaatgatgattagcggcaacagagatagccggctatgatgacgaagttgcccatcaacggcagcagagtaggctatgttgaagagacttgacaggatgttgatgaagataaccatgtcgttgatccagtcaatagtantgtagcagtccatgataacgatgagatcctctatcggcagttgcatagtaggccaaccgtgaagacgaaataacaagtcggcgatgaaagtcggtgatgacaaaagtaaccgacggcgaggacgtagtcaccccttagcaacggcggagacgtcagggccgatgaagtaaacgtgctggtgatgatgtcagtgacaacaatccatcaaaccattgagaagatatcgaagcttgagaagtttccttgatgtgagcgtgtgcataaagaaaactgatgcaatgcttcttgatttacgaagatgactgtagaacttagtgttacagctgttgtagatgcttcacttggaggaaagtagatgttgttgtccaactcgtctaaaccgagctgattggttgataactccaaactcccgaacatgtagattaaatcttgaacttgatacttgagaattttggagtagattatggcagcgctgagaagccaaaattgtcggtgaaataattgaagttgctgaagtagaacatctgctccgaagcaaagatgaagacaatgactcctggataaattgattgcttcagcttgtcgaattttgagagtcttgtatttgtgtagctcccgactctttggttaattgggaaacaaactgaacatagagtcgagaactgtagcttcttgtcatcgagtagtcatcacttgagtgaagatacatgttgaagatgtccgagtagaattcttgaaaattggaaaaccacttgttgtaataatataacacgacatcatagttgataatgcatgccgagatgtcgaagctcctatagacgtcatggctggtgaaatagcaaaacttgcgaagtagcggcaattgagtttgccgatgccgaagataataaagatgaagtcgctccaccatggtgacaaagttgcaaagccgtgataaagtgaacacgagtccagtggcaacagaagaaaaccggtggcaaagacgtgtagttgtgaagatagatactccagtcggcggcggcataaccagtcggcgacggaagacgatgatgtccattagtagtggtagcggtataaaccagacatagaggcgagggcactagtcagcaacagacgagacaactagtgatgaagacgataaggccaatcaacactggcagaatcatgcagcc

SEQ ID NO: 2501 - DNA, 2000 bp, Oryza sativa
  misc_feature (1441)..(1441): n = any nucleotide
  misc_feature (1466)..(1466): n = any nucleotide
  misc_feature (1471)..(1471): n = any nucleotide
  misc_feature (1569)..(1569): n = any nucleotide
  misc_feature (1581)..(1581): n = any nucleotide
  misc_feature (1589)..(1589): n = any nucleotide
  misc_feature (1636)..(1636): n = any nucleotide
  misc_feature (1650)..(1650): n = any nucleotide
  misc_feature (1674)..(1674): n = any nucleotide
  misc_feature (1695)..(1695): n = any nucleotide
aagctatcaaatttaggctgagaaggagaaagaaaaagattgagtagatacgtaaaatgatataagctattaacacatgattaattaagcattaattattttaaacttgaaatatatattaatatgttttttaaatcaacttttaagtaaaaaaattataaaaaaatgtattgtttacaatgtcgagaagtgttcgcgtagaaacgaggagattattttcttagtgtggttcgaacgaacaaactttttggccacgttcgttctcagtagattggaagaagattcaactcgttacgtaattaagcatgtgatttccggtattgttattggatgatgatgtaattattatgtgatattattgataaaacttgcaaaaaaaatgacatgtgatttctagcatacattcttcatatattcttcctggtacccactacaaccaataacttctataaagcaacctccaggttaagccacgtcatcatcaccttacagccgttggatcaagtgctatctctgttcgattcatgaaccagacagaaactcaaccagtccaaagtccacccaggcacacgatgaggactactggataaaccatatttgccgggtcaaccaaaatccacaatagtcatggttcattaatgagagagctttttttatctcttgtgcaacattcgtattactattatctacttaatcgtggggataaattaaatggttttttttgtttaaatagacttaacaaatattccctctgtcttgaaataagtttatttttaatctgtcctacacatgtatataccaatataaaacaagaagaaaaataaaaatactcttacattatcaaatctcaatgtgattattccttacatttttctcccactttcgtaaactccaatataatgatgactcaaaagtaaatttattttggaacaaatgaaagagggtaaaagtaaactaactttatataagttaggacaaagtgagtagtattggcttacaagaagtggtgtgagctatacagtaaaacatttttttttaaaaaaaaactttgctgttataatctgttgaaatagctactaagaacaaattgttttagattgtagctagtgaattatgtgcggactatttgtgtcatgtttccgaaagtacaatttctaactaaacaaactttatacatcagttaagataagatgttcaacaaattttagcaaaagtagcctttaatttatccctataaaaaaattgagcataatacatccaattatctataaagaatactatatccgtcttgtgttcttaaaaaaaaaactccaaattgtgatctggataaatacatggcaaatccaaagagcccaaaattttgaaaaacatttatgccatttaaggtagtttttgttagaaggacaaaggaagaaaaaaatctctcactttctactcgcanacgcttctcaaacaattaaacgggnttctnttgcaaaaaaaaagtaagaaagatgctttaaaaatcatattaattagtattacaattttaaaataattaatacccaattaatcatacgctaatatctnaccttattaagnaggttctnaatcttccaattttccctcctctaaaacacatcctagagtgacttangagtatctaaactngcttatatcagcctattttaaccntaacttatatatagagccaantcacatagttagggcatccacaatgtggtgtaaaagtagtccataagcaatagaatatttcattcagccacctattaccattgtgcaattagtccatatagaaaaaataacaaaaggtatccatatgcatatggactacccatatggaataaattatattatctatccctactcctctctcttctcctaatgataccttgtatccatatacattatggagattgtcataggtaaaaactatttatatgggtcccatctatatggatcactttgccatatacattggtgatgccctttagagctca

SEQ ID NO: 2502 - DNA, 2000 bp, Oryza sativa
  misc_feature (1799)..(1799): n = any nucleotide
ttcaagagctttgccattgatggaaggagactgtttttaactccatcacattttatgagaaactcatccagaacatccctacataagagtcaattcgcataatggattggtactggcgaaagtgttttattgacataatttgaactataaattttgggacagagggagtactaaatttttgtgacacgttgcaaccataaactaggccttataagttgtttaccatcgccgtaaacaaatcgtaaaacatctctgacactgtgtttgtgatattacctgaaagattcaggatgcttgggccaaacggaaagatttctctcgtctgctggatctactttcagatacaatcgatccaaccaatccaggatttgggtatcagatttcacctggtcatttccatacccttctagctggaaatgcttgccgtcaatcaagttggtgtatttttgcttctctccaagatgctgttgaaaaaactctcttgacacattcatcacgttatccatcagagcatcttctatgccatggttagttacctgagaacacaattgcagatatagaatataagccacgacatcatgttatttaaagaagccaaggcagttcaacaaaaatctatcaaaggtacactgactacttattaccatgaaaaggccccaagactccatcgcctgccggagtttcaccgcctcattggcatcaccatctggttgggacaggcgaccaaggtcaacaatggggaatgatgcagtggctgcaatggtcggttggtcttcttgttgcacaatgtactgtcttggcacagatttgcttctcatgccggcaagctcctgcacaagtagtgttgatctcacatcctccatgctcccttccatacggatgtagctcaggtactgtctcaggacttaggttgttcaatgctgttgagttgatacggagaagttactatatatgagtctgagaccatgtacgaaaaaagagtaaaaatactgccattgttgcacaagtggtcatgtaatgaaaacaatttatacctggtataaaaaaatgctgtaagttgcaaccaaattgctgaattaaccaaaaaaaaaaggcaatttgacatttatggagcagagttaggaactgcccaatagtggctgacaattaagatttaaattcaagctcaacatctgattccctaacttcaatataagcacctagagcgcagctgtgtactagcctggagttggcaggctgtttgttctatccttaggtagttgggctaatttctggtggcacagcaaccttgtttgtttatttattacttgtaacctctccttggtcttaatttgggcggcatacttttgccggacaatgaaaaatataagcacctagaagaataaagattcaatataccatgtgaatcagaaaaccactccatgtgttacacaacatacaacatgccaacttcaacttgagaggttgagcaaccgatgatgcacagcacaggcccttaaatttaagcttgtgataacgtcctttccagaataacttaacatcttgaaggagcatattaactgaacctggcaatatcgcttcttttttatttggaagtggcgtatttcacatcaaattctatgacatcttgtttcttttaaatttgaaagtggtgtacttcatgacaatattgtttcttttttatttgaaagtggtatagttcatggcaatcttgttcatcttctactactttgaaagtggcatgcttcatatcaaattctatgcaaggaaccctaataccgtgtgctgttttttttttnaaaaaaaacgaacgattcttgttcctacgggatttttcttcctgttttttggattgcacaaaatcaatcctgaaaacattgcacattcgcacagtactaatcccaaataaatttcccccaaacttttcaaagaacaaaaaatttaaccgaagctgctttggcacaaacctatccgccccgattccctatctgcgtaagaag

SEQ ID NO: 2503 - DNA, 1698 bp, Oryza sativa
  misc_feature (3)..(3): n = any nucleotide
  misc_feature (8)..(8): n = any nucleotide
  misc_feature (11)..(12): n = any nucleotide
  misc_feature (19)..(19): n = any nucleotide
  misc_feature (27)..(27): n = any nucleotide
  misc_feature (30)..(30): n = any nucleotide
  misc_feature (34)..(34): n = any nucleotide
  misc_feature (39)..(39): n = any nucleotide
  misc_feature (50)..(50): n = any nucleotide
  misc_feature (59)..(59): n = any nucleotide
  misc_feature (91)..(91): n = any nucleotide
  misc_feature (101)..(101): n = any nucleotide
  misc_feature (103)..(103): n = any nucleotide
  misc_feature (105)..(105): n = any nucleotide
  misc_feature (111)..(111): n = any nucleotide
  misc_feature (142)..(143): n = any nucleotide
  misc_feature (155)..(155): n = any nucleotide
  misc_feature (162)..(162): n = any nucleotide
  misc_feature (169)..(169): n = any nucleotide
  misc_feature (171)..(172): n = any nucleotide
  misc_feature (175)..(175): n = any nucleotide
  misc_feature (177)..(178): n = any nucleotide
  misc_feature (180)..(180): n = any nucleotide
  misc_feature (182)..(182): n = any nucleotide
  misc_feature (184)..(186): n = any nucleotide
  misc_feature (188)..(189): n = any nucleotide
  misc_feature (195)..(196): n = any nucleotide
  misc_feature (205)..(210): n = any nucleotide
  misc_feature (212)..(212): n = any nucleotide
  misc_feature (216)..(216): n = any nucleotide
  misc_feature (228)..(228): n = any nucleotide
  misc_feature (235)..(236): n = any nucleotide
  misc_feature (239)..(239): n = any nucleotide
  misc_feature (250)..(250): n = any nucleotide
  misc_feature (253)..(254): n = any nucleotide
  misc_feature (262)..(262): n = any nucleotide
  misc_feature (266)..(266): n = any nucleotide
  misc_feature (282)..(282): n = any nucleotide
  misc_feature (287)..(287): n = any nucleotide
  misc_feature (294)..(294): n = any nucleotide
  misc_feature (297)..(297): n = any nucleotide
  misc_feature (309)..(309): n = any nucleotide
  misc_feature (323)..(323): n = any nucleotide
  misc_feature (326)..(326): n = any nucleotide
  misc_feature (330)..(330): n = any nucleotide
  misc_feature (336)..(339): n = any nucleotide
  misc_feature (370)..(370): n = any nucleotide
  misc_feature (401)..(401): n = any nucleotide
tangatanagnnaaagatnataataantantacnctaancagcagataantttataatngaggagcaagatcatacgcagcagtatatgtntattctctangngnagaggngagagaatatatttttatatatggggggggnngaaacaccctcncaggggnggagagncnnacnanngngngnnnannaacggnnaaatatttnnnnnntngtgnaacaagagaaantttgtannganaaagagaacgnacnncctaaaanttgnaaacccccgaaaaggnggggntttttcncanaaccccggaaanttattttcaaaccnttnttgntaaggnnnncccaaaggcaatttcccagcatatcactcgnacccaagtactccagagaacaatgtcaaaanttagctgttttgctgtttagcttagtgccaggaggacgccaaaagtctttccatcagctccatttgtttcgccgcatatatggggcatagttcttgacagacagtgattggcacgttgttcatcagtaggtacataccaacagaaaccttccaaaccatgccaatacattcttcgtatatattcctggctattcggtaggtcagttctgaatgagtgagtgataatggcatctgtttctgccataaaataaacgaaatctgcgacgcaaatgcaacgttgtgatgatcacttaaattagtaccacccagatgcacatggtgttttaccacgactgacctcttgacctctgagatttattgattagattataacgtaatcgttgttaactgcaaaagctgcacttgccactgttcctttcttgactttcagagttcacagcatagttcagaattcagaaacgaagtacaagcggttaattaagtactcactaattaacaatggagctgtacgcactagtagtaattcttttcgagcaatgaaagctgtctgatgggcgctggctatcaatgtatgtcactgtgttgtcatttggcagccaatgtgagttgtaaagaggtagtatagcgtcttttcgagagcaaaacgccgtggcacgatcggtgctacaggccaagtcaggcggttcgtcatgatgaatccaactcaccaaaaataattctggtgcagttttatttcagtcctctgctcttgcatccaaagagctagacttccctgaacaaattggcatcgattttaattaccaaacggtaacggaatgaatgctgtgactaaattagctggactgctggagtagactctgacctgcatagaactaactactataattagttcgagattccataaaaatcaaagaagctaatcagttcgtcctctcggcgcagcctgcacataattgaactgctaattttattctagtcggaagcacatttaggtagacctgccttccatagtcttgtgtggcgcaatcattatcgaacatggctcctgtccccaacaccatcatctaaaaaatggcttttttactctcaacgtcgagtccatatatacggccttgagctagcgcggtggtggtagactggtagtggcagtagtgcaaatccacagctcagcattttgcctcccatggcgtcctccaccgccattgcccttgctctcctcggcattgtgcttcttcttcccggcaatgccttcgtcgtggtcgcctaaccacgcggcggcggcggcggggactacagg

SEQ ID NO: 2504 - DNA, 2000 bp, Oryza sativa
  misc_feature (1388)..(1388): n = any nucleotide
cacgacaccgaggcggagaatatttgatgttttaagttcgattcgaagttagtagcttgtagactttttgttccactgcttttgttgtggcgggtaaacgggcacgcccgcgggcataaggcgcccgcgggcaatgggcatgggcaaccatccttacccgtcatgtagtaatgggtatacccacgggcacaaataatctcacgggcatgggtatggataggcactacccgtgcccgtcacgcccgattgccatccctaccacccatacacaattgtctttctttcaacttgccgaaaatactttatgcaatctattttgttcagcatttttctgttttggcatcacaaccgaatactcagtacagtccagaaagatcaccggtataattatacagtatacatggacaagtaacgatcaatctgatttttgataaatcatcaatcaataacttccctaactccaccatttttcttattttcttgaattttttttgggctatcttatagttttacacctcgctgctaatccctcctgctactcgcgtgcgcggggccaaccgcccataagcggtgcgccggttaatcaaaatttgggcgctgtggtggtgtgcatgcgtggcggttagggtggaggggctgctcccggtgagagggctgggaacttttgtaaaaaactcctcgtgttttcacggaatatcgcatacgtcctcggaccgcctgacatcccgttgtatttctttcatataaccgctcgtctttcaggaaaatacaatgcgaagaagagaaaattccgcttttaggggtagatatgtaaatataaaaactatagggggttttctgcaaaacgtcctacactaaccccccaattccgaaaccctctccccattctctcccttccctctcctctcctcccctcccctcccctcccacctctcctctctcgacgcgggttccggccggagctgccgccggagggcggcggcggctaccggcggtggcagaggtggctcaaggcggtggctgcgcggagggtggagccagcggcgggcttccctccctcctcccagatccgatggaggcggaggtagaaggcggaggcggcgcgaagggtggacgccgcggcggtgggtccgctgggaggggtgagggcggtggcgtcggcggccctcccctccggatctggcgaggcggctacgtccgcggctggattcggcacctccgccgtcgtcgctgtggtgcgacctcccccgttcccgaccccctatattggataaggaggggaggagggcgaaggggagggtgaaggcagttttggagggcggctacgccgggaggggggatggcggtggcggcggtggccagatgcggacctccgacgcgcgcggcgnacggcgcgaagacggcgaacggtgagtcaccttcccgcctctccctctccctagcctctgcgtctccctcttcctctcctcccttcccctcccacctctcctctcttggtggagtggtggcgtggtgcggggactgccgttgccgacgaggccagctcggagtggcggaccatggcgcgagggagtgtccaacacgcaacccctcccatctgctgcctccgtgcctcctcctcctgtgctgacggctccggtggaggccctcttcgatcgccaccgccaccgtgccctgctacccccttccgcttccctttctccacccgtgtccctctcctccgagtagcgttaccggccgcagcccctctcctccgagcagcgttaccggccgcagcccctcctcctgagctggctgtcggtgccatgccgcgccgctcctcggatgagtcgatgatgccgcgacactgagccttcgtcggagagcatctgatttggccctttgtgcccaggtatgctcagcccaagtgttgtcgttgacgccggattgcacgtctccttcctctgcttgtcgactatcagcaggtcggtttggccactgcaggtggagccgtgaaggta

SEQ ID NO: 2505 - DNA, 2000 bp, Oryza sativa
  misc_feature (1)..(1): n = any nucleotide
  misc_feature (14)..(14): n = any nucleotide
  misc_feature (29)..(29): n = any nucleotide
  misc_feature (162)..(162): n = any nucleotide
  misc_feature (174)..(175): n = any nucleotide
  misc_feature (177)..(177): n = any nucleotide
  misc_feature (199)..(199): n = any nucleotide
  misc_feature (202)..(202): n = any nucleotide
  misc_feature (206)..(206): n = any nucleotide
  misc_feature (210)..(210): n = any nucleotide
  misc_feature (233)..(233): n = any nucleotide
  misc_feature (236)..(236): n = any nucleotide
  misc_feature (324)..(324): n = any nucleotide
  misc_feature (1652)..(1652): n = any nucleotide
ngccggcccaaccngcggcgaccgcgtcntcggtcgataaggaggaggtcgaagagcaccttccgcctccgcctccaccactggttgcccgggagaactccacctcccgctgccggccgcccgccgcttgccgccgccggcagcgcccgagcaagctctgcntgtcccgtcctnncncgccgccgccgtgctggtgagnagngagngagngagggagagattgggatatagtnganagggaagcagatcctttgacttaactgcacatgcagttgagtcactgacatgtaggtcccactttgctatggcccacatgtcagtgantcaactgcacaacagttaaatcagaggatccttttccagtagagagaggggtggagaactggcatgtggggtctactgatttttttttaaaaaaaagctgactgcactgccacgtggatccaaaaccactccggattgagtcgaggggttatttgtctggtttcaatagttgaggctactagtaccttttatcctgaagatgtggggcatatgtgcattcgtgtctacgaaatctggttccatcaccgtcaatgcatcttgtcaccctgaggtgtgcactatagctatccatgggaagaaccttgatgtagaaattggcaagcgtcaattcagagtgaccatttatgaatccatgtcttcctccgttctaaaatatagctatttctagcacattaccttattccaaaataaagctatttcttcatctacctagcttctcctctcaccaatcacaaccattcttcttcactactttctcttttcaaccatcacatacttcctccaatcattctcacatactttttaataccagtgacaacctaaaaaatagttacattatagaaaggaggaagtacatggtgtgcatgcttgcatgtgctattggtcttaggagttcaattagggcccatgtacagatgcacgtggcaatactgcagtagcaacttgcggcatgtgtatttgccttaggcagtgttatttcccttcaaacttctaaaaattctgtcacaacaaatatttagatacatgcatggagcattaaatgtggacgaaaaaaccaattaaatagttagcatataaattgcgagacgaatcttttgaggctaattacgctatgatttgaccaatgtgatgctacactaaacatttgctaatgacggattaattaggcttaataaattcgtctcgcagtttacaggcggaatctcactggtggagaaaccatctttggtcggtcggccgaaatccacaatagttccagttctattaaaaaccgggactaaagatgatatttagtcccggttctaaagatgtcaaacgttgtcaggctccccgagatctttagtcccgtttgtgttaccaaccgatctttagtcccggtttgtaacaccaaccgggactaaaaatcccccctttatatatgtcttattcctcctctagtctgagcaagcttcaaaatttctcaaagaaagaggggaggtcatgccaaaatttcttgtgaaatttttttagtgattaaatacaaatcggaggtgtctaaaatgttagtaacttcatcctccaaatgttttttgttggttatattacttttgggagctatgtttcacacnatttgtctccaaaactttgttgtaagttgacgagagagaaaatttgtgtggggaagaagaatatatagaaattttgtttgtttacttaaaaaagttttattcttatattaaaatatgatgaaaattaatcttaaaaaatagaaaacaaactaaattgaaaattaagagaagtacaacattaatattagtttagaacttcaaaaattgttaataagaattgtttgttggattattttataattattaattgtatgagtaatgatatgtcattattgtatgcttgtcgaaagagtttttaattactttatcattattgtttgactgtcattattgtttgaaaatttattt

SEQ ID NO: 2506 - DNA, 2000 bp, Oryza sativa
tcacatatgtgcaatgttaaaccatgtaagcaagaaaatttatgtataagacacatggaaattttaaatgttgcatgagaggctgataagatgggtccaggctcacatatcagtgaggcattaaaaggcatatacaaaatagaaccaaaatgctgctggttacaatttacaaagcatagaatcagaatataattgcacacatgagtatatgacaaaaacagaatagcaggaaaccccaaggtagaagagtgaagtttatgatttgcctcagagtacatgcaatccactcgttgacctaaagttgcccatggctcccttggattttagcaattagtaaattatcatattcaacttggtttgtaggaataaagcgccaaattaagcaactcaagcctccacacaagagtcgggatttaaattgaaatgttttttcatattaaaaaattataggtctttgccattaaacacattagatgtctacagtcaatcattctcaacaatacataaaataggattttcagtcaccatttaataattcgtacaggaaaaggactctttgtcaacagaaacacaagatgacattcatgtggtatacctcttcaggggtccaatttcctttggtggaacgccgtgtcggaccggtggtcctcctaaatttgcatggacaaagaaacaaaacaaaatttagtacaatatacattacgatagtcaaaagagcttttagccttttacccattgagaggtcgtcgcctttttggttcattgctgatttctccttcttgaggagccgacggaggtccagaaggctctccatccttatctggagcctttccgttatcgcttgtcatcatgagtgaagacaatcaatcctcactttgcagtagaaacctccaagggatataaaaatcattatactgtcaagcctcagtgaggccttcagggagttgctccaagggagaagcaatcataagctgcaaaagaattggacgaatgaagatattgtcacaagatgtaacaatagaagcattcagggatgcatagaggacaggacattgactaccctcataagaacatgaattctcatttcaaaggagttggggtagaattcatgtcattttcgttttattatagagatggattgtataatattttatctaaaaaaagagttggggtgataatgtgtctacaccccctcgttgtacatctttatgaaaactaaaaaatgcatcattcaccctgatgtatatgtagatggttgattgatatgcagtcaagtggataacttgcaaatggggaaaaactcctctttgcttccgtaaactattctgcaaatctacttattagctcattctaccctccgaagtccgaactactgaagtagctaatttcacatttagggggagtaaaccttaagctttctgcaatatataaaatagttttagggtagtaaaatgttttttctccttttagatttgaggattgtattttctgcaaaatgtgaattatctcctggtttatccataatctaaaaatatggacctcctctgtctgggtttcaggtttatttggtgctaaaagcgtctgactttcgctgtggaatttaccagacaaaaaatatataacacagatcttagtgatacgaattatctgggctcgtaagtcggtttatatcgtatagcatagcacctcctccatattcaaactcaaatcagcacaacacttcaacccaatcaccaacgaagcaacatcccaaagcaacaattaatcaagcagagagatggagagatatataccagatcaccaatcgccttgctgacgggcgagcctggacgcgagacgcctctgccgtgccgccgcctcgtccgccgggagcgcgtcccttccgcggcttctgctgctgccgctgcctgcctggatctgggtggcccgaaatccttaccagacgccctcaactcaaccaccgcggcggctgctgctgcggacgccgcccggcccgagcg

SEQ ID NO: 2507 - DNA, 2000 bp, Oryza sativa
  misc_feature (1969)..(1969): n = any nucleotide
  misc_feature (1977)..(1977): n = any nucleotide
atgtgtcgacgaaaaagctcaagcaagttcaccagcaccacacggagtagaaaattttcacgttttctaagcacatgcttcccgaagtatgtgtgtttttataaaagaatgatctataagaaagttgttttaaaaaatcatattaatctattttttaagtttaaaataattaatacttaatgatgcgataacgtctcatctcgtttcgtgtattttcactatcttcttctttttcacaagcatacgcctcatgtgtactgcgctaaaggaggtgggtcaaaacagttcaccaatttttccacggatcaagccaacctggatatatacatagtattcccttttgggtctaactcaacccatggagtttttcaaccaaacacttacaaaaatagaatggcccagtccaactcaccaaaatcctccaacaaaaagcatgctaggttagatggacaaaagggtgctgcagtgacaagtatgactggcagagtgcttctaggcactgttcaagtgcaactacacattataattatagactctccatatactctagggagtagctatatttatgacgccatatttttttataaaaaaatagccggcatgtatttatattataaatttctaatatgtaattttagtgtatttacaatgtaagtcccaaaattatatatgtaagttctaaaattatatatgtaaatcctaaaattatattaattacatatgtaagtggtgtgtaagtgatatgtaactacaatagaatcacactataattacatatgtaactgcagtttaaaaacagacattgacgtgagctctctatcttccttggcttctccttttctggtccttttgcctaccatctgtgcatggcatcttggattttactccgtaatgattagatattagtatgtcctggatagtgtatatcgatgtatagtatcaacaatagtagtaatgatggtgttagcagttttggacatgcacaaatcgctgaactaattgtacggtaaaagatcgactgtaaactaattgctataaatatgacgccatatttatagcaattccgtaactctatacgttcttttttatggttttatgtgaaattcatgcaaacaagtgaacaactaaacactgtactaagtcctaactaccgacaacacaatcaagtacagtagatatctatttccatatatacatttcctattgtatgccctaaatgcatatccaatcagccatcgccgtggtccgtggtaccaaacccaacacataaacagcgacataatgcagtcccattcacgcgacaggttttttttaaaaaagaaaacacacacacacactctctctctctgtgaagtcctcaaaatcattatagaatatttattttggttaggcacggaaatgtatatattgagttaaattgtaagtaacttgcatataaatttattaagaaaaggagagaaaatacttcacctacatcattaatcattaatatattaaacccctagagctaccctttttctccctttttggattttttttggctcctcagtagttgtcctatgtaatttgcaggtgcagaagctcctcgattgggtgacatgattttttttgcgccgtttcctccaccggttgtgccagtctcgtcctgcatgtgtgtcacgcagaacctttcttgtagtaaatgacgcatggtggtgtttataaaaaaaaagactcctcgtgtttggacggaatagcgcgcacgtacttccaccgactgacaccatgttccgttttatacagtacacccctagcttttaaagaaatgcgacacgaagaagagaaaattctgctcttaggggcagcactgtaaacatgaaaaacacaaggtttttttttttccgaaaaacaaccaaatctatccccttccctcctatccccaaactctatccatctacttccttccctgcccgtcccatctcttccccangccgcganagcgctgtcgtccctccctcacc

SEQ ID NO: 2508 - DNA, 2000 bp, Oryza sativa
aaagcaaaagctaacactcaaacttaaatttaattttaaagttgattttaagatatttttaatataatttctttttaatattgatttttaagtcgctgcgaataaatataaaaaagttttacttataaattaatttttatttcctattaaaccaaaataacttatgagaaaaatgagcaaccgatgaggctcttgcaagaaaaggagctgcacagataacttcgtgtcttttatagtagtatattgctagatggcaagagtgaggcatgtttaatctgaaagcctcgaaactaccgtattatactaactaaggtgtgtttagattcagggagtaaagttttggcgtgtcacatcggatattatataggatatcgtatggggtgttggggcattaataaaaaaaactaattatataatccgtcagtaaaccgtgaggcaaatttattaagcatatttaatccgtcattagcaaatgtttactgtagcatcacattgtcaaattatggagcaattaggtttaaaatatccgtctcgcaaattagtcgcaatctgtataattagttattttttagcctatatttaatactttatacatgtgttcaaacattaaatgtgacgaggtgtaaaattttgggtaggatttaaacaccccctaacgatgatattatttaatgggaaagcggtgccgaaataaaggcaaacccaacacaacaccaaagccaaagaaatgcgccgtcgatatgataaggtcctttcatcatgcacaaggcgctcacgctccatctttgcttcagaagtcccaactgatgtttatattggtagagtacgcagcccggctcatcaatcgtgggctatccaggttatattgggtctgctccaccacagatctaaccagagcaacaactttatcccgagcctacacaaccaaaaaaaactagtctgatgggtgaggaccgcccacattttaagtcgtgctcctccatcatcaattaccgatgtgggactaaacctaacaatctcccccgtcacatcaacccatgtgaccccgaagacttgttatccgacctccccaccatatgaccaatagaaatcgttccggttccaaacctgggctcttataccacttgttagagtgcgtagcctagcccaccaaccgtaggccacccaggttacattgggcttgctccaccacaggcccaaccggagccacgcaactttaggtcatgggcccccacaacccaaaattggttatatagcatcgaaagttcacgttttttttattttgtaacacagaatcattataatatattttaataataaattgagaaaatatatatgctattatatgatagaaaatataatgatactatccgcgtaatttgcgcggaccaccatgctagttgtaataatgataactaatgcgccgctaattaggacagaccgctagcgcgagggccatggggagcgcacggctgtaatagttaattaagcaggtggtgcgtgcccactatgaaccccctatacataacctgtatttggttttgtggatgttgtgctttatgctacacgaatctcagaacatgtatggacggctggcatcaatggcggatttgccatggtcggcggggtctcgatcccctactaccggcgttgcaatcatgggagcccctattaataagccctcactaaaatttgttgccatacatgtattataggagggggttataattttgtatagtttgttcagtccctactattagttcttcttggatccgcccttggctggcatactgcgtgtataaaacccggtcctgttgatgaagaaataaaatcgatccttatttgtgctgtcgtgagaggagaggggagggttgtcaaccgtgagaattgctacctgctgcttactcccactgcatgccatggccggatggtagcagctaccagctgctgctgtatcggggtaggcggatcacattggcaagtttggtagagctaagaag

SEQ ID NO: 2509 - DNA, 2000 bp, Oryza sativa
  misc_feature (33)..(33): n = any nucleotide
  misc_feature (41)..(41): n = any nucleotide
tttcactttcatttgtcatttgctcgttttcantgcttttnatgcaccattcttcccttggttttcaggattagcatgaacttattttatgttactagccaaacaatacctatgagttacaacaggttattcaaaatagctaaaataatatttcattcttattgggaaaaaaatattagcttctacttgagaaacaagattcttcatcttaaaaaataaaaagaaaatcaatggctccatctgctttaacaaaatgcccttttcatacttcttaccgtaaaaaatcgtcggtggtgtttccttttcacaaaccgaaatcgcaatgtaggccgaaattatctcgaggccgaggcccaacaaaagtttgtgtccgtggccgtggccgtggcctgcttcatccgggcggcgtgcggcgcgtgcagttgcgggcctcgcgagcgagcgagcgagcgatctccatccccaacctcaacaatccccttcccttcccccatcgcgcgatgctggtggagtgtggcgtcgcgacctagccctagccctagcgccaccgccaccgccaccgccaccgcctgctcgctcgctcgattcccggctccccgtcgctacctcgctacctcgccgcgccgccacagccgccggcgccgtctctcaccgggatcgggacaacaagcgccgcgccgttcagtcaggcgacgggggcgtgcgtctccgctctctggggggcctcgacgtcgcctcgccggtgtttcggaagaccgtcggcctggttggtatctctgattgcttgattactgctagggaatggatgggtggatgtcgtcgacggggtgggtttagctttagcggattagcgcgtatcacatcccctgattccagtcgagtagacaggataatagcaggtggagggtttgaattttttagttatataaaaggataccttacgttggtgctgtttgatggattggtagaggtggtgctattcttcccttcatcagaatgtcaagcggcttgcttcgtgtgtagattactactagtatttttagggtttgggtgcctgctaatgtcaccgaataggtttcgttagcttcttattaatgtttttaatgcactttgtcgcgatatggatagcgagaactgctatttgtgccgttttgagatggtgtgtgtaatttactatgtcgttatgggatgttttttttttggtctattcctttggctcacgtgtccctcctgctgcaatactcatttttgtttgttggatgatcagttgtttgaaccgcttaccttttttataggcgcatataaaagtgatttggtggtcctggagtattcatttggtcatgtattctatattttggaaacttaagttttaatggattaatctagtggaggatgtagtcaagaattttcttttgttggttcctaagagatttcttggctcgcaagttgcaacgcgaattgggctctcatgtattttactattttagaaagcttttaattatcacagatatagtagccgaacagattggatatagctgtgtattcgagacatctgtttgttatcttatacagggcatgctccgccactgaagtcaaaatgtagggagatctgttaagttgtataccatattaggcttagtttattctttaatctttctccatttgttctgctaggaactgagctatcccatggcatcaccacaagaatccaattccttgtgcttgaagcgcaagcttgttgatgactgcctgtcaaaagagtgcaagtctcgtcgcatcaaaactgagaagggaccatcatctgattcatctgccaagcgctgcaaatgctgttgcactcgacctaaccttgccagtgattgtgtcaattacctaaaaagtggagtgcccagccgtgttatgttttacaaacagggttcttggcacaattttcctgagcagataatgaagtctctcattggaagaatttagaagcaataaaatctagtgttgttgctgtg

SEQ ID NO: 2510 - DNA, 2000 bp, Oryza sativa
  misc_feature (44)..(44): n = any nucleotide
  misc_feature (61)..(61): n = any nucleotide
  misc_feature (86)..(86): n = any nucleotide
  misc_feature (92)..(92): n = any nucleotide
  misc_feature (103)..(103): n = any nucleotide
  misc_feature (136)..(136): n = any nucleotide
  misc_feature (162)..(162): n = any nucleotide
  misc_feature (198)..(198): n = any nucleotide
  misc_feature (212)..(212): n = any nucleotide
  misc_feature (333)..(333): n = any nucleotide
  misc_feature (566)..(566): n = any nucleotide
  misc_feature (589)..(589): n = any nucleotide
  misc_feature (607)..(607): n = any nucleotide
  misc_feature (632)..(632): n = any nucleotide
  misc_feature (723)..(723): n = any nucleotide
  misc_feature (756)..(756): n = any nucleotide
  misc_feature (824)..(824): n = any nucleotide
  misc_feature (923)..(923): n = any nucleotide
  misc_feature (933)..(933): n = any nucleotide
  misc_feature (1310)..(1310): n = any nucleotide
  misc_feature (1336)..(1336): n = any nucleotide
  misc_feature (1372)..(1372): n = any nucleotide
  misc_feature (1461)..(1461): n = any nucleotide
  misc_feature (1601)..(1601): n = any nucleotide
  misc_feature (1685)..(1685): n = any nucleotide
  misc_feature (1741)..(1741): n = any nucleotide
  misc_feature (1784)..(1784): n = any nucleotide
gtctgttcaagccgacgcagtgctacttgtccctggactcgacnctgctaattcaagccgntggtgatgcatctacccgaagctgngacctngccgagatacnagacatccttgatttgcaagcttcaccgcactngagcgggctaaccatggaggaggtcntcgggaagccgccctgccggagcgcgccgaggatcnccggagctgccgcngactgccaagacttctatcagttctcatgccggaggtcaagcatcacgcatggcgtcgaaaccagcggatgacgatggaggcaagtatggctgcagtacagaggaaggacgacgggagganggcgagccagtgctgttggatggcaacaagctagctaatgcatgttgattaagttaattattgtggcaacgtggccaaccaatcggaggacgacatgtcatcgctgctacagtgccatgcacaaaccaatgcgtgggctgaagaagtcctgttggtttttcttatttgtcccaaatgagatgccgagctttgattaaatccggccgccgtctacatcaaccatcttcaataantcctccctgattcttctctaatntaatctcgacgcaactgntgtgacgtcaagtcgttcaagctangcaactccatgcatgtcttcaccaacaatctacatcgacacgttgttcaagaccgacgaggctagacgacggagggtgggcgaccaacacnggcgcacggaccgacgaggccatggatcgctgncggcgctcacacacacacacacacacacacacaaacacaatctatatcatcatcacaaccatgcatgnagaacgcgaagcgaagacgacgagacgaccacaagcagcttaatcggaggttctcttgcaggcctagacctgcggaggtaattaactgggagcttctcnaggccccagnaaccaggagaccacatcgcacaagtcagatctgtccaatgacagattatggagcgcgcatacatatatattacattgggaatttgtatttatgatcttttaagattaataaagagcatgttccctatgttttgtttacattgtgtatttaggtacactggcacgcccgcacatatatgtatctctaaacaaacgagatctcagatgttattttccaccctaaacaaattggcacgcccagtgggacctggttctcctcccatcttcgctatgctgtggtcgtcaagctcgtcttcgccgttcatccaaccaacaccaacatgttgcatgatgatcttcaacgtggagtgtacctgaccaaggctccttcttgcaggnggactttccatcatcgagaacacccngacgccctttgtgattcagtttggatcactaccacnggtgacattcttcgagtatggctccaaggtctacatgcaacaagctcaagatgtgacccaattccaggaggcccagtctaagaagcaangcaagcgtgcttctgccaaggcgaagaaggagcggcgaaccctcatgcttgaagcccggaccctcttgaaggagtccgttgtagctgagattaagggagacatccaagctgcacagaagctgcgtgtcaaagcttccaanaggcgctcaagtactgcatccctgcgtgcccctgatccagccgctactccaaagcggcctaccccaactgtgcaacacacagangtggagctgcttgaggctctagaagctgtctccgacaatcttcgtcgacacatttngcatgctcgacgggcaaacagtcctcatcccctgcgcaactanaggaggaagtatcgcaaggtgcagcgtctacaccaactcgttagctcgcgcatcgcccagagctccgtcccagaggaagactggtctcttgacacatctgtcctcatcaagaaggtgttcaagttctcaagcattctagagccaccttacgacttgttccctgacgaatgggcatgtgagccaactaagatcaaggagaaagtcagacgagccatc

SEQ ID NO: 2511 - DNA, 93 bp, Oryza sativa
cgcactgctacttctgagtttgctattgttccaagcgagataactgggatctaacaatctggtatcagagccaccattccccaccaaattcca

SEQ ID NO: 2512 - DNA, 2000 bp, Oryza sativa
  misc_feature (996)..(996): n = any nucleotide
  misc_feature (1007)..(1007): n = any nucleotide
  misc_feature (1019)..(1019): n = any nucleotide
  misc_feature (1022)..(1022): n = any nucleotide
  misc_feature (1032)..(1032): n = any nucleotide
  misc_feature (1109)..(1109): n = any nucleotide
  misc_feature (1141)..(1141): n = any nucleotide
  misc_feature (1245)..(1245): n = any nucleotide
  misc_feature (1247)..(1247): n = any nucleotide
  misc_feature (1381)..(1381): n = any nucleotide
ccgatagtggtgatcgtgttgatcgtctcatggtgagtgtgtgtcctcctgtcctcctaggggggcttgtatttatacccataggttcccccttgtccaagtataactagggaaactaatatggatacaatccgagtagtccttgtcgtttccatgtagaactctggttctttcctcatcggaactcctcctatatccgaaggttgtttccgtataggacatggtatgtggtgggtcctgccgagatttagtcaactactattaggtatgtggtatccataaccatgacaactataatttaatatacaaactttaaatttatcgtggttttgagatttgaagttgtgccaaacaagatttaaatatctttctcatatttatttacaagttattggaaggaagttttcaaattgatctagtgcaaaagtgaagatacacaacaatacaaacgcaagattttttttatcaatatatttatgttactataatattatattaaaaaataattcaaattttcaacacgcgtttacacttacactaaaaaatcgtttcttgcacagtgaacaaatcaaaagccctgaaaattaactgtaatccactaaaaatatgtcaacgcaattttagtttttcctcacaaataaacaccgaaatttctatacatctatcgcaagattttttctttagagatcttgcaatttttttgaccattggatttttattgagattcatgctaggaacctcccagaaaaatgcaaacgcacgagagaagggagtcaacctcataacctcaaggtcacacgggttgttttcgtcggatttctcccgagttacagttaccagcacgggctctcgctcactactaggagaacgtttttccctactgtcaaatccgattttgtgtgtgcaggtgggcggtccgcacccacccaggggtctgcgaaaattgtaatttttgtgtgcggcaacaaaaatccagaaaaaatgaaaaaaaaaaantgaaaacctanaattcggcggtngcnccgccgcctnttccttgtcgtcgtcctcctcctcgtcatcctcgtctttggccgaggacgccactcccgtcctcgtcatcgtgggtngcggcctccgcaccgcccgccatcggctccgngctcccctccggctgcaccgccgctgacgcccctcccctccaccggatctaggaaggggaggggaggggaggggagcgcttgcccgatcccgcgtgggggagancngccggccgccagatccgtgctcccgctggcctccgggctccccttcgaccgcaccgccgtcgacgcccctcccctccgccggatctggggagggaaggaagaggaggcgaggggagccggatcccgcggggganaggggggagagggcggccggccgccgccaccgaatccatgcggggacggccatcattgccgaatccgtgtgagggttggccaccgctcgccggatcccccgcgccgtcgccacgctgctgctaccgccgcgcgccgtcaagactcgggaggagaggagaggacgggaaaaagtgatagagtggagagaggagagaggagatgagaaaaagaggagaggacagaagaaaaagagatagagaggagaggagaggagagaaagagggaaaaatttaaagtaggtagaagggaaagagagagtgagtatttttacgtgcggctctcttaaaaggtccgcacgtgaaaataggtttattttcgcgtgtggtccattaatgggaaaataagctcatttacgcgtgcagtccattaagaggaccacatggaaaaaatcgatttttccgtgcggttctcttaaatggactgcacgtgtaaatgagcttattttcccagacgggaacaccgttatggtccgtctgaaatctaaatgggtccatatccaggaaaatcattttttaagtagtgtcagcctcagatcgcttgccagccatctatcccattcactggcgtccgccgccgccg

SEQ ID NO: 2513 - DNA, 2000 bp, Oryza sativa
  misc_feature (1321)..(1321): n = any nucleotide
  misc_feature (1419)..(1419): n = any nucleotide
aactacaacaacaaaaggtggtggttcaccaattgagcgatccataattggcacatgaagacgacgttgttcaatctcagccgatcgtgcttgtagacgcttggcctttgcagctgactgaaaggcaaaagcctgggacaaggaatggtaacctattaaaataaatactccaaaactagagaaggaaaaggttaaacagatagacaaaccattcttgagttgttgagttcgtttgcacagtgtaaagaaccatttagttacagagatctaaccgtgtcctttttaaggaggatatttaccatttttctttaaaaagcatggatcatagccagtgaccacatgacctccaaccaaactcataaaattccatatatagacggcagaaaatatcaccaaagcataaataaataaatgcatctattgcaatagcttgctaataatacgagcacgggcactcaatgctatctaaattctacattttaagctaattgcactggactataacactgtattaatacagagcaacgctgttagcacagatttaaacacagtttacaatatccaatctgtatggcttgcatcagatgctcaaattaatattgttccaatttctccaatagaaaaccgagaaaatgagacttcatcgtgataagcaagatgtatatcttctggaacaagttggaaccgcgcagtatatccgcatgaacgaaaaacaggatcgccacgagctacatttaatcgccacctaaacgaaccaactcctacagctaccacccggatagcacactcgccagagcgtcaaaatcctaatccatggaagctcacagcctcacgccccccaccagacagaacccaacatgaagcccgttcacttgtccgtgcgcccgtgcgtgcgtaccttcgggttcttcctctcgccaccgtcatcgtcgccgccgccgcccttccccttccccttcttcttcctcgccttcgcgccggacttgtgctgccggtgcgccttgtgcggctgctctcccccgccgtccgcgggggccatggagcgctagggttagcggcggagggcgtttgcgcgcggcgccgctgcggcgaagagagcggcggtggagaaagctagtggggaggaggaagcctggagggggaagaggccgagggttttggggagagggagagagaggcgccgcgtgtgatgggccgagcggggtaagcgctactatgggctgggccaagaaggcccaggcccattttcacgtcacgagattcggacatgccacgtgtagcgcgcaggggtcgcaccggccaccgcgccgggaaggggaangcgtgccgcgtgcgcggcgcgtggccgcctgcgacaaagccaccggcagttacgcctccgcgctcctccttcccaagagacgcagatctccaccccgnggttgcctcgcttcccccaaaaagtcttctcgtgagagctttcccccccttcctccacccaacaaatccccagcctcccagattcgtggcggaggctgcggcctgcggctgttctagggttagctctcgctccgccggcatttctcggtattttttctaactagtcttgtttagggcagcgcccctccgtaaatttttatagcggttgagttttctgggtagatgctttgttgatatagaatggacatggttccggttgtctgtagcgcgtggattcccagctagaatttctggccttatgttggcgtcaagttccaataaaatggaatgtttactttaatgtgcttatcgtagagatatcagatatgttttagttgcaaatgattttttttatttatgattttgggagctaaaactggtgcacaaactttttttttgtcagtaatagattggctatccgtctctagaacatgacatttacctgatgaaacagctaatctgttaaatgtggttgtaagttgatatcttttgttgtattagtaggtagataaagtattgtaagggcttgggtttgcaaccgg

SEQ ID NO: 2514 - DNA, 2000 bp, Oryza sativa
gattcaccggggtggtgtccggggaggacccctgggcttgctggcacagtatggtctgggacctaccctgttgttggtctgggacccctctcgtcggcatatggtaaacctgtatcggctttcgaaatgccttgtcatgaaagcttggaggtctcccgacgtggctgatcccctcgggctgggtgatccgggttagtaatgtcgtgtgggtaaagtgtaccccctctgcagaggttaacaaactgttcgaacagtcgtgcccacggtcatgggcggatgtgaggtgattcctagcgtagttttgtttgactactgattgtgaaattgctgtcgtgaaaatgggttcgacgtctgaaaaatcagcagctgacgggatcagctaggcccgggtggccgtttgaaaagttgttggcccgggtggccgtttaaaaagctgttggccgggtgccaatcttgtttcaattctaaagagctgatacattgcacatactccgaccggacgagacgcactgtctcatccgtgtcgtttgagaagcactcacctagttgttttagaaaagagttcaaataaaaccaattgcaaaaacaacagcctttccttgaagcctgcattaaacacttattttcccctggcttgctgagtactcccgtactcacccttgctctagataaataatccccccccagttgctgaagaagatgaagcggatcctgttgatgtggagttcttccaggagcaagccggctacgatgagttttagggtttcggcctagttcccaagtcgcgcctgtgatgattggtccaagtcctggcttccgtttccccttttgtattgcagttgtgatattctgtcttcctgtgataccagcactgtttcctgggactggtatcgattaacaggttaatttggagcgtcacgggctagttccagtcggggctagttcggggcgtgacaatatctttacaaatatacaactttaaatttgacatttacgaggagaaaaaacatatttgaatgcgaatagtgcattattcacaagaaaattgttgtttttatttttagttgtgtatgtcaaattcaaacttgcatatttattatggaagaacacgttttcaaaaagttatatgactatataggagatataattgtctacaaggatgaaaatactctcacctaatataacgaataattcacttgatgggcatgtcatcgcttattaacacacttgtgacattttgtgctctttaatttatggagaatatggtttgtgctcatggttgggatttttcttgaaacaaagccaaaatttattgtattatcggtggagagcatctaaaaaactgccgtaagtttttctagtaaaaaaatttcagatgtaactatagtataattgaagtgtaattacatgtagctgcactataaccagggtttgaaattttagtttgaaatttccgaaatctcgcccgaaatttcggtaatctcgccccccgccggcatgctcaaatctcatccgaaatttttggctttttgcaaatttttgtgaatttggtcaaattttattcaaattcattcaaaatcaatcaaaatttcaaataatttcgttccgaaatttccaaaatttcagtaacccttggcataaagtccaaatttgaaattgtcaaccttgattataactacgttgcaattacggtataacttacataaaacttgtattcaactgcgctttggttaggttaggtagtactgaaatcttatgcgtaacatgtataaaaatttctttccagcaatatttttccttcatgtataaatctcaagatgatccgatggtcataaatccgaaagttttaggggggaaaaaaacttgtggaagtttttttggcaaatccgctgtaaaagttacacgctcgtgatgagtgccgtggagtgctgtatatatagagatcgcgcagagctagctgcttttgccaacaaccaagaagctagctagtgatcgcgaag

SEQ ID NO: 2515 - DNA, 2000 bp, Oryza sativa
  misc_feature (1991)..(1991): n = any nucleotide
atacgtacctaggaaggtcgcagccatggggttgccacctccaatgctggtaccggaggtccgtcctcccgtacttctcgcacgccgactgctccgacatcaccctgcacgcgctctccctgtacagcgggtacgccgcctcgtcgtacacccacctcccggagaagaggtcgcactcgccgccgccggacgacgacgacgacgggagctttattgacgccggcggtggaagcggcggcgcgtgaggcgtctcggcggggtcgccgttcttggtggtggcggagacggcgagggcgacgaggaggagcagcaggagcagcacgagcgagctgaagtggctccggaggctgacgctgacgccccaagccctcgtcgccttcttcgcagctgcagcctcgcccgccgcccgccacgcgtactcctcgaggctccccccctcgccgccggtgacattgctccggttcttccgcggcggagtgctcccggtcgtcgtcatcgacgacgacgacgacgaagaagaaactaattcagtcgtgaattcgatcggtggcgcgcgcgaacggtttgtttgctcactggcacgcgagatcgcgatcaaatacaaatagctcgcgtgcagctgcatgcatgggagagtggggagtaggttcagctcagtggtcagtgcagtgtttcagcgtgctgtccatcgcttacagcacaagtatccctttgattaggtgagagagtacgttcttgctgcctatacaactggcctcgttttggtgcacctaaacttcgtcaacgaatcaaatcaacgtagaaatagttgctattgggcattggcacatggcatatttgcacatttgaagaaattatagtactaatatcgtactgatggagaagacctgagaagtgattctgacgaataaacaactagtggattggatggagccgggaaacgatcggaaagctaattactattggcacatcgcatatttgtacatttgaagaaattatagtactaatatcgtagtgatggagaatagctgagaagtgattctgacgactaaacaactagcggattggatggagtcgggatgaaaacggtcggaaacgattggaaaatcgtctcaacctttttttttttggaaatggaattaaaaatggtaaagttagaaacgaaaataaaatcggaaatataaaaaagggaaacagaataatatggacggaaacatgtcggtacaaatcgaaaactggtaacaaatacgaaaacattaaactataaaaaatatatttaactttgtgtaactatgtaatacatataaataacttcaagtttatactatataaattacaaattaactctattttaaccatgcactcaagttatggatttaattaaagagtcaatttgtctctaaattgcgggtaaaatagcgacatactctataatatcgacatatttagaaatacggtaattactatattataagaaacggtaatctccacaagaatacagtaaatacggaaatgatcggtacaacatcaaaaccattttaatttttatttatatttttttaccatttctatttttatttcggtcgattaccatttccatatggctcggtcggtacaaaatcagaaacgaatatcggtcgaccgaaaattttcgttactgttttggaattcacattaccgttttcacccttggatggagggtatttagctttctgtctgaagaaaatctgttgattactactactggtgttgtacttgatttgtaaagtgaaaattaatttcttgatgtcttgcaagtaaaggtttttgcgggaattggggcaagtaggagtagtatatatgtggagcagatgaccaattaccaacatcgtttggtgaaggttccatgattctaacaaaggtcaatagtacacatacttgccctacaaactagtgctaactacagagattgattagattaatagagctactaatgaaactttaagtttggntttcaggga

SEQ ID NO: 2516 - DNA, 2000 bp, Oryza sativa
ccaaagatggtttctccaccagtgtctgcaccaaatagacttgcgttgaggacctatttatgaaataaattttaaaaaataggttgaaatgtactccctccgtttcacaatataagtcattctagcatttcccacattcatattgatgttaatgaatgtagacacacacacatatatatatagattcattaacatcaatgtgaatgtgggaaatgctagaataacttatattgtgtaacggaggaagtaaatacttttcttacaacttggcctttaggctagcctctttggtgctaaggacctatttgtaagaaaaaaattaattgacaattttttataaaatttattttacaaataggttcttggtgctagtctatttggtaccaacatatctacatctcggttactagggagcgagttgaggtatctacatctcgatttctagggagcgagttgaggttatcggtgccagtgtcattgacaccaagacgttgaaccttggctccagcatcacgcatcgagaaaagagtatattcatggaacaagctcgtttaggagtctatacgtaaaataagctttcaaaaaagatcaaagtgtaaaaaagttcagtctcaccttgtcagtctttaattatagacatttaagtatagaccaaaatccttatatgctaccgaaagttcacaagtttttatatataccattataaattagctattcccatatatgtcatcaaatggaatttccgttcacccaagagtagaaatagtgttagcatttttgaaaaataacaaaattgcccatagactccctttcctgctatgtgaagcacaaatcaggatgagttgcacttgaaactataactaaaactttagcaatcattactgatgcgacacacaaccaatggctggatgcaacgtttatttcttctcttccatttttgtagttaatttatagataatagaaagaaattgttaataatctctttaaatggcactaataacagtaatttaattaattagttatagtctaatgtatctaactggatgtaagcatacaatttagaaaaaaaaatacaaaacaatctctcggcttagcaaactgatcgtgtgcttaatttagtcgcaaaaaataggtatacttaacttcaaatttgcgtgcttaatttcatcttgtcatggaagtaagtaatttcatgatacagacattagttgattaaaaaaaaatgcatccgctttatatattcgtagtaagaaaactaagataaaattgagaaatttctagactattcagctgccttttcctgagccagagaggtggagttgtagacgaacaccaacaattaaggaagataaaatggagagacaatgcataagaaagaacggaaaagaattctaagggtaattttgtactttccatgccaactaaaatgatcagataacgtcgatggcatatgatgaaagaaaaaaattaacgtggatggcatatggggaaagaaaaatattatttagtggcatatatgggaataccaaattttcgatggcatatgagaaacagatgaactttcaatggtatataaggaattttctcactattataagtcttctcgctagaggatcctattcgacaccgactcgacggctggcgcgtctgcgccacaatcttattgtttctttcatgaatttttggacgtattttagactttaaatctttcagcccaaattttaaactttcattgtaaaattcaaaactatcaactcaaatataaaaaaaataactcaaaattgaaaacttgaataaatcttgattcgaatgttttcaaatttgagttgagagtttgaaaccctaagttgaatgtttcaaatctttgacttagaagttttcaaatctgagttgaaagttttaaattatgctgctttggcatcaagtttaggggcattcccgtcatctctcttccaatgcaaccattgagcggtagcacgacgggcagacgtcacatgggg

SEQ ID NO: 2517 - DNA, 2000 bp, Oryza sativa
taaagcacccaatacatcatttcgctggtgagcttgtacatctcagacctgtgcttcagcatgcggagccctccaccattggcaccaccaccagcatcatcctcatcgtcatcgcagcgctccacctcgacggcggttaacacagcgaacagctcctcgccatcgcgatgatcctcatcggtgcggaagaacctggcaatgcagaacttgccggagcccaggttcacgaggtccgagctgacaagattgagggcgtctggcggtgtgaactccataggaaagctgcgaagcagcggcagctcgccgccatcaaggtccagagcggagagcaccaagctcctcttcctcctgtctctggtgctgtgtgagaggccaaaccaaaggccgtgctcatggcaatactcggcgagaccaacaaatggcagcgtccatcttgtggccactgtgctccacgcatggcgcaccgtgtcgaagcagtagatgccgccattgtcgtgcgtggataaccagatgtccgtgccaccgatcacagcgtaggagtcgacttcgaagtcggacagcggcggcggcgggagcgcgcagcagcgccaatcctcgttcaatccatcctcatagatgagcccatggaagcttccaccgtcgtcgacatcgaggatgtagaggtcgtcgccgacggtgacagaggtggcaggcaatgtcacctggtaggggagggcgggcatggtgcggacggcgtgctcgccggggtcgtagaggacggtgcggcagctctggtcggcggcgaccaccatgttgtggttgcctccaaggaggaagaactccatgttctggttcccggacaagctggaggagggagggtagaaggtcatggccgggcatggcaggctgccgtactccaccgcgtcggcggcggcggcggcggatggcaccggagatggacgtgggaggaagaagcggtccatgtctatgttccgcagcgtgtagttgctgcggcgtggggcgaactcctccagcaccagatgaacaaaccgacgaacactcatcgtcgatcgatcggatgaatcgatgatcgtccccaaaatgaagtaatcttactaaagattgattggattgattggattggattgctctggatcttcttctcccccaccacgaataactagggttttcacgaagccaaacgatctttctcgttgcaaagcgacttatccgattcggttacgcggagtggagatcatgcgggcgccctgatcatacgatctatctctatataaaccgagctgccgccttcacgcaacacacgcgaaatcaatctagggtttgcctcctactctgtgctgcacctgatcaagcgatctatctctatataaaccgagccgccgccttcacgcaacacacgcaaaatcaatctagggtttgcctcctactctgtgctgcgccatcgctcgtagactactccatcccactcgccggtgtgcaccggcgatcgggagagtagatctccggaacaatctacggtttgcctcctactctgtgctgcgccatcgctcatagactactccatcccgctcgccggtgtgcaccggcgatcgggagagcagatctccggaacctctgccttcgacgtcatgcaccgggagaaggcggaaataaggtttttgggaagcgcttcgcgcgactgctccctgttcgtccgcgatggctcgccttcctcttcgctcgcgtgctgcgcaccttcgtcgacgcctgcaaccgcgagtagtccctgccgagcaaccggtctttccgccacctcggtacgtgttcgacatgttgcgcatatttgatctgttcatattttactgtttagtttacatatgtagacctaatgatgcgttcatgctagtttatatctgcaatgtcatgatttatttatggaataaattaaatcattatgtgcttataatttcaacataagcgaatcggatagtcaccggcggcggacagatgatgggaaggga

SEQ ID NO: 2518 - DNA, 2000 bp, Oryza sativa
  misc_feature (1227)..(1227): n = any nucleotide
  misc_feature (1485)..(1485): n = any nucleotide
ccagaacagatatggacatgtggctggatccatttgaaagtagacttgataagctttccatgaagtacttgcacgcccaaatcggagttcgtatgaagtcgtggcggccgtcagaagttggcgctgccctgcagtccgaatccaccccgcgcgaatcctcttccctttggatcctctccatcgttcctgagtaaaacacgagtgcacgcgtctccggggtataaagacgaggaatatgaactcaagaaagaactcacctgataatttagttgacgtgcacgagcgcgggtaataggaccatcatgctgtacatggggggacgtggatgtatcgatggtgttgatgtcctcatcatcactattcaagggaatgctaagctggcagtgcaatgcgacaagcaaagcctcgacatggtcgagcacacgcccagcccacctgctacagcagagccacccaagaaagtgagcaagacaaacaagacgccgataccagacggcgcaatcaagatcgttccactctccagtgccaaccctgacaagaccgttaagatcggggcatcactaggagagaaataggaactcgtgcacatcaccttcctccgtgacaatgctgacgtgttcgcttggcagctgtccgacatgccgggggtacctagggaggtgattgagcacaaactcatggtgcgacccgatgccaagccagtaaagcaaaaactgcggatatttgcaccatatcgaaaacaagccatacgagaagagctcgacaagcttctcaaagctggtttcatcagagaggtacttcatccagagtggctagccaacccagtcatggtgtggaaggccaacgggaaatggagaatgtgtgtcgacttcactgacctcaacaaggcgtgtcccaaggatcacttccctcttcctcgaatagaccaactggtggactcaacagccggttgtgagttgttgagcttcctcgacgcttactccggctaccaccaaatcagcatggcgaaagaggacgaggagaagacagcattcatcacgccgttcggggtattatgctatgttaagataccattcggactaataaccgcaggaaacactttccagcgcacggtgtagggcgcacttagcaaccaactcggaaacaatgtcgaggcctacgtcgacgacattgttgtcaagaccaagacaagcgactcattgattgacgatctgcgggaaacgttcnataaccctccgacgatatcgcctcatgctaaatccagagaagtgcacgttcggagtaccatcgggcaagctactcgacttccttgtctctggcagaggaatagaagcaactcccgagaagatcaaggcaatcgagaacatgaatgtcgcctacaagactcaaggaagtacagaagctaaccggatgcatggcggcactaagcaggttcgtcgctaggatgggagagcgaggacaacctttcttcgctctgctgaaaangcaagacaaatttatatggacacaggaagctgaagaggcattcattgcactcaagcgctacctatcaaatccacctgtacttgttgcccaccaacctaatgaagaattatttctctatattgtcgccacgccatattccgttagcactgtcattgttgtcgagagagagaaggtgcaacgaccagtctactatgtcaacgaagctctccacgacacaaagacaagatatccacagatccaaaaactgctctatgcggtaatcatgacatcaagaaagctacgccactacttccaagcccacagggtcacagttgtatcctcctttcctctcggtgaagtagtgagaaacaaagacgttgtcagccgcattgcgaaatgggtagtcgagctaagccagtttgatgtccgctttgtgccatgaatagccatcaagtcccaggtacttgccgacttcgtagccgattggactatgcctgataacaggttagacaaccaaatcaaaaacgaaacatgga

SEQ ID NO: 2519 - DNA, 2000 bp, Oryza sativa
attacgccgtgtcgccaaccccgcgattgccacggctatctgctctcgcctacctgcaagagcacgtacgctcgagttcgtcctgtcatgttcatgtctgcctttattttgccagtggaacctactagtaacataaatatcagcatatcgccgtcaaattatccaaccatcacatatacagtacgtagacagcgtcgtgccggattaacgagcggctcgatcctgatcaagtccccggttaaagttaaacaggatgtagtcacgtgcagcgtacaacgcaaagcccagagaacaaaaaggaacagaacagtcaggatcaatcagcctcgccaccgttttgtcttttacttttccttttcttgttttttgcatggcatgtggatggatgaagaatgacgcagcagtagcattagtaggagtactttacaattaccggctttatacaggacaagttaacagaagtagtccatgagctgcacccgcggcaccgtggccggcgggcctcgcggcgcggcggcggcgcgctccatccgtcggcggcgctgctcccacgcgctccctgagccagcaaagcaccggttcaccgcctcgagccaccggaggaacaccgcctcgacgacgtggagccggcaggacctccacggcgccgtgcagccgtctccctcggcgccgccacgctgcggcggcgcgacggggaaccttgccgggctcggctcggagtagcaccgccgcaggacgatggcgcggttgagctgcgcctcgaacgccatcctctcgtactcgtccagcagcgcgctgtgccgcccgccgcagccgtcgctcacgtcgaggctgtaccgcgccaccacgccgccaccgccgccgctgacttcgtcttcctcccttgctctctccatgtgtacagtagccgttgccaactgcgagtacacgcgcgtgtaccataccaccacattgcgagtggtatttaggcagcgtggtggtccatgccgcggcggctacaccatttttttggagcgaaagcttgtgcgagcttgacgtcgcaaggacggcaaggatcggtactactactaccggatgagcttgtttcgtacggattcttgtcaacgaagcacgcatacatgcatgatgcatcgcatgcatggttgtagccgtagattccgatgaaaatgagacggcgatcttatctcgtctagctaggcaattttggttagccagtagcatagtggatagagagatttgttgccaaattgatggatgattcttcgctgagctcgaatgttcgatgttgtaaatattcagtgagggacatatacgcaaggaaccaacaaaaaacttgcaccataactgtcatgtacgagattccacctctgtcgcttttattcccttggagagaaaattccatgctctttactctttagcaaaggcataatgtaaagttgcacactgcaggtgcattctgcaagcaacctgctgaattttgagctgagcacaactttttattcctgaagtagtagtaccactaccactaccacttgctatacttgctactgcatttgccgtttactatttttttaaaaaaaagaaaaatcagcgaggtaaccttatacgacgatttcagaataacatacaaatgatagttgtgcagaaggtatctcagttgccaagcccaaacgctccagaaggatagatgctccacattgcaggctatttttaataggtcccacaagtatctcccctctctgccttttcccaccgatggaggaagctgaggtgccggggcaccggacggaacggcggcaagacggcccaattgatgaatggatcctcgagcaggaagtgccaagcagagcgcggcgacacattgccacatctccttgttaagggcggaagtcgcgggataagacacaaatgatagcgccaccaagctcgctagatccagcccggggcttgtcggatctaaccttgggcaatggaggtagctcgtcgggcgcgacgcaagg

SEQ ID NO: 2520 - DNA, 2000 bp, Oryza sativa
gcgcagacgatctcaagaagggcaatgccgaagctgtacacgtcggagttacggttgaagctgacctcaccatccttcatgcactgtggatcaatgtatccttgtgagcctatggcagttgtcttcagcgttgcattgttcgggttcgcgacccttgacagaccaaaatcagcgagcttggcgttgaaatcgtcgtccaagagtacgttgcctggtttgatatctctggtgtatgatatatgggtagcactcgtgatgtaggtacaacaggcctgacccaatgtccttggctattttatacctgttagaacattaattgtagttaattagctacatggattgatcattaacatgcttaattaattatacatgtactaattgaacacataacagaagttcacacataaacaaagaaaatcgatcacattatgtctaatgattatatatatataatcctaatttataagtcgctctgcgctctcctcagcgtcagtggttctggagtccatccactcggagggccatctatggtctctagctagcgttgccgcttttggggacttgttaggagtttgtgtctaagcttcagctttttttattttttttcctttcccctagcataagctggtttggctgattgcgtcgtgtaactataactcttttcttctaatatattgacgtgcaattcttttacgcgttcgaaaaaaattataagtcgctaaatcttgaaaaactataattgagaacggtccaaattatccaaaccgattacaactcagtattttttttcacctagaattttgaaactattaaaacaatattcccccgtaccaacttcgactacacgttcattaattatgattttcaaaattaataaatcgtgaggcataataaactaagtctcccatgcaaatacaactaaataccacttagtttcaaatgtcgtatgtgtgtgtgtgtgtctatatatatatatatataataaaaattgaagatgtttccgcggtttgtcgtccgtgtttgagtcggttttaattgtatgttttagttttaatctatatattttctctgctattataaaaattaaacatgtttttgcaggtattttggtacgtcattcatgtatgagtcggtttttaagtttgtttgcttttgaaaatacatatccgtatttgagtcggtttttaagatcgttaacttttggtaatacagatgaaatcatataagaaatctgtttaaaaaaactcgtatgctaacttgagacgatcggacttctaactgcagctcatgattttctaatatatatatatatattcaagcgaactctcatagtgaatttcatcataactaaaccatataacaataataatattaaaatagacttcacccgttacgaagcatggatattttttctagtttagaataaaatgtaacaacattagattgaaaaatggaagtagcagaattttacagttatttacaaaatgtaataattttatcctaagtacagcgaaatggaatcatataactttgagagaaaaaatgactagtctattgtaagagaaatcgatatcgaggcctagaaattggagaaaaagataatgatttgtgttgttatattatgatgggtctagacaatatcaatcactattggagaagtggtctttgctagattgccaaaaaaaatcatattagccccagttaaaaagcacactagaacaccagtcgggactaaagatcctttttagtcccatttaaaaatcatgtcagacccccattatttttagtcctggttggtgttaccaaccgggactaaagatggatctttagtcccaattagtaacaccaactgtgaccaaaatatataaaaaatcgtgcagcagccccgagccggccagccttgtccttatctccttcggagacctctcattttctaaccatctcctcctcccccttcctccccttcccctgtcctctccctcccctccccactcctccga

SEQ ID NO: 2521 - DNA, 2000 bp, Oryza sativa
  misc_feature (1046)..(1046): n = any nucleotide
gaggtcccgcatcttgtggatgagccacgctgagcgcttcttcatgtggctcggcggcttctgttgctctgagctcctcaaggtttgacacgagtgatcacccacccaattcagtaacaagcaaagaatctgaagctaccattgactgctattgttgaatgatgatgatgatgttgtttgtgcaggtacttgagagccatcttgagccgctgacgaatcagcagttgatgggcatctgcaacctgcagcagtcgtcgcagcaggccgaggacgcgctgtcacaggggatggaggctctgcagcagacgctaggagacacactggcatcggcggccgccaccgtggtcgtcggcggtgtaggcgccgacaacgtcaccaactacatgggacagatggccatcgccatggccatgctcaccacgctggagaacttcctcaagcttcggtcaaacatcaatggcgaactaaattgcttattaccatggcgtgatgcgatgatatttttgtgtaggctgatctgctgaggcagcagatgcatcggatcctaaccacgaggcaggcggcgcgggcgctgctcgtcatcaacgactacttctcgtggctccgagcgctaagctcgctgtggctggcgcggccgagggacgcgcgtcacggcatggcagagcgcgcatcgcaccgaccgcgcccccggcggcacggccaggtacgcgccgcagccactgcatcccgctgtcggcgaccacctccccacccaccggccggcctgcccaagaggagaaaagtgagagagagagagaaagagagagaggaggaagggagaggaggggaaagagatagggtgatgacgtggaatcctggcatgtggggcccacatgggttccacgctgattcagccgtcacgtcagacaaaaccgcggtcaaaaccaccgagggacctaaagtgaacggttttgtaagttgagagatatcatatatctggttttgcggttgtgggacgattttgtaactcgatgacaagttgagggaccttgggtgtactttttccnttgaaagttgggacaaattgagggacctatagtgaacttaaccccccccccctaccttttcttttcatgtgcttgacgggccgcgaatgtcgcgtttgacatgtgggcctgtgggggcaaaccttagggtgtgtttggataatggaaaatgtggagtggaattgggattgagaaatgaatgaagggttagaattaaatggaaaagggagaatgaatgattaagatttaaagatgtcttttagtggatgggaaatgatttcccattagccaaacaggaccaaaataaataaaaatcacccccgtggcatgtgcccccgcaacacagaattccccaattccccttctcccatcccaggaggagccgccggaaccctcaccgtccccccaagatccaaccaatctaccggtagacccggtgttgtgccgtgatggatccattaggcggtcgccgccgccgtactgctgcatctgagagtggaggaggatggatgaagggttgtaccagtgtgagggcgagagatgtaagtcacctccgatcccttcaaaacccaccattttttttcttgtcttggcttattttgtggcaacacatcaggccagccagacacataatttaccaccagatctgaatcgctcccgcggttgtaatgtataggatgtatgtatgtatgcatgttcatctgtttgtttggttttccctttcactagattcattctttcttagcacaaagcacccccccaaaaaaactctcttttcgttgtccttgtggatttctcagaattcggcgcagctgactccgattcgtttttggtgttagagagacaccgattcggactatgttatgttaccttttgtgaataaatatagtactagtgtatatgtgcaccgcaatctcagagttaagcatcatacatagtctttgtttgtgtgtttgctgcatgtacgacgacacc

SEQ ID NO: 2522 - DNA, 2000 bp, Oryza sativa
  misc_feature (222)..(222): n = any nucleotide
  misc_feature (639)..(639): n = any nucleotide
  misc_feature (875)..(875): n = any nucleotide
  misc_feature (1631)..(1631): n = any nucleotide
  misc_feature (1634)..(1634): n = any nucleotide
  misc_feature (1638)..(1638): n = any nucleotide
  misc_feature (1640)..(1640): n = any nucleotide
  misc_feature (1643)..(1643): n = any nucleotide
  misc_feature (1645)..(1646): n = any nucleotide
  misc_feature (1648)..(1651): n = any nucleotide
  misc_feature (1655)..(1655): n = any nucleotide
aatcatcttgccaggcattatgcaaagaacatacaaagttctgcagaattagaaaactaaaacaaaatgacaatggctaatctttaaaacaagcaccggcattgatgactaacgaagaccattcaccatgattaacttgctcacctagccgtacaaccaagatattttcaagagaggcttataatctttttaaaaatgtgctaagcaagaacttgcaagtangagataaatactgaaggcgctctctctctatcttcacattagttagactcaagattgaagctcccgtcgtttcgcattcggattataagccaaaatcaaaatttaaatctttaaacgtaatttataatttcttttaaagacttttcatcgtagttttttctaacttggtttttaaccattaattaacacatctacaaaatttttacacaaattattttttccattgcgaatatgcgtattctgcatattgaccatttaggccaaacgatcagggcctgaatattgaaataatcaatcacttgcacaaacatagcctaaaatattcttaacacatctaccaaaacttatattcttcagacatatcaataggccaaatgaattctcaccaatttcttgtggtggtaacagttggttctnacacttaatctggcatccagttgttcggcaggagctacgacacgacatatctactcatgacttagtcaaggttatcctcagagctagggatgctacaaaagagctggtcatcaacaccgtaacgcctaagatgtatgagtgatctggcaacaaagatgaatttgcatttcgtaatacaaacatgaaccagtcttgtaataaacatatcttttttttttgtttacttctacattccnggtgtgtggcgttatggcattttaatcttgaatgaggcatttgcttaccattatgacattttggtccttggaacagtgctgtgtggcatgtttatatgatgcaatttatgagtaaccctttcatctaattagcattagtgaaatttaatataaccatagcgttagtatgggtattttactaatgaagaataaaacatcttaggtctttttaatagtctgtttggtcaagatgaagattgttgtcggtttgtctagtgtaaaataaacctaaaattgcgtattattcacggagcaatgtatgtattattaattggctggcattctctggataatactgtggcaagtttttacttacaataggagtatgtgactatgtgagttcattaatctcagctgaaattgaaataagtaggaaatgaaaaatggtgacagtgatgtctgcctattgaaattaaccatagattgaagggacatttcctgttcttaatcttccaaatcagtaggaatgtggggcaacaacccatcttaggctccattcggtagtatcccaactcctctttctcgttttccgcgcgcacgcttttcaaactgctaaacggtgcgttttttaaaaaaagtttctatacaaaagttgcttaaaaatcatattaatttattttttaaaaaaaaatagctaaaacttaattaatcacgcactaaaacgctgcttcattttgtgtgccggggagtgagggttgggtagagccttagagctgntanagcnangtnanntnnnngacnagaacagaacagaagaattttttttactttgaataaggaaagcactgcagtataaacaaagataatcttctacaataaactgacattaatgcagaacaagcagatactatagcagagtaatgtctggagatcactgtagaacaatggaaatgcagaacaataggaaaacttggcaagcaagaagaaaaggattagcagccgcgtggcttcagacgagaagcctataaaaccgcagcaatctcctcctcaacgaatcttcccacttgccctcttcttcttcccaccattcccaatcccatccaaaagtttccagaaactcatcctcctcctcctcctccccctccc

SEQ ID NO: 2523 - DNA, 2000 bp, Oryza sativa
  misc_feature (685)..(685): n = any nucleotide
ctggtccaaggccaaggccctcctcctccaccatcgcccggcagctggtgacacggcggcgcacggcaggcaagcccagtgagtagcaagcacgcatcgtgatgtgacattctagcttagcttccgtcgtcttcttcttcggctgtgtttagatttaaagtttggatccaaacttcagtcttttttatcacatcaacttatcatacacacataatttttcatttttcagtcacatcatctccaatttcaaccaaaattcaaactttgcgctaaactaaacacagccttcgtcaggtcatcgccgatcagttaatactcctactaggctactactcccagctgaattagctgcacaattaaatatcggagaagacgacgagggtgacttgttgggcctaagtgggccgtgtgccgaacaaatggcccaagtctaggacaatattttttgggccgtgatacgacattttgccacgagggcccaatatggatattttttgcattttgctccctgatttgaactgtatttctgcattttttgacggcatctcatccaggagcccaggtcggcgccgccgcacacgcgtggcggcctcgccggcgactcggctgctcagagcggcgcgaagaaaggccgcgctggagtctgcagccgctgcgtgtggcagagtagagaccagccaggganagcgcagctgtcagcaacctataccagccagtgagcttgctcgcgccgttcgccggggcgggggaagagaaccatctggcgacaaagcacaggtgaaatccagtctctgccaagcaatctctaattccccccatggttccctaattgtgtgtgtatttcccatcattagtgctgttctaattcatcatttgtgctgtttgttctcaagcgtattgctgagcgaatagaatgcccaaagtgcttctaatttgtatgcataggaattcttgacctgtcaagttacacactgcatgagttgatatgggaacgtgcggatagaaaaattcgtattttttggcgaaatttcatgaaacttgattgcatgttttgttctctgcgtttcattttggaatttggggttcaactgcagttgaaacgagtcatctcaaattcgttctgaacaattcccttcacgctgttcaaacgaaagcaaagagcctctcttataaacatgtttgcaatccggtggggatgatggcaatttcaaagcttccgaaacctgcaaggcaaaagtaaaaaatttcacattggaaagctggcttgatttgaaagccctataattttttttagtataaaatctctgtttcgaagtcaaacaattctgatcctgagtaggaatcactgatttgctaagctgaaatctgaatttgtttttgcactgaaattttatttggaaattgctcaaaaagaaagtccagtacatgtttagaaaattcctgatttcaggaaacttttaagccgaaaacctgagttggaagttgttcttgggaatttaccaattagtgtttttttgtaattataaatacaaatagtaaggacaacaaaatcctcccgctactttgtgacctaactgttggtttgcatattagaaacacccctcgtgctaaatccagtagtttatgttgtctgttagtttttgaggcaaacttctatatttgtgcaggtggctgtgatgggaacataagagaggctcttatgaacttctaattcatactagtagtatatttatgcttattatacatgctgacttgcaaccttttgctttatcatgctactatctggaatcaatattgttctaagtaacaacattttgcctaatcttaaaacaggaagcatgtcactggttaaccggccgctccctgcactgtatggaatttgcacggcctcggcgaagaccagagcttggtggctctgcagagatggcaatctcccatcaacaagtcgaatttcttgcacagagccatcgaatgggggttctgtcatggagttggaggta

SEQ ID NO: 2524 - DNA, 2000 bp, Oryza sativa
gtcaaagcttcgctcttcccctagacctccatagcacgctgcacactagctttttgtgctctgtgcgatcctagccgctctgctgccactcacgcctatagagtagcatctttccgccccgccatcctgcaccaacctcctagctccctagtcgttgtgctgcccggcgatagcatcgactagaagagccaatatctagccattatgctacccaactggctagaaaataaaccaataggtgaatcccacataattttatttcttttctaaattttatccactagttcactagtacataatgcaaataacctaatgtggcattttgatcaactctttacctaggtcattacccctcttaatagtacgacaaagctagaaataaaccccacataattttatttaccatctttgttccattgctttgtgcgatcaattttaatccttggtagtcctaactcaaagtataccactcaaatagaatagttagtccacaattagcgcttatcattaattaccaaaattaacaacgagggccacgcacaaggaaaaatgatgtttttggcagacctttaggtgcagacgggtcttcggtccgcacgtgaaaatctgctttggctcgtctggaaaaaatgtttttgtactagtgatcactgggacatctttgaaccaccatcctgttcccatggaagtttcacttcacccaccgtgcctccaccaccttcttattgtcaataatcaccgccacctccccgtccctcgacccccactcctccccaagcacaccactgccacctcatgctctgtcccgttgtcccgaaacctgcatcgtgtgctgtgcactagcaaggctgccgccgccactccccccatcggtgccggccatcgacagccgccttggagagaaatgggaaagcggggagaggtggagagtgatgggagtagaggagagagtagggttggaggaagaagaatgggaatctaatgacatgtgggttcggtcaatggtgactcaatgatatgggttcagtcaactgccacataagcgaaaacaggagactatactatcatgggacctaatgtacaccgttttgttaagatgaatagtgaagatttatggtattatagtttagggacatttatcaaacttgacataaaattgagagatggtaagtggacttattccctttctttgtatgggctggaattactggaacacaaggaataagttcactttccatccctcaactttacgtcaagtttgtttgatatcccttatctccaatactagaaatcttcatccctaaattgtacaaaaccgtgcaatttgggtcccataccagtatggatgtctggtttcgctgacgtggcatcctagttagcaaagaaaaaataaaaataatatgtgaggtccatgtgcaagtgaaataagaagaaaaaatgtggggtttcgtccgcgcttcatggcctaggagagaagggggaggtagccggcgggagaagggggagaggaggctggccgcggtcacgtttgcatgagaaggggaagaggtggccgacctcctctcactctttttcttttcctggcgaggctggagggtggggcagtcggcgaggggagggtgcgggtaccgaaggcggcggtaagagagcggaggaggcgtgcaatggcgctggtggttggagggttttgcagcgcgtcgctggtctaggggcgtctacaagaagtactaggaccaactggaaggctaacaggagtcgggaggtgggggactcacgacggccatggtagcagcggtgagagagtttggtcaattggaaacgcatgagggtggcgaagcgtctcgcacgggcgggtcagctcgggactgaacagcagagcacaagacgcataggaaagcggtggcgagcgaggagggggagaggacggtggtcggtttctcatcgagcggggcggcagctggggtttcgtccgcgcatcacggcagcaggccagcagcacg

SEQ ID NO: 2525 - DNA, 2000 bp, Oryza sativa
  misc_feature (171)..(171): n = any nucleotide
  misc_feature (173)..(173): n = any nucleotide
ttttatatatacactatacgcatatatataaactttatatacgtatgtatataaactttgtatactgtatatacaaactttatatatgtgatgttttttttttaaaaaaacaaagaaccgaagaaaacaaccataaaaaccggcgaaaaaaaaagaacgcgggcctcccantntgcgcggccgccgggccccttccccctcctacgcgcgccacgcgtccatccgcgcggggtgagggggcacgcgaccagtcgccaattaggaatttcggatgaggacctcgtgtttttcgactgaaaattttacatttaagcccctttttattttttttcataaataggcccctaaagttactatccgtaagaaatacttcctccgtaaaaaaaaacccaacctaagaggagatgtagtgtccagattcgttgtactgggaggggtcaaatcccctcttaggttggtttctttgggatggagagaatcacaaaataactcaatctagattcgttgtcttagaatatgtaacatcctatcctatattgagttattttgggacggagggagtagacgacgagcccaaatcacgtcaaatgtggtataagatcttcacagtctacctctcagccaactcatgtagtagttagctcttaactataaactatatggttcccatgtttctctcacatattttcttggttcctatgcctaagctagttttaagcataccactcgctttccctctctctctcctctctcatccacgttagcattcaaccttctaacggccttttattatacttgctcttacagtgaaaggtactactaaggctgtgttccctcacctctcgcacagaaaacagagcgatggattagtgcgtgattaattaagtattagctaaaaaaattaaaaataggttagtatgattttttaaagaagctttcctatagaaaatattttttaaaaaataccgattagcaatttggaaagtgtgcgcgcggaaaacgaggaggagaggatgggaataggcagtgccaaacacagcctaagaggaatctagtatgtcatatcggatgaggcttctttaaagattccagcaccacaagctaggccatcctcacaacgctgcttcccgccagattccaactctcttcctagctgctttttcatataggttccatcttcccacctgctttttttagctttttttcagaggaagcactcgtgtccatgcaaagcaccgagtatctatgccaaggtccgagggcccacaccttctcttctccacggcatcatacggcttagatggagcggcgaatccactcgacatcaaggcgcactgtgaacagcctcatgggaagagagatcgacattagtcttattggcgccgagccatttaacctaggggccagcctctaaaaagggctccagaaaaggattcatttctgaaaatagttttttaagatctatttatgaaaatagtctaaaagaaaagctaaattgtaaaaatttcagtgttcctcgagctcctctgctttatggtctttcatgggccagccccaaacacactaatcaaatggaccgttctcctttgtgggtttccatgggccctacccaaacgaaacctccagatgggccgtactctcggctgcccatgggccgggccccaacggaacgcacggataggttgggcttgggctggattggacatgacgccatttgaaggcccatccagacagcgagagcggcgccgcggccgctacttctacccgccgccgcctctccactccactccactcctcatccactccctctcgccgccgcctgcgacctcgccgccgcgcccgcctcacctcacctcgccggagttcccccacggtacgctccctttcccttctctcgcgccgccgtccggatccgccgtgtcgtaatcaccgcgttctataagaggaggatttctcacgatttggtggttttacgtagatcggggggcatccggggtggg

SEQ ID NO: 2526 - DNA, 2000 bp, Oryza sativa
  misc_feature (624)..(624): n = any nucleotide
  misc_feature (1033)..(1033): n = any nucleotide
  misc_feature (1066)..(1066): n = any nucleotide
agggaggttgttccgaaaactcaaggtatgtatatatcccaaaaatattcggcatgctgggtcaccagtactcggtatttgccaaaatttaataattgctatgagaacacctagaaatggaacccacaaacaacattctactgataagcttgtattcattaaacaggtagcatgagacctggaactgcgcaggcgacaggaggatccttagccaagccttccaaaagacggtagaaatagaatctgacgaagcatccatgcaagtttggcaactgtgatgtaactcaacttttgcgctgaaacacacggggggtagtttaggaggtgctactggtgttttctgtgtatctgtataagtttcgctggtcgactcaacaacgtatcttggttaaagattcatgatgagcagcgaacatttgtaccatttttgtcacggctttcatgcggtaattccgtttttctttgcgcgctgtgggttaggggaaaaaagtaatcctgtgagaagaaaagaagttaccctgtgtgtcagtgagtggcctggacatctgtgagacaaattttagtccctgagagcaaaaggaaggggaataaaggcaaaacctgtgagaagaagaaaaataagcnaaaaagagatcatcatgcaaaagggaaatcatggggaaaaatatcaaaaatgagaagaatagccaaaaaaaaaacacctgcaaaaaggaaatataaaaaatgagaagattagcaaaacacatcctgcaaaaaggaaatattgtggaaaaaaattattagcaaaacacatcttgcaaaaaggaaatcctgtaaaatggagaagattggcaaaacacatcctgcaaaaaggaaatataaaaaatgagaagattggcagaacacaccctgcaaaaacacacctgcaaaaaggaaatatcaaaaatgagaagattagcaaaacacatcctgcaaaaaggaaatccctctgtgaaaaaaaagtgagaagattagcaaaacacatcctgcaaaaaggaaaccctgtgaaaaaaancgagaagattagcaaaacacatcctggcaaaanggaaatcctctgtgaaaaaaaagtgagaagattagcaaaacacatcctgcaaaaaggaaaccctgtgaaaaaaacgagaagattagcaaaacacatcctgcaaaaaggaaatcctgtgaaaaataaaatgagaagattagcaaaacacatcctgcaaaaaggaaatcctctgtgcaaaaaggaaatcctgtgaaaaataaaatgagaagattagcaaaacacatccgcagcaaaaaggaaatcctctgtgaaaaaaaatgagaagattaaatttgcggtgagcgtggatcgaacacgcgaccttcagatcttcagtctggcgctctcccaactgagctatccccactaacatggtagattgcgcatttatttgtactgtattatctgagaaaaaacatgcctatggacatcgcacgcaatgctcataactcctttacaacggtactcctgagttctgacaagtatatgagtgaactgatgaaagtgaaagcccaaagttggtaaaatggagtacttctacccgtgactgatgaactgatcctctcattcaacgaaacctgtgcaaccgcaagaataaaggactgacctgacaaaaggacgctaaacctgcctgatttaaagcagttgaaacaaagcaaagcgctttgctgttccagaatatccttaaaaagaacgcagaatgatatttcgaaggtacacagtgtatctacttgcacctctgacacaatgatggctgatgcagcatcatgccttccaccctctccctctttctagctggcatctggctcctcttatcatttccccttttccacaaagaaaaagaagcttaaaatccatggccctacaagaacacaagaactcaagcaccatttctccatgccaacgcgaatcacataagagttcaagccaaagctaagaggccatgagatcagct

SEQ ID NO: 2527 - DNA, 2000 bp, Oryza sativa
tccagtcaactttgatatatggatgcttttcttctgacttcagcaaacgcttccaccaacctttcttttctttctggatcgaacagattatgtttcgcaaacccatctttgtcttagttttacttccctatatacaaagcaaaatgatagttagcccactaaaagttcaaaataagattgataatatatgtcatcaagattggctgggaagttattatcatcagctagcagctctaagaaaaaagaaatccagtgatcgacttcacttatttgtttgctcagtttcttattttggtgatactacagtttacaacatgcattagtaaatgttttcaaatcttttatagaagtcatattcaacgaattgtgtggattcctactttcatacaaatgaaatgtgctccattaaagaataaagaccaagcaacagccaacacattaaatatatattacttatatgatcatctcattaacattttaagttcatccatgcaagatcaacccaaaagtggaaagtgaataaagttagtacatgcccaaatttcaatccagaattgaaatccacaaatactcctacttacctctggcagtacagaatcaaacagctccaaagtgaagctaaatggttccccattagcaacagctaagaagctaaagaggccctgaggttcagtcttcagcactacatctttagcatctggcagtgaaatagtcaagtaaatcttctcagagcgttgagcccacagcacctcaggttgacgactgcatgccattgaaagtgcagccatataagacaaaaataaatgcaaagtttgtcagttacaaggatatagtagagaaatgaaaacagggcaagaaaaggtgtgtcgacaaataacagttctatccctctatacatgaatacattactcttaatggtaaataggatactgtctcacagggaactgcatgataacagattgcagagaacggagagaggagggggggcgggggcgggggtgatggaatggctatagtactatagtcagttatggccccatcagttgccctaataggctgaagccaaagccaaagccaaaatttgaattctcaaacttaattttgaaattgattttaagatattttaaatgtagtttctttttcagcattggcttttaagtcactaagaacacatatataatacttaactcacaaatttttttgataggtacttaacttaagaagtactagaaatcaaacacatacatcaattgattacaataaacacacgtgtcacgatgcacagattatagctaagtccaaacctttatctcaagctattggcctataaaaaaggacaagaaacagcaacggtactagttaattgccaaacgcatattctattagcatgttatgtgcatcttgtttgacagatgtcagcatgtctcactaactttagcatccattccaatgtaacagtagacattattttctagattacaggacatcaaaaatggccgtcctgctttgatattccagcaatgaaacatcataaacattataagaaaccactaacaattgagtatatagttatatactgggtaactacatatcctcatttgcagtaatcccacaagcctttgtatttctaagataacaagaaccgacttcaacattcttgttagatacactaccccaaataagaacaactgaggcagtacataatccgcctgatcctaccatccaatcgaactacatatgtaccattcaatccatagtacaattaacgccctatcaatctcggtgccaagaaacaagatcaacccaccaattcagaaatacacattcggattcagatcctaggaagccgcgacacatcgcgagtctcagcaatccaagaaacacacttcccattgggcaaaagtacaagaaccaagaaaaacccaagaaagggccaaaaccccaacacatggccagaggggaggaggggtaggggagggacggatgaatacctcatggcg

SEQ ID NO: 2528 - DNA, 2000 bp, Oryza sativa
  misc_feature (296)..(296): n = any nucleotide
  misc_feature (400)..(400): n = any nucleotide
  misc_feature (803)..(803): n = any nucleotide
atcgacggggatggctgggcgcgcgccaattgtggcagacttggtccgccggtggaggagccaaatgtgggcgatcctgagcagcatggcgtagccctcgccaacgacgtcgacgtggtccttccacgccctctcgcctcgccccgccccgcccgccgcgtcgaggtggagcagagcaggttgcggttccgcgggtggtgcaccgcctctccccgcccgtgccgggtatccagtacgccaaggacgacggtggggtgtcggggtggccgtggcgcccttggacgaccagcggggcncgagtagcgccgccgaagccgccgcgccagatgccgcaaatcaggagcagccgcggcgtcgctggagatcggcatgggtgaggtggtgcccgggaacgacgtgnaagcggaccgcgcgccgagacggagtcgtcgtggccttcaccgacgaagatggcctggtcgtccagcgcgaacagtgtcatgttcgccaacctctcgagctcggcgaacatgacgcgcgtggccagcgccacgaagccgtagtggtcgatggcctcgcggatcatgatgcgcaccacggagcggcgttgatgtggtgttggtggtggcggtgacgatgatgcaagccgtgggagagcgcgcggtggcaggggcggtggagagctcggagcaggggaagccgggaagtagtccagggcgatgtgctcctgtaggacgcagcatcgccagcgcgaggagagcaccctcccgtcgtcgtgttcgtggtcgcggcaggttcatggagtggcggctgcgacggcgccntggagtccagatctgacggcttggcgaagggaggaggaggctgtgcggccgctgcttgctacggggagtcgatcagcgtcggggttgcctcctgctcctccgccgccgctcctacagcagcgatggcaggcgcggcggcgaagtggtcgagcaggtgcagcgactgggcgtcctccgcctcgatttgggcgtgttcgcggcggagcggtggtgccgtgggggcaaagcgggtggagggggacggccactcctcatcccgccggtgagtggtggtggtggtggtgggacttgggaatgggacgcggcggtggttaatgaatgagagtgaggaggagggaaagggaagagagagagagagagagagaggcggaagaggaggagagccatcgatgcgggcttttggaaaaggatccaactcgcgggccgggtattttcttgcgtaaggagccaaggaggtggtggcctgtttttcatccttgtccatcttttcgtctctctcgagaacatcccgtatcttacttgtcacgaaaatagtcatatttttttctaaacaaatattaacaagatagattaatataaattataccacttcataagcatgcatattaatataaaactagtttaatctatcttgttattgttttaattcacgttcaataccggagacgtatagcttgttgaatataaaattgatgatgcttttaattttaattttgtggttatgtttgaagttgaacaattttgttgtttgattatattggtcaccaaatgaaggatcgatccatggatccatcgtttgttttgcgttttaatttgctatataccacattagcgccggcccgtacgttgtgtgtgtacatgtgcatgcgtaataatcttgccgacgtggcgccacatgacgtccgttcgcccagtctgcgcgcgacacgtgtcctacctgggcccgctccacgcgccagttgagcgcctgtgccaagacaaatatatgggccgagtccctgcacaaaaggaaggggatttgttgggcctagcccaactctctttcattcaaatgcccaagcgcccccggcctgtataaaggcagctacggctacccatctctctctctctctccagtctcctcctccttccttcttccacctcgctccccttccaatccctctctcccccaccgtttctccctcccgcccgccatcc

SEQ ID NO: 2529 - DNA, 624 bp, Oryza sativa
  misc_feature (2)..(12): n = any nucleotide
  misc_feature (15)..(15): n = any nucleotide
  misc_feature (20)..(21): n = any nucleotide
  misc_feature (25)..(25): n = any nucleotide
  misc_feature (29)..(29): n = any nucleotide
  misc_feature (32)..(33): n = any nucleotide
  misc_feature (35)..(35): n = any nucleotide
  misc_feature (41)..(41): n = any nucleotide
  misc_feature (45)..(46): n = any nucleotide
  misc_feature (52)..(53): n = any nucleotide
  misc_feature (55)..(58): n = any nucleotide
  misc_feature (61)..(62): n = any nucleotide
  misc_feature (65)..(66): n = any nucleotide
  misc_feature (82)..(82): n = any nucleotide
  misc_feature (86)..(90): n = any nucleotide
  misc_feature (100)..(103): n = any nucleotide
  misc_feature (106)..(107): n = any nucleotide
  misc_feature (112)..(112): n = any nucleotide
  misc_feature (114)..(115): n = any nucleotide
  misc_feature (120)..(120): n = any nucleotide
  misc_feature (126)..(127): n = any nucleotide
  misc_feature (137)..(137): n = any nucleotide
  misc_feature (140)..(142): n = any nucleotide
  misc_feature (154)..(157): n = any nucleotide
  misc_feature (161)..(161): n = any nucleotide
  misc_feature (163)..(163): n = any nucleotide
  misc_feature (171)..(171): n = any nucleotide
  misc_feature (177)..(178): n = any nucleotide
  misc_feature (182)..(184): n = any nucleotide
  misc_feature (195)..(196): n = any nucleotide
  misc_feature (199)..(199): n = any nucleotide
  misc_feature (206)..(206): n = any nucleotide
  misc_feature (210)..(211): n = any nucleotide
  misc_feature (221)..(221): n = any nucleotide
  misc_feature (223)..(223): n = any nucleotide
  misc_feature (226)..(226): n = any nucleotide
  misc_feature (228)..(229): n = any nucleotide
  misc_feature (232)..(233): n = any nucleotide
  misc_feature (246)..(246): n = any nucleotide
  misc_feature (248)..(248): n = any nucleotide
  misc_feature (254)..(254): n = any nucleotide
  misc_feature (257)..(257): n = any nucleotide
  misc_feature (260)..(261): n = any nucleotide
  misc_feature (263)..(263): n = any nucleotide
  misc_feature (275)..(276): n = any nucleotide
  misc_feature (297)..(297): n = any nucleotide
  misc_feature (300)..(300): n = any nucleotide
  misc_feature (317)..(317): n = any nucleotide
  misc_feature (325)..(326): n = any nucleotide
  misc_feature (332)..(333): n = any nucleotide
  misc_feature (335)..(335): n = any nucleotide
  misc_feature (339)..(339): n = any nucleotide
  misc_feature (349)..(349): n = any nucleotide
  misc_feature (354)..(354): n = any nucleotide
  misc_feature (357)..(357): n = any nucleotide
  misc_feature (381)..(381): n = any nucleotide
  misc_feature (383)..(383): n = any nucleotide
  misc_feature (403)..(403): n = any nucleotide
  misc_feature (407)..(407): n = any nucleotide
  misc_feature (409)..(409): n = any nucleotide
  misc_feature (413)..(413): n = any nucleotide
  misc_feature (419)..(419): n = any nucleotide
  misc_feature (425)..(425): n = any nucleotide
  misc_feature (435)..(435): n = any nucleotide
  misc_feature (438)..(438): n = any nucleotide
  misc_feature (440)..(441): n = any nucleotide
  misc_feature (447)..(447): n = any nucleotide
  misc_feature (449)..(449): n = any nucleotide
  misc_feature (455)..(455): n = any nucleotide
  misc_feature (459)..(459): n = any nucleotide
  misc_feature (461)..(463): n = any nucleotide
  misc_feature (472)..(472): n = any nucleotide
  misc_feature (474)..(474): n = any nucleotide
  misc_feature (476)..(479): n = any nucleotide
  misc_feature (481)..(481): n = any nucleotide
  misc_feature (484)..(484): n = any nucleotide
  misc_feature (486)..(487): n = any nucleotide
  misc_feature (489)..(489): n = any nucleotide
  misc_feature (497)..(498): n = any nucleotide
  misc_feature (500)..(500): n = any nucleotide
  misc_feature (502)..(502): n = any nucleotide
  misc_feature (504)..(505): n = any nucleotide
  misc_feature (507)..(507): n = any nucleotide
  misc_feature (511)..(512): n = any nucleotide
  misc_feature (520)..(520): n = any nucleotide
  misc_feature (522)..(522): n = any nucleotide
  misc_feature (524)..(527): n = any nucleotide
  misc_feature (532)..(536): n = any nucleotide
  misc_feature (539)..(539): n = any nucleotide
  misc_feature (557)..(558): n = any nucleotide
  misc_feature (561)..(563): n = any nucleotide
  misc_feature (565)..(566): n = any nucleotide
  misc_feature (569)..(569): n = any nucleotide
  misc_feature (571)..(571): n = any nucleotide
tnnnnnnnnnnnaantgatnncccncttntannancccccnaggnnaaattnntnnnncannaannttttttttgaaaaaangggnnnnntttataaacnnnncgnntgggngnnttttngggganngctttttccnccnnnggggttttcccnnnncccnangtttttcnaaaaannttannnggggggggggnngtnttttttncccnnttttgggggncnaancnnaannttccccccccgananaaaaanccngcnntntaaagccgggtnnaaacaaagagggttttttaanggncccccaaaatttttttnaaaaaaannggggcnnanggtnaaaaaactcnaaggnggncccaaattttttaaaaaaacccgngnaatttttcggggaacccccnaaangngggnaaacanagcganaacgataatntgngnnaaatgngnaaaatnggantnnncaggcaggntntnnnnanggncnntntttcaaanngncnanngnaaanngtgggganangnnnngggtnnnnngtnaaaaaaaaaggggggggnnggnnngnngcntngggagggttaagtggtggatttgggcctagaatgatggcctaggaggcggccg

SEQ ID NO: 2530 - DNA, 545 bp, Oryza sativa
gcttctttttttttaaaagatatgtttgatcatttgacttgtgaattgtgattttgcagtttacttgtccgggagactgggagtagctcgttgccatggtcaggcccaactagctctaggcaaaagcttcctgaagcccagccacatatggggtttggatttgatggaccgaattttcccacaagaattattgacagatgagtggcctgaaacacaattgatgagtagacatgatgaatttgaacatttgtaatttagcacttgacactttgcaacgcacaaatgccgatactacataagtatgatgtgtcctttgctgagggtgaaaattcaataggaaggcatcagttcgtgaaaatggaatcaggaaattcataattttgtcaaatttagcttgtgtttttagcccaaggtccatcatgatcagtgcataagcacgagcagctaaggcctatgggcttccatgaagagtaggcccattggttaaaccggcccatttgtcgcagaattttttacctttggacttctattaaccggctttttcc

SEQ ID NO: 2531 - DNA, 1613 bp, Oryza sativa
  misc_feature (10)..(10): n = any nucleotide
  misc_feature (129)..(129): n = any nucleotide
  misc_feature (153)..(153): n = any nucleotide
  misc_feature (165)..(165): n = any nucleotide
  misc_feature (173)..(173): n = any nucleotide
  misc_feature (940)..(940): n = any nucleotide
ttttgtttanaaccaaactgagccacaaactaagccttacccactagacatgtggaattacggtattgctttgcaacataggcccgagcttagtccttatattggccggggtgctacttcccacaactngcatgcacccaaaccccaccgaanaacaggttttangggctttnaaagaggaatagaggggtatgtccaattccaccataagccaaccattccatagtatccaagtgatatgagaattcccaaagtctaaagttataaaaccacctaatgttgcctaattaatcagcgaagcatctacctaaattcatactagtggaaccatgaatagagtacccactggttggggttttttttatcctagggtgaacaaggtaataataacaatagcaataataataaggtcataacaaagataaataggcatggctaaataaaacaatgataacgcgggaatttaaataaagcgataatgcattaatttaaatcaaaataattttataaactgggattcaatatgttcaaggatgatgtgacttgccttgctcgctttcccaaacgtcggcttcaacctccacgaaagcggatcttccgaagctgcagcgtctacacgaccaacggaaaggaaaaaggcttttactctaataaactccgtataacaagcaggaacaaagcacaaaaatgggttcttgacttcttaaggaaaaattagagacttgaacggtccaattccgagttcaaacggtccaattccgggattcgcggcggcggcggcgctagggcgcgggcgaggcggcgggagcggcgggaggaaggggatgacgggtgggccctacccgtcagcgagggtggcgggcgggcccgcccgtcagcggcgcgcgcgcggggaggaggccgaatgggccgcggggagaggagagggagggggaagganatgggccgagccggcccaagagggaaagggaggggaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacagagaagcagcatcggtcagcattgcgtccaagctatcggctaagccctttagggaatggttcaacaatttttatgataggttccccaagaataccaggatctggtttgcatatgaaggatctgctagttttgagctgccaggtgattttcggtttgaagagatcaattctgaaaaatatgacaaatcccgagaagtattctcagcagccatcagtccttgcatccttcctgtcggcattcaccaaggcaagaatatccaaatgacctacgaattctatcacccgacaagtgctgcaaggcaattcggcatgggtcaactgcaatcagcctattctttgccgacaagatccaaagtagaggagaaatcacatcaacactca

SEQ ID NO: 2532 - DNA, 2000 bp, Oryza sativa
  misc_feature (150)..(150): n = any nucleotide
  misc_feature (206)..(206): n = any nucleotide
  misc_feature (239)..(239): n = any nucleotide
  misc_feature (310)..(310): n = any nucleotide
  misc_feature (396)..(396): n = any nucleotide
tatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatnctaattgcgaaattgttttgtttacaaataaaattgcatgcaatgatgaacatccnacttgtgattatgccatgccttgattattgttnacccttaaatctttgtaaccatgtttacgtatgagtccctagtcaactatgacaattgcttagaaatgctnttctagaatcatgcatactcatatttgtcaaatgctatatgcttgggcaattacctttgggaaggtaattgagatgcggcatgtgnagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatgtggacgtcctcagaaaaccataacgactcaatgacgggaagctatccttgggatcacaatggatggtggacagaaccgtcattgtttaatatgaacactggtattaaaaacttgatcagtctatgctaggtcttaggcttgtgaaaagaattacaaaacttgctttgcgcaaaagaaccatagccatcctttgaatttctctgtcatgtgcatcattgctgtggtggcttgctgagtacggttggtactcacccttgcaaatataaaattaatcagaagcgggagatgaagcctcggaggatccctatgcctactatcaggagggagatgaagacgatggcgtccagtaggtcttagtacggtcgttgcctgtggcaatggcatgccgctgcctgaattccgctgccttatctacttctgcttttggatgtattccggaccgctcggtccgatgatttaaggctatgcctgcgggcctatgatgtaataattcgtatcagacactcgtgtatgtgcacttggtattccagctatgaattcgtgtgtaccaaactacttgatccagggaaatggtactgtttacacgattgattcctgttataaaaacgggggtccacagagctggtatcagagccatacgactgtaggaaaagaccaaaaggcgcccaaccccttttctaagttggccaagggagaaattcccatttagtaatactttcaaaaataaaaacgctatgtttacaaaactcggtacaattttcatcttactcttaactattttctttacaaaaacaagttttaccctcaactgactttgggtttttcttaaaatt

SEQ ID NO: 2533 - DNA, 2000 bp, Oryza sativa
  misc_feature (9)..(9): n = any nucleotide
  misc_feature (41)..(41): n = any nucleotide
  misc_feature (54)..(54): n = any nucleotide
  misc_feature (80)..(80): n = any nucleotide
  misc_feature (110)..(110): n = any nucleotide
  misc_feature (113)..(113): n = any nucleotide
  misc_feature (234)..(234): n = any nucleotide
  misc_feature (268)..(268): n = any nucleotide
  misc_feature (1242)..(1242): n = any nucleotide
cgcactcgngaaccttcgcaacgacggaaacgacaagctancacgcaaaacgangaaaaagactaataaaaaccaaatanacaatacataaaaagtaaacaaacatgtanatnataattttagatgaattatgagacttgaacggcctcattctgacttcaaatgaatttattatgaattttacaagattaaatctaattaaagcccatttaaaaagaattaaataaatttaantcaatttatggacaattttaatatgtagatcttnattttatataatttttgcaacttgaaccacattaaactgagttacaatgaattagttatgaatttttaaagattaaatcggattaaaacacttatatgaattttaattgaattatgacgcaataatgaattatttttgaaaaggaaaaagggatttattgcgtcagcggctagggtttcgcggtggaccgggcgcacggcggcggttcacgggaacggatggccgagatcgatcctatccaaaacggacggccgagatcgatcggtccacgaccgggccacgacggacggcgacgatgacgtcagcgatgacgtcaccaccggcggcggcgcctcggcggctcgacagctcggacggcgcaagcttgccggcgaacgacggcgcggcggcgcgaacggagggcaccaacgggtagcggacggcacgacgaactcaccggtgaccaaagcgacggcgggagaggaacggacggcgacggcgacgaagaagaagcgacggcgctcttcggcttgacgacggcgacggtgctccggcggtctacagcgacggcgaaggggcggacgaggacggcgacgacttggcgatcccgacggcggtcttcccgagcgacgacgatgaccggaatggcggcggcgcacggctggagcgacggcgacgacggcggcgctagggcacacggcgctagggcgtttccgacgacgagaggcgaaggcgagggtggcggcgggtagagaagagctcgggggtccttatataggtgcaaggaggcggcggcgaaggcccacggcggccggcgacgagaaggaaagattggggaaaaacgaatccgaatcaaactcgaatccgcctatttccaaagggaattgaccagagtttctataagagaaaaggaagaggagatcgaggagattatttcccctcaatcgattcggccggagaaggaaaggcgcggccgaattggaaagcggcggcgncgcggctcggctagggtttcgggcggcggcggcggctcgaggaagacgaacctgacaggtgggacccaccctgtcagcgacagagagagagaggagagcagcgcagcgtcggcggactgggccggggagggagagagaaagagagaggttttgggccggctttcggcccaaagccaaaaggaggatttaaaaacatttttctatttaaattattcatgaaatgcaattccatttattaaaaatacttccttagctcaaataaatcctagaaaaatctaggaattatagaattaagcaaagtatttaatgaaattttatctggccccattttatattgagatttagcaaattaaaattagatcttctcttttaagcttttaagatcatttctaattattccttttaaacaacaatttataatttaagaatttttaaacaagaaaagctcttaacaatcataattagatcattattgatcaaataattactgaactgttctttgtatcatttaggaattgagctctgaaaaatccgagaaaatttcagagagttgacttaatcatggagaatttaataaaaattaaatccatccatgctttaaatttaggaaattttatttcccacatttaacttcacttgtaaattaaagatcatttaatataaattctaataataatttattaaataatttataaatcctgaaacaaaaatcaggatgtgacagtgtcgtccaagatgagttggaaggaagggttcaa

SEQ ID NO: 2534 - DNA, 2000 bp, Oryza sativa
  misc_feature (1501)..(1501): n = any nucleotide
  misc_feature (1507)..(1507): n = any nucleotide
  misc_feature (1509)..(1509): n = any nucleotide
  misc_feature (1595)..(1595): n = any nucleotide
  misc_feature (1623)..(1623): n = any nucleotide
acctaaccctgtacacgtgggctgataagtggagggggtcgaagcagctcgaccccacacgagggcggcctcctccctctagctgggaggggcagtcgccgctccaccccaggctcgaccccctcggggggagccacgtgggtttgggggcggcccaaccccaagctgggagggggcgcgccgcaacacctcggggttgacctccatcgggggagccacgtgggtttgagggcggcctcctccctctagctgggagggggtagtcgccgcgccaccccgagctcgacccctctcggggggagccacgtgggtttgggggcggcccaaccccaagctgggagggggcagccgccgcaacaccctgggcttgacccccctcggggggagccacgtgggtttgagggcggcttcctccctctagacgtgatacccccgggcccatatcaccgatagtccccttctgtgtcgtgctaggattttatctctaggaatctatcttatctctacgattatatcttatctctataatttatatttgactcttatctctaactgacatatctgtacttctgacacaaactctatagaatttatagttggataggcagctgcttgttctctaagctgaggacgtgggttaagggtgtgtttagttggcaaaaagaaaatttttgaatatcacatcggacgtttgaccagatgttaaaaagggttttcggacacgaatgataaaactaattttataactcgcctggaaacatgtatggagtattaaatatagattaaaaaactaattgcacagtttccatggaaatcgcgagacgaatcttttgagcctaattagtccatgattagctataagtgctacagtaaccaacatatgtccaaagattcgatgtgatgtttttgggaaaaaaatttgggaattaaacaaggcctaatttgtttggttgataaactgagtggaatgcctgaacaattatatgggcttagcttggtggaaggaaaagtaggtggaaggaaaagtttgtgatgatgttacctgacaagtgcatacctgagttttttttaagtcgtggctgagctaatggatcggaatcactcgtgcagtttcaatagcaactactccatccgtttcatattacaagtcgttttgctttttttctagacaaacttcttcaagtttgaccaaatttatagaaaaatataatattattttcacacaaaataaacatattatcaaaatatatttaatattagatttaatgataccaaattaatattttagatgttgtgaaatttatctacaaatttggttaaacttaacaaaatttgactagaaaaaaagtcaaacgacttataatataaaaaaggagagagtaaatattaagctactggctactgcacgcaatagcagccatccatttttttttggtgaacggtccagatcgtaggtacagtaccaaaacatacgtacataacactacttgctaaagtggtntcccantncctaattatagatggccatgtaggccgcccagcacgacacggcccaggcccggccgtgcttgggccgaggcttgtcgggtcggctnggcccgaccgacgcactgtgccagcccntgtgccacactcacagcccaggcacggcccaacatgacttgggccgtgccgagccggcccgaaggcacgatggcccatcgtgctttttctcagaataactctaattttgccccctcctattgggctgtgatatatatagctaaaaaaagtctattttacctccctcttcttagggctgtggtatataaatagctaatatatgtctatggtccctattctttgaacggtgacatttatatggctatttttaatccctatactttgtgtgctgggctggccctaccgtgccgggccagcctagcgtgccggtgaggaggcccaggcacggcccaacggtcgggccgggccggtacgggcccgacctaagtcgggctgtg

SEQ ID NO: 2535 - DNA, 2000 bp, Oryza sativa
  misc_feature (256)..(256): n = any nucleotide
  misc_feature (309)..(309): n = any nucleotide
  misc_feature (1482)..(1482): n = any nucleotide
ttcatctttgcataggtctaaaaactaaaaacataaaggtgaccacgtgattaagaaaaaaaattgtcgtaaaaaattgacaacgatcaaatagacagaagattccatttgtcgagatcgatttactacaccctgattagtcattttgacttcaacttagctactccagtctcatactaaaataaaatggggtcaccatgtcctatacattcattaaattagatatatttcttgacgaggacttcagattttttcntttttatttccgaggacatgcggcagacctagggattccaccatgccttggtncttgagccaatccaaatgcctagccctgtttagattctaactttttcgtcacatcaaactttcctatacacaaattttcaacattccgtcatatcattccaatttcttcaaacttccagttttagcgtggaactaaacatagctcgtttttatgttctcccaactcgccactctcgtttttcacacacacgcttttcaaactgcaaaacggtgcattttttaaaaatgtttttatacgaaagttgcttaaaaaaacatattgatctatttttagaaaaaaataaatatttaattaatcacgtgtaaatggactgctccgttttccgtatgtacagcttgggttgagaacataggcttccgaacacaactaagttcatgactagtaagatgagatttcaggcttgcggatgggttccacaagtctgaatttccgtccaccatgataataccttgctaaattaaaacggttcgatgaaaacggacgaaaaccatctttatcgttttcgttttcacatgtttttaattggaattgaaaactctgcatatggaaacggaatcgactattatcgaatacgaaaatgtagcgaatatgaaaatgtagcgaatatggtaacggatatttattgaaatataaaaagtctttatactgaacctctcagatcaaccaagagatgtatctaaatattttttctaaaacaataaatcaatatctatatcttttatcaattaataatacaaatagttgtaaagtgtaaactatatttatcaatagctaactataattacaaatagtatggtatgccctagtagcaataaaaaaataatcattagacaaataaaagctaaagtactgaactagaaaatatctctatttaattaagtacctcaatacaatactcattccctcacggtaaaagaaaaaggcattctcattacctcctctaggagactaggactgcaataaatctttcattataaaatttcacttgggagatagattatcacatggtgaactgccaccaactactccctccgtcgcataatataagagattttaagtttttgcttacactgtttgatcactcgtattattaaaaaatttttggaattattatttatttattttacttactttattatttaaagtactttaagcacaacttttcgtttttnatatttacacaaattttttgaataagacgagtgttcaaacaatacaaacaaaaactcaaaatcccttatattatgggacggagggagtatttcacaatgcattcatttgccatcctctcgatcgtgagtttatatatacagacagacaaaagcctacataattcggtcgactcgtttttcctcacccctaaggccaataatgccaaaagaaaaaaaccctaagatccatgagcaagcatatgcagtgttaattaattactccctccgtttcgaaatatttgacgcaattgactttttatcacatgtttgaccattcgtcttattcaaaaaatttaagtaattattaatttttttcctattatttgattcattgttaaatatatttttatgtatgcatataattttacatatctcacaaaagtttttgaataagacgaacggtcaaacatgtgtgctaaaaagttaacggtgtcagatatttcgaaacggagggagtgctagtattttgattaattgga

SEQ ID NO: 2536 - DNA, 86 bp, Oryza sativa
  misc_feature (10)..(10): n = any nucleotide
  misc_feature (22)..(22): n = any nucleotide
  misc_feature (53)..(53): n = any nucleotide
  misc_feature (60)..(60): n = any nucleotide
tcgatgggcnctggatctgcancctggttgggctcctggcccggtgttttgcncataacncttgctgctggtagaacaccaggaac

SEQ ID NO: 2537 - DNA, 2000 bp, Oryza sativa
cttgaatcctcgctggttacatggtttcggcaggtcaggtcggagggtctcatgacataccgccaacagcccctcacgggcaagggtgagttaggagcttcggccgagaattaggagcttctgccctgccctgcgctgtgtgcgccacccactaccgcttgcctgcctctacctgctccctagctacacgcaagggagcaggcagaggaggaaggcgacgaagcttttaggttaagtttaggttgtttttggtttggatttgtcaatcttaagtttgaaaatttaaattgtcttcatatagagctttggtcaggtatgtttgagtcttaattacatactcaaacgtacgtaattatgtactcgcattatgtactctgccggtgctcttcatctaattagactggtatgaggcgccccctttcgaccgacgctcctgccgaaacctatactggagtcctgcagaaaatgtgtacactttttgcatatgtatttttatggttagtaatgttttgtagctttcgccttttgcgaacggcgaagccatccttacttttcctttgggctgcaacgaacagtgatgggcttcccttcgtgggcttagcattgtgcggcccggtcaatgggaatttaccgtttcgcctacccttgtgacacgtggcggcttacgattgggtgggaaggcgaatcgacgccctggtaggttatatatattccacccccctttttcaccgccgcaccccagtcattttcaccgcgagctctctctctcttcaccctctctcttcatggcgctcttgagtcgctagaccctttcggccgcttctcttttcgccaccgcccacacttttcaccatggtcgctcgcaagccaaacccagcctccgtgacgggccctgatcctggcatgatcgatgatgacaccaccgcctatctgggggcttcgcttgttgacgaggaggagttggcgaagctggtcacctctggcgtgttggcagaaaagcaggccgctgccccgggaaaggctgtggtgccgaagcccggcgacaaccggacggtagttttcaccgtgttcttcgaggcaggccttcggtttccatgcaacgtcttgttgccggagatccttcgcctttttcaggtggagctcccccaactgagcccatcggctctcatctggatcgccatcttcgactgggcgtgccgaactgccggattctaaccaaacgccgagcttttcggcactgttttttatgctcgggagcgtgaacttcaatgttcgccctgagcgctccgatctctggccggtcaacgcctctatgtccaagtgggatcgccactggatgtcaaagtggttctaccactccatccccttcgaggccgggtccgacgtggcgaaatctctccaatggcggcacagagcgatcgcgccgaacaagaagcccaaggtcgccgtcgatggcgctatggaagcccgtttcgccctgcttcgcaaggtctgctcccgccttagctgccgcgacctggtggaagagttttgcatgcttcggatcttccctctctcccagttgtggcaagtcgaggtgaactaggacgaggaggtcgatggcctaccaaaacttgtcatgctagagggggcgaatagtaagcctctgctttcctttgtgtacctgtctttcgctcttttttgcctgttcggcgcctaatacgatgacacattttgtttctgtagtgttaactcttgttcaggccgaggccgaagctcggaaggtgatcggcgatgtgccgatcacagaatacggccagctgcttacacggcaggcggccggccgagcgaatcgcgtgtacgacggcgatctcccctcccgggagaagccctccaaggccgatggcgacgaagggacctccaggaagtgaaaggcccctgcctccactgactctgatgccgatgatgaggacactgtcaacgaccgtgacggcgaagaggagggggaggatgagggggag

SEQ ID NO: 2538 - DNA, 2000 bp, Oryza sativa
  misc_feature (167)..(167): n = any nucleotide
  misc_feature (169)..(169): n = any nucleotide
  misc_feature (208)..(208): n = any nucleotide
  misc_feature (888)..(888): n = any nucleotide
  misc_feature (1540)..(1540): n = any nucleotide
tttctccttcgtctgggcaagccggcgggcggggcgaggtgggagaagaggtcgggcggccggcgaccggcgacgggcgatgcggcagcggcggccgcggcggcggtggcgatgacgacgacgtgggaataggagggccgccccctatgccgccagcctccgtcgcntntccaccagctcccatggatgatgacggcggcctcctcgntctccccgttgcgctccccatcggctcctcatccttcgtgctccgtgaggacggcgtctcgcgcgccgctgacgaggctgccgccccgcgctgcttgccgctgctgttcgatctgaacctgccggcctcgtccccgtcggctgctgccgccgccgaagtcgacgagatggattggtgttgcgacacgctgctccacctctagcctgcacatcaccaaacaatggcagcaatcgccggcgaactctagcctacgacgacgacgacgacgaccaaccagcaagcaacaagaattggaaatttgttactgggttgctgcgctccaatccaaccatcaccattgttgctgctgctactgcgaagaagctctaccatctcctccatagacacggataattttctttttattttcgttttcctccatctctttttcaccactcaagatttcgtttccgccgcctctcttgtgcatctctgtatccaaaggggatgctgctgctttcagctgtaccaatagctagaaaatggtagagaagatgataaaatttggttcaaaatttgtaacgtaaatgttatcggaagacgacggggacgaggcgggcaggttcagatcgagtagcagcggcgagcagcgcggggcggcggcctcgtcggcggcgcccgagacgccgtcctcgcagagnacggaggaagaagagccgacgggaggcgcaacggggagagcgaggagaccgccgtcgtcatccatggcagctggtggagtggcgacggaggccggcggcgtgggggcggccctcctgctcccacgtcgtcgccgccgccgccacgtcgcccgtcgaggtcagctcagccacgagagagagaacgaacagaggggcgggcgtcgattgctcacagtgtatcagaagcgtgcgcgcggaggatacggtgaggaggtcgacgagcgacgaccggaagtcgaacacccgcgcctgcacgacgatggcctccacgaatgacgcgtcccctgcgcgcgacgacggcctccacggtcgcgcccacaccctctcccctcctccatgcttctacgtcatcgtcagcgccaccggcagcagtagcctcttctccgccggaagcggtggtggtggtcaatcaccgaagcaagttagctagagtcgatcggctcggtatttgatttggcttcgattgcttcgccgcgtcgaggccgacggatgagggggacggccgccgcggccatccgcgcgacggcatccatcggcggagccgcccgtcgcatcggccctcctctctgccgcgctccttccccgccagccgccggccacgccggctctcctncccgccgcgtcgaagacgcggccaccatccacgcccagggaaaaatgagagaggaagggagagaagagggaaagagagagcggtgacatggacactctgacacgtggggcctaggtgggtcccacgctgactcagctgccacatgagacgaaaccggggtcaaaaccacctaataccttgaggttttgtaagttgagggatgtgatatatctggttttgcggttgaagaatgattcggtaactcgataacaagttgaggaaccttcggtgtacttttcccaagaaaaaaaagaagatgaaggcccgattcaaatacggcccaatataagcagcccaatgttcaaactgggctgtacgatcagcgctcgtcggcccagatctaggcggagggggaacgtgcggggggcccacaggccgaagcagcgtcttctccacaagctcaggctcgcctcgccacgcc

SEQ ID NO: 2539 - DNA, 2000 bp, Oryza sativa
  misc_feature (1)..(1): n = any nucleotide
  misc_feature (195)..(195): n = any nucleotide
  misc_feature (1460)..(1460): n = any nucleotide
ngccgcccttcaccatgccgccgtgccgcccagctccacctgcgccgctagggttaggggtttgggtggggaatttttcacggggcagagggagaaagagaggggagaggtaactgccacatcatttgccacatgagtgtgccacggcagatcaaagaggtaaaaccagccgaaattggccacgagggggttaantgtccggattgaatagttcaagggggtattatgtctggtatcgtagtttagagaggtaaagcatactttcgcaagagtttaggggggtaaatcagacttaacccttatatttatctggtgcaggagaaagttgagttgaaatggaatcgagattagttatcccggttcaattgccaggcatgcaacttctgttgtctttccatgaatgtgtttttttaaatagttttaaagaataacacatgttaggaaaagagaaaatccctcgtatatccctgaaattttagctaatctcctctgtgcccctgaattttgcttaattccgtataccctctaaaatttgattttgatatcttccatgtcccttctgtcagctgccgtctaatttctatatgaccattttactctttggatgaacatagaaatttatgagttacataattgaaaatgtaaatgtttgtcgcatgagactattatagttatgagtttgctgtgcgatacattatttatgacaatttatttttagataatgaaatgaaacatatgcatttattttttaaaaaagtcataaaaattgaggagtattcgtacaaacataggactaccaacgtccacggtatttttttatgaatgctcctgataaaaaaaaatccattgccctattaaagattcaaataaaaatttaatttattacattttttattttcaaaatttatgtcaaaattttccgcactaattatttaatctcattaattttacaaaatgcacatattgtgcactcaaacaaaaattttaattgttcttcaagcttatattcaaacctaaatcatcaagggcataaaagacatttgcaaccagacttaacagtgaaacaaaggaaaatgtaatggcaagggtatggaagggatcaagttgaaatttcaggggtatagaagggatcgagaaaattttaggggtatgaaaggaattgagtgagttttcgagtgtatacagggaatttactcataggaaaaacacatgaatagaaaaaatataggaattgaagttgcaaatttctttaatcgtataggagtgaaaagcataggaaatatgaagatggagccctttgacagcatcaccggaaactaacaaatcaaaggaaagttttcaacatgttgtgcttcttgcttatttttctatgagattgaaccatttgaatgtagtcctaggaaaaatttcgtatctttcctatgaatcaaagggttccatagaaaaaattctttaggaanttaaatcctccaaattttctaccgcaatccttcatttcgggccctaaaaggcaggaaattcagataaatagttttttttttatcatgacatcacctaggatttaattaggctccacccatacgttgtgcttcccattttaagtattacctgtctacctcggagccaccggttctcatggctgcttccttccataggttaaaattaagtaaaaatgctagcatctctgcatcaacatgacatcccccttaagaaaagaggacgttcagtgctactacactgtcatcaccttcaggaaaaacaaacaaaccagttttggatagtgaagggttttggacagcctccatcttcaagtttacaactaccatggctttaggtcacatattgaacaattgaaagattgcttcgagctaaaattttcatatagtacttagacaccttaaagtacaaaaccaatttagtcagttcagtacaactcaggatggagcatctttgagggagagaagcataacttttgttgctacatatatgtgttagttaac

SEQ ID NO: 2540 - DNA, 2000 bp, Oryza sativa
tgagaagaagcaattttttaataaaagaagacgctatgaaaatacaattgacgtaaatccaaaaggcctgtgttgcattattgcctttgtcgaatgagataattcaacttttgtgacagtgaattggtattgtgttgacaccaaaatataaagtggatatgctcttagtttgttgctgctaactgaacaatcccttattagcaggatgttcacgaaaacaaaatatacgtgcacacagttggtttagcaggatgttaacgaaaacaatcccttattactgtcaagtgtcaaacagcagctaacttaccttttttttgtcctggccgaacatgtctaaatcagcacaaaatcaaaatactccaatgggtaaagaccattttatcagtcaccaaataactaactgaaaattctatgatgatattatttttttcaatcctaaaaacttttatactcataatatttcttacaaggaaaccatttgtcaatcacgagaacaatgcaactgaattgattaggaggatggccgagaaacttacagcaagccgatgagcacgacgaatatgacattcatcacttgtgctccggtgcatgtatatcccttctccaggatcagcttggcatcataagaaatccccagggagtagccacagaagaggagcactatgaccgtgcccatggccatgccggctgcgacgttctccggaacgttggagctgtacgtgctcttcatgacgcaacctgcatttgtcggaccgaatgttcagagacatggcgacatgtacacaaagttaactgaagggaagactgaatgtttactgttctgctgcgcgaaggccactgcgaagctgctcaggaatgtgacaagaagatggacaaaattaccgatcttgtcacacattctcaagacgaccgacgacctcaccggtgtcatcgtcgtcacctcccaaccggatcggaatcacaagcccatatcgtccccgtcactgccccaccgcttgccgccgtctccgcaccatctagacacaggcagagaaatccacctaggagaaagacgagagggaaagaagaggcgaggggacaaagaggagacgacaacctgtcaagcgagaaggagagatctttcttttagacaacggcagcgatttcgtggcggcgttgtggtggccggtggagtggaagaggaagaagcggcgccagcaagagaaaccgacgagaaatccgcgcggggaagacgagacggggcgcgggctcgagccgaggtcgtcgtgacttgtgtcgcatcaggtgctgctgcgtgcacgccacctcttctctcgtttccttcttcactaagccacagacccggccactccgatggcggcgtgcggcttgatccctagtcaaacagtacaagcaaaaacttaaactcccttatattctgtagcagtagctatctacaaataattaaacctctctattgcaacggggttagtatcaagtatcacaagtatgtttgtcacccatgagtcatgactagtgtcatgttgtgttaccattaagcccattttgaactatggattttaccgaaagctgtaaaattccaagggaaatgtatgtatgcaataatgcaagtgcgagtatgcaacacacctgcggagtgtacttcatatgcttcagttttggaagggtcccaaaaaagcattccttgttgggtcatggacgcagccttattccctccagagaactttgacattgatcctagtatcctacggcccaaaaagccacatgaccaaactgcccctccccccagcacgatgaccgtcaccgacccccttaactaactccccagtgtacctccacgccgtgggagctgagctgatctgatgatcccttctcacttccaagtactacacgaatgtaacaacttgatgtgacctcagttcttctcccatctcctcttctccccacctcgcgcgcgccgccctgcccagatgtttctccactccctcttgatgcaaaac

SEQ ID NO: 2541 - DNA, 2000 bp, Oryza sativa
  misc_feature (38)..(38): n = any nucleotide
  misc_feature (1991)..(1991): n = any nucleotide
tatgtaggcttagtcactcttagtagaaaatagtagantgagggaagctttggaggagtgcctggaagtttggcgctctctctgacttctacctcagtggatgcagcaatctatgaggaattctgagagtactgagctgtcagtacactctgcttcaagttcggagaaacttctataaagtaaatatccgggatccttttttttatgttatttaattacttagtccaagtgagatagatttccatctttgtaggtttattgtttagtattcgtactaagtgctctagtactaggactattgataaagaaggaatttcatgcgcaaatattagagcagtaattaattacttaggcatgatatctaggttagagattacctttgtttgttgtgtaccccacggttttatcagaggtagacggcaggtggtgacagctctgaatctcgtcctagtagacaagacgcggatagacggacacccacgtgattatgcgtggctaacttgaattagttgtggacgccacccacaagctcacccacgaccacgacgtcattcttgtgcttgcaagtggacatcaccttcttcacgctctcccatggttgagccttcatcaagctttccgttggctacctccatcaagcttgccacactgctatcctcgagcatacccacgatccttcgccaagccgcaataggcttgtcttccaaggtgctttaaatgcttttgcaagtgaagaaagaagataaaagagcatgctgataataaagtaactacagttttaacgaaatgctaaaataagtaacggagataactttcggttttactgaaactaaaaacgaaaacatttgatgctttgaaaccaagagctacatgagagtaggtctaggtgatatcaagccagcgggattccctaccttacccttcttcacccatatctagtggctcacgctgtcatgttggccatatccccttcacatttctaacctctccggtgtcatcttcaacttcagggcctctttgtttgtcttctcccccatctctgttgctgaatccaacatcgacctcgcgtttctgtctttttctcatgaccccgaatttctctataaatccgcctcctgccccctaccattctcctaccatcttcaacccccaaaatcctaatttaaagaaaatctattttagtgccatcccatcgacaccaaagcttaacaagaaagttattgtttaccagtgagtcaatcatctccctttctttcctctcttcctgcctccagtccaagatggaaacagatggataggctgttggatctcgatcgaatgacactaatcaatagactgaaatttgaactatttgtatccatccacttaaatttggggaatttcggttgaacgatgcaggaagtataatttttttcctttccatatgctcgctccaaaccactcttcccgtagacaaaattaccatcgtaaaaagggatttcgccaaaacaccactctacatttaaaaaattgcatgtaaaaatatttgtgcggtatttacttaaattgatttaactaagtgcattttggtcaacaaagatgtgagaaaatggagaattgtgagaaaatggcatttgggtgaaaccttctgcattgagactggcataatggaaaatcctaaatgtaaaatggtagtactgtattatggcaaaacccctttttaagatggtataatggcaattttctcggcctgactgacgccggccgacctcgccttctccttccccggcatcggcgaccctgaattgcggctgccctcgcctcctccccgcggccaccgcgtcgtccctccgccggcatcagctcaacgccgccgtcctcctcccttcgccggcgccgacgagccgacgaccactccacgcagccgccctcgcctgctgcatcgaccctgagcggccgcgccatcgcctccgcctccgccgaccgcgtttttttcccccgatcggggcccngaggaggcc

SEQ ID NO: 2542 - DNA, 2000 bp, Oryza sativa
tgggttcaagagatggattctccgacaacctctataagtgtttgtatatgcaatatttatctattgatcctcttttctaatatcgccatgtcttgaagtcgatcctttcgtccctttacgctgttctgaatgcgtattaactaagccgtgtaatcggaaattggctttaccaacttcacgattgggggctaggatttcgtcaacttcagcttggtttgttataagatttaagttgcctttgtggaaaaacgacttttccataaagatagctgggagctaggaagggtaccatactccaattgctgagggcagatttagagagaatactcttttattgtcacatgtaaattcaatttattttcaatttttaaattcatattatattgtgttacccttgagtgctcgcttggagaccatttgtatctaacaatctgttctgagtattgatttcagaaaagtcatatttcagggttttgtcgcagattatacaattactcgattactcgagaatggttggtggagttcgacgaagattacggaatgtagcgatggtgtacccgccgagataaaaattcttgacttcaacccaaattctcgattacggcgagacaagaaatttagtcgcacactctgtatcttctcgatcgtccgagaatggttaagcgagcattgtgactgttgttcgaaggtcttcggttgagaacattaactcgttcatatgcgttgccgccaaaattttctcaggctcgtttatggtagttgtttagacacaattcaaattcacttatgaactgttgatcttgtttcaatgatgctgagtactccatgtcttctcaattattatcgagaacgaccaagtgagcatgacaactttgacaggaaaacgcggatgacaaacatgaattcatttgagttgaagtcaggggctattgtcatggttatgaataccacatacccaatagtaatagactaagttttcagtggcacccagctgatatcgcgaagcatttttttaatatggcaaaattgcaatggcatggatctaattaaccctaaaacaaaatgctacacaaatacttttagagttacttctaataccgtgaaaaaatattcccatacttttagtactggaaatagttacttctatttttcaaaggtactttgtatgtacacatgattattttttaaaaaaaataatatagtgattacttcaaataaaaactatccaagtttgcatcttctctacatttgcatgttaatttaatttacttcacatagtttttgttattttaagtcatccactgagatgcccctgattttttactctaattttacgcaagtatacaacacaaacagtcaaactatatataggaggtgcggccgttggcgcgcctcagcatcctcaattcttgatgcgacgatcgatcatattttccagataatgaaggtaacttccgatacaaataccatcattttcaaaaagaaaaagatacaaatgccaatgatagctacaaggacgcggtgaatccatccaacgaacatagcttgcagaaaaagttaatcaagagcaaattttgtcaagcaaattgacctcgtttttttcccatcaaaaaaatcgaccccatttacaaattttactaggtaaaagcaattttatcataagccatgacgaattaattaattggcgtgtgccgttcgtttgttgctagtcgtcgtcgttaatccgatgcagataatcccgttcaattcctcaactaatccgacagttaattaacgggatgcaccatgtcggagaagctgctccaaccaatggattaatttaatcggggcattagttaatcattttcttggtccaaatccgccttattaatatcgatcgatggatagtggctcagctcggagattcggcagcagctagctgcctgatcgatcgatcgtcgtcgtcttcatctccggcgagctagctgagctgaactgagcttcgccgcggcggcgcgcgc

SEQ ID NO: 2543 - DNA, 2000 bp, Oryza sativa
  misc_feature (1393)..(1393): n = any nucleotide
ttctcccaaggatgattagcacttataatctagctattaattatatcattagttgcagatgagactaactatataggacaggacaactgcctagctatatatatataggacttatgaaatgacttagctaaatgatttatcaatcattttagaagtgattgcaagactccaattaatgaaacaaactgttcaatcatccatatattaaaaatattactgaattttaaattggcaaatcatgatatatgggttcttattctctcttgtagctaatcgctgtaatatgtatgatatcgagttaccgatcatacatcaacgctacaaaatcactgttcactaaaccttaagtgagttgccatgtctcgtagatggcaccctccaatctctaaatcttggcttcgccactgcggacacgtacatggctggctatataggtcattagcattaggccatcactcatcagtgcattatcgagagcacgagatggcctcgcggattctgcccggcttcttccgccgccgccgctcttccgccgtcgtcccggcggcgactaaggaggagatgctggagctggagaggcggctgtgggacatcgcccctgcggcggcgtacgagctgcagaagcggcggcactggacgccggagcaaggtggcgagggaggccgagaagcagcggtggatcgccgaggagaagcgccgcatcgagaaggagaccaagcggcagcagcagaggaggagctccggcttcgccgtcgtcgtcgtcgtcgatcttgacaaggagcttggcgaggagttcgagaggacgcggttctacgaggagctccggctgcaacaagccgaggctcgccgtgcggcggcgtccaaggtcgtgacgacgacggaggaggaagacgatgacgacgacgtccccgcccgcggcgacgagggctacctcgagaggcgccgggaactcctcggacgttaccgcctcacgtaggccgccggcgcgctgagaaggcggcgcggcggacagtcgccgatgagatcatgagatcggccgccggcaagacagcaagatgcatgtgcgcggagcggcggaggacgatggaggcctcggcgtcagatcaaccatggcgcggcgcggcagactgagaaggcggagacgacgatgctggtttatcatagaataagatcaaaatcctctcttcatatttattacctgcaaagcacctctttgaaatgtttatcatagaataagatcaatattgtcactacttgccctgagaaaaaagattaattaatactgtcatatttaaaatagatacatccatcttgtgaaaatcaaatatttttcttttacaaaatccacgtaattctaggtacattgaattaaccatcagttttacataaaggnaaaaaaaaagataagttgagcatggcagtaaatgatggccagttcctaatctcggcccaggccagcccgagtcatctcaggccggcccaagccatgtccatcgtctgcctacgcaaaaatgatttggtttttttttatgataagcttagtagaatatttgatcttataattttttcctttatccactctggtaggcttggtgttcgcatttgaccctacatttttttttctttttggtgccacacacatctttaaactagaagttgttgtatttgtgtcgaaacaagatttcggcaatataaagggatagcgcacgagacctaaaagtggatggatgtggagacaaggatgtagacaggttcagaccctctcgatgagaggtaatactgagttgcatgcaccgaccagttcaacccaaaagcttaagctgatgaggaaaggcgggcaattcactttatattccaacactccccctcacgcgcgaccccctcaagcctctatcgtggaatagaagtgggctacaatttttatttaattgcgtgccagccaggattcgaactcgagacctcttcggtggaccatccgtgctctgcagtcggaatcctcg

SEQ ID NO: 2544 - DNA, 2000 bp, Oryza sativa
ctggtgtgttattcctttcttctaaactttagatactcccaccgaattcttcatttcttccacggtgatctaggccttcgaaagtgtggccatacattaggcttaggcgctgtagtgataccagacgcgagtcaaagattaccaagtacattacttctgtgttaaccttgcctcccgacatggaaaacaaagcacacaattatagtgagattaattaagtattagcctaaaaaactttaaaaatggattaatacgattttttaaagcattttatataaaaaacttttataaaaaatttaccgttcagcagtttgaaaagcatgcgggtagaaaacgatggaaatgagttggaaaagagaggaaaagaacacagcctgctgtaccgtcgtcatgttcgattcgtgattcagtttgtgaatactccctccatcctaaattatagggcgcccactttttaaagaaagtcaaactcgatagttttgactaataatcatactaactatatctatactaagggtgtgtttgaggagaaggggattgagaagattgggaagatacgcaaaacgaggtgagctattagctcatgattaattgagtattaactattttaaatttcaaaaatggattaatatgattttttaaagcaactttcctatagaaaatttttgcaaaaaacgcaccgtttagtagtttggaaaatgtgcgcgcggaaaacgaaacaaacaaactcactctctcaccctctcgaacgctgcctaaatagtattatgcatgttatatcactatattcatattttaaaatactttcatatgatgctaatttcatatttgttgggatcatagaataaaataaaatactattcaaagtacattattgaagaccgtgtaaaaaaattataagccttaaaatttgggacaaagtgagtagatctgtaaatgcatcatgtatttttgcaataaggttttcaatgtctctttatctgaagtactggtacatattcgcacacgatcaccaccaaacaggagaggtagggatggcagtgggtcgggtcgggcacgggtagagcgattccatgcccgacccgagacccacacgcccacgcccgacccacgccgccaagtctttcgagcaaaaccccatgcccgatgggtacgggcatgcctgatgggtatccactagataccacataatctgaaaacaaaagtataatttatgttcaacacttctataaatgcataaataacatgcacacacaaatactaaaaacatcaatttcagatctggatctggcataagaaacatgcatacacaaatactaacatcaatttcagatctggcataagatgaacatgctacaaggacggagacacagagtggacgggcttgcctgcgtgcaccgccgcttgctccctcccgtgcgcatgtgcgccgccgcctgcgctccctcccatttgtcgcgccggcgatgcgcagccccctccagtgagccgcgccgacgacgcgcagccccctaccgtgcactgcgccgagagagagacgggagggagtgaggagtgaggagagattagggttagggtaaaatatatataccacttgtataaatgaggatggatattaaactattgaaggtttaatggataattggacatacatgggctataagttttcgggccgggcatgggttacccacgggtgaaatatgaagcccggttgtgcccactaagttcgcggatgacaggttgagcatgctcacggacaaaagaatgtgcccacgcccgtgcccatcgggttgggtatccacggatacccgactccgtgggcatcactgccatcgctaaggagaggcttcaggcttgcggttggcaagatatattctcgtcccaggaagtacataccgcctgcaaaggcgccacctagagatggcaacggggccccataacccgatacccgatgggtctttactctattagaagtcaaatgtgtttcaaatattaaaccc

SEQ ID NO: 2545 - DNA, 2000 bp, Oryza sativa
cttatttttagccaatagatatatttttagaaaaatcttaagccaccatgtgttacatattaaaaattagaaaaaatgaataacaaaagttgtgagaaaaactggatcatcagtttcacttaaatcatttagaaaaaaaagaaaaaaaccgctcatgtcccctgcacttcgccctcccccacacatatgcacaacatggcactaccgaaacctccctacttcgcttgagctctccatctacccttcctgtttttatagcgagaaataatcaaaaatattcaagcatacatgaattttaagctatacatttgatttctaatataaatattgttgtatttatagttaaaccaatgatttaaatatccataatgcctatattttgaactgttataaaataaagcaactaacagaaaatgtcaatagggtctaaattgaactgtttagagaaaatgtaataagttagtaaaaaaatggttcttacatttcactaaaattggaccgacctgcatgttccatttttataataattttaaaatgctcaaacattaatggtcttacttctatcctatagcatagcatagcattatgagttcctccacatattattacacatataagccgcactaaggtttgtagtatatggtttgttgacaagtttatttgttactgtcagacttacaattttggattcatgttaactatgtattttctgatgaaaaagacagtatagatcacacatatcacaagtaagtgaggtataggatatgtctttattaatttactagcaaaatgcccgtgcgttgcactgggtaatgtcgtgttcgataaatgttgattgaatgatttttttaatcacaaaggttttaaacaattattccacgtgtacgtgtatgatatgaactatgttcatgactcgttagcgtgatgattgtatcatgggaggaacaaacggtgaatgccttacgtcacttttacgcaagagtagatggacaaaaatttgtatgattaaaaaaattgtatttaaaataggtaagtttattataaaactaatgaaaaccagcttttgcatatttactcatagtctcgtagtggtgacacgtggatgatatatagcgcatagactttaatatgtcatgtttcgtagaaatttttatctcaaacaaatattagagtaaatatttcgatgattatgatgtgaaaaataaaaaaatagttaaaaaatatcactcgtctgtgaagtagtatgtacctgtacacttatttttcaacggaaatcaatttggtggattagcaaactataggaaattgaacgcaattaacaagtctactataattgtagtttttttaaaaaaaatatcagtggcctggttagataggcttatccctctcgctacacattgcgattgtcgattgaaaaggttaatgagaattttaatattgggattgctatacactataatttaaaagttgatgaaatttttttcttgattttgcaccgaaagcccatttcttccttcttatttagccctacgctagtatgccctttctgttttccccatattagagcttaaaattcgggataaaaaagtccagaaagatcaccaatcggtcagattcggcctgggcggctacaggaggcgcacggtgcaatagatcagttcgcattcgggaaaaaacaacgacaaaaaaccggacgaaaaccaaaaaaacaacagaccaaaataaatcggaacctttgtgtttttttattaggtatatatatacatataaatatatattttctgagtaattgatcataattttccagcaattttaaatggatcaaaataatgccaaataaaattatgtacataatcaaatgaattaattcggcgaaattaaataaaactttattttggcccattacttccataaccggcccaaaaaattggcccgacccgtttagcacatgcgcacgagctgatcgcgcggcgaacggcccatctaacggcgacggccca

SEQ ID NO: 2546 - DNA, 236 bp, Oryza sativa
taaaaatcccctaaagagagagagagagaaacccgcctcggcttgcgaacaagtgtaacaaaaatccccaaatcgatcgaaaagatccccaaaaagaaaaagaaaaaaaacttcttttttattccccatccactcgtagcgggaaagagaagagaggggctctcccggcgctcggagcgcagaagcagcgagccgcttcccgaagggagcaagaaaattcgcgcccagtttggtcg

SEQ ID NO: 2547 - DNA, 293 bp, Oryza sativa
  misc_feature (7)..(7): n = any nucleotide
  misc_feature (10)..(10): n = any nucleotide
  misc_feature (12)..(12): n = any nucleotide
  misc_feature (17)..(17): n = any nucleotide
  misc_feature (24)..(24): n = any nucleotide
  misc_feature (44)..(44): n = any nucleotide
  misc_feature (46)..(46): n = any nucleotide
  misc_feature (63)..(63): n = any nucleotide
  misc_feature (79)..(81): n = any nucleotide
  misc_feature (85)..(87): n = any nucleotide
  misc_feature (158)..(159): n = any nucleotide
ggggggnccncncgcgnccccctnaaaaaatttgtaaaaacggngnaaccaaaaaacccgaangggtttgggctttctnnntgcnnnccctcaataattgtacacgcgcaccacaaaccgacggcttcgcttctcttcctcccttcttcgcttctccnntcctcgtgcacgcccaagtctcctcagaggctttatataaagagcagctcgagtccgagattctcccatgccatgaatcgcagctcactcctctgcttccttcctcgctgtttgcttctggtttgattgatcga

SEQ ID NO: 2548 - DNA, 2000 bp, Oryza sativa
  misc_feature (503)..(503): n = any nucleotide
  misc_feature (758)..(758): n = any nucleotide
  misc_feature (765)..(765): n = any nucleotide
cttggcacatatacctggacttaatcagatagaaaacagaaaacccaaatacctctcgttctccttggcgcatcacggcgccatggcgataggactctttctcttgacctcccacatcccacgacaacttcctcctcccctctaatccccaaacacatgagccgctgactgatatgacattgtgtatcacctgtgtactaaattgtttatctttctcctttttcttttcctccattatctttatttttcaggatcaatttccaggtcaaaagagatatccatatacattatatatccagaagttgaagtgtaattgcttgtgaaaatggttcgcaggagactggaacatgatgaaattactagattctacttttgttatggtgaagaacatatacatagaatgatggctgagtatgttctgagaaggtcactccaaaaataactggatgtaagttccatttgctgattttgtcttaagtagatcacctcttccttttttttantatttatttcagtttaattgattttacttttttttttcattcagcagatagatgaggtgatcgactccttaaaaatgctacagatgtttttcatggtccatgcactgactaagcttcgtttattttcaaggtaggctgggcagtaccttaaatattagaatggtgattattctatccatactttaattttaggctttagggtgcaataccatgatcaaaatttacaattatcataattcatctctgcgttattanggttgcncattaggttttctattaatactctcctagttttggaacctctgataaaaatcaaaactactccaaagatgaaaatactactatgaaggttgactttctgtgagaactaccgttcatagtgattgtgcatttacccagtccagatggagcgattggtgctgtttaaaatgttggtcaaaacaatccaatgtacatacaaaatggtcagatttctatgaaaatatagttgtcataggcgttgggcagagaggccgaggcccacgaggccaagtcctagcggataaacagtaccacgagtactgtagcagttggttaggacataggataggattagatagagttagtttgagttagtttcttaagggtcaagtcatatcatctctatataagggatggattgtattcatctctagttaagcaatgaatatcaattagtctaatctctccctcccaataatattcttctccctagcctaaatctacatcccttctccaggagccgacgccgcccggctatcttcccggcggtgtttatcccgtcatggccttgggtcatgacaatagtttggtgtctttttaaagaaagatacaatattgcccttaatgaactttcagtgagcagctccaggagtccgaatcaaaggccttgttgatccccagcgccccatacaaagaggactttcctaacagttgtatataagatcagtccaaataataacactgaacaacttagtaataaaaaacttccctagggaattattgatgctgtcatgctgcagaaccatgttgtacactactctgagcataggtttcccttgatatatcgcacatgagagtcagattgacaaaccaagtcattccctggtcttttaatctctcaaaattcttttttgcgcaatagtgcatcactgtgtcatacatttttctgatagcacctactccctccatcccaaaaagcattaacctaggaggggatgtgacccctcctaggttgattctttttgggacagagggagtagataggtaaataggtgcagatccttcataaaaaggtgaaatctacaggagagcaattgattgcatcataattgaccaatccagtggttgattgagatactttcattaacttagataattattttttattttgtttgatgcctgttttggtttattttagcttgttcatcaaattgaccaatgcttgctctcatccattatgccacttgtatgacagac

SEQ ID NO: 2549 - DNA, 2000 bp, Oryza sativa
  misc_feature (1632)..(1632): n = any nucleotide
  misc_feature (1640)..(1640): n = any nucleotide
agtaataaaacattgttgaagttggtgaagaagaagattgaggaatacccaaagaggtggcatgaggtgctttctgaagcattgtgggcgcataggatatctaaacatggtgccactaaagttactccttttgagttggtgtatggtcaagaagccgttttaccggtggaggtaaatcttggtcctcttcgttatatcaagcaagatgatttgtcaagtgaagattacaagatgttgatgggagacaatcttgatgaagtcatcgacaagcgcttgaaggcattggaagagatagagaaagagaagaagagggtggccaaggcgtataacaagagggtgaaagcaaagttgtttcaagttggagacttggtttggaagacaattttgcctttgggtactcgatccaaggagttcggtaagtggtctcctagttgggagggtccttatcgagtatgcggcattgttcgagggaacgcatacttttttgagacacttcaaggggagcgttttcagcgagcgatcaacgggaaatacttgaagatatacttcccgagtgtttggcaagacgcttaggaggtactatggccggtaattggattatcgtcctaagaccaaaaacatgttctatgcttttagattcacgttgttcatcaaaaaggcagggggcatgtgtttacacccaaatttgacacctaggattaaaataggaaggattgccaaaatttggaagtctaccggtttcctccgagttggccggtctgaccgccgtgtgttgggcggtcagaccgccggttgagggccggtcagaccgacggtgtgtggccggtctgaccggcaggaccgagtccgattgtgttttgtcgggtctcggggtttccttactctggaaggcatgttttgggtttcctttggtctccaccccgagttggacgtggaggagggcctgtagagggcaagaccaacccctatataagggacatggccggttcattgtaaaaaaccaatctacaatcaatcaatcgaatcgttttttcatattgcttttagttttctcttagtttgtccatctttgtcggtttgcgccgtaaaccgtccgccgccgctgcgagagtgcgacatccctttgtaggtttgtcctgaaaaccttccgttttgcccacgagacgggtagttatctagaaatcggttccgctagccggtttagttatcaaaacccatctaggtttagctctttgctagatcgaggtggttgacgactctaggatcaccgcaaggcttaaggtgctgcgatcgtgcttgtcaacttgtcaaaaaagttgccaacacttggattagagagatcggactccaaacgagaggaatcgaagccggaaaatcctagggttagattggagagataaactcaaaacgaattcaatttgggtttatccgggcaaaattgatccccgaaaccttaggggaaagggagaggataaggagaaaatgatttcccctcaagcaattggactcgggggcgaccggttgaggcggattcggcggagaacggcggcggctcgggctcggttcggccggccggaggtaggggatgaccccgacatgtgggccccacatgtcggcggctgagaggagggntggggcgncggcggcttgggccgctcggcgcgcgcgaggagagagagatgttgggccgaaaacggcccaacggcttaggggaggattttaaaaacttttccaattaaaataattcgtgaaatgatgtttcatttattaaaaatactttccttgctcaaataattcccagaaaaatctagaaaatagataaacaagcaaagtatttaataaaattttatctagctcaattttgtgttgaaatttttcctagattattagagtttaacttgtaggcttttaaaataatttctaaaaatgatttaaaagatggattattaatttaggcgattttcagggcgtgacaccaagcgccacaaattttcaggaat

SEQ ID NO: 2550 - DNA, 2000 bp, Oryza sativa
  misc_feature (1770)..(1770): n = any nucleotide
  misc_feature (1775)..(1775): n = any nucleotide
aaatagattggacaaattataaaagcaacactgatgaggataagttatggataaacagtatttttgaaatggcaagtgtcatctggttgatattctatcattttaattttttttcaaacataatctctaatacatgctcgcgcatcgcgtgggctaccttcctagttatatactaaaggtccattaaacttcctacaaacgctctcaagcctccacgtggcacatctacaaacgctcctagaccaccacgtggcaatgcctaatctcaccgtcaattttcactcaaatcggtggacccgataatttagaccattaggttagattagatgtattttatttaaaaagttgtgagaaaaaacatatcaaccattggttttcatttattttcaaccatccgatacattttagatcatatccctactttcagctaatggacaactcatctttaattgtgctagagaaaaaaaatactctctctgtccaataaaaaaagccaacctagtactggatgtgacatatccaagtaaaacgaatctatacatgcctatgtccagatttgctatactacactatgtcatatctctagattcctttttttacagagggagtaaattacagtccatactatgtattcttaaatattcttaaaagttttcatattatgtcatcatttaaccattcttttcttttacacaatagctaactttacatttcaatttggaccaccctattatatccatctccaagtctgatgactcagcaatcactccgcacactatctctctctctccattttctttttccctccgtttgataactgctaggtatagcaagaaggagcacggatatagcgtcttcgctttttgttaggtcaactcctgcctcccagtcccttcacgcccgacatccccgacctcaatgcaaccataacaatagtgtgcataacgatagtggaggagaaaaagaaatgtcggtgatgacggtaaaggcaaagaggaggaacgatggtggctcaggagaaagagcggtgatgacggtgcatggagtatcagttagtggttgctagtggtctgagaaatttgttgtcgacacaatcgctaactgtgtttgttaatttttgatgatatgtgggtcaccagtcatcataaagaaatactattaactagttttaaaatagtaaaaatattaagataaagttggagtagactatagatggccataaggccgaggcccgacagcccgaccatttggcctggtccaagcatggaacgacacaattattgtcgggctcgtgccagcttggcccaataattgggccgtgcttgggccaatgccttggcatggtggggctgcccagcacggcatggtcaaagaaaaatagttggggttaattctgccttataaggcactgtccaaagagaaggacataaatagacttattccatcatatatgacacaacccaaagagataagagacggaaaaagacttattttgtagaaaagcacgatggactatcgtgcctttggatcggctggcatagcccgagtcttattgtgcctagactgggccgtggatgcagcccgtgggcacggcacagccggcccgactgacctcgggtcgtgcctgggccctggcgtctcgtatcgcgtaaaagaaaagagaaatctgccgtctctctctctcgttgtctcctcctccgctcctttgcgccgccgccaacacacagggcagggcgcgccgatctccatctggcgagcagagaaggggangggangggaggggatcctggtgagccctctttccgattcatctctcaccgggacctggaatttgcttgcgttcgttaaccctactagcttctcttctagatctggaagaagctcttctcctcctccttattaatttgagagccttaaacctctcttaatacaactagctagtaacattttgtttgtttgtttgtttgttcaccgaatagtttgggggttcaactgaacca

SEQ ID NO: 2551 - DNA, 2000 bp, Oryza sativa
gttatatatgtataaaattaaggggttgcacctctctactaacaacagaaaaatataacgagaagataaaacatcccaaattaaagcaatttaggaaaaagtatgatcaagttaccaacagtctgacaatacactttaaaattcagcccttctaaccgagtgtggcaaggcatgataggtatcaaccccatttgttgtcttgaattttaattatatcttagatgaagtggaacttgctaaccgacagaagcttgaagcatatttgccataaagcgattggatgagtaatggtatagcgttcttatatataagtggattttataatgtctaaccccgttgggttttatgtagttttttttagtcaagagagaactttattaatgactaaatagagggttacattcttgatttaacaagtctaggattgatgcgggggcgcacagcctccattccccacacgacctagtactcgttgccatttgtgctaacacatgagcaaccctattagcttgtctcttaatcttgtgcacttgcacccgttcgatacaatttagttggatttctatcattagaaagaagtgcatatctcacacgttgcatcttgtatttagacattagattcaaggctatacctcactcgatgtgtgttaccatatttttaggattcaaagttgttggcaacttttttgaacaagtcacaaaatacgatcgaaacacctaaacgtcatatggtgacacggagtcgccaaccacctcgatctaaacaaagctaaggctgcgttcttttcagtggattgggaactcctttcctttgcacggaaaacggagcggtccattagcgcgtaattaattaagtattagttaatttttttaaaaaaatggatcaatatgatttttttaagcaactttcgtatagaaactttttgcaaaaatgcactgtttagcagtttgaaaagcatgcgcgcggaacacgaggaagaggggtggaacattgagcaaagaacacagcctaaatcaagatgagttttgtaaaattaaatcggccagtggagccgatttagatgaaacagggataaacacccgtctcatgggcaaatgaaaagtttacaaaagggtatttgcactcttacagcgaggatagatgacagttagttcaaaccgacaaaaatggacaaaactaggctagaattaggcagaaagtatatgcgacattgaaaaagtgattcaattggctaattgtgctagaaacagattgtgtggtcaatcgaactggtcttgacccttataaagaggtttatcttgctttctataagacctcctccacgtctaacttagggtagagatcaattaggactcgaaaaaatagattaccaaacaatgaaactcgagactcagactcggacttagccggtctgactagtcacaagtcgtcggtcagactggtcatgtgaaagaaacgtacttttcaaactctgacaatgatttcctatttcgtgtcaaggtgttaaatttttggtgttaacaaaaaccatcgtatctttttcatttacagtagaactcaactacgagtaccaacttatgacgaaaataaaagattcatttaaacgggaataaattcgtgtgcagtggtgggtaagtgtaaaaaaaaaaagccaacaatcccaaaaattcacctgagcattaacctgccaagtcgtgccaggccataccggccaacattacacggacgcatacgtgcacagggcttccacgagaccagccacgcaagcacctcccctgcatcacccaccgtccagaactcgatcgacggcccagataatcccacgtcgtatgactgcaaaaggaagaggagataaaaactcgagaaattaagccctgaaccggaaggaccccgagaggtcgtcgaatggcaactccgcctccctcgaacccgacgacgacgctccgagtcggctctcactgatcgcttctagaagcttccggaaggctccgaccccccg

SEQ ID NO: 2552 - DNA, 2000 bp, Oryza sativa
acaatacagtaactgatgttggaagcagatttcatcaagaaagagagaagcttaaaacttttgcagttctgacttttcctagatgcatgcatgacattgcacgaaactgacacaagaaagagaccatggggcatccatgcagagcatacacggctggcaaatgacgttgccagctgatgaatgccaccctagctagcaatactatgctgactcatcattcagggagagagagagagagagattaattagagttaattaatcagtagtcctacctggcaacgcctctgtacttggagacacccctggagaaaccgctgctccggcggcggagggaggccaggtactcctccctcgacacaccctccatctccgacctctccttctcatattcctccagctgcaataattcacattatcttcagtaataattcagattacacaagtcgcaattgtctagtggtaagttggcaaacttactgggaaattgagcactgtctcaggaccccagtacttaagagctgcaaggtcatatgcacgagcagctgcttcctcactatcataagcccctaaacaccattaaacattgcactaatgttcagaaacagatcaaacaccaacacaataagtagttatgtaacaactagttgctatatgcctatattcttagggataaactgttttcatattgagacaaaccaaggatgtgacagatcaaacaaacaaaatgtgagattatacaagaacaggaagcaacatgcagcatgaatctgacaaaacagggtgtatagacaactagtttgtgggacttacccaaatagactattgagaggagcatcaagcagcagcagcagatcaaggtcacatgcgcatcacaagggcaaggtcccccaaagataacagcaaaaaagaaaggagataaaaaaagcttaatcagaatgtcagccttaaaaaattcgctccactttatagtaataagctttgtactaatggccgatgtatcaagatccttggcagtatacagaagtacaccaaggaccttgtatgtttcactttttctttcattatagtacattatactgtaaaaatactcgaatttcactttctttacagcattttcagataaaattcatgttaaaaatcctaaaaaaaattaggcaactaatgcatgttgcgatcaatgtaccttgcctccctttcttcttgttctgaagtgaagtggagcaattcttgtcccacagatgggcctcaaatctgccagtccaccgatgcctgtttatagacacatgcatgcagcaaatgattccaccgtatattgaatttattaatgattgataaataagcagcattcaagcattagtgtttgctttacaggaggaagaaaaactgaaggagttgaccaccccagcagtaaatgtagatcaaccaactccctacttcccagctaataataattgactcactccaaggggaggagcagcaagaaaaaagattaaaaatgggaattatgagatcaagaaatggatccgatcgatcatgctcgccaacctccaaaagatgaggcatgaaaaggggagcagactcgccacccacaaaacgataaaataactgatgatctctgacatgcaagtgaaaatattcaggaacagattggaaagaagcggctggtaattttgggagcctgaaaggatggaaatgatgcggaattttgggctggaaatcagccattgattaactagcggcaatgcaggatgaattcgcgactgaaatcgagaggggatcagaaagaacagcagaattgggatcagagggatggaagcaactgaacatgcagggacgcatacctggtgactcccctgtagatagaactcctcttgccgccgccgccgccgccgccattggaagaaggatcagccacctccttgctctccttcttgggcctcttggccttgccggtgctcttctccgtcctcggcctcgccctcctcttgcagggcatcgac

SEQ ID NO: 2553 - DNA, 2000 bp, Oryza sativa
  misc_feature (7)..(7): n = any nucleotide
  misc_feature (1718)..(1718): n = any nucleotide
  misc_feature (1722)..(1722): n = any nucleotide
  misc_feature (1742)..(1742): n = any nucleotide
  misc_feature (1761)..(1761): n = any nucleotide
  misc_feature (1763)..(1763): n = any nucleotide
  misc_feature (1768)..(1768): n = any nucleotide
  misc_feature (1770)..(1772): n = any nucleotide
  misc_feature (1774)..(1775): n = any nucleotide
  misc_feature (1777)..(1778): n = any nucleotide
  misc_feature (1781)..(1781): n = any nucleotide
  misc_feature (1784)..(1785): n = any nucleotide
  misc_feature (1788)..(1788): n = any nucleotide
  misc_feature (1803)..(1803): n = any nucleotide
  misc_feature (1837)..(1837): n = any nucleotide
aaaagtnggattttttttttacagagaagaaattgatctctaatgattccagtctaaaatgcacagttcttccctactaacctaataaactgtaaaccgaaattattgcaaaggaattgttcaacagaatgttccagaacactcacgacgccaagaacggagtagaagtcgtcggcgacctcatcctccgcgctgccgtactcagcttccgccgcataggcacagctcctaaggtctctccttccccccgtgctccggctccggcggccggccgttcttgcgaacctagctgaaaccaacggccgggtgcggcgaggagagcaggggatgggcggcgacggcgaggctgtgcgcagcgtcgcgagcgattcggccagcagcggtggcgagggtagcggagccattgggcagcggcggccttctccaactcgatcggaatcgaatcgaaggcggcggcggcggcggttgccggttggttcgtttcttggcggtctacgtcgttttaagtcggggcaccactaattcttctggttcaggctgcctaactaagctgtttttacacgctgggacttgcggctattcatatttcaatattagggattcttaataaattctaccatggaaattccaaaaaataaaagagagagacatgctttgcctggcttggctagcttctcgttgacatattaagacatagctaaattaaggttttagaattgatttacaagtatttttaaacctaagccaaacgttgctggttttattttaagtaccagagaaattatacataatcactaagggtgacagaaaaagcaaaatgaaaaacatagtaaatcagacagcaacagagcttgctaacacactactctctctatgtctttcgtcccgatacaatacataattttatggcaaaatttgctacagacacttaaaaaatgtacaatttactagtagacattataaaaacatgtcacggctaaaagatacttaaaaattgataatttgttggatgacactttcgactcaattggagagagaaatttttcaaaaaaacaaggatgcctctatggtcaaaatattttgagctgaaactagagctaagatggaatataatgtgatggtaaatttagagttgtataatttctaaatttttactatagcatcatgcagtttgaagcatgtggttttaggggcattattatctttcttagaaatttatcgatccaattgaaccgaaagtgttcttgtcacaccccaatccggcaccgccgtacaacggcacctgacaggagcgtgtcgtaggaaaaacgacgtgaaccgcttcctacgaaaccgtgatctcagtaccagtcccaggacatagtgctggtacccatggtgacaaatatgaatcattgcaatccttaaaataaatagaggacttatttaccttaacttaggttgcagcttagaacggcccgagaatgcaaccgacgacgcggacgaggaaacaccaacagcaacagcggcagcggaaccaacgaactaacacccaacaccacaggcgacggctgggaaccaggacgaaaccctaatcttcacttcacttcatcttcacttcaaggcagaggaactatatatatttatatagagcaagggtgagtactttcgtactcagcaagtcacgggaatttaggtgtttaatgcaagcttggaagagaggtaaggttgttttgcanatcntttgtttgaaagcattttgnaatcactaagtgatttacntnctttntnnntnngnntgngtnnaanagagacttgcgtctngattcgactttaagagatgcttttcaacaactcnaatggtaatgtaccgacctcccgggtcagatcattacttatcggctcccagagccatttcacttgattaggcggctcccagagcctttttcattttctcggactcccagagtccagctgcccagcagcaaagcaatccgcttcccctcgggaagcctagtcta

SEQ ID NO: 2554 - DNA, 2000 bp, Oryza sativa
  misc_feature (292)..(292): n = any nucleotide
  misc_feature (563)..(563): n = any nucleotide
  misc_feature (638)..(638): n = any nucleotide
  misc_feature (1022)..(1022): n = any nucleotide
  misc_feature (1980)..(1980): n = any nucleotide
gacatattgtagtgtattgggtgcgttcgtggcaaaaactcacttcgtgattcgcgcggcgaactttatgtcaattaatgccaattattggcatttattggcacacacgggtgcgatcgttttcgaccgatgtgaaaaagttcaaaatgatgatttttggacatattggagtgtattgggtgcgttcgtggcaaaaactcacttcgtgaatcgcgcggcgaacttttgtcaattaatgccattattggcatatattggcacacacgggtgcgatgtttttgaccgaaatganaagatttcaaaaagcaccaaaacatgatttttggacatattggagtgtattgggtgcgttcgtggcaaaaactcagttcgtgatacgcgcggcgaacttttgtcaattaatgccaatattggcatttattggcacacacgggtgcgatgttttcgaccgaagtgaaaaagttcaaaaagcaccaaaacatgatttttggacatattggagtgttattgggtgcgttcgtggcaaaaactccacttcgtgattcgcgcggcgaacttttgtnaattaatgccaatattggcatttattggcccacgtgggtgcgatgttttcgaccgcagtgaaaaagttcaaaaancaccgaaacatgatttttggacatattggagtgtattgggtgcgttcgtggcaaaaactcacttcgtgattgcagcggcgaacttttgtaaatttatgtcattattggcacacgagggtacgatattttcgaccgaaatgaaaaagttcaaaaaacgccaaaacatgatttttggacatattggagtgtattgggtgcgttcgtggcgaaaactcacttcgtgattcgcgcggcgtacttttgtcaattaatgccattattggcacacgagggtacgttattttcgaccgaaatgaaaaagttcaaaaaacggcaaaacatgatttttggacatattgtaatgtattgggtgcgttcctggcaaaaactcacttcgtgatacgngaggcgaacttttgtcaattaatgccaatattagcatttattggcacacacgggtgcgatgttttcgaccgaagtgaaaaagttcaaaaagcaccaaaacatgatttttggacatattggagtgtattgggtgcgttcgtggcaaaaactcacttcgtgatacgcgcggcgaacttttgtcaattaatgccaatattggcatttattggcccacgtgggtgcgatgttttggacatattggagtgtattgggtgcgttcgtggcaaaaaataacttcgtgattcgccaggcgaactttggacaattaatacaaatattggcacacatgggtgcgatgtttttgaccggaatgaaaaagttcaaaaggcaccaaaccatgatttttggacatattggagtgtattgggtgcgttcgtggcaaaaaatcacttcgtgattcgcgcagcgatctttcgtcaattaatgccaatattggcacacgtgggtgcgatgtttttcaccggaataaaaatgttcaaaaagcaccaaaacatgatttttagatatattggagtgtattgggttctttcgtggcaaaaaatcacctcgtgattcgctcagcgaactttggttaattaatgctaacactggcacacgtgggtgcgatatttttcaccggaataaaaaagttcaaaaagcacaaaaacttgatttttggacatattggagtgtatacggttcgctcgtggcaagcactcacttcgtgattcgcgcggtgaacttttgtcaattaatgcctatattggcatattttggctcacaatggtgcgttgtttttgaccggaatgaaaaagttcaaaaaacaacataacgtgatttttggatatattggagtttattgggtgcgttcatggcaaaaactcacttcgtgtttcgcgcggcgaacttttgtcaattagtgccaatattggcacacaangggtgcaatgtttttgaccg

SEQ ID NO: 2555 - DNA, 2000 bp, Oryza sativa
gcgattgagtcaggagcaagaaataagggaggcaaagtagacttccactgtgccggagacgtgtagttggggttgcggtttttttttgtatcttgggccttttgaaccagactgggcttttcctgagtttgacggcccaattaatttacctgtccctccttgtttttaattagggccgttttggtttgataccaaaacatgcctttccactttgttggcaaactgaataatatgtgtgttagtttggactaacaccaaatatttggtagtgcctaccttatttggtcatattctagaagtttctcctctatactataagagtttggttttatattggtagcaatccaaatattagctaaataactttaccctacaatattttgatagtgccggagtttacctagaatttggcactaccaatgaattcaggcgttaatatgcagtttactggtgtgatgagatcatgagaagagtgacacacacaggcacacgggtgacaaatgcctaatggttcatgtctccctatatttcacatttttactgcaaaaaagttcttttggacacacctctgtgtgcaaattgtacggcactctggctctttccctgaatggaattggaatcaatatcagaaagttgtatctgatgtcaaatagatcgtataccattaaggcattttaccatacgaacatctgctccaaaaataaatacgtaaagttcaagctatgatcagtgtcatccaaccagctagccatccggcactacaattgacctggcgattggttgtctaacgacggatagaaatgcatgaatgcgaagacacgcaaacagcacgttccaagtttttgccaagtagggatcatacgcattcacatttgcatagcaaatgtttagtgatgtgacctcttaacttaccaaagcaatttaccaataaaacccccacttgctgactggaccaagattcatatatcatgccaagcctaaccatgatgatccacaagagatgatcagatcagatcagatagaacatcagaccccattcttcactccggttaatctacaaaaacatgattgactgacgccaccccatcagcatgtgacatgtcacccgtccaacaatgacacagtttcaacaggtggacacccaaacacctcatcacccattgcatattatcccattgcatcgcatggcttcctcctcgtgcctatccagatcacctaatactctatccaaagttccaaacgcaccaaaagtgaacccaagaagcagcaacggacagtgaaaaaagaggagggcaacaagtcgacgacgatggcaagcagcaactgagcaaaatgcagctgatgacactagttacccaggtggctgtggcctgtgtggctcctaccatggtcaatcgatcgatcacttgccccgcgccggcatcccactcccacccaggcgcgggtggtcgtcacctactccaccaacccggcagctgcaggaaggcgctgcagttgatacgcttgtctctttcccatcattagctttcccccatagcacatgccgctgctcctccaatccacccatttctccctctcccgtaatgcaaaatacgcaatcgctcgcctgatcctcttcccctctctgtcgctcgctgttcctgtgtaacttcaccagttcactcccaagcgctatgcgaaacatgctgtcttgccccttgcccccgactagttcgttcgttaccaactgtggcattggtgtcacaaagaacactatgcaacgcaggcaggattgtgacgtgccacatgtagtttagcggttgcattgacttaagtagcatattcatgatagcaaattttagattgggttaggctaaatttataatttaaaaatattgcatatatccggtcggatgtagaggccgataaaaaatacccttctctaagaaaagatcgtgatgtgccctatgggatccacgtgtcagtgacgagtcatcctgggcgttgccgagctgttcgta

SEQ ID NO: 2556 - DNA, 1995 bp, Oryza sativa
  misc_feature (68)..(68): n = any nucleotide
tagtttctatcggattggcctaatcagccaaagaaaaaaaaccaaaatttaaattttcaaactttaanttttgagattgattttgagatattttcaacattagtttttaagtcacgaagaacacatatataaaagttttacctacaaatttatttttattccctaataagccgttttggtttattaggaaaaaagccaaacgatggggaccttacttcctgtttggaaagaaaacatgatagggagcagctcgatttaatttaaaataaaatggtagcaccaaaaacaatgttgtacacgtaagacactactatctcgtagtattctcgtcacttgtacacactctacgtactctctctggttctataataattaacgttttggacaaggttgaggtcaaacttttataactttaataatcaataactttaaaaatatttagtttaaagaaattatgacaacatatatagatttgtctttcaaagcactataataaaagtaaacatacatttatttattgtgtatattataataggaaaataaggtcaatgatatattttgtagaccgtgtcattgtccaaaacgttaattaaaatgaaaccggagagagtacatatttttctcccttttttttcacagccagttagcacaaagtgagtcagtcagtgacacagatcagctaccttaaccatcgctgttaggtaaaaaaaaggtaaacggaaaatctgccacgtcggcaccgttaccatcacagagagtccaaccgtctcaaccacctcttggcactaggcgaagatgacatccttgtcaaaaataataaataaaatgaaatgaaactgccctctgagcgctggggcccactgtcagtgtgacggtggagtccacgcgtcctgtcaacgtggcgtgtcagcctatgctgcgtctccgaataatctttttttttaattatctcaagcgaagaaatgataatgataataatgaataaaattaaaagtagtcaactgaagtgaagaggaaccggatgctactactgctagtagtcggccacgttacagaaaccccctccttgtcctacaaatttacagagcggcggagactgaagcgagagcaaagctggtcagtttggggaactttaaaattttgagatgtagctggttggtagcttcttagaacctggaaaaactgggtttctcatattctggtttccaattttttttctgaattccaccgccacagtttattagaatttagaccgaaagcttaactatctaggagagtttctgattctgggagaacctgtagtagctagaagatcccttaagagcaccctaatctcacaaaatttgtgtggtagattcatctgctctgttctgggtgagttcgaggagaaggtgattaaggagattgagaaatacgtacaacgagacgagttattagctcataattaattgagtatcgattattttaaattttaaaaatagattaatatgattttttaaagcaactttcctataaaaaattttttatcaaaaacacaccgtttagtagtttgggaagcgtgcgcgtggtgaacgaggtgttttctccctcgatgttacccgaacgaacgcagagcttggcatgtcaatctcgtcttcttgggcgatttttcttgtgatgttttgtattgatttctcaacttggccgtggtcaattaagttgtgggtttggttgagaagaaacttccccttctgattagttgcgcaatttcgttggagtttgtttggaaaatataggtttggatcactgtcaccgcgattgaatcgagcaaatgtggtctttggtttggtttggtttggtttgttttggaccatttattgacaataatttatgcctctaaagtttaaagtcagttcaacagaccaacggctaacaagttgttgtttccaagtttttggagtttagttcagtttgctttgcaacttttgtttttctcggtcaatatcatgatgtacg

SEQ ID NO: 2557 - DNA, 2000 bp, Oryza sativa
  misc_feature (1567)..(1567): n = any nucleotide
  misc_feature (1637)..(1637): n = any nucleotide
  misc_feature (1832)..(1832): n = any nucleotide
ttgtctaacagtatagacagcgctgcaattcggtgtcgtcggttaagcaagtccaaagggaaaataaggctcataatagtaatacccaatcaacgccagtacataactggcatcaccactagtttttgaattaccagcactttataaaagaaggaagtgatattagtgccagagctagcaattaatgatatttgaattccaaattcaaattttgtaatgccataaacaaatattatgtatccatctcttatggccagactactcgtatgtgtaaaacccttttaggagtactttataaatgctgtgcatactttgaatactctaaaaaagtatactctttgatattaggcagcatttctttcactgtcttgagagactatgatactagctagtattaatttacttgtgttttttttggtttcgtttgcacattcttcttatggctggttactttggatgttttacttggtacagatgtccaaggagaaccaaaggtatcttgagaaatcctgtagtctcaatgggtctcagtgcggcacataacaggattgattgcagagtttcaatggccggaatatattatgaatggaaaataaacaaggagttggccatacataccttcgccgcggtataccgagatatgcagcacgttttggccttcaggcccagagtatgacaatgttgtaggacttctatcaagcaggtcccgtgcaatctccaagcgccccagcgaaacggcgaggtacagcggcgaggcgccgatgccacgatcctccggaatcctggccagctccggatcctccgacacgagcctctccaccaccatcctgttgccgccgcggatcgcgccgtgtagcgccgtctccccgagcttgttcctggtgctcaggatccgtccgttggcggcgccgccctcgtgcgcggccaacgagatgagacggcagaccatggcatggtgcccggctctggcggcgcagtgcagaggcgtgtcgcctctgttgttggtcgcgcctagcaggtgcctcgccctgccgtggatcatctccgcgcactgcacgtactgctcgccgtcgccggaggtggccaccacatggagggccgaatcctggtccgaatcaagagtcaacccttccaggagaggcgacgctgctgctggacgatttgcaggttgaccttgttgagctagatcactactagtactactagtatttgaagctccctcctccggcatgcggatgacgagatgggattcagcagccgcctcctcatggttgacgagaagattctcaagcgccttgcacgcaccagatcgtgcagccatcagcagctgcggatccataatcacaggggaatccatcgcgacaccacgccaatcgtgctctggagagggagatcgtttagggcgatagcagtgcaggcacccgatattgagttaccccgtacgccagctaggcctagcaccgttgaaagaaacaaccttcaaaattgcacgagtgcacgtgacctcaaatagagcccaaaaaattttagcccacagtggtgtacccttgattgagtgtaccaaacngcagaaagaaataaattaccctaaactttcctaaactaaacccgaatctccttttcttcttttttttttnacttctcgaggcttcttgccatctctcgcgactcgccatctctatccgcacaaccgcgccttctccgcccgccgaatcgctcctcagctcagccacgccgcatcgctcctctgcgccgccttcgagcgttttttcccctcccccaatcgagcgaaggcgaggctcagtggcatgagagattgcgacgccctcacntcccccaactccaccagctctcccattgcccctccgccagcgcccctcctccctccgccggcgccggctcgacgacgccgcctctcccctctcatccctgggcggcgagttaacaagctccccagccgccgcgccgtttctccctcctccccatccgtcggcgcatcg

SEQ ID NO: 2558 - DNA, 2000 bp, Oryza sativa
ttcggtttttatatttgtaaaaaaaattgaataagacgagtggtcaaacgttgtaagtaaaaactgaaaatctcttatatcgtgggacggagggattagtaaccttcatccttctcctttttgtttaaaggcagtactaatcttcagaggaaaaaggaacagagaagaacagacgaacgtgccatgggctatgcagctatagcctactaataagtctatgactgggccatgtctctcatggaaaggaaaggtggtgccacagggaaaaggggtgatccatttgtgcccatttaaaaggaactcaagatgagtgtcaagattactactcaagctctagtctgtaatgtgagtgagactcctattaggttcaggatatgaagctcttgttccagtgtccctgctgctcatgcttctgcgtcatgaaggcaaagaagaacagcagccaaggcaaggaaggaggaggaggaggaggaagcaaattgcaagggggatcagtcatggtgaaaaactgaaaaccacagaccattagtagcttctgttgatccctgtcttaatttggaccatgtgcatgtccagttagtttcttcggttcatctctgttgctgcagcagtttggtagttagttttcatgtgctgttgattgctgctgccactcatctggccggccactgtcgatctccgatcttgatttttaagtctttatctagattttgttgatgtatctactatagtcaaataaaaaggcatcattatttaccttaattagagttttgtctggatttcatcccttgatttgtttcaagttactaccttgttatcccccctcccccagcgcattggtaaagctgtggttagctctgtatatttcttgtgctaattaaccagttcatggatgaacacttgcagaaaaattactgagcagctaggaggcgtaattaaagtagtgatgttttgtggatcagtttaaagtgttgtcatgctcaattagcagagcaaataggtgaagaaaagtgtgtatgctaattactgaaaggatgcatatgcatgggggacattggagcacgcctgcttaatttctgaaacattgatctgaacaattaaatttctgaaaaaatgatctgaacaacatgaccagatttcacataagtgctttctgtccgtgcatcatggatgccatgactggctattttcttggcccatgatgatctattaatgctgattctaggattcaaaaaaaaagggattgctcacatacaatatttgcaacaaagaaagtggcacactagcacatataatggcatttggtttgtgcctaatcaagctagcctagtataatcacttcacaattccctatagtacgtagtttttggttacttgtcacaattgtttcttagcttcatggcttacatatggcgcgccaattattttactacacctacgtattttgtcttgatcttaatatactagtataaaacaaacgagtataaccatcacaagtttttccatagcaaacatcttagaaaatatataaacccaacgttaattaatactacattcatattttaatgtacgacgccgttgatttttttatccaacgtttaaccattcgtcttattcaaaaaatttatgtaattatcatttaatttattgtgccttgattcatcatcaaatgttctttaagcatgatataaatattttcatattttcacacaaattttaaataaaacgaatggtaaaacattggtcaaaaactcaataacctcatatattaaaatacggagggagtaattagaaaaaccaagtcctctactaggaatgggctgaggtgacggtccaagcactagacggcccacaggtcggcgcgccttagcccggcccattgatccacgccgcggacctaggtgagacggcccaaacgcggcccgtttaggtttggggtttttggcgtggggagttggggggcaaagcaagcgaagcaaagcagcggcgacacggcggcg

SEQ ID NO: 2559 - DNA, 2000 bp, Oryza sativa
tgatgaaccccaacatgtatgcatgcctgataggtttaatttgggcactggtcggcttcaggtatgttaatgagtttatatgaatcaatttggcttcaagcagaaatgcagctgttattgacttacttcatacaactccataacatacccacaggtggcacataagattaccgttgattgtcagcaattctataaggatgctctcggatggagggctgggaatggcaatgttcagcctaggtaagaatagcaggatatctgattcagcttgatgcaatgcagataaacttctaaatacgtctaaactttgcgaaaaccaattatgttattataaattctaaatacttctaatcacaggccttttcactgctctacaaactaaaattatagcctgtggagcttaaaaggatgctactagcattagccatcaggttctttctaggaccagcactaatgggtatgtcttcttatgctattggaatgcgtggagtattgctgaagatagccattgtacaggtatattctagttctttctttggacgagctattatttgtaactttgaacaattcaaccacagaaattacgattaacctgtcaaaatcacattcaggcagctctacctcaaggaatagttccgtttgtgtttgcaaaggagtacaatgtccaagcagatattctgagcactgcgtaagtagatcacctaccacgatacgatcctatgcttgtatatatgaagaagcagggaagcatcattaaccaacaccttacactgatctctcttatggcaggataattgttggcatgatggttgcagttcctgtggcgctggcttactactttgcaatgatcatcccagctatcaaataactatttgcagaagctagcctgattgtgttcatttgagaaaacaatgacggctcgctgtggagaataagttcagttatgagtgaatattttgctagactgtatatatatgtgcccttgggtttgtggtgaaccataataaggatatctgatttgtatcttagtgcatagtggccatacataattcttaccgtttcaactatgaacaactctaatgaaccagaacatgtagagaaagctcacattccccggcgacgcggcgtgctctgttcctgtcaggcgctccgtccaacagacggtgcaccgtgcaccccgcccatgagctgctggcacccctgtggggcattctgccgaacatcttgcaggcgtacccagggctgaatagcagattatctggctcagcttgatgcaatgcaacagcagccaagagcttcatgtgcatcaaccatttcttggcctcattttttcctctccggagaacaattacatggcaatatggcattcacacaccgttcccttccaactgtggtgtggaagaacaaacagttcgcttcaccggcagcgtggaacttgcaactgttcgacattttgtagttgggaataagttcactttattaccctcaaaactgatcgaaatcgaccctaaaccacaaaaccggatatctcgacccccaaacttttaaaatcggtgtaatttgactctctaggcggttttggagggcggtttcgctgacgtggcgcctacgtggcagtattgactcggtattctttccacgtggcattgacgtggcgcttagttggcattagaaataaaaaaattatgcatgggacccattagtcattcacacacaaaaaattgtggggctcactgacatgtggaccccacatgtcatcctctctctgcctttcttcttcctcccctcttcctcccttctctctttctttctctctcttctctccccttcggctggccgcagggagcacgggcgactgaagctggagtggcggcggtcgggggccagagcggcggcgaccgcgggagctgaagcggcggcggcggcctcgccatcggcctcaccaagtggagagaggagaggagaggagaccaggtgagggaagaacggaggtggtgggt

SEQ ID NO: 2560 - DNA, 2000 bp, Oryza sativa
  misc_feature (842)..(842): n = any nucleotide
  misc_feature (847)..(847): n = any nucleotide
  misc_feature (908)..(908): n = any nucleotide
  misc_feature (1203)..(1203): n = any nucleotide
  misc_feature (1224)..(1224): n = any nucleotide
tgtgtttttcactaacaagccttagctgcttcacatttttttagcatatgtaaaacctcacaagtgttgcgtgcacacttatcaaattatttgtgtggctctgtcaacaaaggcgactaattaaacagaacctaccattacaatgaaccaaacttgcagccccgttcaatagcgaaaagagaaaccaacagggacatagattttcaaccatctaaatagttatcaatttttttaaaaaaagacaacatagattagtatatgaaaatatatcactgcacaaacgacttctacaagttataacaaaaagaataaattaaactgaaaatagttatcgtacattcgcatctatatttgttatttttgttacaacttgtagacaaagtaaaattttaacttgcgtgtttgtggattgatataatttatattaatctatcttaccatttttttaaaaaatttatgactatttatatgacatacaggattatcttcttctcgagggataaaatcattttcccaaaccaacaggaggagaatcttttcagctgcacctaggctgaacgtaaaccaacaacaacaacaattaatctgatggcctgtaacttaacatacctggttcaatcttaacacacaaagagacacatgatcacacattccatctggacccgttttcacttcagcaaagatgaacttgggaacaagctaggtcaggaggtgtcaatgcaagggtcccgtagttcgagttcgaggatcgtacgtctctcatcaaccacgcacgccgacgtctactccccgcgatccggcggcggaactcgtcagcgagcacagactggcgccgggaattnacccnaaagggaccagcagcgtctgctacttctttctgctccgggagggtgggccagcgcgcgatnggcggcgccggcggcgagagcgtgtggaagtcggagtgtggcaagaaggccgtacgtacgtgagcggcgccgatggccgcctcgagcgtcgggtacctccagaagttctcccctacggtgtctacgtacgagccgtcgatcgcggcgtcgccgtcggggtcggcacgcacgttctcatgcacgaggcttgggtggtgcatgaccgatcgagtacggcctcgacgacgccaccgaacggagcgcgcggagaagcatgcaggtaacgtgctttgcaatgtgtgtgtgtgtgtgtgtnatatatatatatatatcgctngccgcgcgcggtctgcgtggaggcgcgcacggcaaaggcggcgtattattcgtcgtgccgcggctctccaagaggatcgaaggcggacgacggcgtcgatcacccggccggaggcgccaccgagtgcgcggccgcagtaagaggccgcgggagcgagaacgaagagcagttgcgctagctcctgccggagttggacctggatgtgcgctgctgtccgcctgtaccgcgccgatggacgacgacagcttgggaatggaattcagcacggccacacgataaaacaatatactccctccgtttcgaaatgtttgataccgttgactttttagcacatgtttgaccgttcgtcttattcaaaaacttttatgaaatatgtaaaattatatgcctacataaaaatatatttaacaacgaatcaaatgataggaaaagaattaataattacttaaatttttgaataagacgaatgatcaaatatgtgctaaaaaggcaacagtatcaaatatttcgaaacggaggaagtacgaagtacgagatatatgttgaacgacgacgaacctttgccgtggtctccgactatggaagtagctagctgcatgagaacatgcatgagagccagggactgttgctagctacgtacgaatcacatgcaacgcatagcaaccactctgcctatcgtatgctttttaatatataaatgctgaaatttcagggaaagaaactgaagaaaaggaacgatttttcctatagaggtttttaaattatatgtgctcacc

SEQ ID NO: 2561 - DNA, 2000 bp, Oryza sativa
gcgtaactgccaaatcatccaagtaaggaaatcgataagcacgaagatttctctcaaagacgagaatatcattcagtcttgagaaatgcatgtgaatgaggagccggtataaatcgtaggaactctttggaagaacgaataaccactgggataaaatgccccaatggagcttacgttctgaatatatcctccttgctcgtaagcaggaaagatgatatttctccaaactgaaattaacataagatcattggttcacgaagggtagatttcgcagatttgactgaacacagataaactataaacgaaaatagagaactggatgcggttaagcataccacttcggaaaagtggaaaggcacggtgttaaaccataggcctttaacggaactcgatcacttattagaccgatatatgaacggcaacctctttagcttttccactccctcaccacaccaaccactgtgtgatactgaacacccacacaatctcgatttaaaagagagagactgtaaggctagaattggttcacacatatgtgtgggggccggtccaatcactcggtagatcacgctattatgtcaccttcattgatgatgcgactcggaaggtatccagctgttacgaactatcagatagtcaagaattgacaggaatgaagggaattgatttcagggatcagataaagagggaatttatgaaataagagttacgagaacaactagtcgaacggaagcattagtttctctacgagatggagatggctcattctctagttttcctacgagatataagtcagtttctaacgtactttgaagttcaggaaggagttattaattaagacgaagaagaaccctcgcttggctttgtcccgaaccaaggaggcatgatggcgggcgcgtgcgtgtgccgactgcagagactacaagccgacgccggaagcatcgctttctttcttctccctccattttattcactactaccgcttctacacataaatcaaagaagcattgtggaatagtggcatttcattaatgtcgaaaatgttcttagtgaaagggttgccttccttcttttcaataagaagaagtatttgaaatgaaacaaattcctcttcattctgttgtgctcagcgaaggaactgcgtaagcatacttttgcggcaccattggccgaagcagacctggaagctgatctgcgagtgaatgaaattgaacgattaatatcgcctttcatgctaaaatcggacgatttcgaccttacgttcacgatactccttcctgtccttgcgatgtttggttaagtgttatcaatcagctttactcttcttccagcattcttctaaggtttgcctctaacgatggttgaatagctcctgttgtttttattccattgaattgatttcatgaacttccctcaagctgaaaccggaacgggattgtcatttagcttcaatttcttcagtctcacaagcgggtccgcatgcaacaaaagaaattgtatttgcctactactccgacctcaggaatgcaagcaagcgaggccagaacaaggagtgtcaagaaaaacagtagccgtttactcacaagctaacacgaagcacgaaacacatggattctctgagaaccggactgacccaaccaagcaatcacttgagccattcacaccttggaagagctattcaaaggttttctggctgactatgaggacacctctgcatcccaggagcagaccgctcccccggaatctgtggtcagtcaagagcggcatccgaatcccgctccgattcaaccttgaccccagggatctcctctccccaactacactaggctcaaggtggaataacgaaaggagggtgcgtgcgatagctaaccgattgaaggaaattcctcgcctatcttattctttttcagttccgatcatcattatacgatccaagtcgtggaaaagccgagtgggaaagccgaaaccgaggtaacttaggcgtaggtcaaagcacgggc

SEQ ID NO: 2562 - DNA, 2000 bp, Oryza sativa
  misc_feature (1238)..(1239): n = any nucleotide
  misc_feature (1270)..(1270): n = any nucleotide
  misc_feature (1492)..(1492): n = any nucleotide
  misc_feature (1518)..(1518): n = any nucleotide
gacgattatatacctactttgttgtttgagattaattatctaccccgatagagtccatcattatgtataaacatttcaaccattgttgcttacaccaagggcaagggcatacaacagggggaagaacatttgtgaactgtaattaatatcatttctatcgaagcatgactctatgtcaggaaaatactagaaaataggtgcgcctttggcgcaccaactaaaaataccttgtgaatatttatactttttaggatataaaaatgttgtagagttatttagaattagcttgatttcttatatatatgagatggagtaaaaataaacgaagcgacaataatcggtgatatttgtgatatttctttttgaaatacaaatgtggaatatttccatttgggaaaaaattctggaaatgtttatttcttggacaaacatattacacttagataaataaaaactggcaaaaaaaatctaagcaagtagaaaatattaatgtggtagtatgcagaatgttttatttggccaactatgtaaacgcttcacatgcaataccatttagcaaatcttcgatataattaacaaatcttcgatattcacattctagtttactccctccatcaccaaattaaaaattgtcctaaaataaataatagggcttatttgattgaaggagaaaagagaagaatgataagatgcacaaaatgagataagtcatcagcgtataattaatgggtattaattatttcaaacatgaaaatggattaatatgcttttaagatcacttttctagataatttttttggagtaaattttactttgggtcaccttttattaccgatatttcgcatttgatcaatcctttaaccaaatgttttcactttggatcgggtaatattgcctttgttactctcttttcatgcatatgaatgaccttgagtacttctgctcttattcgtcaataaactcccttgattgtatatagattgtttctttgatatatgacagtttagatgtatatggataaaacaactaaggatggtacaaaatgctaaggtaaaagtatctgatcgaaagtgaaaaaattagttaaagggtgattcaatgtgctttgaaacgccggtgataaaaaaaagtagcccaaggtgaattttactattatttttatttgcaaaaatcacacgatttatcatttttttactatggaacccatagatgagaaaattaattacatagataccctnngagcccactttgcattctaatttactccatncgttcaaaaaattctcccttttaggtttaaaatttatcccaaaataactaccacttaaagtgtgtgtttagtaaatgagaaagagaaccatgatatgatacacaaaattaagtcattagcgtatgattaatgatgattaatattttaaatcaagaaaatggatatgttctttatgtaaatttcctataaatttttcttttgagaaaacatacgtcatcaatnggttcgggtagcatgcatgcggaaancaagattttcttttcaccttctcacactgtcgaacatagattaatgtactcatcggttatccatattccctaataaaccaaaacggcttatttaaaataaaaataaatttttaattaaagcttttatagatgtatgttagtgacttaaaagttaatactgaaatagaaacaacgttgaaaatatcttaaaatcaacttcaaaattaagtttgaaaattttaattttagctttaactttgagttattagggcaaccaataggttataagtaatataggggcatctgatatgtcatttttatatatatagatagtactatatttgtcatcttaatgcagccttaaatgagaaaagaaaaaaaaaggaaaaggaacgcagatcagagtactactgctgcgcatgttaggaacgagcagcgttcttccaccaggccacgaccattcgtttccaatcccataatcacaagtcgacaagcagagacgg

SEQ ID NO: 2563 - DNA, 2000 bp, Oryza sativa
  misc_feature (255)..(255): n = any nucleotide
  misc_feature (266)..(266): n = any nucleotide
acattattcccttgcgactggaggtaggcctccattcgtgccttccaaatgacaaaattgtgtccatcgaaaacaaatggtttcgcagagtatttttcctccatagcggcattcgttgccacggttaggttacaacgaacttaaccgggctctgataccaattgaaagaccaagaacggctatagagtggggggtgaatatagcaattcaaaacttgtccccaaaaatactcatcaagccggatttctcaaaatncttactagaancgcggctatagagaagccggatctagaaaagaagagagatggaattctcgaatctagaagtgaggtgaggagaagatagcaaaactcgtcatcgcgaaattcaaatcgcaagcggaatttaaattgcggaatttaaaaggcgaagacaaaacgaaatgcttcaaatcattttattcatcggtgttgcaaaataaccgctcaactaggagcaaacatacacctttagaggaacattaacacaaactttaaaatctctcggacaaacacactccaaactaatcctaatacaaaagcctctcgggcaaacacactccaaactcacaccgaaactctctcaccgagcatctcaaaaggattacaaaagaagcaaccttcacccttgcatccacctctccatttatagcctaagacctcgtaagacattgtcacaaatgtctttagggcgaaaccctaactcagatgcaatctgggccttaggttgttccttacatcctaaggaagtagcctggattgaagccacgtcgcttgccacatcgggatcctcttttcacaaagagtctgcaccaaattcctcccatgtgcgtgcccgcgtgctcctcaacgtgggccccgtgatctgtgagaaggctcctctgagccaatcagcatgcaccgatcgggagatcgatccgcgtcgtctccgtcttgccgaatcgaaacttgccacgttgcccagccgtgccatgcgcgtcctgtctccttttcctcagcgcgcgcgcatgcccgcgccctgtccggagccgccacgcgtctcgccgagccgctccgcgcgcgctcgcgaaaaccgcgtgggtcccacccccgtgcgcaccgaattccttgccgccgcgtgtccactgcgcgcgcatgcctcgcgcgatttcccgcgcttgcccatgcatggtgtcgatgccatgggccgtcgtcttgtcttgggcctgctcggcctggcctccctgccagctgatccatccatcatcttgagccacgaagaagggctggattggcttggcctccctgccaaccaatcacaacacacatgcacccatgggctagcaagctcctcatgcacacatgcatgtcttgagcccgtgcatggcattcggccatgtgcacgcatgcataaccgaagcaccactgcccatgcttggcatatgcacataccagtgcatgtatacaagctcctcttccattctccattttcttcgcgaacccggcacttgcacttgaccttgcgaactccgttgcgaagacctcctcacatggtgtccgtccaccgtgtgcaaccttgtgtccaatcttgtcacccagcatccttgatcgctctggacctcaactcctccctgagtctagtaccgatccgtcgttgactaagatcgaccccgatcacctgcacacacatgaatcaaacaaccgttgtcttggcacagatgtcgcaacctgaccaatgttagtctacgcacacacttcttgcacttccggtacttgtcaatttcccatcacaaaagaactataaccacacatggtttcacatcactagagtcttgaatagggattccttggaaaattttcagcatagtggataaatccacaaagctactcggctaattgtggactatgcaagattgttttggggatacgagggcttgttgcgtcacatcctgctttccaaatgggatcctcactcggacgaccgatgctctcaacttccgatca

SEQ ID NO: 2564 - DNA, 2000 bp, Oryza sativa
  misc_feature (879)..(879): n = any nucleotide
  misc_feature (917)..(917): n = any nucleotide
  misc_feature (946)..(946): n = any nucleotide
  misc_feature (1357)..(1357): n = any nucleotide
  misc_feature (1993)..(1993): n = any nucleotide
  misc_feature (1997)..(1997): n = any nucleotide
cagacacttgtgtcattggtatcgatattttcttttaggtatgcaaataatctacttgtttgtctatcagcacttcagtataaagaggtatgctaccattgacaccaaacaaagagtagcctggtttctgtatacccacccaagcctaatcctctaagtgccgttcaaaccgttgctgtcagctccttaaaatgttggtcccccaagttaatttttttaatgaaacggcaggaggattggcatttgattaaattagcaaggaagtaaagattccaaaatttcaaagaaaatgccaaggggccaagaagacagtttacagttgttgcctttctagtaattatctagtctctaaacatgatgctccagctgcgtacccaagcttgcacatttgaccctaagttatgtcttctgagaaggattacacaaattgaaaatttcacactagtatcatataaaatacccaaatgtacactatcagtagatgtgaaatgcgtacacgcatacatttgaaataaacaacgtacaagacatctccatgcactcaacgccactcgccactagttctgagttctggccatgcaagtagcatattatatactctcccgagtcaaagctctcaacttacaatattgagaagatgggggccagcatttacctaaggtttggcaataggacaaatggcattatttgttttaatgggaatatttttatgtggttcccaagcttatcaagaaactgatgtgtccactccccaaacagaactacagaagcagacatccggttccaatattagcacaagaccaaattacaagtatgtgtcagctttcaaaccgctcagctacttctcaacaaatatatgactgctatcagtaaatattnacatagcattcattgatctcacttagtctattctaganggttgaaagaaaaatttctgaaaatcccngaagtgatgccctataattcatagctgtgtatttggcataatttactaaaagaactttgttttttttctcagaagcaacggaatgctatgtacgaggaatcatcgtttgagtactacagttttgttacctcagatctcctgggtaatcatctgtccgataaggaggagcgcagaaaataacgtacggaactttctgaacagctggtcctttcaaggagggaatgatcccaagttgagtcaattcactgtgatgatctgtggttgcagtatgaccaaaaattttgcaacctggatgctcctgtaaaatatgcaaagctatcagacatatttttacatctttactagtagaaaaggaaagcagaaaatattatcagcaattcagcatatataccatccctcacattagaaacnaaaataggaattccattcagaaaccatcgttaagcaaggaaaagataaccataatcctactagtcggtgcttcactacaccactgaagattatctttatgtgtttcaaccatgttaatcatcaagtcggcaatgtacaatgaaattcttgatattcagaaacagcagaaaagcagggtaaagggtaccaatgcttaaaaaaaagggtacaaaaagcaataattaacctgctgccatctctccgccacaatccggccaagcacgccaggcccaacaatcagcagatcgtactggccaacgccctccgacgcggacaccgccatcgccgatgcctcctgagatgcgcctgcaatcccggaacgaagaggaagcgaacaaccagcagtcagtttcaatcggataggaccaaactaagcaattaaccatcgcagtcttgccccctccctcatggattccctatcctatacgtccctcgccgatcgagacctgccggattggcaaaaatcgaggtagaagcagaaaagagcaatccgcaaccagatattactaaactaaactaacccgctctctgtcaagattgggcacgtacgtaccgaggggagaagcggcggcggcggcgatggcggcgtgacggganggcnggg

SEQ ID NO: 2565 - DNA, 2000 bp, Oryza sativa
  misc_feature (758)..(758): n = any nucleotide
gcagaactagattcatccaccattactctttatcaaatggttggacagccatcaatgaagtctaaataaaattaccaaaaaattagctcttttccttcttgttgcgtggcaaaattagtattaacaactagctaagcatctaaaatattgtcaatcctgtgcagctaccttcatctgtgagttcaaggttaaacaaacaaaaaaagttcatggtgattctgattccaaaggattgcgtatagtaatggatactaactggatgtaagcggctggaattttcagaaatattatggaaatatcatacagatgaacatgatttagctacaccagtgctatctgaaatgttggcaaaagcaaatgcacaaacattttgttactgcgatatttatatttctggtgaaaagggtataagaaatggatgacctgcaaccgttggtgctcaccattacctgctctgcagaaatcctttatacaaaaagaaaccccattagtcaatggagaccaaaccactacactagaataagcaatatatgacaaatatatggtactgcatttcaaagttcactagccatacaagggaaatggcaaggtgaacattgttagcagaaacatataaatatgaaacttacctccatgtcatcaacaaatccttcgatagatcgatacggagcataaacaatcagatcaaaatctaaagactggaataaggtaagaaatgtaatgtcatgttctgctggtttggaggaggtaaaatgacnaaaaaatggaaatggcatactttgagaacaatcatctcgttatttagaataatctggtggtcctgttgaattcctttaccaagttcctcagcagaaacatgattttcttccactttgcaagaagaataaatacaagttaacctgtcaagtaaaaaactgattaacttcatatctaactgataaaaaaaatacaaactgaatcatgaaagaccatgacttgcagaggacattatctcttcgagtaggacacaagaaaaggtaatttactcatcaggttatctccttttgtacgttccaatctatagaagatttcttataaaagtgttgcttacataatatgctttgggtgatgttccattacagaccattgcagataaaatctcttgaaatatattattgcggtagcctacagtgcagcaataagagatttttagcgcaggatcatgaggatagcaaaggcacagagtctcggaagaggagtgctttacctggattttgtgagggaacttaaatgctgaacatacttcttgaatcttttgctcataaaatacccgcatcaatcgctcctcttcacaagacagaggctttacacctgagctccctacaactgaataaaaaacaaatgcttcaatactagcacgcttagatgcaagtagtccactgaacaaactcccatggaaacacagaactcgatgcatatatcgtccaaagtagattatgcgagaaactactaaagcagaaaactttgaagtgaatttcacatgaggatgctaatttggatggtaacacattgcgcatctagacatataatcaatcagaatcattaaatgaaatgtaccatgatcaggcgcaggttccgggtacgacagcgacccatcaacagggtccaccttcaaccgcgtcgttccatacttcaccaagaaacaaaaggaaaaaaagatatgagcacctatcatctaataagctcaacaagggagttaggttcagagcgccgggataacccaacctgaacgagcgtctccgtggcccgctggttcgccgccccccatctatccatctgcaaagcagagagaatcaccagcatcacaacccacccacggcatatcatatcatatcacatcccaaagaaagcagccctggcaaacaaaccgatgaggaagcctcaccagatcgttcgtctggaagatccacctctcccgatgcgtggaggtccggaaatccgccatctctccgccgccgcgg

SEQ ID NO: 2566 - DNA, 2000 bp, Oryza sativa
ctcgtaattgcattgttgaataatttctcgttaacattaatatcttccttttttgttatctacactcagtccctcaccattagttaattgtatacaattattcatttattgtgctgccgtatataacaatgaaattgccactctgctgttgttatttcaaatttgtgtttatgcattgaataaacaagcaactgaaaactgctgcgatatccaatgatattttggcctggtttctttctcagccgttaggtttaatatttagaagatctatgtagctcttgtcactgatgaaagcataccatgcttggatggttcaacacagaataaacagtattgctaaacagcaaaacatggatcattcaagtatggctttttgtgcagtacgagttataaactgcagctgagttcttgttttgtaccatcttgaggcttgagccactatacaaaattaatcctagaagggtcctggcattgtggcatatgcaaagttcatatgaacactctatgaactgtagacagcaaatatgataacatctgttttttaaatgataatgtttgattaaatttctattttcaaacttttagatgatatgttaaattgttaattatctgactataatactgttttttggtatctaattatataagtcagggtttttttatgataattttacttagatttacatagagtatagaccttcatctcctgactcttcgggacgtgtactggtgtggattttgacacaatccatgcactacggtgaacgaagtattacagtgctatacactgaacacatattggcatacaatttcgaatataaactggttggttctcacatgactagtttatgtagcgttgcctatagtggttctttatattcaatgcaataaaagcatgtattcgaagaccgtgtatctttcaaagaatatgcaagatgtatcatcattagcaactatatgtacatcctcactcttcagccaatatattccatgtttgatttgcatcttggggtcttctgctgcccaaaggatcaattgctttttttttgggtgcaaacgaagcaaattaccagcatgctaaatacctaggaatttccacttgcaatggctgagtgtcaagctggcaagcatcatgttaaaatttatgaaatcttatttcatctggtgtcacttgatatctccataaccaactgggaagtgggagggaactatcatgttatgccgtgatgataaagcccgaatcacccttcataatccgtcggaataaaattcaagttaaagcaacattctgaaatagctctaactgttagttctatgtggcagatgattattctccttggtaaacatcaatggaaaacaacacatttgatcttgctaggaacatggaaatacatgctttgtgcagcacctaacaattttgaactgtcaatatgcattttgtcattttaattccatgaagttaattgtgtaaaatgattcctagctatttggtcttacccgtttctttttttctttgactttagattgtaaccatgttggcttttgccctgtgactggcaagaacagtattgctgtcaacataacatgaacaatatttagtatgctattagtgccattagcatgcatgctattacctatgcaccatgcacgtcacctgtgcacccatggaatgtgtcgctaactagtcacctaccgacctcacatttgtgtttctttaggagtattggtggtaatatgtgataattaatccaatttactttccaagttcccattgcagtgcttgtattaatgaatttattttatatatgtgctcaccttgtttccatttatgaattattaggcggggcttaataagttaatatgtgataattaatccaatttactttcctttacacttcatgtagttatgaatttatttgatatatttactgaagatgctcttcatattgctaaacctatttgcctatatgaatgtgactatggacttccttctggaatag

SEQ ID NO: 2567 - DNA, 2000 bp, Oryza sativa
ctcccctgcacggagatgtgttgttgagggtgggctgcttttcttttttgtatttgtgtggagtggctcccctctcaagtttagtttagtagtatctagctggtagaataggaatagagtagaaatcaggagtccggtggaatcttaggtgtatgactctacgaacaaaatttagatcttgctacccacggttaaataattatgtgctcatagttggtgcatgcaaaacccaaaacatacttccattattataaacacatacagagactcttgtttttggtgttttttgtgtcacgttagcttcacttcaaggttaagcttagcataacataccaagcaactttgacaaatcttggtttttcttccaatttctcaggcagactatgtgttgaggattgcactgcaaatggttaactccaaaagcaaaaggaactctaatccactacttccacaagactctagcactcctgtcaatctgcaacggcagcatagggttgcaggtcacaacaatgggcttgtaataatgcaaccacatcataaacaagcttcagatggcatggttatgacaaaagatggtaatcataagaaaaaaaacattgttctccagtgcaaagcaccacaaataagaaggcattgtctagtactaaagccattctcaaatgtgcaatatttaccttgacatgttatttttttttgtccatgaataatattttcagcacaaaatttcctttgtggtagaacatggagcattatgaattgaatttttaattatatatgcccttatgcctattttagaggtttaaatgacctgtacctctttcttccttttctatattaactaagaaaataatgtaaattagtgaattttacaatatttagcataaaaagtatgaaaaatgttgcgagcttgtgtattcttcattatttgagtgtagttatataagtttaatgatgtttaattattcacattctacagcttctaaaccagactatatttgtgacatactgatttaacatacacattttacccataccgttttacgaatttttaccacattttacccaaaagtttcatgaacaatccatagttatgtgtaaaacattctagcactctctcactgaaagagcacacacaatttaattttccgcttgacacctttatttttattttttattttgaatgttgatactttctcatgttgttctactttatgcaaaaaaaaaaggaaaaatcacttttgtatcagatgcaggccacatgttggatcaaggaagctcgataaatacgaggaatgggagcatcgacagaatcagcaatcttcctaatgaattgctatacgccataatgtccaccttaccagctttggagcttgtgtacacaggcatgttatccacacgatggagacatctttggacctcatcagcatacctgaacattgatgtaaatcagtttggaaggcatagaggccagaagttctgcaactttgtcaaccgaatgttgcgccaacgtggctcttctttgttggatgctttgcgcctccactctgcagatacaagagatgctggctcttggataacatatgctattaagagaagcagtaaagtggttgagttttctgaagatatagattgtgaacctttcaagttggactatggggttgtggacttcacttctatatgcctgaaatttttggtccttaacaatgtttgtattgatgccaatgtcttctatcccatcaactcttcatgcccagcactagaaaatttggagcttagggactgctctttggaggtccctgaaatctcatctggttctttgttgcacctagatatcgataattgttgtctatttgaagatcttctcatatctagttcaagtttaatgtctttgtgcataaagaaccctcaacacagagctcctatgatcatgacattgccatgcctggaggtggcaatagttatacttgatgagttttttcattctactgatgatttagcgg

SEQ ID NO: 2568 - DNA, 2000 bp, Oryza sativa
catccaatgcccccaattttattcacacaagaatgtttcaggaacagagaggtaagaacccacaccattcccacataaaaatcgcaagttcaataccaatctgaaacatctaaatcacctaaagaaactagagacacttcacattctcacaaacactatgtatctacttgatcaccatccttcactttgctacagaaaatcttgagcatgcatgatctgtatgttgaactcttggatagccaccatcaggctacctgtagtatgctggctgtgcctgtggcgcatacccaacataaggcggaaccggttgatcgatgcgagacatctgctgcattggaggcactgtcataggtccaaacttgccgtccctcttgtccatctcgaccttgtgctgtgtctgaatttacattttgcagtttcatcataagatatcaggaatttaaagcagtgagattattcaggaggaaagtaaaaaaaaaaatgtgccattacctgcatacaagagcaaaccctgcacattgcaacagataacatcagaaatactggtaattggaaagaaagaaatcagatttcagaaggatgaatacttgagttgagagccttacgtccagtagaccatgttagatatgcaggaaatcaactgcgaggcctcggaaagttcttcgctgccaacgatgcaagcgaccagcgaacagatgcaggcgaattgttggagacaaaacatgaagccctaaagtaacaagacagctgtgtttaatcgcagtctgaaacaaatcgggtcgagaagagtccagtgtcttagctaggatttaaagtaaaagtggtccatctatatgtaatatatcaattaaaagggtgatccactatacaatttttactatattaactagcacatatactataatttcaaatttttaggtggtccgtggaccacggtgccacctagctggctacgcccctggaagagtcggatgaacaagaggggagtgatagtacaatgatgcagttgtcgcactgggttgtctgaatgttgaactcatcttgcagcaggaacctggttgaagccaccgagttaccaaagcagcagaacacctgaaacaaatacagtttcatcagctgaatcggttcagcttgaatacattacatgtcaagatcatgtagatcatcgaactgattcagctcgggtggctacagtacgcagatggctacctcggttgcaaggcacacttcggggcagttgctctcgccgcatctcccgctgcatggcatgtacccagcacagcacacatatctgaaacacacacacgcgcgtgaaagggacttaagaacagagaactgcactgctagttaactatgcacgatgaacaaacatatttattttttctagagaagggtaatttttacccggtctctatgtccaatcgaatatatgtagcctttcaaattgaaaacttagcccctcaaacccaatttgaaattcgctcatatagagatttaaacttagaaccttggggtactattcagattaccgcaaccactaagctacatgccctttcgcatgaacaaacatatggtggaaaaagagcaaatttacctcgacatgtcattgtagagcgcacgtttgcgcagcatgtaagacacacatggtccgctggataaggagaaatggatcagataagaaacatgtcagacttagcaatattcctaagctgaagatcgatgcagccatgaagagattcagaaacctagatgaacaaactcaccaccacagagacaagcagcagcctgcagggaaaaaaaagatagagaaaattagatcgactcccaaaaatcatcagaaaactagcactatcattttgcacagggatgacgaatgctcacatgtgaagtcggccgtgatggcgttggtgaggtcggtgtgccagacgttgcggtagctctgccggagctgcgccttgtcgaggtacgcctgcgacgccgccatctccgtcgctcgccgg

SEQ ID NO: 2569 - DNA, 2000 bp, Oryza sativa
  misc_feature (173)..(173): n = any nucleotide
  misc_feature (178)..(178): n = any nucleotide
cagcttattacagcatcattgttcgttgatgtgcatgtgatgaagtacttgagttgagacattgttattcttttattccctttttacacacagtattcagtcgcgttagtctccttcgaatatgggggtggtgagataacggatgacgctgatgataactattcgatgatacnaatgnataaactaagcattgtaaagttaaattttattttaacaaggtttcctaaagaaatagaggactaagattttttttaagagagattgtaccgtcgagattgaacaaacgcgaactatattactactgtagccgttctacgagcttagtagcactcagagtttcctaaaccgtcgggaccggggttaccacgcggtaaccgtgaaccgttcaaaatttatcaaaaatttaaattattttttaaatttatttaaatttaaagaggttactgcggtatttctattaccgtacctcggcgataagaccggtaaccatggtaaccgcatcgtttatcagtaatgtaaaacctggtagtagtagcctagcagagtaggttgtgttggtggtcacttgaaaaattgcgattccatgggctgatgcccttacgtgggcccaccacccacccctgacgagtggggcccaccaggcagcgaccccatcacacgtgagaagtccagtccacagctcgctccatcgctgcgatttgcaacacggcgagacggatcaaacgggcgcctgcccccacgaactagacaagcagcaggtcaagcacccaacccaaaatcccagagaaaaacacacaaacaaaaacaacatacaactgcacacaccctgccgatgcagcgaacgtgtccaaataaattaaaaatcccccaatcgatcaatatacgctgcaccacaccacatactcaaaagaaagaaaagaaatccccccaatccccatttccagcgaaatctaatctaatcatctaaaaattcccttcccttcccttccgtccgagccagagcagtagtagtagtagaagtaatgaggaaaagaaaacgaaaagcgccaagaaaacaacgcaccaacacatccacagcagcagcagcagcagcaagcatcatcggctcaggcttcatcaggagaataggttagatgtgagaggaaggaaaaaaatccgaggaaaagtctcgagcccaccccccacatctccactgctgcagctttgcttgctcgagagaaagaaagagagaaagaaaataaaataaaaatctctcacaaatctctctctcgcagccgtcaaaatccaatcttggcgcatccccggccgcctactgttctcgccccccctctctggtaataattgtcaggctggtggttggtttgctgctgctaataatcgagtcttttcctcccaaggagaggcgttcaatttcttggtcaggatttgtggaggtttttcttggattcatttcgtcatctcgtcgcggagccaaagcttttggtttttttttttcctttggttggtcttggctcgatcgggatggatgcggggtgggttgggctcgcgtccaattcgcctccaccaccacaagtacgcttcttttttattgtttccggagtggggattgtagagagctatttcggcaatcgctagggctccgtgtgtgttctctctcgcccactttactctttttttttctatatcattattcccctttgccctccaaatcgaatcctctctcccctcctgcggcgccgcggggagggagcgatctggggagggggaagccgtcgattgactcgattctgtgtcgcgggggctccgattcggcctctgaattgcgccctggtatgtttgccccgcgtcgattcgtgggttcttgccgcggatttggttggatttatttaattttgtgtgatttgttcttgctgttgttgtagggttccatgagggcgtgaggtgaagttggggaagagagagagagagagagagaggggggtagggttgctgcggcggcc

SEQ ID NO: 2570 - DNA, 2000 bp, Oryza sativa
agaaagtaggtagaagtgagtgatggagggttgtaattggatgaatagtggaggtaggtggaaaaaataaatggtggagggttgtgattggttgggaagagaatgttggtggagaaattgttactcccttcgtttcagtttataagattttttagcattgtccacattcatattaatgttaatgaatttaaacactatatatatctagattcattaacatctatatgaatgtgggcaatgctagaaaatcttataatctaaaacagaggaagtatattttaagacaaatcctgagggcttaatattattatattttgggatggagaaactatgtattaagtgttaaattctctagaacaactcgtaagggtgacaaatagtagttaattattttcatagtagcgcattactccaccattagcatttactagagtgtcacattactgtcagtacatttggtaggtgaattaagcggagtactaaagtgtaacagctgcacatgcagtgaaggcccccggacagctatggcaggtgaggaaaatgcagggcgccacggaacagcgcacagcaaaggttgggcagttttaatggccaacctttcctcgcacttcgctgtagcagcactagtactcctacgtactagacccgttatcgctggcccattggtgagttgctaaatcacaagagagccttttcctcctttttttttttcagttggaaagatctgcaaaaaacaggaggctcacagcgaatccaaatccaattccacgatcacaattcacaacgtctccgttgcggctgcggctgctgctgctgtcgtggattaatgcccgtcattagggcggggacatgcagtgcctttgcgtgtcggtgccattagagcaggtttacgaagggtttaagctaaccgaacagcgtgggttctaccaattgtttccacgaattagtgccgtgttactactaaccatccttgtgcttaaactgcatctatgctgcagcaatataaagggagacaatgcacgcacgacgctgcattatgggttaggactcaagtcggcagcagcagcagcactggtgcactatactagtagtgcaggattgttaattagctacatggaattgactcgggtagatcggccgaccaatcaccggatccgtgaaagccgcgcattaagctttgtcacgcactggagtgaccattgcagccttcccatgcatctgaatgctgcctgaaactactacggtcactgatgactgaaagattgcagtctgtcttcactgtgtgctgctgctatacgtaggagtagagtacacctttccactttccagcatgaatgggcatattggcatcgtcgatttgtgccgccacagctggggggtgtgggccactgggccggggcgatggtagccgccgcggaatgggatggtgaggatgagaaggttccaggttgcaaaggccctaaactttagcgtgcacgcgttggtccatctccggctggtgccacacatgtaaaggggacgggccaaccagacgcgtcgcagccgagggcaccagcacacgcccgcgtgccgccgaaatcacacgtaataatgcggcgacgtgacaccaaaaacggcctgggtcgtgcgccattgttgcgcgtgggcgtgcgtgctgccgctcacggcgagtccgtgaatcgttttttcacgtgaaacgagcgaattcaagaagggctcgttcttttcacaggattttcaaaacgtaggaatactacagaaatatatgtgcaaacctatagattaaaaaacacatgaattttttctatgttgttgagcaagccaaccaaaaaaatacaaatattaggttggagtgaattattttttcctatgcttttccctttaaaattggaggaatggaaaactttcctatagttttcctatggtacatttcctatgaaaccgaatggtaggtttaaaacccatttctatttcaatgctttttctttacaattccttta

SEQ ID NO: 2571 - DNA, 2000 bp, Oryza sativa
gcacaggatcgaatggtccacgggaaaggcatctaaaacccaaccatattcaatccatattagcgaggtgtctcaagcggattagtcaacaggagccaaatcgctttgggagcggcaaacgcaggcgctttaagatatctagtatgagtcatgtgctttgcaatgggtgaacttaattttaattgtgcccggaaaaaaaccgttcattgcataatgaacattaaaaaataattgttttcattaacttagcacaaactaatcaaattgtaatatgcagtgcatcatagaaataacagtagtggcaacccatgggtgcaccaaaaactgcccaccccattggctcaatcaaaacctaaaaagcaccaatttcatgactccactacattactgcattatcactatataatcacttgtatatcagacatcacataagtgggacccatttataatatcagaattaaaaaatatacatgggacccatttgtcattaaaaagattgtaggacccactgacaggtggggcccacatgtcagtcaatcccttcacccatctctctccatctctcatcttgttcttactgggatgtctctgaagtgcacgtcccacaacacgtccatcatctcaacgtcagtgagcacggtggcgcggttgctgcggaaaccccaccctacacagctcacctcagccactctcttcccatcgatgctgacccgcacctccccctcgccaccgttgtcactgccgccggttgcctgcaccggcggcttcgggctcaacccggccttcccggaacctacactgccggctgaggacaacggcgccgcgtggggctccgtcgctgtctccgaaccggcgagagaggtccaagtagaatgcaggcaatgaggggtagaaaggttatatggtgtgcgtggatgggtcaatagcgactaaggtggacagaaaacgatcgggaattgatggaagtgttcaaaatgtgaacgagtgaactttgagtactattaaagtaaaccgatatctttaagtgctataaaaaaacgtaaactttcgatgctatataaccaattttgcataaatttttagttaggttaagataagataagataattagattgagggagttaaatgcatatggactaggtacgttatgcatgagcctggactacgggcttcggcccatggttctatcgatagattgatcagataactcgttagagatagcatcggtttccaatatctcctagattcgtgccgcgatattattatttttttttctgaaccttccgcgcccttctggccgcgcgccacgcttcaattcgcctttcaagtctcacccgagaacctctccaccctccgccatcgtgccgctgctgcgtgatcagcgtatatatactgtgcgccgtcggaattaacttggtttcgtccttcgtcgaaatcaacttggtttggttagtttgcggtgctttaagcctaaccggtgcgtacgtatactgaagccattaaattttcgtttatttttcactgcacgtagatatatacgcgttgctaaagggcacaaattaagattaacttggttgcgttggattgattttgggaaaagctgatgcttacataagccaaataaaaatctggtatagccattcaactttcatatatatgtcgtatggcgattttaaaattttactcaattagttttctcttaattagtagtatacctacgttcttttaatatatatgatgccgtttactttttaaaatatgtttaaaaatttatcttatttaaaaattatggaattatcatttatttcgttatgatttaatttattattaaaagttattcaagcatgttatatatttttaacatttgtatataaaagttttaaacaagacaaataatcaaacctacgtcaaaagtcaaatgtatcgtatatttaaaaacacacggaatatcgaacatctatgtatatgcatgcaggcggtacatccacactagtaattca

SEQ ID NO: 2572 - DNA, 2000 bp, Oryza sativa
atttcacataaagatgtcagttctaattttagcttcgggtagccgcttgcacttttggttaaataaagtgttgctattagtacctaattaaattcataaaactctattttccacaattatagatggtggtatactctgttgtccaatacggttagcatggtcctactgaagtgctcttagtataatccttaggtaaactaactctctatttgctagactaactggccgttatttatatatgttcacttggttgtttatattcacttatattctgattgtgaatgcatttcttattatgtagggtggtgtcattttgggacgaagtatcctgttgtcgcatcgagccatctgctatcgcactatcagttgtggatggaaaaaaaataaaaaggatcaaaatctagggagtcaaactaggatcacattcctcaaatcggctataccgttctagattattgttctgaaacatattccatagttttagaagagatataccccctctcggtccacttcctcaatccatcgatgcaagaacttttgagacttagacaaaaacatctttttggctgctttagctatgatactttaagcttaattcaccaccaaaatatggtccaaatgtttctatttgaatgcaaggatgtaaagtcggaacctttttaagttatgtaaacacaccttggatcaagtgaaatatgttgtgacgtgctaattctgtgtttcacaaggatagcttgacattatgctgatgttcaattattggcttcacaaggatagttggtattattatgctttttagcaaaccatggctttacaactataattgttgttagactattggctgccttatctttttgtatggtgcgtcttgagcaatagtcttcatagcttacggaaaaacattgatggaggcataatggcttgaagagttgaagtaattatggttcatgtgctcactaaaaaaggtgtttaatgtcaatgttgaatcctgaacttgaagcagattttctgaaagtgtagctagatgtcactctgtagtaaatatccaacacatggatttaatactgcataacactgcatatatacacatacaagatcaaacgaactgaactgtatgcaggcagtggtttgctaggtgtcatgatatggcttagacacgatttcagggggttgggagctaaagggctatgcttctacttgaattctacccatggtttagtatgtgaggctgccaagtgatcccttgtggatgttccctagaagaattaggcagcgttcgagagggtgagtgagttggtttctttcgttttccgcgcgcacgtttcccaaattactaaacggtgtgtcttttgtaaaaattttatataggaaagttgctttaaaaaaatcatattaatctatttttgaaatttaaaatagttaatactcaattaatcatgagctaatagctcatctcgttttgcgtatctttctaatctcctcaatccccttatcctcaaacacacccttagtgaggtaaggtgaggagcatgatggaatttggttttaaaccattctttcattctcttcctctttgacaaataaaaaatttatagatttaagaggtgattcaccaaggtagtatggatgatgaatggatagaaaatgggcccatatagatgcttcctagaaggactatagagatagtatgaattttggtgaaagttgactttaacccttctctctttctttcctccatttgtaaaaaaaaaagatagattcaaggggtgattaactaatgttgattggttgcatgtgaattactaaagggcccttgaagatgtactctaggcatgtgtgagtagtaatgtaaattatatggtgagaattgtattttaacccttatctcaccttttgagaaataaaagaaagattaaaagagagatgagtagatggtatgttggctgtgattggatgacacatgggtcccataaggatttggtcccacatgtaagagagat

SEQ ID NO: 2573 - DNA, 358 bp, Oryza sativa
ggctactctctacttttgctgcggctctgctttgttttctgagtagtggcggttgcagcagaaacagtggtaggtagcgaatcgctatggagcagcgatttcgtatggtttgggagttttaggaagttcaatctgagtgtgtagtttgtgattgttggattcgtttgtgccatcggaaatggctggcgtctgcataagatgctgcttcatgtggaagctgatttcgttggtagcaatgtaggattggaccatcggtgtgtgtacgcattggttttctgaactaaactgactggcattgatgcgtggaccacaattggaacataaacttcgtgaatgcaagtgttggtacaagcagtga

SEQ ID NO: 2574 - DNA, 2000 bp, Oryza sativa
agtaagcaatatgattaaattgagttcacatatctgggcagagtaaaacatcatataatgttttgaattgtatcacactgagctcggtatacatacagagctgtccataattcgtttagcaaaccacaaagttgaatgaaaataaatagcacacactacacactataagcgtgcgtaagtaaaattaaaagggaactaattttgtacgtgtggaggcacaacagttggaatgaatggaacaatttgtttgtcttgtaataacagaattcggtaagcgatccataggaaggaaatggaaaaactacgaataaatttttaacctacatttgctaaatataaatatatgcatcaatatttactgccatgtgcatatcaaacatgacaggagagcatctagaaatgatgaatccatgtatactgagggcaagctgaacccatacagtctttaaaagaaatttacctttgttttttttaataaccgtatgatgcaatagggaaaaaaccaaggaataatcataaaacgtgttcgatgactttgggtaccataggtgcaacatatgggtagtgaaatctgcatttatatataaaaaaaagcatagctagctgagttgtacccattgattcaggagaataaaaaagatgaaaatggaagtacacacggtccacgtgttagaacgattgatgtataaaaccgaggcatatgtatacatatatgttgagttattgaccgtatgaaaatacctggtaaagctaaccacgctaattcacaatattactaaatatttcagagtatacgacattatgtgttttagattcatacccaggtaggctattctcaatgaggactcgaagaccttgaggtgatgtaatacacatttgaattattaaacgtaaactaataacaaaacaaataacatatttcatctgtaaactacgagacgaatttattaagcctaattaatccgtcattagtaaatgtttactgtagcatcacattatcaactcatggcgtaattaggctcaaaagattcgtcttgtaatttacatgtgtaaattgtgcaattgattttttttatccatatctaatgttttatgcatgtgctcaaacatttgatgcgatgaaattttttgggaagtttgaaggacactaagagcccttttgaattgcagggttgaaaaaatggaggattaggaaaaatacaggattctgataggaattgaattgtaaaacagaggattgcaaaacacaggaatagtcgtttgatttgagcgcaggaaaaaacgcaggaatcggacgagagagatagactcaaaggaaattttccaagaggttggagctcttgctaaatttcctccaaaatccatatgcaatgtgctattccataggaattttatagaatttagaaagcttcaatcctttaaatcaaagaggcaaatagaaaattttctataggatttgaatcctataaaatttctatataaaccctttgccctgcacactgccttggtatgtactactcctagatgcgttgcaaagtccttgactggggagagggggcatcatctgaaaagaaaaaataaggcaatggcagaagagtaatatccggaggaatacgaggacgaaaggccaccgcagagatggggcccaccatagccagactcccaaggtggtaaggaaaggaaaggaaaggaaaggaaacggcctccactccatctccatggatcgtctccgtcgccccctgaattcccgacgatgagatcgatgaagaggccgggaattcacctccagatttgaggggatcgatggtggaatctccttctccctttcccaccaccactaccacttctgctgctgctcctcctcctcctcgtcggcggcaaccaccacctcccgccgctagcctgccttcccccggctaacctcgccctcactcactccactactacttttcctcttccgccccgccccctacatcctagatccatccatgctcatgctc

SEQ ID NO: 2575 - DNA, 2000 bp, Oryza sativa
acgacgtccatttcttgtagattagccggtggtccattacgaaaatgcgtatgattaggggtgcttctaaaaagggaaaaaagaacaaagttagcacaagtttaaatgtaaatatgaactggaacatgtaaagtgtttaaatagtatataccactatgtggtccgcccaccaagcatcatcagcagtaaatgttcctttaattggatcccagcctaatccagttgatttttccttcagttcgatccacaagttgtattccttctttagtgtttcccagtggttctttaattgtttttggtcatgctttttccctgtcctctgaaagaacttcagctgtagatttttgtagccagtagttgacaaacaacccgtaggtctattcccagcctcacattcctcggcacagatctcacaaaaggccctgttgctaaatgtgtcccaatttgccttggatcgaggaactagatccatctagacaatttacattcagccataaacacattttaatgatttatagtaagatttatgtaatgctacatgactttattacatgaaaaatgtttaggcagtaaagatgcacagcaatgtattcagaaaaaaaaagatattcagcaatttaacttcgtgctgtgtaacaactacattaatggtctaaataaatcatgtaggcaaatcacgcaataaaacacatcatactgatattccatcattgtcacctgctaatttatccatcgagaatatgggcttgtcttaattaccttgatcacagaaggctgccaagaagatggcgctagtgtcagggaagaatctgatgacagttgggaagaagagcagcaggggcctaggggaggaagagggccaccgatgcccgtcgccggcggcggagagatggctccttggttcgctctcgctcgaggatagaattcaaacaaaacgattcgttccgtaattataaatggattgcatggtgggtaatttgttatcaaatttaatggcactggatattctccaacccacaaaagccagaaaaagcacctttctatgggctttcggcttttagttatagggtggcttaggcttttttaaaagccagatgaaaaagcctgccctttgtttgggctttagcttttctggctataaactgaagcttaagcctaaacaaagagggtctaagtgatgagtatttgaaacagaggaagtatatccaaagttgtttgggacaaacgtgatgtttcctcgagatgcaaagccccaatcaaggaggttgttgcacagagagatggagtgctactatcataaatcaaaattgtccattgtttgatttttaaatacaaatccatgcacgtccttcatctacatttgcccttaaatgttagctacaatactgaaacatttcaaaaaatatataaagaaatgcaagcctatgatatctctatctctgttacttgagcccaccaccccctgtcaggaaaacaacagtttgcctagaactcacagacataccaataaaactaagtatctgatgtttcaaaaccgtcttagtaccaataaaataaacctattttatctttgcgaaaccatctccgcccacgatgccatcatccaaaaatccaaccccaaaccgatcctctatcctcggtcatcctagcatgcaaaaaattagaaaaccaggggggatgaccctgtgagaactagaaaaaaagaaatgggctctccttctctagtccgccacacaataatgatcttcttttgttcaaaaagttgatttctgttgcaactcacagacatttgactagtatatcatcatacaagcagcatttaattctcctcgtacccatttcaggcatcattcagcacagacagtgcaacgtactcgaggtgacggcggagaggaacaccattcttcatgtcgcagcggagaaagggcatggcgagctgatccaggagctctaccataggttcatcagggacaatagtctcctctctcgccggaactcgg

SEQ ID NO: 2576 - DNA, 717 bp, Oryza sativa
tatatataagttttgctacaaattattattattatgctaatatgccatatacgtatttggccaaacgatcggccgtcattttacctgcaaaaataatttatgtaccaaagttttctattccctccgtcccaatttaagtgcaaccataaattccgtgctcaactttaatcgtccgtcttatttaaattttttatagttaatatttttattgttaagagatgataaaacatgaataatactttttacgtgacttatgtttttaattttttttttcaaataagacaaacaatcaaagttgtgcacgtaaaatcatggactgcacttaaaatgagagggatggagtatataaaactagataagtttaaattttaattatgggtgtgtttagtttacatcaaaattgaaagtttggttgaaattagaacgatgtgacggaaaagttgaaagtttacgtgtgtaggaaagttttgatgtgatggaaaaagttggaagttcgaagaaatattttagaactaaacacggcctatataataataattgatacacaattaatcctgcactaacccattttcctcagcgaaatctccgtatagaacggagccagtccattagacaaaatgtaaaccgtgacgtctaaaacccaaccccaaaaagtaacgaagatcggacggatcgatccattccccttcactccctcgactcgacatcgccggagca

SEQ ID NO: 2577 - DNA, 2000 bp, Oryza sativa
tggacttggactgctgccatggacgatcttgctgatgaccttataaggccgctgaaaccaccgtggatgagacgctgcggtcatctgccggccacctcccctccggccagatttgggagaggcaaggtaggggaggggagtagggaagccagcggtctcctccgtttttgctgccgccagtaccctcctccccactagccagatctggaagcgggaggggagttggggagcgccgctggtgccccctataccgctttcgatgtcgctggtctcctcccatcctaccaccggatccgtcccctatcattgtcaccatcgcattctcacttctcggggggatggggggagcattgcctcctttctcctgtagcactaccgccgaggtccagaactagtcttctcaccagtagggatgaaagcagagaggatagtttccgttcatcaagagaagatacctttcggagcggataattctcgaatagttcggatacagatacgaacatgaacacaaatattttctcccgtatacgaatacgaatatgatatcggatataaggatactaatgcggatattcggtgaacagtgctatttggataaccgctgaagccatgagacatacactatttctttataactctatgaccttcaatctaccttttagattttaaaagtagtccatctcatcacactggtccacataattaatattatttaaacttttaaatatttttataaattatactatattaaaggagctaattatatatgacgatatttatttccattagaagtttaggtgatttcctttgttccgagaaaaataatgttttcatattcgtgtccgatcatattcgatccttattcatattcgagataattcgtatttgttttcgtatccgccaaaaaaatatatgaaaacggatatggtatgagcattatccgtccgtgtcagctccattttcatctggggtcgtgcttagggatacaagcgggccaactcacgaaccctcttataggtaaaattagtaggtaacctgtggattgactcgcgggttacctactaatttgatctataaatgggtttatcggtcgacacgaccacttgtatctctaggcgtggcaagccgagccacgacacggaaatccatgggttaccacttatttgacatataagtagatttgcgggttggcccgattgcatccctagttgtgctaccaatctgcagcccccgagcgatcactgttgtcatcaccttcccgtgctcccgccctcgcggcgccgctctttcaccgaaccatccccacactgtttacacccaaatttggcacctaggattaaaataggaaagattgccaaaatttagaaatctaccggtttcctccgagtgggccggtctgaccgccatgtgttgggcggtcagacagccggttgtaggccggtctgaccggcgggtccgagttcgaccctgtttcgtcgggtctcgaggtttccttgctcgggaaggcatgtttcgggtttcctttggattctaccccgagttggacgtggaggagggcctgtagaaggcaagaccaacccgtatataagggacaaggccggttcattgtaaaatcaatctactatcaatcaatcgaatcgttcttttcatattgcttttagttttctcttaatttgtccatctttgtcgatttgcgccgtaaaccgtccgccgccgcagcgagagtgcaacacctctttgtaggtttgtcctaaaaaccttccgttttgcccacgagacgggtagttatctagaaatcggctccgctagccggtttagttatcaaaacccatctaggtttagctcttcgctagatcgaggtggttggcgactctaggatcaccgcaaggcttgaggtgctgcgatcgtgcttgtcaacttgtcaaaaaagttgccaacacgatttttggcgactccactggggacgagatccgttcatcgtcaactcgacttcgacttcg

SEQ ID NO: 2578 - DNA, 2000 bp, Oryza sativa
gggtggccacaacagagagaaaataataaagggccacgccactgaatgagtgaattttggtcagcgcgtggtgccgaaataacatcttgggctgctgcacacgcactcctacactccaagtgcacgcacgtatcccttcatccttacccaacccccctcccctttgccaccactgcactacgctacggctgtgtttagttcctcccaaatttccaactttttatcacataaaaaacttttatagtatacacataaactatcaattttctctctaaactactaactttctctcaacttctcaacttttccaccatctaaacacagtctaccctacacttttatagtcctactgaacctgcacgtaccaccacactttctcatcagagtctcactgccactccacatcaaccacgaacctactattcccagctctcatatcatagctttccactagaaaaaagttattcgactttttgattgaacatttattttattccctacgaaatactacaagtataatgtacaagttattgtaatactaatgtatctagtttagtgacttgcatatgaatccaattagtccttggtgttttacatttagatttttctcgcatacgactaaaaaacaactcgaagtaattttaaaatgtgactttttatactctcactctcttctaccaaacagaccctaatttcactctcttagtggttcaaaagcaatgggttaaaaaaacaacaaatattgtctactataagtgaaaattctgctagttttatatgggtaagtatttgtcacgccgattgaaagcgagagggaggtgggatcgactatatttaaggcaatttctaacttttaactctatggataaaaagaagtcatatgtagaaaagggtattgtaacttatatagtagtaataagaaactactatggctattaaacttctaactttttccatcacatcaacctgtcatatacacacaatttttcagtcacatcgtaccaatttcaacctaaacttctaactttggaaggaactaaacacaactatataacaacataggccaaatgaaaagtttctaattttgtgttgtatccatggttacaatagtacattttgcatggaccatgtgaggagccacgtattcgcgctagtctatgctcctttagtgctacgaattgaatgctgacaatattgctagtgctatattatgacttccgttacttttgacctaaaccagcagatatacatacgtcttctatcatgacatatttagatcgaaacaaagttggtctatataaaagtttaactagaattttggccaccatagaaaataatttgttaattggtcgatacaaaagtgcctttcttcttttttttttcttcctttttccgaccatagtcgtatatggatgataaaagtggtagctattgagtatgacctgtgggaggccaaatattgggtccttaaaagccaactatactcatcaggtagtatatagaattattcataaaaggcaatttttaactctgtatagtatactgtagtactgtaataaatcaacaaataataatagtactagtagcagagttggaatagaaaaatccaccaaattagtggctgtaccgaacgttattagcgctttaaatgcaaaggagtcccgttcacgaggaggagaggagcatggagatacggaacgcaaacaaattcatcttctcctccgtttcttcttcgcttgtctccaagctgtgtactctactcctctgatgagtagagtggactttgcagctatcgagcttggattctagcgccatctccatctccacctccacatccctactagtatacatcattgctgctgctctgccatcgtcgcgcgcacacacgcagacaagaaagctggaccaaacgggccccgccagcaatggtggtgccgccgccgccgccttcccttctccccctctccctacaccccgcctctgcccgtgaggccaagtcc

SEQ ID NO: 2579 - DNA, 2000 bp, Oryza sativa
ctccaattttaacaaagtttattaaaaagaaaattaaaaataatcatgcttcctcctttgagccaagtctggcccaaagtcttcctctctcctcctcggcccgcagccgaagttcttccttcctccctccctttctcttctctcccgggcatccccccctcctcactacaccataaccaagtattcatggcacttaactgccggcaataaaataaagttagtggcgaactatgtgccggaaatatatcaagtgctggaaataatcttgaacatcatctcatttgccgggaattaaaaaaatatggcagcaaattaagtgccggcaatgaactaatataacaggtcaattgatctgccataaataatttaagacaacacattatctgccgggaattttgttaccgggatttggctagctaaaattattttggcacctacaccaaaaaaaatccacgccaaaaagaaaattgacaaaaaaaaacctaagcgccgccacctcgtgtcccgttccaccgcgcgcgcctcctctgccaaatcgactgcgcacgtcaccgccttctccgccaaatccaccacgtgccacctcgtcctcctctcccaccgcgccccacctcctcctcctctcccaccgcgcgccgcctcctcctcacgcacaccgccgcacaccgccgtccacccaaaccggccgcccacccaaaccctcccctcctccccacctccgactcgacccaacgccttcccatctcctccgccgactccccatcgcctccacctccagtgcctgcctccacctcctcttctgacatcaactccccttattcaggtaaaaatgaaatctcttggttatatgtgtttttcttttttcaaccttgccctgtgatttactcgatttgtctgcatattggtgcttgtgtgatggatttggaggggaacttgtagccattagttgcttagaagtcgagggtaactgattgaccagcttgcttgttctgtagtttaacgaattttgcaccgattgcaatcaaaatttgtttcgggtgtacttagaattgggagaatgacaagggaggtaaccttgaatcatagatcaacaaggtaaccatggtgttgtttgagctaatgaacagtattcccttagcactacatgttttttacctgacatatacttgttgaccgataggcctggttagcctgtgattcactcgaattagtctgcaagtaagcacgctgcaccgcccagattgggctaccagctcactaattttagcacatgtcttgatccgaaacagtgaaccatcggatgctacataattctgaatatgtagctctttggcagcttgtaactctgaatatgtagctacatacatgaacataattcagagatacagtagtacaaagatttcacctaaatttttcagagccatctatgttcttgtagttttcacctgaattctgatacctttagaatttggagatttcatcttcactccctgaatatgtgcatcatggcagcaatgactcttgaagcgttagggctaaatacttgtgttagccaatattacacacatgaggaaccctctgtcttgtatgtctacatataagtataatgcaccttatatgcaagctacaaattgttttgctatatctctgccctgcatataacatgttggtaatttagttgtcttcatcgatcaatttcgtttgcttataagctatgctcatggatgaatatagttttttgataggaagttgatttgtttcaataaagtcagtcatgtaagtacggtaacctgttgtactcctatacgtaaggatttcgttaaatgttatgttgatctggaaatgggcaaccacttaaatgtcataaggaaaatatcttttccccttttgcatctctctctgatgtctcaagcattaatccaacagcaaaatgtttcatggctcggctacccatgtgctcggtatcagattcctttcgatccttcgcgtttctgcggctc

SEQ ID NO: 2580 - DNA, 2000 bp, Oryza sativa
  misc_feature (767)..(767): n = any nucleotide
  misc_feature (769)..(769): n = any nucleotide
  misc_feature (915)..(915): n = any nucleotide
  misc_feature (1523)..(1523): n = any nucleotide
gtgatagaatccaccgatccactttcatcctcctcatgttgtatgttcctaagcacaactaaagtagaacacttaggtagtataacattctcagaagtactgaaattaaaatcagttaggaatgaattcacctgaacttgtagtttcttggcacgacttcttgtaagtggaccttgaattgtatcctttgtgtttgatgatggttgcttggtacttgaagtagcatgcacggttgggatgtcctcatcatcaaccctagatgctgatgcaataaatcccttttccttttcaaaaataattcattattgcgtcataattcaattaaaatccatataaatgctttaatccggtttaatctttaaaaattcatatctaattcattgtaactcggtttaatgtggttcaagttgcaaaagttgtataaaataaagatctacatattaaaattattcataaattgaattaaatttatttaattttttttaaatgggctttaattagattaaatctagtaaaattcataataaattcatatgaagtcagaatgaggccgttcaagtctcataattcatctaaaattatgatctacatgtttgtttactttatgtgtattgtttatttggagtttcttagtgttttcctcgttttgcgttttagcttgtcgtttccgtcgttgcgaaggttcgcgagtgcgccggaagtgttcaagaagattaattgaagaccgaatattgcaaggcaagtcacacagatcccaaacacaattncnttgagatgtgatcctatatttaaattctctatttatttcaactgtgcatttattttcaaatgtcaccgggtggtgtgaacctattcctttgttatggcctgtttgcattgattaccctatttcttgattacctcgggttataattngactagttggatttatatattggttcaactagatgtattagatataattgcttagccatgcttagaaacattagcacatgattgggataattaatgtttcactattatttaatgatggatatttaatagctcacgatggtcaatcgtgattggttaattaattaatgtgccaactaaaacttgataatggtgggttgtgagcacatggttttgatggtcgtgctcatgaaaattaaggaccggttcacgagtttcggttgtgaaacattaatcgttccaaccacaagccagagtgggcaacggctggacactttgtataacaaggctcattgcggagcaccagactgagaagtggcggagataagcccacgggggtcgctggggagtccatgactctggtttttgagggggtgactatgatccgggaacggtgcactgctttgggttgagttatgcgaggggtcttgtcacaactacagaaatggtgacatgttcagcatgggcacatgatgatatggtgacatattgtggagttttgtcttgtgggtacagtggtacacctctagccagagtaaaactattcgaatagccgtgcccgcggttatggncggtcgaacaatgtctttcgtgattagtcccacactactcattaatagtaatgtgataattgatggtaattaatttagctcctggtttggaatggtatattcctggtttggagatagatctgtacaactgggtatggttgttcaggatggttgggcctgtgcagcatggatgtgctgttcagtgattgattaatattgataattaattactctattgttttactactcttaaatgtttgctaaatgctgcttttgcaaatgagccctatattatgccatcctttggtatcctgtgcacttgcatatttgctgtgtggcttgctgagtatgtcatatgctcaccttgcaataatcaatcaaacctcagttgaagacaagttgcgaaggagaagacgtttggcttataccccagttgagctacctgtgggagtggagccggagcttcgctagattttattttccgctgcagttttcttc

SEQ ID NO: 2581 - DNA, 2000 bp, Oryza sativa
gggacactggcggttagactgatggcatcggcccggtcaaaacgactggacactggtggtcaaattgacagcatcagcccggtcaaaccgacgggtttatgatggtcagaccggcggcagcaacaggcgttagcagggcaatgcacaatcagatcgagcttcactaccggtcagatcggaggtcttcgagccgtcagaccggtgcatctactccggtcagaccaatctatatcgaattcgagggcaacttttaattccgctaaaagttttggtttttgggtactacaaccattcacccccctctggttggtttagttcttgttgtatgatcctacaaattctacatagtggagatagtcgcacgtaatgacagatcatggccatattatggtaagaaggggttccgttctagtgcccggaaataatatttgcagagccagtgtggaaggcctatgttatagagtatataactttgatcgtagggatcaatttctagtcgcatagcttcataataattctgcaatgcttcataataattctgcaaagcttccacataatttccttcagattgagacaacatctattatggtcgttcattctatttaataaaaatctccgctccaaaactatactccctccgtactcgtaaaggaagtcgtttaaagataatgtttaagtcaaaccttgagagtataaatcatgaataactctcaagttgttgagtttgaaaatgtaaaaattataaaatactttcgtaaaagtatacatatattatttttcaataaatatttttatagaaataagaaggcaaagttgtgttttggagaccgtatcgttgtccaaaacgatttcctttacgagtatggaggatgtacatgaggttttcacctcatacggctcctcatagtaataatgtaaaaatagaattaattccatatcattagtagatcgtgccgtttaaaaatgatgagacatgttatctggagtataccaattgtcaatgttagaaatgaaaacggatatcgagtatatgtgcaattaatgcatagtgtccatgccgacgtttgactagaaagagatgctttctctcatcatcaatgatggagcctgctttgttttcttaatttgtcatgatctttcatccacaaatatctcttgaaatttgaagtatcgtttaaaagcatttgcttttgatcaaggaaaataatagtgaatttaataattgtatacttaaaaaagcggttactttatctctatataatagctctaactcctccaatctcctagccaaagtaatccatagaattctctctcatcccgattatattttctctataatttttctttagatctgtataacaactacattattatttttagtttgtgtgatctccatattagccttcttactacccaaccctcactctaattataataccattatttggcaccgaactttatcaaatcaaagtattgaagagatcttttattcatcatcatcactatcacgagttcacgaccgccatcgatctccttatctcagagtatctcagatctgaaaaagtacttacctatattattatttccctaatttcgggctgaaaaatctttccaaaaacaagaagagcaaaccccataacaaaatccgatctccggcagtttccccaaattttgttcgaatatatagtttccaaaggggcaaataacggattccatctcttgatttctactaccaccgttcgcatggaaagaaaaataaataaacaaataaaaaaacccccaaagaaaatccccatcacctcgtcttccccaccatttctctctcctctctcctctcactacccccaaagcagcagcaagcggcatcagcagcgagcacccaagctaagccagcagcagcagcagcagcagccaagccaattcccccaaatcgcctcctcccaaatgcgactcctcctcctcccctgacgaaaccctccccctccgcctccgcctccgcc

SEQ ID NO: 2582 - DNA, 2000 bp, Oryza sativa
  misc_feature (440)..(440): n = any nucleotide
gccggcggccttgagcttggcggcgagcgcctcggcctcctccttgggaagcccggatcgcaccacgaccggcgccttctccacgagctccttcgcctccttcagccccaggtccgtcaccgcgcgcacctccttgatgatctttatcttcgccgccgcctcgtacttctcgatcttgacatcgaacgacgtcttcaccggcgcgggcttcttcggcgccggcggagccggaggcggcgtctccggccgcgccagtggccgcggcccccgatgcggcgctcgacgtgagcgagaggcggagcttgagccgcaggagcgccgagtagtcgtcgagctcggcaggggagagttccaggagctggtccgctatgcgcgacagcttcgggtcctccccggcggccgtcgccgtcgccgccgccgccgcgttggagaggcggcgnagccgggggatcagcggcgcgaatttggaagcgaagagtggcatttcggtaaatcccgggaattacgtggtgaggggttagggtttttttggcccattcgacacgacccttatacgagaacacaaacacgtagccccaaccattccgccttccgatcacgaaagcgtattcgttctggcccgtttaggacgagcctcgtaggctcgaaggcgggtttcagtttttctctgcggctaccggaggcgtattttccgcataccgtggcccacctgtcattgagagtagtggctgttccgctccgagacaaggactcgccatacgactccacaacacactgcctcctgagtcctgactccccccgagcgccagtctctctctctctctctctctctctctctctcctctcgcacgcctcggcggagcggagcggagagcaacaaaagcgcaaaaaccctcgtagagatcgaaaccgccgcggcggggtgggatcgcgtgttccgatcgtgcggaggcctcccgctcttatcgagaggctttcgatccgcttgcgattttttttctgggatttttttggtgcattttttttcggttttttggttttccatttcaggtggcgcgtgggggatcggtggattcctggagttgctggtcggtggaaatcgtttctcttcgtgtgcgcgtttgcgtttgttctggggtttttgttttgggtggtgggttttgatccggttgctgcgggcttgtaggttggattttgcggtttgggagaaaggtggtgattcgctccgtacactgttgagatttctctgtgactctgcgttggtgttgttgctaggtgagctgcgagcttccgtccgtttgcgatgtgccgatgtttagggttttacttgagggtccatttgatattccttattatgttttagagcacaatctagggttctagactggcatcattacgctgcatgtaaatgtattatcaagttgggggttagggatttaggtggggatcacttgtgattggggttgaaacctgaaagtaatcggagacgtctgcaatgcgttatgtgtatatgtgtttcgggtatgctgctaaagtgaagtctctaactgcctcatgttgttttgcatgttccttgtgtgcggaaatgtcgtatgtaatgttttcatgcttaatataggaattgttctcagctgtttctcccttgtacttagcatacagctcgtatcaaatgtaaaattctgttttgacatggagcatatcagtataggaatttttcaccagaatctgggagttggatcttttgaagaacaaattttgtctgcatataaactgctacttcatcagaattccctaatgcaagaatgcatataccatggcatgacttaacctatataccataccttgtgcagtttcaacctgaagattaccagttattcagtcctgttccttgtttcattataacctgtaatttccagttctacatgttagaaggctgcacattgttcctatttaattgtatagccactttgattgtgataagtgtgaatttttggcagtca

SEQ ID NO: 2583 - DNA, 2000 bp, Oryza sativa
attttcttgaatttgacgatgtttgatcccaaatccatgattggagaaaataaggaaacccttcgcttaaaatcgactgaggactcacgttcctcgatgaagctacaatggagggacttagagggcaaagcacacggaatcgtgctatacaagcagaaggaggaagaagaagaagaactccttctcatgatcaagaacctcaacaagcagtaggagtgattcgatgcgaggtgttggttgttcgtttagttgatgtgcagcccataactcaccaacctacctcctcatccacttaccattgttcgttagtttatgtgtgcagcccagaacttcttggtcccatagggtagttatgaactctcaggcccatcaagcccacatatataaatcatataaacataaaccatatcatcttgcttcacacacttgaaagctaatggccaatacactgaaagccctgcagaagtttaatcaactgaagcaatatacggccagattcaataaatcgatcgtgtggaggggtgaaactatgtcattcttattgacacaagggggttaacacaaatttaaataaacgaaaaccataaatatatccatatgtctaactcgaccataaacaggttcataaaaccaaccacatgcagtccatcatgtgtaaccaaccgctcacatgcggtgtcaacaattctcggcatacagccataaacagttctataaccatgcattcacatgctattaacaatatccatattaagtcaatagcatgctaaataattaacaattcttttaggtgtttctcaaattttatcataagcttgttagactttaaggctcattaagatgtcgtccataacaacaacagaaaaataagcaataatagtaaaataataaatttaaaacaactcatgcggttaatgggattaaattattcaattgcgggtgcatgtcttgcaaccttcaggctcgatgtagtcgtacaacccgtctcctcctagctcggagatttcactcgctccaactacgggaccaatattggcgttttctatttatgaaacaatcatcatgaccttaaataaaagctaaataaaaataaaaaaattaaataataacacaatgtgcaaggatgggttaaaaagatttaaacaaataactttagagatctttgtgatttcggtgaacggcgaaccctaggccaaaactagggtcacgtcaacgggtgcttggattgcaatgaaacggcacagatgggttcagaataattctaggagtttggaatatgtcttggatttcgatttttaggtcaaacggatggtcaacttgatcagagaagaaaaatggaattttctgatttatttttcattaggaaaatcaaagtgttggcggatggcatgaggcccttcgaccaaatctgccgaaacccgtggcgaagactatggagcgagaacggcgagaggcgaggggtcgtgcgagtaccttgtcaagccagaggcgtcccgggcgaagggtgtaaggcgaagagtacctgccgaaggaagacgacttcgccatggcaagttcgcccccgcgagggccgaagaagccttttcggcccttcaagcctaggggccatagggccggcgatcgctcgacggcccatcaggggcccatgagcctccataacattatgtacccctgtaaatgtccctttcgtaagggcaaccatgtaaattcccctgtataacctaaaccctagtggtaagaacctatagcggggctataaatagtcccctagggccatgtaatgggggatccggagtaaaaaactctaaaacttaatacacttcatttctttccaaccactgttgagtaaccatgtctttcgacgtatgcggttatcgtttcgacaacagctggtgccgaccgtggggacctccgagcgaaaccactgagagcgaatgctaccgaggaaggtcatgaaggagaaggttacaaagcgaaaggaaagcgacgccggagcggac

SEQ ID NO: 2584 - DNA, 2000 bp, Oryza sativa
  misc_feature (24)..(24): n = any nucleotide
  misc_feature (33)..(33): n = any nucleotide
  misc_feature (47)..(47): n = any nucleotide
  misc_feature (49)..(49): n = any nucleotide
  misc_feature (58)..(58): n = any nucleotide
  misc_feature (166)..(166): n = any nucleotide
  misc_feature (176)..(176): n = any nucleotide
  misc_feature (1049)..(1049): n = any nucleotide
  misc_feature (1217)..(1217): n = any nucleotide
  misc_feature (1763)..(1763): n = any nucleotide
  misc_feature (1768)..(1768): n = any nucleotide
catcggaacactaaaatgttgaantttagggcnaattaagttgaagnanccggggtcngtggtacctgctgagcctatccttgtcttaaataaacatgctctgataacattagtgtgagtcaattggctcttgcacgtcttgcttcttcttaggtgagtaggtganatcttttggngttctttctcttcgtgcgtctccttgggaatgaatgtttgtgctgtaaactggaatactcttcctctctgaaataaatgtcttgcttcttctggttggtaaattgttgattaaactgaaatttaaacatttttttttttgcaatatgtgttctacacaaaatatacttcttccttcaggaggccggacaggaggttgggccgtgttcgccttgatatggaaaaagtacacccaaggtccctcgggttgtcatcgagatacaaaatcgtcccccaatcgcaaaatcagataccgggcgtccctcaactaacaaaactattcgctttggatcccttggttttaaccccggttttgtccgacgtggcggctgagtcagcgtgggacccacatgggccccatatgtcaggaagccatgccagcctcttctctatttcccctcctctctcccttcctcctctcttctctctttctctccctcctctctaggtctctggatggccagcggtggggaggaggtcgacagggcaaggaggtccggcggccggccgacgatgcggcggtagtggcgacacagcagaaggaaagggcggcggcggcaggagcatgggggagatcgaagaggatgacctcgagcacgacgacgagcggagtggggcgacggcgaggccgagcggagcggctgcgcgcgaagccggcagcgcggtggcgggcagagcaggcaggtcgacgaggcagtgacacaagaacgggcgtggcgtaagcgtcggtggcgcggcggagggcctccttgacagtggaggagacgacgggggaagaggagagcgggccagagaggagggatttggagagggatttgtagtggtggcggagggtngagggggagaggggcgagccctaggagtcggagtcggggaggaggagggtggcacggtgggaggagtggtcagcgacgaggacggagacggcggtgaggaggagcgagccgcgcggggagtccgggtcgaggcgggcggcacggtgggcgtgcttgtgcacggcgcgnaggtggctggcgtcgaggtcggtctcggccagggagaggaggcgcaagagctcgtcgtcgtcgttcgcatcggctgcgcgtgctgggtggttgcgggtgtgggggccaccgccgccctcctctcccaccttgcccctcctagtgcgagagcttgtccgccgccgcccgcctccacaactgtaagcctcctcatcataaccctctttcgtttcccgcgtcgcctcctttgccgccgacgcggtctcccccgccgccctcgactcgctcccctcccttcccctgccattctcatccccacccccgccgccgcccacctcgccgtcgcggcgggggtcctcttcgcgcccgccaattgccctgcagcgagtgagcgaggagaaaagagatagggggactgagggagggagatgatgtgccagcctgacatgtgggggccatgtgggtctcacgctgactcggccgccatgtcggacaaaacctgggtcgaaaccatcgagggacctaaagcgaacggttttgtcagttgacggacgtattggggggacnatttngtatctccgataacaagttgagggaccttgggtgtactttttccccttgacatttgggttgaatgggcttgggcctccagagcgggcccacgaacaccaccgactcggcgaccacgcggcggcggcggcgcagagaggaggaaaaaaacctcgcaactctcccttggattgaagcggacgacactccctctccctcggcggcggcggcggcggcggcgaaaagccggccggg

SEQ ID NO: 2585 - DNA, 2000 bp, Oryza sativa
tgaaaaacctggtccctatcctcttctccatccgtgcagctccccgacaccttgaccccccagctgctagagctcctctatggatctatccccactgtttgtgactggattcatcatcggttgggccgttcgtttgtcacatgggcttcgtagttgggctaagccccgagcaaacctactcggcccgattcacccccgacggcccaccaaactagccgaaccactcgcctagtctcgtgccccggtgttcctcgcccacactcccaacgcataaccaaccctagctctcgcaaagcaccgccaccctcgccgcccccaaccgcttgccggcggagttcgccgccgcgccgcccctcggcggtgctccctaccccgcccgcctgaccgcccgcctgtccgtcgcccctccccgcctcgccatcgccggcgccccacccaccgctactcgcgcgaacgcaccgtctcgactagccgacgccgccttgggatcgcccccgcccacctccagatacgcggcccggccgcggagccgtgcttacgtccgctaccacccggcgccgatctccacgacgccccgctcacgaggtagggttttggagtgggaacgacgacgatcgcgttccccctcgcacgccgcctgatttgagctgccccacgcgttcgttcggtcctttctcaggtactcagatcaaaccctaacccgatgcttcgcttgtccgagaggatctgtgcaagtgtgtaatcctggattgatgtgatgatagattaatggtttccctctgcatgtgtttgttgtgtgtatgattgtaacagatctgttgtgttgcccatatcattgttgatacatctcgtgccgagtccatttcaagttcacttcttgtatgtgttgggtataatgctttggtttgtcatgtggcagtctatgcagtgttattagtgcatcactccgtatgtatggacttcaatggatatagtcagccatgaaagattcccttaatatgttgtttccgctcatctttgtaatgtttttggctaaccttgcaatttggcggaatatagttagcaaggtcttttcagatttaataatatagtctggtactggttctatttactctgtacgtcgttccagctcatattattaacgtagtcgaatatattctgtctccatttcccgccaaaattctagttggaacggtttaattccagctttgataataatgtctgttactactgctacgtcgattccgtcaacttgtcgtttctaccttgattacgtggcataattttatctgaaatgattggcttggaaacttcgcatctaataacatctcttattgacacgtgtgacatgttggttcccattgtatataccatttctgctcagctcagcaacgatgttggccaattttgttaatatgattacctgccatatttgtttggctgtgtctgattgatgcacatgttgtatatggacctgctttaacgtaatagtgcattatggtttagtattactattaaaagggatgttcattagcagtttttatcctctttggtggacgtaatacctgctgcacttgaccaaaaaatatgttgctgacatgtgaactctacttatcacactttatgtggctgttaatcaggcaatggatagtgcttttgtctcttgtcgggttaagattcctaatatttgcttctgtaacttttctgactgaataaatttgtttgattgttcctgcccatgttatatgatttattgattgattggtacaaattttgtgattattctcaaaaaccaattcttgcattgtcactgcatatttgtttcttttcttcattttatacgctatatcatgcatgttagagtgaatgccatgcatgataatttctggttttattgcaaatactatgaaaattgaaaagctcacacctgcttccttttatcacctattggatttgcaggcatcaaaaccctgatttgataacattaagtggaattttga

SEQ ID NO: 2586 - DNA, 2000 bp, Oryza sativa
tatctcacatttctcttctaatataacggtgtgtaaaagtgtgcaaaaaatatatcccatattgctcaaatgcattagtcagatttaaaccatgtgagatatctaagttttgaatgtctattacttttgaatcataaattgtatttttcatctatttgtatctttttttaataattaaatgttgactacccccgtgaaatctcatcgtatttctatttttttagtgtgacgtatatatacggtagtcataattttctatgatgaattacgtcacctatgattagtcgattacgtttgctatcaaataatacattaattattgattttttacacaaattggtagagaaattagttacatatggttgtatatccaatatcttttatagcaaagttttctctcttttccgatagaacttcaagagtcagatgtcataggtagcataaaacccaatctcaagtaggtaattttataaatggcataattaaattcgtcatgcaatgttaacggagagaacatagacaaatcgtacttttgaaatgtggcaggtattatttcataagtatacaactaagtttctcaaatgcaacctatgatacatgcatgcgcgcctagttatccttaaatgtgaagttgtagttttatttttttttcaagtcaaagatcacagttaccgtggcttaccgttcgtgcagtaacatgactttaccatgggatttgaaaattcttaatccaaactttcctaaagataaaattcgtatggtttttgacggtcactgcacaattatcacgtttaccgtcgtcttaccatcgaggagttgtaacctccccggtgatggtttgggaaaccttgctcataggcattatagccgtatacaagtttatttcctaactttattggaagataaatttgcataggcacatatacttcttcagtttcaaaattcgctttgatatgcccttattgaacatatgggatatatggaagttaaatacccttccattacctgggcagtgctttgatttgtccgtttactcgttatggtaggtaattaacagaatacgttcggttggcaccgattaaataaactttcatgcaacaactccaaatatgatatcccacgtcacatccatatgctcgcatagcgtgcagtttatttaacgataggaaatatacaatatcaaggtgttaaaaataaaatggaaacaattcaattaactattgtcaggtactattagaccatatgacgtcgtgggagtaagctactaggttatagcacacgttctattaaaaatatatgttgcccaataacatcaaagataatttaagtaaaaaaaccatagtagagagaacatgaagtggtaaaaaaaccattgtcacgggttttggttagtcatatttgattactcgtaaatatttttactaaaataaaagtgattgagtttgaatgtaagcaacttctaacgatagtgcattctaaagtgctaatggacaatgaattatggccagaattgagttcacgacaatttcgaggttttgataaattgatttaaaacgctttataagaagtgtcaatgaaaaaaaagctttcgtaaaatcgtgctgtgataaattaggaagcttttcgaggcggaagcggataagttaaataaaaaagtcaataaattaatttaaagacgttttctaaagtaatgacacgaaaaaggattatataaaaaacgtgccgtgacaagtttagaaaacatgccgtgataaatttaaactagaaaggtagccacggagggagtactctccttcagccagataaaacgtgacgatatataaacggagtgagtagattaacttagttagctctcaccaagtgttatgttaaaaaaagaaaattaaatacaattacaactgtgaacttgacgagtgacacatttaatcaacggtgtgtacggtaacttgttacaatcataccgaaaacccctcatctagccacacggaatagcccacaca

SEQ ID NO: 2587 - DNA, 2000 bp, Oryza sativa
  misc_feature (1355)..(1355): n = any nucleotide
atgatgtggcattgtgagagaacaaaagaaggaagataatttagaccatacatctaagggttaaaaaaattgagatgatatgggttaatgagagaagaaaagaaaagagacaatttgaagcatagattaatcatgtaagtactaaaagcaattaatgtgatatgacttaatgagagaaaagaaaaataacatgaattaagtaagtatgaactatatagatatataggatattaaaaaaatgatgaagagatatattgaaatattatatgaattatgtgggacgatttaacatgcttacattttaaatatctaaaatttaataaattattaaattatagataatatagcattcttgaatgatgcttaaatataataattgttagtagatgataatgtggtatctttgcatgttaagctttaggaattagtaggcaactttataataagagaggatacaaactaacacaaaccctaattcaaaagggacaattgcatctatgccctcactttcaaccccaactactgttttaccccatttttagggtttacagttttacactcactttttgaaaacgaaccagccgtttgccctcagttttaacacccgttaggtgggccctacttttttgggttaaaaaacaaatggaaatgaaaaaaatgatttatgaaatatcaatttaccattatacccttgagggaatggataagcatccaaccagctctcctctcctaccggattggtccttgcgcgcgtggaggcggcggacgtgggcgcgagcgggcgggtgaggcggcggccgcgggcgcgggcgagacgaaggcggcggcagccacgggcgagcgcgagtcggcggcggccgcgtcgaggtcgccgcctacctctaggtatggcacctcgaggaggtggcgtcgcccctcgccatcgacggcctcttacgtcgggtggatgcgccttcgcctcgactaccttgcgccgccgctgcagttcctcaccaacgcatgcgtcgtcctcttcatggtccagactagcatcgacgatgaatgctagtagtatttgtgatttttgttcaaattttgtaattgcataggtatttgtgaattttttttttgttaaagttacaaaaagtcacaagagatgctcatatttggtcaaaatgctcatcacacaagctaaaatcaaaaaataggagcaaaatcacaccaagctgaaaaaataggggcaaaaatacaataaccaccaagggtataaatgtcctttttctacaactaacaccgttaaaaccggttgttagaagtagaggtacacgactgattcagattaaaaagtaaggtaaaactgtaaaccctaacaggtnaagggtaaaacagcaattgattttgaaaggtgggagcacccatgcaattgccccaattcaaaatccatgtccatactcatcattagtgaaatacatcaccatttttaaccaaaaaaaattgtttatagacatagtttgagatgttattggtcaagctttgcaagttaaaaagtgaaagctgaaaataaccctacttcatttcgatttgttcagaaatgaaattgtttaggctaaataaaaaatagcaaaaaattttaaaggctgaaaatagcttagtcaaagtactagtgctggcgacctggcgtaatagacaaggcagccagagtagtaaactgtaaagtcccccctgtccctgcgcgaacacgtcccccgcgcccgttaacctcgccgccgtcctcctccccctacgtcacactgcacacggcgtagccagcgcgccgccgctttaaaatatttcgcgcgcagccagcttcgtcgccacgccaacgaacgccccccgcgtataaacgccaccgccaccgcgctcttctctctctctctctcctccgatcgatccaagaatcgaagcagagcggagcagcgtcgccgtcgagagagagagagagagagagaggtgttccggcgccgggatgaagctcaggtcgc

SEQ ID NO: 2588 - DNA, 2000 bp, Oryza sativa
tcaacctacaagctcaaagttagaagtatacagtgcaacctattgtacttgcaatctttcgttttccttaactagctatggaatgactattttttttaaaaaaaaaagaggaataaccttattttctttgttagatatctttttacaatgttgcaatatgtgcagtttcatagcacagtccaaagactactcagagctatattgcagggctgactaaatgagtagaaacagaataaatataagtggaatcttgatttcgatgatcataacttatattacctgttgtttcaattacaggttttggaaagaataactgacacaacagtcgcaacagaactagaagtccttattggccttagttcacaaatatgccatgtcgttcctgaagactttgcccgggaactagagcattatcagattaaggaaagatttgtgaagaaactagttgaggcactgaatgcaaatgtgaaacctactgcccactgccccaggatcaggagggtgatagttgagcaagttatatatatgatggaaaacaattgtagctatgcgaactgtttcaatgaatgccagatgatggaagcactcacggtggtagaagagacaccttcaaaggttgaaaagtacaggctcttcatgggggatgcaggactaatggaatacagcatgccactctctaatcttgtcgctagagcaaaggaagaattaagcaatgcatcatgtaacatgattggttaagaagcatcagcatttttttttctttttgaattttagaagcatcagcattcagtagtcacgactagcagtttatgtagatggtactattttgtaatgctatccatgtaggagatctgctaaattaagagttggtatctaaattaagagcgggaaaatggtattattagcattgtacacaagacgaccacgatatatgtgtaactaagagattttgccttgcagcgagaataactgcaggcattgtaatgaatttatctactttggtaccattaacatttagtcttgtaatgttcaaagaatcaacagcagtggatatttcaggcgattactgttctacctgtcaagggcatcgcagttgtagaatgaattggtatgaattgaaacaatacccaacaccacagagttacccacttggccactaagcacttaaccagttccaatcccaagaccaagcaagggaggaaaaaattaattatactccagaaactagcctgtaaaccctaaatctgagcaccaaacacacgggcgccggcgggagaaggaatgcaggaagagagatgaagagatgggaggcgagaaggtaattgcacctgctgttaaggaagggaggcaggatagagctctccacaccgagcttcctctgctgatccgctcgccgccggagcggccatttcgcgcgccgccgctcgcccgctccggcgacgccaccgctaaccccgcaccgcatgaggcggtctgacggaccccgcgaggcccattagccacacatccgtccggctctcacggaggcctacatggcccacgtaacgtaaggcccatgtcgcgctcctcatcttgccgtcgcgtcgcgtcacgggcccaatcacgcttccttgtcccgctcgtcgccttcaaaacaaactccaatccgtccgtccatccatccatccttccgttcggcttacatcgtctttagttctaaagtttgttttttaaacttttaactttttcatcacatcaaaacttttctactcacataaactttcaacttttttatcatattgttttaatttcaatcaaactttcaattttagcatgaaaagtagcacgaagtcttccgaccttagcgacacggcgatgacgagaaaaatggcccaaacaaacggtcactggaacgatcgagcgggaaaaggccaggtgaaagtgagagtgcgaaaccaaacacatctgcatcatgtactggaacaagaggaggaaaagtcagaagaggcgggagctgaatg

SEQ ID NO: 2589 - DNA, 2000 bp, Oryza sativa
  misc_feature (244)..(244): n = any nucleotide
gcaaggtgttgccaatacatgacagctgatgtgttgacatcgccttgagatggccgatatagattatatcacccttagcgtttttttcattctcatcataatcggttgtgttctgccgatgtatgacagccgatacagattatatcacccttagtagtttttgttcttatcataatcggttgtgttctgccgatgtatgatggtcgatatttggtatatcgcccttagtctaaattgtaatttnatcaatgtttccaacattgcaaaattagggggcctcatatacataaagtttggattttaaaaggaaaattcaatagcaaacttcattatattacatcccaaaagtttgcaaagttgaagttacaataatttgttcatccagacaaatatttttggatggccgatattgccctttgcctaatttgatctacttcatctattatttgggcatcagctgcatcagagccagggatcactttcaaagacttcgttagttcggccaagtgattaacagatgctttcaacttggacttttgatcttcaatagccttgggcagatcagcaagcttctgttcctctaaatcaatttgagcattgcactgttctaactcagcaaggagttctattttccgagcattaagccgatcaatgctaactcgggtagaatctggaccagcttccaattggtcaagttttgctttctcttcattaatagaagtcctgctaacttggatgattgcttcaaggtcctttctctcacgccgattggcaatcctcttttgggctttttcaagtttaagccgatgttgctcaagatatgctattggggtgatagtattggctagttcatctgggattttgtcgtggatgtcgagaaatctgtccctaatggatctgcagctggtcactaaagtctctagggagccttcaagccgtcttgagatatacaacaaagttactgttgtcgaaacgacaaccgcatacgtcgaaggacatggttactcaacagtggttggaaaactgtaaaatgtattaaatcaagaatttttcttgggatcccccattacatggccttaaggatctatttataaccctgttataggtcctccttttagggcttaggttttgcaggggaatttacatggttgcccttatgaaagggacatttacatgggtacacagtgtcatttgcatacatgggcctctaatgggcctggttggcaaatgccgacctaaaggccggccggagtggctaggatagcgaagtcaccctccttcggcaggcacccttcgcccagaatgtacagtcttcgccataggggtccatctcttgccgtcctcgctccattgtcttcgccatgtggcttcggtgtctttgccgtggggcttcgccccgttgaaacttaacactttgagcctggatcctgactggtcgcacggtttcggcaggtctggtcgaagggtctcacgacataccgccaacaagcccctcacgggcaagggtcagatgggagcttcggccaagaccatgcaaaccatgtggtatggtatgaggcgccccctttcgaccgacactcctgccgaaacctatcttggaatcctgcaaaggatgcaagcgctgcatgtacatttatgcctgtggttagtaatgtgttgcagtttttgcccttggcgaatcggcgaagctggctttactccctcgttgggccgagatcaacagtgaagggcttccttttgcgggctcgtcactgtgcggcttggttgatgggaatttaccgtttcgcctctcctcaagacacatggcggctcgtggttgggtaggaaggcgaaccgtcgcttgggtgggctagatatccccccttcccctttttcaccgccgctcccccgtcactttcactgcgagagcaattttttctccgtctttttcctttacagcgcccttagagtcgctaggtcgttcgcctgtccactcttttcgccacaacacacgcttttcg

SEQ ID NO: 2590 - DNA, 1898 bp, Oryza sativa
  misc_feature (27)..(27): n = any nucleotide
  misc_feature (29)..(29): n = any nucleotide
acccccccccccccctcatggtatccnanttgattttgcaaatattgccgaataagaaaaggacacttttattttccaaggaaaagtgtacagagatatgcctctattatcaaggggaaaaggagctaatccacacgacagttttaccaaccacatctagtgaatatatggtaagcggattccggcattgtcaaagaccaaaaagagtcatttgtaattataaaccaaaaataaagacatgtcccatcatgaactcaactgtgctgacctggctcactaataatgcaacattatagtacttgcagtttgcgcaactaagacattccgtttccatttctctaacatgaacagttgcaggattctatatattgtaacattacataacaaacaggatttaatatctgccatgatgcatgaatgcgtcaattccatttgcagggtctagcaatgtagctcctcacatcttattttattacctaaagattgcattatcaactttcatagtcaattggttgcctgtttggagtctaaatttcatacattaccaattttattattaatatctatccttcattgttcgtcgcaagtggggaggtgcctaaactcatctaacagccatcttgtatcggatcctttccattcaatcttaatgaatccaacctaaagtaattactctgcgcttctgtcctttatttatcctcttaactatattatgaacagacaccagtatttgccccagaagatttttccaaatcatgttaagtaatcctatatactgggacaaatacattataaagtactaaaagatgcttgcaccactttacttttcttactaattctagagcttagataacatatggtgtatataaagctcatggccactacatccaatagaccaagacccaacctgcagtactgtataatagtataatagtaagtcttccagtctgtgccactacggtgacagctagcatgtgacaaaatcaaccaaatgctttggtgaacttggattcttgtgatacgttaacatatacaatcaaaatttacaagtaaatacaagacaggcaaattgaaataaatacagaaggcaagctggatacgcacctgaagtacttacctccatctaccatggtcaccattatcgaaaaggtgatatgaaggcatagcataagtggcctgtcactcccaagatggttaatccatcaagatatttcatcagacagcaggtatgcagatccacagaaagcatttcaccaaacatgaactgtcctccagcgttctgtcaaacagcaacaggttgatgcccaaaaagggtatctaagttcagacaacgacatccagctgtttcttgcatatcatacctgcacataagttgtacagagaaatactgcacacaacatatctgacactggagtttagcggagtgacagcaacgtgcccacaatatatgacttattaggagttggataatagattccatggagtcattcctggaacatgcataggaacaagtctttgtagtcatgtaaagtattgatatgtccagctcacacagcatgacacaataaaaacaataaaagtctctttctgctctcgtgaactatggtaagcctcaaatcattgcacgtttctttcagacgacaatgctagtcaatttgaaacagtgggatgtgagaaccccacaaggaataaagaagatgagacagatcaatataaaaagacgacttgggcaaagtcttccagtctacatcttcattgataatgctaagcccatccatggcatcactattaggcaagagaagcacagctatatacatcattatgcatagcaaagcaccttattagcattgatccattcacaacttggagtacctcctttctgcttctatctctcctgc

SEQ ID NO: 2591 - DNA, 2000 bp, Oryza sativa
aaaaaataaaccccaatgataaatatgttcgatttttaaaatctcaatgacaatagagagaggagtctgtgggccggcagtagaggagtacagtggcaaagccgttgacagtttgacaggacttctagaaaataaaaagttaaacccaaacgataattatgctcgatctttaaaacctcggtgatataaagagaggacgcagcgagcgggccgtagaggaatacagtgatggcgtttgacagaacttttaaaattataaaaactagcatggtggcgcgcgcagattacgcggctagcatcattgtattttctttcatataaaagcatatatgttttcttaatgtattgttcaaatatattaaaatgacaatataattttaaattttgtactaattttacgaaactactaatgtgtaatattcatattgtattttatatacgtgttagttgttaattatttttaatatcaaattttagttatttgtaacttatattcctatatggactctagactcgtctttcaatatttctttttctaattccgaattttggttatctgtaaattgtatttctacatagactatctgtaaattgtatttcatatagactctaggctcttcttctaatattatttatttttaattctgaaatttttattatttctaattggtatttctatgttggactctaaactcctctttcaatattctttaatttttaatttcaaattttaggttacttctaaattgtattcctatatttactttagactcttctttccttgtttttttttaatttcgaattttaggttatctggtaaattggtatttttatacgaactctaaactctacttttaattttattatgtttattccgaatttttgttagtttcaaattcctatatgggactctatactctacttctaatattccttattttttaattccgaatttctattatttcttaattgtatttctatatggactctatactctacttccaatattccttatttttttaattccaaatttctattatttcttaatagtatttctttatggactctagtgcactctgtcaatattccttatttttaattctgaattttagctattttatattgtattcctatatggactatgtttttttttctcctattaatgtgggaatttctagaccgtgagagcgaacgtggaggctcctttttctattactttaataagataatagatgataacctacgagacaatgaactctaaaaactacagagtcaaatttttaaaaggttttaaggaggatgaataaaaacaatagtagatcggcaaacaaataaataaagaggtgataaagaaacaaggggtagcgattgacgtgagttttaaaaatataaaattagaaacaattcggtctttcaaagtcctaaaacaacgagttagctatttaacaaaacttaagtaaaatcatatgtaaaaaatagataattttgtatgggtactagccatgcaattgtgcggatcacccggctagttcgacgaattcaagcgttttttgggttgcagcgtttggaaggaggcccaaattaaagtggtgatcgaaattgtcaagtgcttgagtagatagagattttgtttggttggcactaccgaagcatgcattgttggagtgggatgccatagagctgcgatcaagatccgacggctcccaatggctctggtgacatgtctccttgacactttccaaaaacggacaattggtcggttgatgttgggttccttatttgtactactccagaagtatataaaaagcggaagttcccaatgcaacaagaggaagacgccattggagtccaattaacttgaataatggcgcgtcgtcgtcttgtcctgctgcttctcatcattggtacgttattatactcatggagtaggatggttaatttgttgatttgcagttagcggaggagtaattaattaattatgttattaatcttgtgttggc

SEQ ID NO: 2592 - DNA, 2000 bp, Oryza sativa
  misc_feature (692)..(692): n = any nucleotide
  misc_feature (862)..(862): n = any nucleotide
  misc_feature (1740)..(1740): n = any nucleotide
  misc_feature (1767)..(1767): n = any nucleotide
acggggcataccagcccccacgccgtctgacacggagtgagacgtgggtgcgctgccgcctgtcccatccatccatcgccgggtcacagaccggtcaaaagccggtcgcctggcgcacatccatcagtgggcggcgcacgtcctgccacgttgcattaaatgcgacggggcggttggagcactgcccataaatgcgcctggcaaacggcgctcctccccgctcaagcccccatgtggcggccacgtggcggccgagcgagggcctcggggcggtttagcccctcgggcccgaggggcgcgacaaggtaccccgagcccccgggaggcgaaacgggcggtcgctcttcggccgaccgcacgaccccccgaggggggctgggtccaccgcgcacgttgcggaggaaaggcttctcttcctcctagcctaggtaccccccgggcccatattatcgatagagagaaacaacaaacatcgccgccgctgtccgcgaggtctcaagaaccttgactgcgctttcacccactagagggggtgagacagcatgacaacgccctcaggagggagtgacgctcgactgccatcgttgctggctcggccaaggacgggctgggttttcacccgccatccaccgcctgcctatccactgttgacacaccgatgctccactgccatctgaacctccgccagcgtntgggcaccactacaccggtgccccgtgccgggcagcctccgcatgccaccactggctgcgccatgtcacctcgttgtgctggtcgctgcaccggaatggcacactcctctcgatagctgcaaccactgttgccgccgaatgaacctcctcggatcgcgactaaccccgtngccgctaaccgggcctcgccggcctacacagccaccagctgtgccgcacctccgcgcctcctcgcgccgtgggcacctcaccggtcgccgccgttgccgggtgctgctgccgctggctggccacccgctatcgccgtcgtcgccacgagcctcgcgctgccgttgccgccgtgacgagcgctcctaccgcgagctcgccccacccgatctggccgcagggtggccagatccgcctccggtgcgtcgaatctggcccgccgtcgccatccccgccgcgcggcgcagctcgcccctaccatcgccgtctccatccctgccgccaaccgccaccccaccagatccagccggagcggcaaggatctggtggtcaccgccgccgccgccctgggcggctcccctggccccgggagcgagaccctatcggcgaaacgaggagcccgccgccactgtccttgcggccgcgcggctttgccggcagccgctcaggtggcggcgaggcggaggaggaagatgagtgggagggggcagccggagctcgtcgcctcccgagctgcccaggggagggcgacgcgagaatttagatggagtggttttgatcagaatacctctcttcaaatatttaaaaactcgtattcaccatatttcacttagcttctgaaatttgtttttgctcgattgaaatctcgaaatttttttctagcagggtgataattgcaaaactacataagatctgattgaaaaaaaaaacagcacacgcttcagtcacttttcacctctaccatcatcagaactgcacatacgattcagttatttttaccgctcccgtcaaacttgcacgtaatctaaaaaagcccaaaaagttcgcacgttttggcgtntcccacatataccagccaaaaaaaaanggtaaaaggaaaaaggaaaattcccctctgacctgattctatctctcgagcgggctcggctcctcctcgtcggcgttcctccgcctccgccgtcttctccgccatctcctctctcgagctctctccctccccgatccgctccggcatctccggcctccgctccgttcggccggcgcgccagtgtcctgtgtgtcccccacatcttctgccgcaacttgcaaccctagccgcgg

SEQ ID NO: 2593 - DNA, 218 bp, Oryza sativa
  misc_feature (3)..(3): n = any nucleotide
  misc_feature (6)..(6): n = any nucleotide
aanctnttaaaagcttcccgggggggggggcgctgagcgagcgcgaggggcagggcgatctagcgagcgcggaggagagggcttctagatgcaggcgccctccgtgatttgaatggagggtagatctcgagagggagggaagcttctagaagcggggtgaggcaaggcgaggcgaggcgaggcggcggttagggcttggtttggtggccgggggaggg

SEQ ID NO: 2594 - DNA, 2000 bp, Oryza sativa
  misc_feature (1606)..(1606): n = any nucleotide
  misc_feature (1629)..(1629): n = any nucleotide
  misc_feature (1679)..(1679): n = any nucleotide
  misc_feature (1808)..(1808): n = any nucleotide
ttttgctcaggcagtcaggacaatcaacaattggtctgaagaaataaagtactagttaaactagtggtcattagttaacatcacaaacttatatttagtatttgctcttttagtgaccaatattttgttgttaggcacttaggatctttgattcatttatgtagaatctttgttcatttatgtagacaagtttcaacgaagcctttactctctcccttatagtatcaaacaattaaacttctaccaaaccaaatggccaattaatcacttgggctcactcctcgccctacgagtctcgattgattgcgtccatgacccaatcaagtcggacaaataactaataacaggggtagcgagatgtgccttgcgtccttaagccaattgttgccatcatcaagttgtgggggcaaaaccatggcttcttcattttctcgggagattaggggtaaagaagaagagggaattatagcttctaagttgcttttccggtcatgtcatacgccaatgtcatggcataccataggagtaagtataccttcggatatgtgcaaacctactttcaatgaatacattttaatgatgcactaaaatcaataaaactctcaataaataaattattcatatatacctccggatatatgaagcttttaaaggttctttttccactaactaacatcggaccactaattgttatccacttaaaacatgcattcagggcaggtttgttttgaggcttaaatttggcttattaatatttgtgaatttcaatagtgtttagtgtctatttggtttgaagccaaattttgatatgcctaagaaaataggccatttcaatagttaacttatgctattttggcttcaatccaaatacaactttgccttcccaaaattaatcatgccaaaacttaccaaaatttggtattgtcaaaaaattagtaaggccaatttaggggcctgttcactttgatgctattttcaaccttaccaaattttaataaagttgcaaaaaaagtgactacatttaatttactgccaaattttggtaactatataagaaattctgccaaaatagcatcaaagtgaatataccctaggtcacaaaccaaaccagccctcaaccttttatcatcaaaaccttgcggattagcattagcttatccctggaggcctttttttaatcagaaaaaaatctcatcgcagaagtttttttttttgggcaataggtgcttctaacaaatggtaaaagccctagctagccccgaggacacgcaaccgcccttaccaccgtccacccgaaaaatccaacggccaggatgtcccccttggcaaaaagcgggcagcccccgtcctagtcactggccacgtgggtcccacaagttcagcgaccgagcagacacctaaaaccgccgcttacaaatgggcccccaacccttggcgattcgagcccccaaagctcgcgaggtcgaggagctgaagcgagaagagagagaaagaaagagagagatagccgagcgcggagacagaggagagagaaagagagagagagagagaggagaagccgtaagcctagccgcctcctcctcctcctctttcgccgccctaagcntccccccgctcgaggaggggganagctctagggtttcgcgggcggcgccggcgcccgggggggtgcgcgtggnaaggcctcgagatctcgcggcggcgccgccgggtgtgggggtgtgggggcggcggcggcggcggaggcggaggcggtcggtgagttcgttcgttcgctcgctcgctcgctcgatctctcgccgcgggtngtggtgccaatcgagctgcttcgccccccggattcgagggttttgtaaggggccgccccttaatccgtggcgcccgtggaataataagctgggcctcttccccctccttgaggggttagggttaggtttttgaggaattgcgggtggattttctttggtccggcctgacgcgtgaggggggtttgcgcgcaa

SEQ ID NO: 2595 - DNA, 2000 bp, Oryza sativa
  misc_feature (1567)..(1567): n = any nucleotide
  misc_feature (1576)..(1576): n = any nucleotide
  misc_feature (1717)..(1717): n = any nucleotide
cttctagttctttctctctgcaatctgcatttctctgttcagaaatgaagtgattttcagcatcgacgcacgaccaaaatgtcttcagcttctactcgggcaggcgacagtattgcaatggtgtttctgaagttctaaggggatacagagaaattgcgccacgtgtccggctgtcaggtatctatattgtgaccgacgagttcattcttgcgaaggatgaacgatgaattcatctctcttcttcagaaagataactggtgagttgtggtttaggtccgacatctttagctccaataatagaaactgcaatgagaataactcaggactccggctaccagtatcacatcctactgataatagctgatgggcaggtgtgccttttcctctgaacttctgaaaagaagttgccgttttccagaatcttatggacaccttacctgttccactagtttttttttaatccatgtattttgctcatgctacctcaggttccaagatgttgtggtgctaactctgcgaacaatcgggatgagaactacctggaagaaaggactctacaggctcttgttcaggcgaggtacatagtggcaacactaattagattagatgtttctgaattctatctaaaagtactgactgaacataaggtgcaacttttttccctatattaataaacttcggctggcttccgccagcccggcgaaaaaaaaaacataaggtgcaacttactattcttttaaaatatatagctatacttgaatttgagtaaggaaaatgtgtacttatgctatgcactcatttccctctttctatcgtgcttgtcggagtgggcgatggtccatgggatgagcagctgatgcactgtcaggaggatcgacagctgtttgacaatttccaggtgtttgttgggcatcacaacattgatttatatgggaggatttgctcataattaagctagttttgtcttcgcagtttgttgatttcaccaaaataataatgtcaagagaaatgcctgaaaccgagaaggaggaacaatttgctttagaagcgctgaagaagataccgagccagtacgcagccataatcagcaagaggatcaggtttgtagcatatctgacaggaactgaagatacaaatagctggtttcacctgttgctacctgctaggaatgttcttttggttctgaattctgattcattttcctattgtgttgtggtgttcagtgatctggctgcagatgcgccttcaaggatgcctcttcctccccctcctccaaggcctgttatttctacctaataattttcaggacaggtatctttctgaaccaagatgattttcattcaactcaacttctgggaattgaactcgactgaggaaactttgtacaattgtgttgcccgcaggggaaatgacagatgaatgtacagtaccgcaaagctagcccttggattagtttcagagccgggagatactattaacctcttaggggaagggcaggccactgtaaacctttttattttacaaagtggttgtgtaggcaatgcaagcctagtctgatgacttagcngaatactantttaaatttaatataaatttacttcattatatcacttcactgccaatagcttgtgagactcttattttctttttctttttttttttggagcaatggcatggttgaactgtcatgctaatcagtgatccagtggtaagagtntaaaatttaatccctattctaattacaggcaagtcacaacattattatataaacaaagcttaatttcacttttgtcgatttattttaaaatatgtacggcccagatggctatgcacgtactcctatatgggccgtgatttgggcccatggactgggataaggaaagcgaaaggagaagaaggaaatatcatgattcatgaacccaacccaaccaaccttctcctccccccaaaatcgtcgcctcttatccccttccttcgattctcttccattccattcccaa

SEQ ID NO: 2596 - DNA, 272 bp, Oryza sativa
ggggaaaatttggaagggggggggggtcggggggaaggggatcggtcaaatttgacactttgaatggcaatgtccaccctttcacttgatgcatccccatcgatgtcaattagttaggacacaactttaccaggtaagagttggccttcaccatagccacctcagctagaaagtagtgtgggtgggggtggccacgtggtggatggtgatgattactgttgggtgtcaatatggtcgacttggcagatctagcggtaacctgagatggatag

SEQ ID NO: 2597 - DNA, 2000 bp, Oryza sativa
caagctccatcaaacaagatatagatgtgcaaataacccaaaaaagggacagaattctgggtcagtgctctagtgtctttctccgttacatcaatgcaactgcttgctccttttttgtgtatatatgtgatcagcagcagcatttcttgctatggatatgttttgagtaaatttcagaaaaccctctgttttatggtcacagttacagaaaaccacaggtattatgacatgcggcacctaaccatataggtataacagttctaaagtttgacaaaaccctacccttatgcattttgagcacagattacttacaattctaaatcatagtgtgtacatgaaaattttaatttttaagttcttgactaaggttgataattaaaatttttactaattcaaaagaattgttcaagatatgcaaaattaggcctagttctatttttcaacttcaaacttcaactttctcgttttccgttagcacgcttttcaaaccgttaaatggtgcgttttttaaaaaagtttttatacataagttgtttaaaaaagcaaataaattcatttttgaaatttataatacttaatacttaattaatcatgtgctaatgagatttctcgttttgcgtcaaaaatctatctgccaaacggatgatcaaacggggccttaatcaagatttcaataaatgtggggttttatgaaatatttagaccataatacatgtggttgtgtgccacacatcataatatatgtggttttctgcaactttgatcataaaatgtgagattttctgagttagctaaatttccatgttgccctttttaatggtctcaataattttgttgttgcttgttgagtactatctgatattgtttctgacaagagcttcctcagtatatgggttacacatttttcagtcttgatatttgcttctatgggacattatgtcaaagttatctcggtaaatgttcagttttaactaacggcataaggaccccggacttcagagcaacctgtctcaatcaagccgttcataccatgcaaggtgcctgaaatctgaatcaatacttcctttgttggtgaagcatagcactttagagtttgatttattaattcattttcttttgtttcagaactttagacagctgatactccatcaatctgaagtttgaatatctcaagtttctctgattcggcaatcatccagatccatcattaatctcttaatatgcatagttaacttcgtctgctgctcatttttcaccatcaaattcctagccagtgcttcgtaaagatagtaagatggacagtgaagttcagggcatattgcttcttattaaaagcttgttttagtgtgatatggcaaatgaactaccctgaattctggtttcatgaatagattttacacaattatttttcttctagcctgcatatagtagttgtagcttcattaggcggttaaaagaaattttagaagcttgaactctgggtccttcacgtttatgatttgttcagatttagttattgcagtatatctctttttaaacttcgttagctaacgcctgtctaaattgcactgttcagtgtaccagttcagggttctgccgaaatcattctagggccgtgtttagttccaaaataattcttcaaacttcaacttttccatcatatcaaaactttcctacacacaaacttccaacttttctatcacatcattctaatttcaaccaaattttcaattttgatgtgaactaaacacatgcaagtcttacagtagcttctgggtgtattatagaaaactgtattgtttgatactagcacaatagctcaagtaaagtaacggctgtgcgaaagtgcgaaaccaaaaatccagtccacgctgcaaaacaggtcaatgccacctactagtacttatttttcccatgcaaccaccgtgattcaagaataggcagacaacccacgctgcgaccggcaaggttgtactagaatttaggctactcaacattca

SEQ ID NO: 2598 - DNA, 2000 bp, Oryza sativa
tcaaatatttctatggaaggttcaaactttagtgtaatatattatgatcttgtttgctcaggattagagttttgtgcatagttaccaatagaagcaaattgtataacagctaagccatctatatatgatggtgtaaaattaacacaaacacttattgacaaagacacaaaagggacaattgcataccagctaaggaatgtatcggaacattgtagggcatcttttgaagtttcccatcatcaacgtcatacttcagtaccgaaagcaggccattctcatctccaaggtacctgaatgcagcaaaaggatttagcatacaagaaaaggctacaaactactccaacaggtacactggcctaataaactaaagcggtggggaagacaagtttccatatatatagctcacatcagaaatgtcccctctacaactgcaaaagcagttatattgatgtcccacttcgaagaataaaatagttgtctgaactcaagattccatacctacaagatacacatgtattatatgcaaacagtccctagcactggcaacattcttgtgaaatgaggatagagtaacaatatatgattcaagtaagcataactaaacaaaaacagataggatgcttgcaaacttgaagagttaggcaacaattgacatccttattaagtgaaacaacagcacacatgtattatataagaagaattaatttgagcaaaagaattatatgtgaattgctcacggcactacctggatttcattctcattagagatggcaatcagaaacccctggttctgtataaactgcaaaagagaaatgtattagtttgttctttggcaattgcaacaggaacaagtagttatgaatcaatgcagacagttagtttaacatagtaagtagcagacatgaagtagaatgaagactaaaagggcagagcacggccacaaaatttaagaaaaaggctgcagcatgcaagcacaagaaaaaaaaaacagttatccaaaaattccgcagagctttgctgtcctggtagttccaaaaagaagaaaaaaatcctaaaattccgctgttgaaagaagaaaaagcgtgggcacatttgatttggcagagctgttagttgagagatatgcatgggcaaacctgcaaaaacttgtatgggagactgttgggtgatataaggaggccctcgatgttatcgcctccaaagattttaatcctaccgtccctgcaatttgaggtagagaaaaaggctatgatcagcatatatagatttatagcgaagaagaaataactttaacaaggagagcagtaataaaaaaaaaagtctagtcgaggactgaatccatgaatgaaggttgagtatgagaaggcagaagaagaggaacggacagtgtggcgagggcgaggaggcgctggacggggtcaaaggcgaggagcgatgcggtgtacgggatgccgtagtgaagggcgatctgcgcgtccatctgtgccacatctacatgagttcctccctctccctgcagcaaaacagcaaataaagaggaggaagaaattaatattaattgagaatccaaagcaagcaaagcgcagctgttggctgttggatcggagcgaggtagcacctgatgaagagccttgtggaggaggcgcttcatctcatcggagagcagagcagagatggattaacttgccggcgacggcgacggcgacgactgacaggcaagcagcagactgaccgcttcttctcccaactccctttcttctctctcttgtgtggggacggagaagagaagaggcgggtggaacgggccgtgatcggcccaataaaaagaaagcccaaaaaacatccggcccgcgccctcggcctcgatgaaatcgatctttggtttccgagaggattgattcgtaaccgattccaacttcaacacccaacaaacccggcggccgcgaacaaatctctcgcgctcctcctcctctgccgccgcggaacaacaagaagaagaa

SEQ ID NO: 2599 - DNA, 493 bp, Oryza sativa
  misc_feature (8)..(9): n = any nucleotide
  misc_feature (29)..(29): n = any nucleotide
  misc_feature (37)..(37): n = any nucleotide
  misc_feature (51)..(51): n = any nucleotide
  misc_feature (59)..(60): n = any nucleotide
  misc_feature (75)..(76): n = any nucleotide
  misc_feature (80)..(80): n = any nucleotide
  misc_feature (84)..(84): n = any nucleotide
  misc_feature (91)..(91): n = any nucleotide
  misc_feature (94)..(94): n = any nucleotide
  misc_feature (101)..(102): n = any nucleotide
  misc_feature (119)..(119): n = any nucleotide
  misc_feature (127)..(127): n = any nucleotide
  misc_feature (140)..(140): n = any nucleotide
  misc_feature (145)..(145): n = any nucleotide
  misc_feature (159)..(159): n = any nucleotide
  misc_feature (167)..(167): n = any nucleotide
  misc_feature (173)..(173): n = any nucleotide
  misc_feature (176)..(176): n = any nucleotide
  misc_feature (179)..(181): n = any nucleotide
gaattcgnntcttgggagaatgaataganatagttgnaaatcgagtaagcncataattnngtgtcaaagacgtanngganaccnaaaggcntancccttgnnactctaaaattgtgacnggaatganaattaatagcgtnaatcntatttgcccgcttngataattnggaaanganctnnnacgcgggccgcccaactatttttttttaaaaaaaacgagatgcttagggagcatatcatccagatggacggtagagatgtccgtcaatggaagaaagtccggctcccatcggaagcctattcagctaaagaaaaagccaaaatttaaattttcaaacttaattttgatattgattttgagatattttcaatgtagtttctttttcatcattagcttttgagtcaccgagaacacatatataaaatttttacctacaaatttatttttattatataataaaccgttttggcttattacaacgaaagccaaacg

SEQ ID NO: 2600 - DNA, 2000 bp, Oryza sativa
gtagatgccttgtccaattgtcccctttgaaatggctatctccttcatcattaggttgatgatgtcaaatcgacgaccctccatgatagcatcaatgacatgccatgcgacaccgcgaatgtcgtcattgttgccacaccttgggcgaatgttgtctctcacaatgcttttgaccacactagggatggtcctcaaacccgccacctttccataggtgtgcctccccccatcttcattaaactaagcatagtgattaatagggaagaggttgtgagtgtgcttgtcatgaagatcatcgccattgttgaaacggatgtgcaagagctccttgaattcacgccaggtgatggaggaccgaagggtccccgacatccatttcatagcatcacactcgccggatatcccacacagtggcatagaactaccggatcaaatcttcaccaaagggttgcttcaaggtaacaatcctatcaatgcccattaccttgaacatcccttgcagatccacaaattccagtgtctcactgatatgtctccaagatatcgatgacaaccaggaggtggggttggaagcaaccatcccacttgtatcacttgtggtcagcaaaagctttgcctacatacacttgctcatacacggctttctgaaaccatgtgtggaaccttggatcagcgcaatcatttggcctctggaattgattgtgatgactgaggatagtgtattgttgggcattcctcaaattgagtgagaattggatggtagagatcgagaggaccctcatcatcactttattcatcatctccttcctcatcatctccacttaccatttatcatcaccatcatcaccattaccactagcttcctcctcaaccccctcaacttcttctacaaattcttcctcgctttgagcatattcctgtctgctcgattcctcatgctcactcacgggctccggcgtgggctctcgacaaccacggtgaatgcgggtagccatcattgagaaacaaggaacaaaggatatataagcaacgattttagaaaacacaaagtgaggtgggaacaaaattttgcactgcctgtcagaggcggttagaccgggcaccaatggccggtcagaccgccgaggagccatcagtcagaccgccagtgaggcgcaggtctgaccgccagtgaggcaccagtcagaccgacaaagggtcaccggtcagaccacccttagggtcagccaaaccgccactgacagatttgaacaaaattttttttaccaccacatagaggattctaaacatgctagaacaaaatttgcacagggtttgagcagagaaacaaggggtttagtctatttcatcaagattgaaggaagggggaaactacccataaccctataaattgaaatagaccgatttgaaggaaaacacaaaagagtgagggattaccagttgaaaggagtgattcacacaaggaaactaccctctattgtgcaaatcgaagaacacctcttgcttcacctagggttctgtggagattatggataccccatacccacacggcatgtatatccgactgggtataggggtaccttatgtagatagaatatctttaagggactcgggttaaattcctaacttgtatatcaaggaaatacccagggtcctagtcggttacgattgtattttatctttacttgcctattccattaggaatatgggctgtatcttataatacggactcctcccactatataaggaggggtctgggtgcttgttggggcataacttttctcccagatcatacgattaataacacactcggcggatcaatccccggacaggagtagggtattacttctcattgagaaggcctgaacctgtataatattccttgtctccaaacccatccacttttcctgcttgatagccacccctttttgtattgccgaattcttgttttgacagttcgcgccaggtaggggttgcgtcaagcttttcgccgattagta

SEQ ID NO: 2601 - DNA, 2000 bp, Oryza sativa
  misc_feature (641)..(641): n = any nucleotide
ggccggaaacgagacggcttgcactgcctgtgcactcggcgccctctcgtcgtatatgggggaaggatccgacggcccagcgcgacgcccgcagtgttctctccctccccacctcgatctctctctctcgcttcgtggctcttctctcctgcgactgcgagaggaatctcccactcagtcccagattgtttctgtgcggcgacagcgtcgctgcgtagcttctgatatctttgccgccgctgtgtttggcgccattgacgcagccgcatccactcctcgaccagacaagggaggcctttctctctgtgctatctccaaaggcttctgagtcgattcagaggcagagctcgaaaccgaaagggcggcgaaggtgaagccgaccggcgggctgcaaattgcgctcgttcgctcaccggcgacgtggaggagaaggtaatggtggtgacggcgacgcacgcaaccagcttgcttgatgcttcgtcttatctttgctttgctttttttttgtgtgtgtgtgtgttgagttacactttttctatgttttgttttctcgtcttgcatgccgtttcttaccctgttctgttcaccagaaagtcaaagtccgtttatcttggtgtcaaaaataaaaggccgtttccttnctccttgcatcccgctctcgcttctaggcgtatacatatttattttggcacatttttgtctgcatcatttcaggcgccggagagagaggaagaggaggcggagcaacccggtcagcgcgcgcgtaggtggtttgggtacgcacactgtttacacggcgagcaaactcggaggagagagagagctgtggctaacgtagctatctgggggccgtcagttacctgtaagcatcatctcatcactctcactgtgcctctcatttctctctccctctacagcaacattaattaattactagctgatactactactgtacaaaagaaattactaccaccggccaaaagaaaacacacacaataccgtgtttaaaggttatcacgtcgtgtttcctattaaaaaagcgcaaaagataatcagcaaaaaccctaccgggctccacaatgcagtcactcgatagccggtcgctttagccggggcccatatttttctcggtagggatggagcaggaggaaaaaaaaaataaagtccaggcagtacgttgatctgggggagggcgtggggccccagctgcagtgactgtagctgatacacatctgagcggctccctgcctcgtccaccgagctactgctgttggtgtcgtttggagtcttccccatacgcccctgcctacctcgcgtgggtagctgcgcctcatctgcatgaacactgtgcacaacacatacacaaacgggcggagctagctagccatagcacactggtggttaataaatttccatgtgcgcgtaaacatcagaagcttccctgccgcaatgtagctgaccgtattttactactacaacctgcttttcagttttgatttactagtagtatatgtgtgtgtgtcatgtggcatggcgattaaagaatctctgtgcctgtgcccgtcgatcgatctgctttgccccgcgtagcgtttcttccactgtgttagagcagcctgcgaatgcatgccatgcatgcaggagtagctgtgaacgactgtgatgctgccattggcatgggtcttgcttgctttgttatgctggtgctatacttttttgtcgctgcaggctccagtgctccactgcaccagctagccagccagcttgccccgttttgacgccggtggcgaattgaagctccagagaccagagtccctagctatagctatctctcgtacatacgcatgcttgcattgctctctgttgctcaacgagccggaaggacagctcctccgacgcacacgcatgcgcacgtgtgcgtggtcacggaccggccggatagctctgtgctcgcatagtgtaccggatgtcgtgttcgcgtgcttacatgtgagatgcaa

SEQ ID NO: 2602 - DNA, 2000 bp, Oryza sativa
aattcgagcatagaaattatccattacttctggtaaccttctttatgtgattacttttatctcagctgcgtgagtgcatgtagcatatattaacattttaattgtcacatccattgataagaatataccatcaccgaatttgttttcaatgctgattaacatactagtcaggaaccggagataagattgagcttgagggggtttggaaactgacccctacaccctccattaaaaaaacaaaattctgattacgaatctaaatatatatcgtgtctaaattcgtagctaaaaattattattatttatgatgatgtgagtatatatgtaagttagtatttgccacgagaattctacaaactttgcttgcactgcatccttctatcattgcttgcggtggcgaaagcaagtagtacggaatctagagccccactatatgacacttcggtggtctttgccactaaaaaacagctcctttctacctgaaaccgtggaaatctttgcagtggctcgttctaattcaaagttgagcgtgacaatttgttccatagtaccaattattttttcaggtattcgtgcactattgctttgatttctttttttctttatatattataaaaataagagcaatgcaggtacatgcttttattcttgttgcttatgaaactaatagtagtacttggcatttagccaaaagaaaagggaatagtacttggctgagacaacatcagtatagaaattaattggagagcgacatgtataagattcagttccattatttcgggaagaccttgtaaatcatttgtgatatatacaaaaattgccggagtctttgctgtcctccaatcataattataccattttttgattgcatcatacgatagaacaaagaaacccaaccactgcatatgtatgccgttttgtccgtgtgttcagctgtgcggttaccacgtcgtgtcttccctttttgcttgaaatttcaggtttgtcatagttggtgtagcctggacttttttcagatttcactcctgtaaatgtatgcatatgcacataagcaaaatcgtgtttcctagttcagccgaggaccaaatcaccaaaagatacagtagtaagcctgacaaatgcagccttaacaaagattcagctgtcagatgctttgcctgccaggaaatgtttagcagctgacctcgaataattgggtgcttccttcgtttggttatccctgtctgtggattgttacctgagattctgagaatatacaaaccatatgcaagtctcatgcaactatcagatgctgtatggatgggaattctactattttctaattgtgttagttgatccgtaagtcaaaggagaattctaatttctaatcgtattggttagcaagtcagagtattagccaaccttctcagactagctaatcacaaactcatgacctctaatggggtgcaggtgccagtttatcaccggaaagtgcaaacagtaattaccctgcttgagaaccagagacatttagatgaagagacgtgtcaagatttttcagaaaaaaagagttgcgtctggtgctccacattttcacaacaactgtcatgtgacaacgaccatcgtttaaagaaaaagctccgtgcttccgtctccgaccatttcaacctccaaggataatcttttactatctgtattaaatccatttactatctgtattaaatccattcatgtgctaccctttcaaaactcaggaagaggagtcattttgacgtcaacagaagaagaaagaattaagattaactttttttttcctgactggagatgtaaataacgtgcaaaactcatccaagctgctaaaaatatgcatcatgcgtgtgtgtttgttcagaatcaaaccaatcttttgtaccagtacaaccacttccagcgaagccagcagctagagtagcaatgtatgcgcatgagctcagccgcagcagcagtggcgcaggagaaaaacaggggagaagacgccaacg

SEQ ID NO: 2603 - DNA, 2000 bp, Oryza sativa
tgaggcagtggtggtgcttgtagcggcaacgacacacctccaccaaccggtcgaactctggtcgtcatcaccacaccacgcaccgcgccgtggtacaaatccattgttggggaaccaagcggaagcaacggccaataccaaccttgctgcgaagaaaagggtgccaccgaggaagatgtcgtcccgcgccgctgccgaggaagattggcattgctgccgaggaacaaggtcttgaagaggagcgcaggaacattttcgccgtgcgcgcgtgagaaagcatggaccaacgatttggaacaaaaagtcgctccctataagcggagttagggaacctgaactatcgggagattggttagagattctattggatacgatttttgacccaaattttctaaatctgatgagagggaatagaataagtaaactgttggtgatgttctaagtatattcttttaaccactccatgcaccccgtgtgttcatacattttttttttggcaatggatacggcgttcacacaattacttcctattattaatcctacaaaaaaacaaacgcatatatgtcactcaaacatgtgtagataggtttcactttgagaaccctaatcaactaactttccaagcgttaatactccctggtgtgccattgacatggttttggcttcccatctcgaacatttttcaaaattagaggccaaaatggacaaagtttaaaattacctttaattttacccatatatatgtccttgacttcatgtgtctcttgtattttttttaaaaaaaaaagaagaagaagaagagatgatcctcaagtgaaaaggccttgtttagtttccaattttttttttcgaaaaacgtcacattgaatctttgggcacatgtatagagtattaaatatagataaaattaaaaactaattgcacagtttgcatggaaatcgcgagacgaatcttttgagcctaattaggttataattagccataagtgttgtagtaacccatatgtgcaaatggtggattaattaggcttaataaattcgtttcacggttcctaggcgagttatgaaattagttttttcattcgtgtccgaaaactagggatgaaaacggtcggaaacgatcggaaaacagcctcaaccatttccgtaaccatatttttctcggaaacgatatcggaaacgaaaacaatatcagaaatatcgaaaaaccggaaacggaacaatatggacggaaacatgtcggtacagatcggaagccagtaacaaatacggaaatattaaacttataaaaatatatatttaactttacataagtatgttatatgtatacataaattcaatcttatactatataaattataaattaacttcattttagccatgtacaaaatttagagatttgattgaagagtcagtcaatctgtaagttttgggtcaagtatagacatgccctataaatatcgacatatttagaatacggtaattaccacattataagaaacggtaatttccacaagaatacggtaaatacgaaaacgatcgatataacagcaaaaccatttccgttttcattttcatattttttaccatttttatttttgtttcggtcgattaccatttccatatggctcggccgatagaaagtcgaaaacgaacgccggtcgtccggtaattaccgttaccgttttcacctctaccgaaaaccccttccgacatccggtcaaacgtctgatgtgatatctaaaaattttcttttcgcgaactaaacaaggaaaaaaaaagtccgaatgtcttgtttcgattatttactttttaaccgaatgtcgaaattccaatacagctgtaatttcaaccaaaaaaaactgacccatctgccagtctgttcacaccgatgttcacttcatcttccactgacacaccgaccccaccccacccggaccccacgctgacgtcgtcaactctttctcctacctcgccaccaaccctctctctcgagctctc

SEQ ID NO: 2604 - DNA, 1998 bp, Oryza sativa
  misc_feature (39)..(39): n = any nucleotide
  misc_feature (42)..(42): n = any nucleotide
  misc_feature (142)..(142): n = any nucleotide
  misc_feature (170)..(170): n = any nucleotide
  misc_feature (172)..(172): n = any nucleotide
atcgttcagagggatcatgtgtgcatctccttttttttnaangttttgtttagtgttcaaattgttgcatgaaatgtttacaatgtcacattgggttctgtataaaacattattttaacttacaactactgcatctgtcccnaaatatttttgaatggaggggagtatcncnttttattttacaaacaattatgtatacaggcggcatgcagactcgaaaactgtactacattttacggattggcaagtgccaacctttgggtaatataggtgttatggtacatcacgattgcttgagactcaggagtcaggaattcaagatagctgcaccaacccattgcaaatttgcaatgcaaaaggaatatatgagatggttggttgcattagtgatgagttccctttacttccaaatgccaaccaattttagtttgtacaatcaatgtgtggtactatcacgggatagtatatgtagcgtaaacctataaactattgtaggatacacaaatggatgtctggaatttgttcacgtccccctgattaatcttttacttctagattaaagtatgattatttttttattggctaaatctcagatgataatttgtgtatcatataacagttttcaggtttgtattacatacagatggtttgcactatatattttctccgctatcgttgtgtctctatctccaggccatttctagtcttctctacatgagccaatgggaagttggcttgcattgaaatttgcatcattgttgaccatagtggaaggacgagtgagtattaacaagtggactcattagtcattagtcatggtggttagtatgcacgtacgctgattaatttgaaacaaaccaataatgatgcccttctccaaatggcactgcagactacctgctctcggctcatttgctggtctgtcagtatcataaaacaaactcatcgcagggcagaaaaaactattatggtcacaaagatttctgaagagctatgtcaggcacatctggaaacctgcctgttccattaagaaccccaaactccaaagtgcaatttcaacatactactaatattctgatgctgaaatccctcaaccaagtttggtagacaataacctaatttaacaatgctgatgttttgtcggttaggtatgcaagcttggctctattagcagctggatgcagtaatcctgagttaatataatcccacaatcttactgctgctcacaaccccaaaaactgttactcgaggttggttgaggtagaaagcctaagacacatataaccaagctgatgttagaaaaaaaaaagctaaccttttcctagttttgcaagctgcagaatacaaagaagccgggagggattaaaattttcagacctgtggatgcaaaaaaggtacagtgattagtgtatactactactactccatttatccagcaaagaaccaagggaaaagttgtgcgtggcattttcacgagatgtcacagtcaacggcctttttgcaggcgccctaaacactagtgtgcgtcactggttgtggctgtgctgtatataacgcagagtgcggggtttctgcagagctggagtggagaaaggagagacctttccattccctctctgaaaaaacaacaatttagtttttgacctgaagggtggtagtagtgggctagttggcggtagatggcattgacactggttgccaagcacagtgcaggttttgttggagcctagtgtggcttcagagctcagaagcagccacatttctgcattcttggatcatttggagctctccttgtttgttgttgggtctcttctctttcctgcttccgagttctgtgaaccagccaactaatctctgtaagttctactatcttgttcttatttctcctgctcctttgcccccaaggatatggctactactgcttgatgtcctgttgcttagagtgttcttggctggttgctttcagttcttgattggttcataccttggtgccaagaa

SEQ ID NO: 2605 - DNA, 715 bp, Oryza sativa
  misc_feature (9)..(10): n = any nucleotide
  misc_feature (14)..(14): n = any nucleotide
  misc_feature (19)..(19): n = any nucleotide
  misc_feature (47)..(47): n = any nucleotide
  misc_feature (69)..(69): n = any nucleotide
  misc_feature (92)..(92): n = any nucleotide
gcctcttgnntgantcacnggggcttgctttccatttccggccaaangggactctctccatttcttccnctttttggcctttgcaaaccccngacattctcatctggattactccgcggcggcggcggcggcgggagcggcatctccgacgaggtatgtgtgtttcaatgccgccgccaatccatttcggctgttctgaggtgggggtttgtggtcgagggataggtggcgccgttttttttcctcgctgcgcatgattttttagggtttgattggttcgagatcagtctccgttacctgtatcccccgcagggttgcggccttttgcaagcgaggttgtgcggaaacgtgtcgtcgtgagaggtgcagttttgattcaaggggcatatcattttctgtttgggaatttaggtcgtgagttgtgatggatgatgatatgtgtggattgatctggcgtctgttcttgatggtttagatgatacagagttagcagattaaagccagggaaatttttagatgggtttttgacatttccatgtatgattttgcaattctaatctattactcttatttttgttagtattgcgtctgaccacatgcataaattgggcagattcctctcttgatggtatcgttgaacaagccaactaagcacaaggagttgtctcgggtgatgagataatttggttaaggaaggtaggaagcagtaaattca

SEQ ID NO: 2606 - DNA, 2000 bp, Oryza sativa
  misc_feature (1682)..(1682): n = any nucleotide
  misc_feature (1695)..(1695): n = any nucleotide
  misc_feature (1716)..(1716): n = any nucleotide
  misc_feature (1727)..(1727): n = any nucleotide
  misc_feature (1739)..(1739): n = any nucleotide
  misc_feature (1743)..(1743): n = any nucleotide
  misc_feature (1745)..(1745): n = any nucleotide
  misc_feature (1747)..(1749): n = any nucleotide
  misc_feature (1752)..(1752): n = any nucleotide
  misc_feature (1754)..(1754): n = any nucleotide
  misc_feature (1758)..(1758): n = any nucleotide
  misc_feature (1774)..(1774): n = any nucleotide
  misc_feature (1779)..(1779): n = any nucleotide
  misc_feature (1797)..(1797): n = any nucleotide
gaatatttgaaagcaatatgtgtctatcctcttatctgaatgcttgtacttgttcctcccttccgtccatttatattttaacttctgcccagtgaatcttgacatgacgtgaatcacaacatattgctgattagttcagttcatagtccagaaaccaaatagtggagtaagagccatatacagttgctggtgatgttaatgggccatggaggcccatattcacccacggtggcagcagtggcctgacccacatcatgtaagtacatgatggtaatgggccatagaggcccatacgtacccacattggcagcagtgtcctggcccacatcagtacagtaatcctcgtgcagaacaatcgaatggcccggactcccggttaaaaggatgcactcacaacatctcaaatggcagtgcgatgcactgtgcgctggtgtgtccatatcgacgtgtcgtcgagatctcgttccattgccctccaataatacgaactccactcctgtagccgttgtaggacgtcctccaaggctccaaatccacaacctccggccactattgaaagccgtacctcatccatgccacgaacagctactcacgtgtactactagtactactcctatctttctctccttttttttctgttgccctcaagcacacgatgacccgaataatcgtgaatcatggtgatggagccaagtgtcatcaccgctaataatggcgagatgatcgataaccaaatcccgtttccaactttccatgtactagtaaacgccatcgacaaaggcacaagcataaccaccggcactgcgatgctacgcgacgcgacgcagtgcagccgtgcagcgcgttttgctaccaaccatagggtttagtgtgcgtgtccggaccagaaaatatccaacacatcgatcacctatccaccattagctcgattggagatcgcgcaaggcgagacgcgattaaatgacgaagcctttggacgtcctgctcgtacgcaacagaggactagtagaagaagcttaagagcatcccagcagatcatttaaatttggacttctatatttctatttgaatggtcatccaaaaaagattcctcctctatacctttacccactccaataaatcatccatattacagcattcatatcacactattctatattttactaatattttttaactacccatatatatctaatgattttttaagaggcatatatttacaatggtttgaataggtgttggttcgatttaattgcagttaccactttgagaacactgtgtaccacctttaatcctcttttaaaaccacatcagccacatttaccttatcctctcgctaaaaacaaaacaaaacaaaacaaaatccaccaaatccatcgctcctgggagaccaacagatagtgagaggcgggcggaggagcgacggaggggatgcggcaggatggcgcggccgacgggggcagggcgccatgggcggaggtacagcggtgcaggtggcagggtggcgcggcgacacggacggagtcgcgatgggcaacgcaagcgaagaagcagcgacgccggttgatttgcagtgggggcggcacgggcggaggccggatggtggcggggcctccactccggcgatctccagcacgagcgaaggaccacggcgcctgcattgggggcggcgcatgcgagtnggggcggcggccnggcggagtcgcagggtggcgncgcgcggcgangagcagtggcgngagncngnnnggngncgcncgaccgcggggcctcnactcnggcgatctccaactgcanaccggtatgtccatcctctctattccccttggcacagttcggatggtggcgcgagttcgtcggagctgggcatttgggggaaatggcgtgaggagagagaaacgccaaatatggcatggagagggcttggtttggaggacatctaaaatggcgtgtgtaatggagactctgctggaccgtgttttttcacctccatacgccaa

SEQ ID NO: 2607 - DNA, 2000 bp, Oryza sativa
gatcaagacatttatagctcccacataaataagaagttgtgccacagctacaaagtaggaattcaataaaatatagaataaggatatacaaacaagaactaatcctagcgaaaaagcagaaaaagttgggttggtaagtaataccacccctagaccccctagtagaagaacaaatcccccaaatagcacaagaatttcatgtattggcccaggtaaatccattatggataagaagaaattaatagtataaattttttcatgaactaactaaaactaaaagattcaaggaagaaaaaagggattaggaaatttttttgtatattgtatataagttctttctatagttagaaatcacatcacgaaaatctactctggtttaaaatcaggaataatttgcaataagcagtaggtattcgtttttctttctagttagtaaagaacttttggattctaacaaaaaaattctagtaatcagtaattgttcttgaattccaagatttttcttcgtctattttactttgagttgaattcctaattgtttgaattgtgtaatctcccattatggagattggtaaccgactcataaaggcaattttatatcatatttgtttggtgtaccccggcttttcctgggacggggattaatacactagcgttcgggaaaaggcaattttctcggtcgcgacaccaacgggccgccatgccaaggaaggtttcgctaagtggttgggccgagccatttagcccaataagggcccatacatgtaaaggacatagtgtgccatcaataatgtccctatcataagggtaaccatataaattcccctgtaaaacctaaaccctaaacgggggaacctataatagggctataaatagccctctagtgtcttgtaatacggggatccaaaacaattttcactaagcaatacaattgtttttcacttccaaccactgttgagagaaccacgcctttcggcgtgacacagttgtctattcgacaacagctggcgctgaccgtggggacctccgagcgaaaccactgatgtcaccgaagaagatcgtcaaggagagagttgtcaagcggatggaagatggaagcgaaggggagatggtagccgaagagggagcagagccttcggcctccgagccttcagcctcgcaagagaacaaaagagaagaagagatactcttcgacattgtcaacatcccctacaactacaacgcaatcttcagcaggggcactttgaccaagttcgaagcagtctctcatcacaactacctcaagctcaagatgcctggcccagccggtgtgatagctgtcaagggttcccagccttcggccgtcacaggacccctttcggcaaggaagtccacaccctagaggtcgaaggacaagaaaaaacaaagccaataccaaagcctgcccccacggcaaggttatccagtggcatatagatgaattcgaccccgccaaagtcatatcgcttggtggagacctgagcgaacaagaggttgtcagcatcctggttgtacttaagaagaacattgatatcttcgcttgggggccagacaatgtagggggtgtttcgccagatcttatcatgcaccatctcacagtcaagcttgaagcaaagccgacgaagcaaaagttgaggaaaatgtcggcagatcgccaagaggcggcgaaagcagaggtgaacaagctgctgaaagctggggtcatacaagagagtgaccacccagagtggttagcaaatccggtactggtgaagaagtcgaacggcaagtggcgaatgtgtgtcgacttcacggacctcaacaagatgtgcccgaaggatgatttcccattgccccggatcgatcagctggtcgattcgaccgccgatgcgaactcatgagcttcttggatgcatactccggatatcaccaaatttacatgaacccggcagacatccccaagacagccttcatcacgcccttcggcaccttctgccatctaa

SEQ ID NO: 2608 - DNA, 2000 bp, Oryza sativa
aagtacaaattcaaatgcctgtcagcatcacctctttctttccgactagctgctgtttgtctgcaactcggtctgacgctttgctttgtcatgcattgcgagtagttcccttttcttctgttctcatccaaagaatgatcaaaattacacgatgctccaaaaataaatatggtgcagcttgttggaaagatataagtatgctttaagctaagccatcattcacagtaaaagtagatcatttgcatttggagctgcagtttaggattttagactatggtactacaaagactgaggcaaaatccaaacagcacaagtgttattcacatctactaattactgtacagtttctacttcgctatgagcctatgattgctgtgcaatgatgacttacaactagccagaatatcagatcaaactagttggtatctgcttctcgaatataacgaccaatagccagaacaattttcaccaattggatatcgaaaggctaattcgctaattctaaagcagcatttatcacgggaacacatagattaaaatataattgctggcttccaaaacaaaagatctgatcctctttatagtagccatataccgagcaatcgcagtgtggatgtgatcaaggtactcatcccagtctgaatcatcagccatagtgataccaagtcgctcaacctcttcatcggtgtagtccgctaattcggtaggggcagctaaagggcttcgcattccgcgcttgatgtttaactcgttgatgcccttcatagccttcttgaaattctcataccgatgagccttctctttcttggttatgtatatccggccatgctccttcatccagtcttcgaattttgccttcatggctggctcatccaccgcgttgttgccatcctcgtctgtgtcggcggcatcagcatcgacgatggcctcctccaccttgtcggaacatttctggtcatagtttggtttccccccgttcatctgaacgcggaggtaaccgtagtactcaggataggcgaaggtgccatctttccttgtgaaccttgccatgacggatggctcgatcacgtccctccactttacggtctcctcctccttcctggtatactcccaagctgccacaggtacaaacaggtagggaacgaaacaaatcagtgtattgaatagtaggctaagacatttaacggtaacctctctcaaacagtttgttggcggatggcatgagtcccttcgaccgaatctgccgaaacccatggcgaagaccacgagccaaggatgatgcgaggcgaagggtcgcacgagtgcacgccgaagaaggacgacttcgccatgccgaagaaggacgacttcgccaggaccggttcgccccggcatccagcccagagaaggacggcttcgccaggtccagttcgcccccgcgagggccgaagtagccttctcggcccaccaagcttagagaccatagggcccggcgatcgcccgatggcccatcaagagcccatgagcccccctttacgttatgtaaccctgtaaacgtccctttcataagggcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtgg

SEQ ID NO: 2609 - DNA, 2000 bp, Oryza sativa
  misc_feature (714)..(714): n = any nucleotide
  misc_feature (727)..(727): n = any nucleotide
tgttccagtgcgtgcgcgccggaagtctacatctattaaatggtgaatgacggggatcctccctgtgtcggcctacgtcagccgacatgatttgatgggccctgcacagcagccgatgctcagatgacttccagattgtggcacgagacaaacatttaatatagagaatattttccctcttcactgggaagcacacccggtgcatgtgggaaccccttggagtataaaaggaggtccatgtccagtgaagagggggatagaagaaaaaagaggtggaacgcttagccctagcttgtacaccagaaattcagagactttgtaaactcagaaaaatcatcatacacaggagtagggtattacgctttttagcggcccgaacctggataactccctagtgtctcatcttcatcgggggcccgactcccggccctcgatctctcccaatcctcctagttcctcaattttcactcgctgccctcggccgaactaacaaaggaggggcctcacggtcctccgctcgaggaggtcgtcctctgacatagctggtcatcaaggcgagcactcaaccaaaccactagggatattgttccctgatattattgtacatatacaattttttatcggtacgggctatgctgattatgttttcgtacatctctgatcgccgtgagctattgatcatttagagtgtgttcgggggtccactttcctaanttccacccatagntttttttttttgtacacgcttaacgaactgagtgtttttgtcgaaaaaattttatgcaaaagttgtttttaaaaaaaatcatattaatctatttttcaaaaattttttaaagctaatacttatctaacgaaaaattatttttgaataaaatttttatgcacgtgttattaatgatctaaaagcataggctaataaataaacagtgaaaagacccccaaaatcaacttcaaatttaatgttaaaaatttaaattttaactgataattataaacataactggaaaaataaggccgttagtcgctaaccctctatgccgaacatagctttatgaaatgtcaaccataatcttaggctctcaagcatgtatgttttgttctcttgtagttgtgtaggactggaagagcaagtgccagcagattctgtcagatcatgtaacgtagcctctatttttaaggtcagtaattaatcacagaccgtgcacttgcaaatttgtgaaggaaccaaaacatcggaaagatggacaaagcaccgcagaacgtgttcgaatcaaaagttccaaacaggatgccgagaccggcccgacagaggctcgatcgctagcctggtagtgttttggttaggagactacgtgggataggatgataccatcctgattttagagatggattgattccatttatttacttgtttggtttattggatggaataatctagtttttttatttggtagaagggatgggtagggatgggatgaatgtcgtttggagtaacgttagcaccacggcagaaggagcggagcggcacggcgaccggcggtgtgggtggaaggaggagcggtgaccagtggcgcgggcggaaggaggagtagcgccgacgtcagagacaacggcgatgtggatttgccgctgccactgagccatccccgccctccccgccttcggattcaccgccgccaccgccggggatttgccgccgccaccgccaccaagccatccccgccctccccgccttcggattcgccgccgccaccgccggattcgccgccgtcgcccgagcccgcatccggattctccgccgctgccaccgagccatccccgccctcccctccttcggattcgccgccaccaccgccggattcgctgccgtcgcccgagcccgccttcggattcgttgccgccaccgccggatttgccattgccgccgccgccctccccaccaccagatccgccgcggccgtcgcttgagcgcgccgtcgtcgtcgagcgagcgagca

SEQ ID NO: 2610 - DNA, 2000 bp, Oryza sativa
  misc_feature (1660)..(1660): n = any nucleotide
  misc_feature (1668)..(1668): n = any nucleotide
caaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattactaggtataacatccataactattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtatctcggaaaggagctgtgacaataccccttgcacaacacaatccaccacagcgcacctttcctggatcataatcaccctcttataaacaaggcatggactccccagcgacctccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatcattaaataataatgagtcataagttatcccaatagtgtgctaatgtttctaagcatggctaagtaatcatatctaatatctagctgaaccaatatatatagcccaactagtcatgttataataacccaaggtatcaaggaataaagtaatcaatgcaaacatgccataacaaaggaatagattcacaccacccagtgacattcgaaaataaatgcacagttgaaataaataaagaatttaaatataggatcaacatgctcaaaggattgtgtttaggatctgtgtgacttgccttgcaataatcggttttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaatttagagacttgaacggcctcattccgatttcatatgaattagttacaaattttacaagattaaattccaattaaacctattaaagaaaagactattccaaattaattaaacaatttacaaatgatttatagctgagacagaagattaaaacatcctccggaaaaagattagatcatatttggtagatgacatatattaaaaaggaataatatgtcattgaaaagaaagaacggatttatatcaattttggacggctaagattaatcttgcaagcgaacctcacgagataccgactcaacgagtcaattctacgtgacacgggatcacccaaatgatcaaccgaaaccggcgaacggaaccggcggctctgaaaggctctaaactaaaggacgactcaacacagacgaacggacgaagcacggggaacacctcgttcgaacgaacgagcgaacgactcaacaacgaccgcggctaaaccggtagactnggctagtntgagggcacaagctgcgacacggcggcactagggcgacttgctcggctagccgcggcgactcggcggagacacgcggctgggttagggcgacggcacagcgacaacggcacacggctacggcagagcgacgactactcgacaacaaaaacgggagattaaaaactaaaccgagggaaaacggatagaagtctcaccgaaccaaaatgatcggagagggagagatgatgacaacgttccgatagcaacacatggagacgacaacgctagacaaaccgcggattagattatattggattaagaccctagggaaaaacctacaccggcgaacggc

SEQ ID NO: 2611 - DNA, 2000 bp, Oryza sativa
  misc_feature (386)..(386): n = any nucleotide
  misc_feature (1649)..(1649): n = any nucleotide
caaacacctttggagtttggggttcgaattcaaactccaaaatcgcgcctccgatgatccgatccggcctccccacgcatagatcgcaactaacctcactagctagccgcggcgcggcgcctatacaagataaacaaacgcgtcaaattgcacggcgccggcgagcgagcgggtcggagaccgcaccgccgccacaccgatcgatcggcaagattggcatgcccggcggccacaacaagcagccggcgccgcccgtggcgaccaccggctgctccgccctcgcgtcctgcctctccttccaccgccgcgcgccgcggccgccgcctgcgcgcgccaacgtcgtcgatggcgcgacggcggcgaccactagagcatccgcggagcantaccggcggagggtgcagttcctggaggaggagatcaggaggctcggcattaggctcgccgagcacggcaggagccccaatggcggcgccatggccaccagagatcgggtgaacagcgcctgcagcggcatcggcgccacggcggccaacaagcgcgtcaccgtcggtggccacggcggcgtgcgggaaatggtgaggctggaaggcggtggctacctgcacgagatcaaacgggtggtgggcatgccctgggagcggctggcgctgcaggtgtcgcagcccgtcgtcgccgagaacgccgccaccgcgtcggaggtgagccacctcgatcgctgtcaagatccatggatgccaatgaagtctatcatccattgcactgcacattgttttcgttcgacaatctgtggcattgtgatctctaggttcttgacaagatgacagagacgagcgcagagaacctgtgcaagttactgtcaaagatgatgccgatcaaggacatcgccggccggaagaatcccggcaaagtcatccgccgctcggcgaggctcagctccggcgacgacttcttggaggctctcctcttcatggaaatggacaagatggaaggactggtccaacaaggcctaaagattcgcatggcctcgacggctgactctgcctcgtccacggctgccggcgacgacgacggcgaccggaggcaccaggcgacgaaggattccatggtctctgtggtcctgattcaggtgagggatcccgagcaagggtacgccgccattggtgaccccatgatcggggtcatggaggcatccctggagaagaaggatggcagggtgaagctggagatgcaggggatgcacgtcgcagggatcctcttcggtgcaagcagcaagggaaggagtaatggcagagccatgatgtggagtgcttgcttgggacagtgcaaggggtctcacaatggccgccgcggcggcggtggcggcgccggcgccggtgatgtctgccggtgcggctttgttcggaacacaaatcgtgttttccgacggtagagattggcattcttggtatgtctagtaaagtaaagctcaatcagcattgtccctgttcttagcacgggagcagaagagacagataataacaatctataataaattttgtgataggtatttataatgtactaataaagtttgtggacgtttcttccattaaccaaccaatcatacattctgacgttaatggtgtatgctgtgctgtctgattttttgnttttttttttgtgatgcatgtcaagtcatttgtagcttttgtttctttttttacagcactgtgttgtgttttgaagcagggatcaatcttggttacgaaatcggtcaaagagaggttgaacgaaaaataaaccgtactcagtttgaattgactaaagttattgagaacttaaaattgttgttaagaagcgaatccgttcaggatctgagttcgagactgatcccaactcggggtcggaaatagatggaatttttttagcggaaaaaatagacggaaaattgtgcatacaaaaattcaaccttgaccctgagaatcagttgtcgacctagattgctagcacgcagcgcaggc

SEQ ID NO: 2612 - DNA, 2000 bp, Oryza sativa
  misc_feature (108)..(108): n = any nucleotide
caatttcatgtttatactatgatatgaccactgaaaattctgttcatttttggcaggcacgtcgtgagaaaataagtgagcggatgaaaattctccaggatcttgtcncctggatgcaacaaggtctcaacatattttcctcattttgtcccataagttggggtttaaatattatatttttgtaacatgacctctaaaacatccccagttctgtttctgtaattgattttcattggaaaacttttgcttgcttggccaggttattgggaaagcatcagtacttgatgagataattaattatatccaggctttgcaacggcaagttgaggtatgctgtttcaccattggcgctttatgaaatttctttaccctccatatctcagctaatcgctctataatttgctgttatctgcagtttttgtccatgaagcttgaggctgttaatgctcatgtgaataatggaatcgaagcatttccacccaaagatgtaagtcaagtagtaaaattaacagtttaaatagcatgatcattattacaataaaaggtctcaagatatatttgaaagattctgtggcatactatgcgctactggcactttatcttagctccaatctttgactttgaacactgtgttaatatgttgtttttttcaacaagtcccatactctacaggcaagccagctatatgctactaccatatgttttagtttttgaaggcgttatccattgctcccttctgaaaattattaccattttattgaagctatactcctgaatttcaaaaacgtttaggcagggcaaggcatttaatatctgcagaggatacacatcattgaaacattttcctgatttttactctttatctaaccatggcatttgtctgtttgtttagttcaatgtgtttatgtatttactaagtactagtagctctgtggagctttatgtaaacttccaaatttggtttttagtattaaaattgtttattttcttttgggtcttttggttgcagtttggtgctcaggtatacaacacggctcctggattgacgtttgatccacaaacaccaagagaatacgcccagggatcaacaccatcggaatggctccacatgcagattggtggcacctatgaaagagtgacatgaacagaacaaagtcaggatggtggcccaaaataaagcataccatgagttcagtcagaaaccacggctttagattatttttcgaaactctcgtgctccaaattcgatttcattcatagcatggagctcatgtatttagagactgcgagcacagtatttttacatctgtaccgggatacaattctcatcagattcatgtattccacggaatttcggcaggtcacgctcattcgtagcatgaaagaaaagtaataaccatcaataattctcttgctataaatcctaaagcccttcatttttttttgccatcgtatgcttatctttctgaatcttaccagtagtttgttggtaatttgattactcacatttgctacttcgatcttcgatttgtgtttgtactcccaagtcaaagccatcaatctggcaaattttcacaggatagttccaacaatttgcacaaaattcatctgaactcgttctaagcgaaagaacagggtggatgaatctggagcaaaactgcacaaccagaactgaacctcccgaaaaccccgcaaaccgcacgccacgaatttaccatcctacccctgtatcgcagatgcgtctccgttccgtttcgcagtctgttttgcccccacgcgaaatctccttgttgcccttttcccccttctctcttctcccctctcctcctcctctctctctctctctctctactcctttcctctcctctctccttgccctcctcgcccccaatggttgccgcggccacggcgccacctgcccattccgcggcgagcccttgacccacccctgatctcgcggcggcggccgatccggcacccggcgacgtgtcccggcggcg

SEQ ID NO: 2613 - DNA, 2000 bp, Oryza sativa
actttacatttgttattttctgatataggtgaatcggcaatgaatgtacatcacagactgacggtcgaaggagtttattgatgacctgcattatttttttttagtgtggctaatgcccacaagactaagggttttatatgttatccatgcaaaaaccagaagaagtattctacatcaagaactcttcatatccacttgttgcagtcaagattcatgactagctataattgttggacctcgcacagattgttaggggttgcaatggaaaaagataaagaagaagacgacaacattctgaactaggctcaatacaatggacttgtagaaaatacaatagacgaggcgaacggagctattgaagaaaacaacggaacaaatgatcttagttagatgttgagtaacgtaaaggactgcgaaagtgaagaagaggtccaaaaattggagcgtatcttagcggaccacaaaacgtccttgtacccaggttgcgaacaggggcacataaagttgggtatcacaatggaattcatgcaatagaaggcaaaaaaatggtgtgatggacaatacatttggtgaattattgaaactcgtaaagaatattcttcctgaggaaacgaattaccgaaaacaacatatgaagctaataaagagtcttccctctaggactggaagtccagaagatacacgcatgtccgaatgattgtaatattgtattctctatcgcggtgaggagtacgagaacttagaagccatgcccagtttgtaaggcactatgatacaagattggatgatatgaccccgatgatgttgactggaagccttcgaagaagagggttcctgctgaggtgatgtggtatttccctataataccacggctgagacatttattcaggatcaaaactcatgctagaatgatgcactggcacacagaagaacgtaaacaagacaagatgctgagacatcgtgctgatgggtcacaggggcaaaacatcgacataacatttcaatacttctgaaaggatacatgaaacataatgtcgacgagtgatactcagggaccggatgagtagagtattggggtacgttggaacgagggtctacgtagtacgacatcaagcagacaaaagataaggattatactggttcagaccccttatcaggtaatagccctagtccaatttatatgagattgatgatgatgaaaacataatacaaagagagtagtcgaaatagagggtactgatgagatcgtagtcgaggggttcgacgagatcttccggcgaattggctccgcatactccggcttcgtaagcgttggtgggtgtgttggtgattgaattcgatgtcttgaacccttcccaggggggtcccttttataccgtggatcatcttgatccccaagaaaggtttgaggatatcggacctggtatggtattacagaaaatctatcccttccgagtaggactttggaaatcacttgactcgtagagatattttccataatttgaagtggtttccacaagacatttatgggaacaatccgtatgcgcgaaggtataccttatcggtatattccataagtcgtaggataggaggtatgccttatctataaccctgacagtagcccccgacttcaactcaaatgaattcatgttgtcgcccgtgacttctctcatcagcgacttgtcgtactcactagatcgttctcgatatggaccgagaagacaaggagctattgacaacactaatggaagtccgcctggctgatcatgaatttgaattgaagtctgaacaaacgcccttaacgggcctcagaatttttcggcggcaatctctctctttcctcgaaatgcgaaccgttgggtagtgtgcttatttaaagggattttgggatccatttcaagtccgtttgccgaaaaattctccaaccttccaacagtcttgaacctttcatctcccccagttccctaagttttctccaccttgccccggtgatctccctc

SEQ ID NO: 2614 - DNA, 2000 bp, Oryza sativa
ggagaagggcgtgtacctcgcagtacttgatcggtgccatctacgggtttggattctcaacgaatcatgtgagcagatgaagtgggaactgaaatacgacaaggaaattcaactctcgtttcagcgctggaactacgatgaggaaagtgtcggaccatggactttacactacagccgccgtgatgtttatgatggagatgacactaattacaatgcagaagtagcggaaaggaagttcgagtgggactctgacagcgatgatgttctcgacttggaggatagggttcaaaggtcttctcatggtggttttttaatccttggatttcatccttacaaagaagttatctttctagatgaaggatcaagcagaggattggcttatcacttgggtacctctaaggctcaagacttaggtaggttacgccccaattttttcgaccattggcacgtcgaaggcgttaatcggtcgttcgtgtatacgccttgctggattggagagctctctaatgggatatagttatatatatatatatatatccgactcgcagtgttctcatgataattgtatactttgatgtaattgaccgacttcaataaaagttctcattatctaaaagaagttgtatatagtccctttgtgttgtttctcttctgatatcactttgaaatcaagaaacatctttcacatatttcccgatgttccttaacgcttccatttctcccataaagaaaaatgttatcctataacctccctctagatgaaaggttgaggctttaccctcatggcctacgtatcatctctaaccttagatggcccctccgtgtaattggcataagaggttccttaatttttcatctaaaataaggaattatattttttttagggaaagcactgaataaggaattgtatttgatcaaatcacccagcatatcaagttttcataatcttctcttctacaaattaacgcccgctcttagaacaaaatcaaggcaatattccacaaatacgggatttaactttagagtgacacttaataaatcccttaattttatttacacacaaagaaatctaaaaagaccactgtgaataaaggtacattttcagtcctttttatacattaaatttgatactgtagaggaatattatttagaattttcacaatatttatacttgtactaattggggctctgctgcatgaagaataaatctaaagaggtaaaatagttaaaaatttccacattaaccggaaattcccacattacttccaaaaaagacatactcctagctagccatccaatgcacgatacaagtaataatgcctacgagtaacatttagttttcgtgtagatacaaaaataatttaacacggatggacaaatgcccttgctctttttttcaaccataactggacaatttcgtttttttctcactttcatgtccaatattgattacacccctactttttagggttttcgtttttttgcccacacttttttgaaccgaaagaggcgtttacccctagtttagatggaagttagtgggaccggctgtgggggatacggcacccgggtacctcacggtagcggcccaagttaggcttcgggggtgggccaagggcccatgaccgatatagtaagtctaacatagttgggcaagacagggagattatagtaacagatccccaatcatgtaatagaaggcaagtatccaaattgtgaggatacggggtcttgattggcgccggcggcctgagattgtataaagaggccggcgtccttccgaaatcctttgggcttctcgattcattttctttccacgaatacagagaaaaagcacactggacgtagggtattacctcatctcgagggcctgaaccaggataaacacctgcgtcaccatctctccttgatctagcgcaccccataaaatatattgccgatcatagaaatcgacagttggcgcgccaggtagggggcgcttgatcgttttcaaggcggag

SEQ ID NO: 2615 - DNA, 2000 bp, Oryza sativa
  misc_feature (989)..(989): n = any nucleotide
  misc_feature (1962)..(1962): n = any nucleotide
cctacaggaaacaaaacatctatgaacgtaccaaactttctatagtatagcttccaagatgaccacgagcatgctttgtcttgcagtatgtgcaagcacccaaacacccaacattaataggaagaatctcgataaatttgttcttccttacctggaaattgtagctgtggtcagtcatcaggaatgatattagtatattacatctgtcagtggtaaaaaggtaatagcacataacattggcactatactagccataaaagattgatacatataacatcatgtacagaaatatgagttgtaccttaggtaaatcaagtgagggcagtgttttccgactcaacaaccgaacctcatggccttttaaggtttcttcaacaacttcaacaacgcggtcaatctgttgcactccaataacgctaataccttcaagctctttcagatcccggcttccttgtggtacacatccagccacaaccaaaggcttgtttgcactcttgcacttcgatatgagagttgtcatggcagactgacttgggtttttcacagtgcatctgaaatggcaaaataggtgtcggtcacaatatattcttcacctctgaagttaatttgaaggtttgcccctacgtgtcaatatatatctcactcttcggcactgcaagttggatttatgcttattatcccaagtttacacagctcatggcatattctagtgcaaaaaatagcgtagctagttttccacaacacaaatccagagcagcaccagtttgaaaccatcacaggttaaattcaactcatgtgtacttttaatgaacgtcaggaggtaatagatggaaagaaacaaataagagaagaaagaaactaaaaccatacgtgttaattagccacaaatccgctccttcgggctcttcagtgatcgcatatccaaacgctgacagctgccctgacatgtactcactgtcactctgcagagcaggaatgatcaactggtnatttaacatagctaacaacagcagaaccattggcttcctagcatcagcacaatgaataagcccgctagaaccacacactatcagtggatcactacttgtttcagcacttcaaccagaatttcttcatttgctagtggaagtaacagcatttaacgaatcatatagcacttcataattcatatcagtattctgtaagctagcgtgccaaaattctgcagaaataaatgtggacgaagcttgcctggttatgcgagcacccgaacgtcttcacatatatcgtctgcaacaaaacgaaaccatcaagcgcatcagattaaacgtggaaacgcagcaacacgctcattggagctcgagctacggcggcggtttcacctgcgtcccggggatccgggcctcgggctgcggccgggtctgcgcgaccctggacgatctcggacgcttgggcttcacggcgacggcggcgagcgggagacggagccccggagccgccccgccgccggcgatcccggccggccccagcacgtcctcgatgtcctccatctccatctccggcggctgctgctgctgcggcggcggcggcgacggcggcggcgcgtccaggcgagtcgtcgtgggctggtggcttccccgaccgagtagggtttctcgcttgcgtcgcgacgacgcgagtgaaagtgggcttctcggtttgggcccgctttgtgggctatcctttgcaggccgagacgaagcccacccaattcgattttttgggccgccccacctttccaccggccgcgcccgcacgcgcgcgagaaccgaaaccgcgcgacgcgcggccacgtccgcccacgcgtgtcgcctcgcggcgacgccgagctcgccaccgcatccactgcggcgcgtccacgcgtacgccgcggcagcgcgccagggcctcggccgccgcggccgccgggcgcttctaaaaccatcgggcggctcagcgaccccncgaatttaacccgtcattaggcgccttggtcgaaccag

SEQ ID NO: 2616 - DNA, 2000 bp, Oryza sativa
  misc_feature (1496)..(1496): n = any nucleotide
gtagtaccaatgtacattatgtagtaccatacaactcgcatcgctttcattatggacatatcttctgtgttttcgctgtatccattctgtcaggacaagaatccggccaaattaaaagccatgcaaactgacaagagtatgatctgtcgtaaatgttcaagattttgttttattttctctgctgtgattagagtcattctccattcttgtaatggggtgtacatgaactgcagcctgcaggtatttattttgttcagtgtgacgtataaataatgttggcaattaccgggtcactgtttatgatttttcagtgctgctagatcaagtttgctcttccgggctagtaatatttgacgatttcttcagttgtttgtgtaattctcgtaaaaacctgtacaatttacaggaagcaaacaccgcttcagatcgcatggactgggctttggcccatgcctaatgaataattatacctacagtgggccagatttggcccattgcaaattgttactggcgaaagcataattagacttcggacgtcggcgatggataagttgccgcaaaatttgtaactttgttttttggatttttctacacgtcttaaattttcttcagtaacttggttaaacacaaatacaatataattacattgtaacttacattttactatagtataatttttatatataactttaacatagttttggacagttagatttgctcagattcatgcaaatatggaaagaaaatattaatgtgttcaattgctcatggatgaggactttttgggggaaaaattcggatatataagattccctccgtcccaaaatatagtaatttttaggtggataggacatattctaatactacgaatctagataggggtatatccagattcatagtactagaatatatcacatccaaccaaaagttattatattttaggacggaggcagtagtccctttatttactagtaactccaagagggctcaacaagaaaattataccttcgtctaagttgtgagataatcgggtactactctactataacaaactctgtattttctggaccatagggtactgataatgaccatagggcactctattaaccttaggaggctgtgataattatgtcggccatgcaggagatgagaaccaaaacctaattttttttcataccaacaacatttatttttatacaccctcaacgaaagaaaatcccaatcatcagatttgctgtgattattctcaacatacacgaatattaattttactatcttacagtgaaacgagcgtaacttaactggttagatttcttatggtggaaccagtttatccgagtttaagtcctagacttgatacggagctcagatttatagctaattgtaggtgatatacccgtcaataacgagatgcccatggtgaacttagtcaatcttaaagtatgccggtctagtattataaaggtgctcatacttatgcccgtgatctcaaaatntgaaaaaaaaaaatcagctcagacatccaaaagtactcgtaggggcaagatatgcgtttgtgccttcatgggtgagtccacgcgtattacatgatttttattccctatgtcctaaaatataagggattttggagagatatgacacctaaatatgaataatctgtctagaacaagattatgggcatgttagtggagcttaagattctgagaagcaactgctaagaagctagctggtgagaatctggagaagctggaaaacccagcttctgtcttctagttcattttccagattctacatctatagattcttagaatcttggtaaaaagatgggttgttagggagagcttttggtagctagagattataggagaagatgcaactgctaaaaactcctttaaataggtccttttagtaatgtgtcacgacctctaaaatcgcttacattttgagacggataggacaagaaaaagcctggaaaatcagaaaaaaaaaaggaagagcga

SEQ ID NO: 2617 - DNA, 2000 bp, Oryza sativa
tttatttggcctctgtataaaaagcacacgggcactacgctgcggtcaaaaagagaaaagtaacctcattttcttttcttgatttgtgacgttcagttaatcagtttgcatgagtatcgtgtctaaatcaacctaggctagctaccaacctcatgataaaacataaagctacacatgccaataaatattgatcgaccaaaagtgcacactacatatatctccatactaacttggagaagaattctatcaccaattaattaagcgatgagttcggcatgttgctttttatgcacatgtgcatgcatccagcttaattagtggaagaaaacgcatttaggcatcttagagtataggttaaagtgcaacctctatgtggatcatatcactgatcttgaggaacttttggatcacacgagctctttaaaatcgtgttttgcagaaagtttacatcacgacgaccatggcacaaacaactttcacaaccaaaaagaatgtttagggccaactccctaccttatcggtgcaatgtttctttacaacaaaaaaattcggcagatatatatgcatgaaacaacatttgccttatagggcaagcaacacgtgacagtgaggatataaaatgcaattggatgtacaaaagttattatttattgcgatggatgaagttgtttgcttgtgctgtgtaagcatggatgaagttgtttaatttgcgtcgtgtgctgtatgagcattattctcttgaccatctagtacatatgaatattatagaattggaaatgtgggatgaaaaataaatgtagtgagaaagtgaatggctttttcttagcagaaaaggaaaattctaaacccatgtaaaagccatgatcacgtcaaaagttaaaagcattcctcttatcctttttcatccatgaagtagtcaagtagcatacacaaaacatgtggggaaatgtaacagctatattgcaactcaacatatgaaaagattatgtacaccatatgagcttaaaaagttagagcagacaaaacgacagcacatgaaaagaacacaattaggatatgacaatctaaatcatgcgttggaataacaaaaaaaaagttgaaagacaaaacataagttgttgaaaacatttcagctgttcttattgctggaattgtgcttcagtacgttttcttattgtaaggttgaattaatatttaaaagtaaacatacaaaacatattagaacaagtggcctaagtaatgcacaataagatctttatttttgagaaatcatatttttagaagcatggagcaaataatctacggtagtgatataatgaagaagctgaaaaaaaggggctatattaccatggacattctgaagatagtatggacccataatgtggcaatcagtacatgaattcaggaattaaagtaaaaagattttgttccacaacacgattcatttttatatagctttctaatgaattcatatgaattagaggtccaagctaagtaaatcccttgcttttgtataaaaaaaaattggcggccggcagaagccaacctgagcatattcaacaatagcccctatagtttaaatggaggctgccccatttattcaagatctaaaagatgcctccaatctagtagtagtctccatttctcaatccttatttttttagttttctctttcatttcaatatacactctatctttatgactagtttaacactacaataattcaaacataaatatttctaacacatagaattcaaccatatttaaattcacaattgtaaacaccatgttcacaatttatattcaaccatattcaaaatcaaaatttcaaatggaaatgaaaatgacatatcataccatgaaagtctcgacatattaatcataatcaggtttattctaattaataacagatcaaaacactgaacaaagttttagacacaacatgaagttcgatcaaaaattaaaagcaaagccatgtaacactgccaaggacatgcaaa

SEQ ID NO: 2618 - DNA, 2000 bp, Oryza sativa
  misc_feature (1432)..(1432): n = any nucleotide
  misc_feature (1451)..(1451): n = any nucleotide
cggtgaattactttgggacaggttacagttagctattcagccagtgtctcaaacccttaataaatgctaatgtttagggcaaatagcacttatcatcaaaactatgattcagatgagatccatcatcgcagcttgtcgccaagaccaccttgttcacttgtagctttttcatccttttccaataatagttgcagatttattcttcaccttgtccctctcatctgctaggtgattcaactcctgtagcagcagatctgtgcaatcctagttcacaaacaatacaaactgcaaaacaatccagatcatgcttgatgaaagcatgctccctgtaattatgaagaaactaattactagtaacatttatgaccattgttccactggtacatgcatgcaagtttgtgtaccataacgtagcgtttttttatcccgatgttgcagactaagttcctactgaggggaaataatcttgtgttgtcttttactcgacatgttgatggacagatgctaatggtgctgaagaggaggctttgcggagagttgtggaagccgaacgtgctgcaacacaggcaggagaaacagctgttcgtctgcgcagtagagctcagcgtctcatggcaaaggctgagctggtggcatacaaatctattatgccctcaggatagatctgagctgctagatatctgactcgtcacggatcttgtttgacgaccctcgactagtgaagaatgtgagtgagatgttcattgatttgtgtgaagagcatagtagccaatagtttgttttcctcttttttgccgcatcatttcaatgctacgtggtatttggctttcgggtaagctgtgggctgtgggtctcttttttcctccccacctgttttaactttgtgaagccaatctttgtagcggatgcttgaactcaactgtaatctcttgtgtacatgatagtggttagttagattgtgtgtatcttttctgtagccatgttttgaaaaagatgaacaaattaaaagcaaaatgaaaatcaggaggaggctaggtaaaacgagtcaactgaatgtatagtggttttcatcctgaagggttttcagatgaaagttactttcgttatgtctacctatttcattacacaaggaaataagtctatttcacctcccttgatatctagctcatgattgaatcgtcttcctcaaccgtaaaaccgggtataacacctccctctctttgaaaataggtgcaaattgactccttaagtggttttgaaaatatgtagcccgctttcttctctcagcaggtggaacccacatgtcagcgagttactactcacctcatcttcttcctcacctttccccttccctcttctctctctgcctcctctttctcgcccttccggcggctctcacgcctgtttctacttcctcattgctggcgcgcantggcatcctctcgcacatntgcgtgcacttcgactccgcctagccgctacggcaccacagccacatccttatgatcattggcagggtgttcctccgactgttcattgtcgtcgtctccaagggcagtgggccggcggcttcttgttggtgacgccgcacggcatggttgattccgcctgtcctggaagggatagatgaacgccaacaccgatactgtccacaaactcaaccgtaaaaccagatataactcatattcgaagacggagaaagcatctcaaatatggaatgggcttgggcctgcagtcggatagaaagaaactgggccagatccggtccaaaagtggcagctcacgcggacggcaccgcacaccacgcgctccgagctccggggtccggctgtgtgagtcgcaagcgactttttttctcttttcaaacagaaagctctggctcttatcgaaaattaaaaaaagagagagaaataaaaggggatcgatccgctcttgtagttgtagagcgttccattccacttccacagcagtggactcagtgagcaacggaggaagcaacg

SEQ ID NO: 2619 - DNA, 2000 bp, Oryza sativa
  misc_feature (1396)..(1396): n = any nucleotide
  misc_feature (1638)..(1638): n = any nucleotide
  misc_feature (1908)..(1908): n = any nucleotide
ctttatagtagatataatgttacagtgaactgaaatactccattccaacaaaaaatacaaatattttggaaacccctattaaagggaattcgttattattttttgttccaccgaaaaatgttttactatcgtatagaattgaaattgttgcagtaaactaaaacattacattcttgctatttgctgaaacattgttttttataaggtgaaacaacacccgatttaaatgagtgaaacagttagtcatcgtgaaagaaatagtttacagagctttcgaatgcagagcttttaaagctaaccgataagtctgcatcatgcaaaaacagcatgattaacagaacagaggtttattgagcaaatcctaagcagtgtcagagtacagatgtgggtatgtagcgttcaccaaaactataacgttgcgacttatgcgtgatgatgcgaagctcgtcgtcgtggccgcgcaccacctcgacgccggtgagcacggcgaaattcctttcatccgactcgaaatcgcagcagtattcggtgcaggtcccccggcgagagaccgtgtacagcttggcgacgcacagcttgctgtcgccgatgtgcacgacgtgcgacgagtacacctcggtgtattcgccgaggtcgacggcgtgcgacgggcgcgccctgcgacgcgacggccccggcacggcgaagtccctgcacccggggtgcgccggcggtggcggctccggctgctggacggtggaggaggagaacaggtcccacgcgccgaggacgtcgtcgtccgcggcggagaagccgaagcagaggccatgctcggggacgtactcggcgcggtcgctgaagggcagcgtccagtcgccgtccttgctccaggtggcgcgcgccgtgtcgaaggagtaggtgccgtgcctcctcgacgacagcaggatgcgcgagccgccgaccgccgcgtacgcgcaggtgtcgccgacggcgttctcgtagccggcggcgtgcacgtacggcggcggcggcatggcgcgccagaggcaaccgtcctctgcctccttcttgcaacggacgagcgcctcgaaagaacggtcggtgacgccgtcggggcgaggtgacaccgccatgacgtacagatccttgccgacggcgagcgacagcgtccggaacttgggcgtgaccatggcgggcaacgcgccgacgctgtgcttggcggggtcgtagacgatcgtgcggccagcatggtcgacggcgatgatcttgtcgtcgttcctgcgcatgatcttcatccacgtgaggttgtccgtctccgaatcgctaccgggggggaaagaagttcatgtcggctggagacaggcggacgtcctccacggccgccgccgccgccgccgccgccgggtctgcgtagaanagacttgatgggtcgattcggcgtagcctctggaaggaggggtctacagcccggaaatcaaccatgtagaggaatcgccggttcttcgtcttcccaaatcgcttcttcgctttctttttttccaagatgccggagcgattattgggaattgttcccaatctgctaatggggttagcatttgcgaacgaggagtagatgcggtcggcgagcgcggcggcgcggcggcagctgctgccgcgganagaggcagcgcccaatcgccgccggcatcttggagcccaggacagcgatgatccggcgacaacttcgacagatcacacggccctatctcccgcaggctacgccgcatcaacccatcacatctcttctaccccaatgatgcactgcccgtgccctaatcgtcggcggcggtggaggacgtcccgctgcctccgacagaggtgaccttctgcgggtcgacggagttcatgcgcaggagcgacgacaagatcgtcggcggcgcaatcctctangaccccgccgagcacgccgtccgcgtcttgccctccatggtggagtacaagttctggaacccagtcgttcgccgtcggcgacgatctctacg

SEQ ID NO: 2620 - DNA, 2000 bp, Oryza sativa
  misc_feature (1326)..(1326): n = any nucleotide
aaccttatcatgacaaaataaaatacgaatggagtaagagttcacactgtcaaggttttgctcaaggagtagatgattctcgaagcagtgtggttgcatagtctgaaaaacagagaccatgggctctggagaaggtagttaattaattaattaattaattaattaattacactgacgtccataactatcatttcccaaccaaagttttttttctcctccaagcatcacaattaaggactcaacaaggtcaagagggagaaaagaaaaggaatggaaaggctaggataattcttttccactacctaaaagaaattattcttggagtgccgcggaggcaagtaattgtaccgatcgagttccatgattatcgattcggaagtcatatattctctcacccaaattaagatgtttttttctccctttgccaagcatcccaattaataaggactagcctttaggtcaagaataataatgggaccaataatacaaccgcacgtaggggtctccaataataatcaatactctatctgttttatactatataagtcgttttatttttttagtcaaactttaaacaagttaaaaaaagggtcgttttatatttctaacctaaaacaaatatattatcaaaatatgttcaatacaaaatttaataaaactaatttagttataaacgttacaaacttttattttatgaaaacgatttataatataaaatggagcgagcagtggcgtggctgttgtcgccatcggcgatggacaagaggtagcgacgcgcgagccaattggagcccctcgttcggtggcgtcgtcattaggatagcgatcaatctgcctttgaatgtacttgttgtgtttaatttactgtggtaattaactgggtcagtgttttaatcggcgatcgagtggattagtacgtgaggtgtaggtgattgttgtgtgtgtggtcggaggaagcagcggtagcacggaagctggggacacttggctggctagcttgctcttgacaaggttcagttaccgtacaagctttcttcagtaatcttggtgttgatcgatcgggacagatttgatgtggctgtgctgcagctgcagcagcatgcagcaaaattaacacacacaatttctgctatttctactgcttgtgcccctagtgtacaaacctaaggcccattgtttggctatttagaatggtttattaggtaataaaaataaatttataggtaaattttttttatattttttttacttaaaagtcaatgctgaaaaaaaactatgttaaaaaaatctaaaaattaagttaaaaattttaaaatttggcttttnctttaactaattaggctattcgttgggagccctatctgatgcatgcctgccagtgccaggtaggattagaactgcacattgtgactaatcatattccgttagaagctaattagaatgcgatgtgcatatgtgagggggcattattgaggcatactatatgtacaaatggcctcttcttggtgcttatttggtcattcactgtttaataattaaatctgctgtacgtgtcctttcctctaaattctatacatcttcctctatttatataaatagcgtgccctcttaattatatgttcttttcggggttaattacatgtttaatgagcagcgagcacatgtatgtctatatatagcagacatatacgactacgtgttatcctaatcaatgttaaactcactgagatcaaccatgacatattatttttctcttggaataagttcacttgagttcacttaacttgtcaacgaatccgattttcgtccttcgatcagaaaaccagatataccaggtcccttaactatcagaaccggtgcaaaacaggtccctcagcggtttcgatggtggttttggctgatgtggcaccgacgtggccagtttgagttggtcctcgtcttacgtggcgatgatgtggcactagaagcaaaatataaaacttaaaaataaaaaccaaaac

SEQ ID NO: 2621 - DNA, 2000 bp, Oryza sativa
  misc_feature (1082)..(1082): n = any nucleotide
gaatagagaaagcaggcacatactagagagaactagagaggtgtgtccttcaaaagcctgcacaaagtgtagtgctcaatgatcccacaactttcacaaacactagcccacaatgctctttctctcttcccttctctctctctctcttgtcttcttgtgttacaacaagatcagagcttttgcatgcatccatctctgattgatatgcatgatcaggcacacagccccccagggaggagtgcccttgttgtagttttgcagtgccttgcccacaccctgctgaaaagaggccatataaagcagcatccttggacccattgcctctggcctcccaaacatttttttttttgcatttttgcttgtgtttgtttgctcaagcaaagactgcaagagaagaatcaaagtgtgcaagcaacttcatccctatccccctatatagacaggtaaatctaggagtataatcctcttgagtcttgtcctggttcttggatctctctcacacagtgctgcatgcttccttccatgaatggattttgattagtttaagcgaaacctaccttgcttgtttgagtgtctctcaatgccagcactgtttaactgtagtagaggatgagtggtgggacagtcatttagtagattttaggcacatgcatgatccacatttttataatgcaatgttgtattttggattaggataactgaccaatgagcctatggtttgcctccccagtgaccaatcattaggtgataaatcccatatgcttttgtcaccactcctcctttacactgtcccataaaaaatctactcctatctaagatgagatgtgatgttgggtatgtttagattcattatgctataaaatgtcttatcttatcttttatgaaacagaggaagtagtaataagccataggtgtatgccctgtgtttagaaaaccgatgaaaaccggtgaaatccaaactttcttgaccaggtcagaaagctacaaactactcggtcttttggtcaagtttaaaattttcaaactaaatttaaatttttgtcaaagatttatctatattttatcggtttataaatggtttnaatcggatagtgaatcactcggcatctataatactcctacagtagtataatgagtgagctactactagttgtgtatgggcaccaacaccttgtcattggcactttgcctcctgagtagggcccattgggttctttgatagcctctcctccaaggcccaaaaaattttctgaacccagtgtcaagggtcagggagagctgctcccttgctggccttgagatgtttgcattggttttttccctttccctttctctttggtggtcattaggcctacctgatactacttgtagtgagtgagtgataagttgataacacttctccctgccccaattgtttccttgttcctagtagaagtagaagctggaagctggtctctttgggttttggaaggcttcatctttccattttaggtcctgcaagtgtgctcaacaactcaagcttcactgtcttcttggtttctacctctggtatcagctccttttgttcatctttgtgatgcattgtgttattcaccatgcatcagttcatctggtattttatgaatttatcaaatgagaacagaaaaagaaaagattcttgttttaaaagttggaagatcagttgtatgttagttgcaagattgaatctctttttgttccaatggaacaattctgtgaggatctatttgtggcttgtactgttgattcttttgctactgtgaaggtaaaaactaaaagtggtagtagatgaaaagatcaaaaactttgatttcaagggtacacctagtacaagcctgatttgtcaaaagaacaacaaaaatctcgtgaagaacagtgtgtctgaatgtctgatgcgtgtgtgctgctgctgttcttcttcttcttctcaggttttgattattatcactagtttctgcaattcttggagatttccgaggcgg

SEQ ID NO: 2622 - DNA, 2000 bp, Oryza sativa
  misc_feature (1923)..(1925): n = any nucleotide
taatggttcaggcttctctcataattgatttttcaacgataaagacaaaagaagttgactacctgtgtagacctttcacctgcacatggaattaatctgtcactgtaaaaaaacctagatttgtttttattccatctggacagagtagaatatgtcacatccaattctaaatttattttttttgatagagagagtatgcaggattctattgtatcatagtcctaggctgggttcgttgttgtgtgttgggaatacatttctagcgcacgaaaaattgagcggtccattagcatgtgattaattcagtattaggtaattttattttcaaaaatggatcaatatgattttttaagcaactttcatatagaaactttttacaaaacacacaccgtttagcagtttgaaaagcatgtgcgcggaatgtgagggaggtgagttggaaagttggagaaagaactcagccctagcgttgttggtcatcctattggacccgctattgatcatcgttttggtaagctgcaacaagcttagctaatcagaggagaccctctccttgggcatatttttacttctactactcaacctatgggtattaggaaccatttccagattcataatttatataaatggactcttgacattaaaataatcaattaaggtatcattagttggatttccaagattaagaatgccacttctatcaaacagataaatttgtctctcgaactatagctttaatttattttcaaggatggtcaataattagatttctactattgcccataaaattgtaggtcctgctcattcagcctctatcataaacaattgttttttggtatgggggaagtcaatcattggctccacaaacagtggtgtgtacatgtggttagggtaagtgctataatgcttcatatgttacccttaaaagtgacacatagaattgggtgatgaggtggagaagagagatgatgagtcactcctaaatcaagaggtagcctccacacaaactccaagaaggatatgggagtattataggtattggtatttgtgtattaggggtgacattgtatatattacctcttaatttatgagtgaataacatagataaatttggaggtagcaatcacatctactatagatcgtgtcactgcaatcagctaaaggaacaaagaatgagaacacacggatcatgatttgtcttggccacttgatgtctcgacctacggagtaacatcctcggccttgagctgaccttgtcagtcctcgtcacatggacactaacgagaataaaaagttaatatggttcactaatagaacatagagccatatacaacacttatactaaatgcaatatccataggtggaacaattatcccttacaacttgatatggattagaggtctatgataaccatgtaccaaaatgatgagaaagattgtaaacaattatcatggtgattgttttcacccatcacatatccttcaaaatttgcagcatatgctgctaaatattccaacatccaactatgttggaattgctagttctgggctatgactctgattgcttatctgtccatacccctttggggcatattgtgattgtgtagattacgtgttatagacaactttgtgtagttgtctaaagaatatgttggttggcaaatcttggttggttggcaaatcttgttcgtttggcgactccgatttttggtaatgccatttatctaagctaagtgtgtaaagactagaaaatctgtcaaaaggttgattttcctttgttagctcacatcctaccaatgaaagcaacacatttaatgcataaacaaagaaaatgtaggatacatttcttcccttccccaaccttaacaaataaagggtgggcaaggctagtatgtcttcattgaatattaccatcattagagannnagcaattttggtatttcgtccacccccgatacaaatgactaaactgaaagattgaaccccactctctctccaatg

SEQ ID NO: 2623 - DNA, 2000 bp, Oryza sativa
  misc_feature (1674)..(1674): n = any nucleotide
tcgactgttacaccatgcagcaaatgaagctgccgtagacgtcaggcgagctgcaaggcaacaccataccttgtagccaaacaagcctcatatcttagtgcgtgcggttttgttgggcccaactattttggagccgtcgccaattataggtctggaatataaccccctttatttagattttctttcttcccgttaacttaggtgttatagccacgccaaattttggcctatatggaaatgtaattaagtctatagataacatattatgtggagataagaatagtacaccctccagttcttttttaactgacattatagcttaatagcttttgtatgggaaaaatcgacgttttagctcaaggctcagtttcccagcactatccttgcatgcatgcaaacacaatacactcccgaggcaaacatttgttgcttggtttccatctgtgaccaacagctggtactccaggagtaaagatgcatgcatctgctgcttcattttcatcctcgaatgtatttaatatgggtataattgaaaatgtagatcctaattaattactcattggtatttgcaatactgtctaaaacatcaattaaactagaaccggaggggagggagtatatttcttttttctttaattttcaggagttgttttcatactttcaatcaccttaaaactacataagtaatagcctaaacataagttttatctcgctagttctcttcacttacgtaatagttataagtcgtattcttatcttaacttatgtaaccgtcataaactatcacaaatctaaaacatcacaacatattatcattcctcatgaatactactatatttttttcgtcagttataaactttcccatcgtacatggttactatcctccactagtttcatattatatgcaattattcacgaagcatatgtcaaatccgatatatgtttaccaagtcaagcggtaaaactaattctttgtgccccaaccgttccaaggggccgccaattccgcacggccgttcaaaggaggttttgcatggagggaggcgaggcagtccggtaggcaggtaggcgtgtatttgccggaaagcccctgtactctcgctcggagaagagaaaaaaaaaccaaaccccccaacgaaaacgcaagcgaaaaggagaggcgacgcgaggcgaccgatctcgcctttaccttagccaagccagcccagccgcccccacccagcgcaacgagcaggcaggccacgcacacgcactctctctcctcctcctcctctcctcttcttcacctctcctcccctcgcgcggcgcggaagccaaggggaagcaaaggaggcttcgagatttccgcggaacccccaggccaccaccatcctcctcctcctcctcctcttctccccatcctccgcctccacctattacccacatcctagggtttccccctcctcctccgcctcacctcccagtaccccatcctcccaccgccgcagccgcattcgaaggtgtgtatccatcgatccccgcctacccgccaacgactccccttcccgtctcgaggtgcctctggtccggggatcgatccttggttcctcgccgccgccgccgcttggtttcggtggggggtggagctttgtgttgctcggtgatctggaggcgtgattcgccgcgccggggccntggattggttttgttgattggggggagttgggggtttcgatttgggagggagattgaggtggtggtggtggtgtatcgaggggccctggttttctctgctattggattggattgggatccatgatcgagattgctcggtgaagtttttggtcctaggggaattttttttatcggcccggatcaggaatggagggttctcttggggagatctagggttgcttgttctgtatcgtttctgtgtgcagaaaattagttgaaaaaaatcccaaaaaaaatagaaagaggaaaaaaaagagagagggggagagtggaggagagtttggagg

SEQ ID NO: 2624 - DNA, 2000 bp, Oryza sativa
  misc_feature (1628)..(1628): n = any nucleotide
attttctcgtcaagcaggaaggaaaattattcagagacagtatccgagccatctaaggcctgaaatcgcaccactgtgccgtggtctaagggcgaatatttatggggattaattaaactggcaatggttaacctgcccattccataggcacattacatgagtacttaactctgcaatatccctaatctagtggataattaacataatgcatatgagatccagacagcacatgctctccatctcatcctgccttccctcatttcccctaaatcatttgttgtacagtgttctcacttctcactcagtttgatgagcgtattttttttaagtatgtgaagtcagatacgaatcccaatgggccgacacgttatgaccatgtcgttagtttcagtcaaaaaaaaattactgaagtaaataactaccattagcttcagcttcttactaagtgacatccatatttcaattaacgtatcgacaggttacaaaaccatatgcgtacgtatataccgggaagaacatccaaagttcaaataggatgaggggcacagaatttagttttggatttctgcaatctctgcatgaatgagccaaacgtgttcaaaattgaaaccctgaattgcctgattgggcgagaggaggaggattctcatggtccctctcctgcctgtatgccccagcaaaaacaacgttcaaatccttgtgaatttagctgaacataattaattgcccaaaattgaatgaggcgtcctggactcctggcccctccccccatcctatgcaggttagcacattgaaaccaccctgtccacataggcccccggcacactgtagcgaaacacggcacgtgtcgcggacgatcctaaccgttggattcgtcatcggacggctcagatcgcctcggaaatggattacagtacaatctgtaaatgcagaggatcattgtccttgggttggcacttctgatgtgtgaacagtgaaatatcaagctatggcaatggtagtagcaggttctctagtgatttgtgaacttgtggtagatagtaaaaaaaagggggggttgatgataattggcatcggatcatgtgcaagcaaagctttgcttagggttgttaaaaaggcagatttgacgcaagctgagttgtgccatgtgtgatgcccagtttgctctgctcctgttaaaatatatatgcaatgtggaataagaaattggagcccttaagattaactggtaaccacatgcagctctgactagctaggaacgaaaaaaatatatattcacagtcaaacttatccatcatcagatcatttatgccatgaactcaagaagttcagtaaacttaagcatgacattcagtttatcctaaaaccatacaaggatacatgaaattcagccaaaaaaaagcacataaatttacagcctagaaaaataacccttttttcctccttttttccaatgacagcaacaaaaaggataatacagcgaaagccttcagcatctctccatttgctttcggatcaagcttctctgatcgcttctgcgtcactatttcttctgaaacaatagcaatgcagcgtacaaatttgtgccaaacatctacagttaacgtttccgcctgaatcaccactgnaaagcgcaatcgagaaattctttttggataggatcagatcagcaaattcagaagcagcagcagcagcgtgcacttgaccacgaacaagaaaagaaaattccattccgttacgcgcgcaaaaattaactaatgcccctcccagatcgcgtccgccatggtgcagcagttattgcaggcgacgtagctgcagagtggcaagtaatatattccccctgtatatgcattgcattgcaccgcactgcacgtcccatctacacagttgcaagcaagatcgatcgctcgctcgcacatggcggcgcgagcggatcgccggttgcgagctcgcggtggtctagtggattagtgtggaggaggagaagaggagaggagaga

SEQ ID NO: 2625 - DNA, 2000 bp, Oryza sativa
gaatgaggaggcgattgtctcgtctgttcaagggatccggctcttcatcaagccatcatgacgagtctagcgctcgttcatcagttgatatctcaatggaggacactgaagctccgcgacatctcctgaacgacactgaccttgaccttgtagatgatcgagaaagacaagccaactacatgctgagtaccaggagtatgctcacacgcgagaatactctctggagctgctgaaaaagataggtatggatgttgatattcgtgctatttggaaaactgttggttggtagagatttgcggtggtggtagatgagcctggttctcatttgcttactttgcaatttctgttcactttctcatttccttactttgcaatttagccctggttgtatggtcatgacgggctgtcgtaaggaactcggtagtcaggggtggcttctcgaagtaccaggagagcatcggatagagggtattagctagtatatcatatgactagaatgtatgtatactatgtatactagaagtataggaatagattatctttctcttttctttccacttagtttagatactttgctgtgagaatgaataacttactgcttgtgtgtcactctacccttgaattatcttaacccctgcttagactatgattattacaagtaacatataaattattagtcaagttctctctaccatgatcttcccacgggattaaataaatacgatactcttggaatactctcgggtaaaatgctacaatggtatatccatacgcttgcggatgaactctgtaaccataatataccaagagtatttctacgccattgctgggaagtatatttctagtaatgtcattaagaaataccaacagtatacctcctatcctacgacttatggaatataccgataaggtataccttcacgtacacggatcgttcccgtgaatatcgtttggaatccatcgcaaattatgaaaaatatctctacaagtcaagcgatttccaaagtcctactcggaagggatagagtttctattatgccataccagatcaaatacccttagatctttcttgggggtcaagatgatccacgctataaaagggacccctgggaggggtgaaaagcatccaattatatcgccaacacacccaccatagtttacgaagccggagtacacggagtcaactcgctaggagatctcgtcgaatccatcgactacgatcttgtcggtaccatctatttcgactactctctttgtaagatgttctcatcatcatcaatcccatacaaactggattagggttattacctgacaaggggcttgaaccagtataatccttgtcttttgtctgcttgatgtcgtactacgtataccctcgttgcaacataccccaatactctattcatccggtccgcgagtatcactcgtcgatagtggtgcgccaggcagggggacttggtgctcaaggatctaccggtatgacttcaagagttcctgacagcagtaccaacaccggcgtcgatcaaggagcctctgctcgacattgctgatgtggactcaagtcggatccattgtctttccggtctacaccgttacgctgatctcgattggcccaatcattatcgggaacgagaaaggcatggttatgactccgagaaacgacaccccgctgacaattcctcccactcaagtggagaacggaacatcgacggccccaacacttggaaggaatcctcaagcggccgaattttgtcctctatacaaaagatcagagccgataaggacgaccaccctaaagcagagatcttggtgtcctattcataggacatccaagcacactctcgaggactgcccggtgatactccatgtgaaagctgaactctacgcctgttgggaacgtgggattcagcgcacttcaccgatgggaacacctactacccaattcataaatctacatctcacgatctgacaagctgtaggatatttctcagaccctcaaa

SEQ ID NO: 2626 - DNA, 709 bp, Oryza sativa
  misc_feature (7)..(7): n = any nucleotide
  misc_feature (27)..(27): n = any nucleotide
  misc_feature (34)..(34): n = any nucleotide
  misc_feature (64)..(64): n = any nucleotide
tttaaanccaaaggtcaaattataatngaattcnccccaaatttaatattaatatataaagctnatataaaattcagctcacgtaagattgcattgaaaaatcccctagtttggactttggactaacacggtagaaaacgatcatgctctttagcttatcagctgcaaccaaaatttaaattttaaatcttaattttgattattttaatcgtagttttttttcaaccattatttttataaatctcgaatcgatataaaagaaaattgaggactgctacaaaacaggatcccgttgcaacgggatagacatattaactattctcttgtacgagtatcacaggtattaggtcctaggtatcacaagtaccgggtaagaggtatcacagatatcaggtaccatgtagctggtaccaaaacaggtatcatactgtcttatagatgatatcctgttacaacatgataccgttgtttgaagaaaattacccacacattatttttctcgcaaatcatcgcttctgaagatcacacaacggaagtccggaacccacgcccaaatcaaaaagaagcggacgccccccaaaaagttcaaaactttccaaaacatcgtgtgcgcggctgcatcgccgcccacccgcctcatcgcattcacaactctcgcctaaaaggctaaaacccttcctccgccggccgaacccgtctggattcgcca

SEQ ID NO: 2627 - DNA, 2000 bp, Oryza sativa
taatgctgttttctaggcctaaatagcttccatctgaagttttttacttttgctataaggagaagaaaataaacacaggacactgattcttaattagaatcagaccaagtttggtaggtgaattcttctagtgtgttggaaggctcgtatgctattattcattattatttttagaactgggccagtagctctatcattccattaaggagaagggacactcatgctagtggtaggacttgaactgggtcgatggcaaggttaaacagcctcccaccaacaggccgctggccttccccaccaaaattgtttgagttatctatggttgttcggtctagaaaatgaattttagcagtactattaacttgtgttatggatacatctgtgaacaggtaccttacaccgccctcacgttttcgtgatgctactggtaaaaagacatcattcacaagtagactaaaggttgaagaatttatcaagacagagtttccagatatggatccgaacacattcttttctatgtttatttggaagatccctgctaaaggacactgtatccaaagaggttaaacctttctgttgccttttatgttcttttagttgctgtttccatgtaagattgtcttttacagtatttcctagcggtgctgtacaaccaccggaccagagactgggctctgacatcagctcactggcagttgtggtgactattggattctgtgcggtttagaatactatagcagaccattacagacgctgtagtgactagcggcttggactacatataataccaggtgcttatttgtagagatattcaccaagtagccagtgccatacaccattcatttcattgtgtgtattgggcgcttcttatgtaggattagaccttctttttggaaaaacattcatttcatataggagactatatttttttgtgacttactatttgattctcttgaagtaattaatatacaacattacttactaaaaatgcctacctgcctgaggacctttctgtgttcctttcctctatctaatagtgaccttctcgtgtaatcaaaatctgatttttgtatggcttacctttttcactgttattttgtataaacttccatattttgaatcttttatgttttaagtagctaacatatcactggaactctaccctatgtatccccgatccacatttttagactttcttttgacacagtctgtgccatcgattccttatcgttataaacactttgattggttttgtactttgatgcaccttcttcaataactttattcagctctaccacttagcatacctcctaactaacaggataatctagtgtagaaatgtgaaaacatcacaggttacctgccatgttacactggaaataaaaatggaaaaagtatacattggaaataataaagtcgataggcaacagtgcttctcagaatgcaatagattctcagtgtactaaccacacttttgatttttcttgtgcctatgcaccatcaatgtcgatatctgttatcatgtgataaatctcctgttacagtgcctctatagtgtagccaataaactatgttctcaatattgtttagccagaatgatatcctatctatttacaaaatacttttgttcatgtgtaatctgggaagtgcttcaagacttggttgttatttttggtggatgcgctttgaacattttaatgtttatcctgtgtataacacacatattttatccataaattagcgacaacgggccctgggctgctcgggcttcagccaggcctggtcctgaaagacccttgtaaccctttatagaaagtaaaatttacaggtatagagggcccataccaggatggtttgtttgcccagcctgggtaaagcccatttctggctccgccactgtatatataggttgttctacacagcttacctcttgcactctctgctcctaaaccctagccgccaatctgatccttgcttctgcctctacctcatcgtggtgc

SEQ ID NO: 2628 - DNA, 2000 bp, Oryza sativa
aactaatcccgtgtccttcaggtttattccccatcgataaaatccttgagaacaatcagaacaacaggacatgtgtaaaatccttcagaagttcaggaattgacacttggaggctacagagcattttcagaaatcagaataactattgccaataatttcaaatttctgccaataagtacaaacgagttccaaaaccagagtcatttgcgcggtagggaacgcgcgtgctgacaacgctgatgtcattgccttccataaattcaaatcccgctttaccgagggaatcctgttacaacttttttttctgattttaattctctgaattctgatgagtctgaatgttttccacttctgaactttgggtcctgacaaggatgaagcaccagaaggctactgacattgttggaaaaaaaaactattttcatcaagcacagtatctcgacatattcttgaaactatttactttttattgagatgctctgtagaaaaaataacatgatcaactatactctgttttttccggtttcactatcttcagaggtaaacaatactctgttttaccccatttctgttaccctgatgtcccttaggtttactcaccatggataaaatacttaagaatatgacatgagtaaaatcatttagaactttaggatagcacttctctgttaaaaaatgacactgaacttctctaaatgatttccatttatgaaatttgggtcctgacaaggttaacacaacggaaggctgctgacaagagaaacctattctcatcgaacacaacatcccaacatattaatgaaactgaattgaacacatggtgcaagatcaaatctatatattcttgatgagatactctgttaaaaatttaaaccaaatgtactctgcttttccccttcagtctgattgtcttctgaagtaaacatgacataggtaaaaatccttcagaagttcatgaattggcacctcgaggctccacatagcattttccaattctgaattttgggtcctgacaagggtataatatcagaaggctaccgacaatgttgagaacataaaagaaaaactatttttatcgtatgtcgacacatattcttgaaactatatattacccttcaatttcattatcttcagaggtaagcaataatctgttttcgtcccattcagttacctcagtctacctaagtttactcaccgtggataaaatccttcagaactttaggatagcacttcagaagttccttatccttttggccgtcagatgtccttgcagtgaaatagctgaaccggcaaattgcctgcatatgcttccctctatatttcaaaaaagtttctgaactgctctgaatactgatgaccctgaatgatttccatctgtgaaattagggtccggacaagggtaaaacaccggaaggctgctcacaatgctgagagcaagaaacttattctcatcatacacaacatctcaacatatttttgaactaaatgaagtgcctctcatcatcaaatctatatgttcttcagacataccctgtaaacggaaaaaaccatcaactatactatctgcttttcccccttcagtttgaatgccgtcagaaatcagaagcaaacagaatatgggtaaaaatccttccgaagttcatgaattggcacctcgaggctgcacatttcattttcaaaatcaccacgactccacgagcaacaagaatacatagcatcagttatagttcaaatttctggtcgaatttggaaactaatccaatcaagttccaaaatctaagtcccatttcgttaaaccctcaaccgttgctccgaagctcgcgcggggcacgcgtgcagacaacgctgtgtcgcgctgacgtcatcgcctctataaattcaaatcccgcattgctgagacgatccacacgcacacttccctcgtctcctctcagcctctcacccacgcgccctcgcttcctttcctcctaaaccctagaaatcctcaggcgatcggatgg

SEQ ID NO: 2629 - DNA, 2000 bp, Oryza sativa
tctcaagatgagggaggtgaaatgacaaatgagaagctattaatgcatgaatgttccccaactgatgatgattttgagagatgtcagattcccactgattctgacattgaaagacttagagaggaagaagataatgaagaggacaatttccaagaggtgtctaacaaaaagaagaacagggctaagaaaacagaacttgcagtgacttcaaggatgaatctaagacaaagggagatggctgctaacccaataaccaaaagaactaagatactcacctagaagaagaacttggagcattaagctacaacaactaattaatccatttgctatatttcagttgttagattcgattgagttgaataatattactattgcctctaacttaaacttaggtagtacctctaaagagagaaaataatatagagactctaaaagcaaggaaattgttcaggctagactaggaaagctaaactggaaaaaagagatttaaaagacaaagacacaagaggaggtggtggagtcagagacagaagggtgagatgataacaagcaagaggaagaaaaagaggagataattatatgagaaatattgtaaaattgcatttttagatcagttatgctgatttaatgtatcacaataggagaaaaacaccttggtaggtctccgctgctgacatggttgttgtcagggttatggataccacataactaatagtagttgactaaatctcagcaggacccaccacataccatgtcctatacggaaacaacctgcggatataggaggagttccagataaggaaagaccaaccagagttctatatggaaacgacaaagactactcggattgtatccatattggtttccctaattctacttgaacaaggggacacctatgggtataaatacaaggccccctaggaggagaggggagacgacgatacacacccacaatcaacagacacgggtaacatagacgtcacaaagctgtgagccaatacaagccaacatacgccaagacaagacgccggatatcgacttcagggattggcacggctagtcccctacggtgtctccggatactatcaggagagacgaaagcgctatctctgatctcgccgggcacgaactcgaggaggaagactaccctgttgtcgactacgagtcagatcttcagaccgccatgtcgacaacagttagataggctaccccaaacattgtactggtgtgattatggtgaataagagcaataccggctttggccaacaggatgtagggttattacctggcaattcaggggcccgaacctgtataaaaacccctgtctccgtctcttttacctcagtctcgcgtatatcctagtaccaacgatccccatactatgcaaataccggaatcgcgacatcaaacgtcgatagttgtcaatggtggtaaaaatttaataagtagtcccctctgaaactcatcatggtaacatatttgcatttagctcctctgctgtttatctctaacctaactcctctctactccatttattatcctctttggactcagagaagggaaagtggtagcgacataagagcatctctaacagcctctccattatactttccaagccaaaatttagccattcatgccaaaaaaaaacatgctccaacagcctctccaatccactagccaaatttggcaagccaaaagccactagccaaccatgggcccctcgcacattcctcctcccatctcctctccggctcctctctcgctaacgtcctgccatcaacgacgccacaaaggagagaggcgtcgtcgccagccgcgaccaccaccgtcctccacgaccgccgttgtcccccgcgccgtcggccgccgccatcctccgtgaccgccgctgtcctccgcgccgtccttcgtgaccgtcgccctcctgacgtcgcccaccgtgacctctgccacgaccaccgccgtccgaggtagagggcgtggggaggaggcagcagtac

SEQ ID NO: 2630 - DNA, 2000 bp, Oryza sativa
tgcggtggcgacggcggcgatcttgcggggcgggaggccgaggtcggagaggaaggcgaggacggcgtcgggcttggagggggacctgaggtgggagagcttcttcgaggccttgcgcgcttgggctccggtgaggccccaggtggcgacgaggtagtcctcgacggcgaagggttcgggggagacgggcgcggcggtggtggagaagaggaggaggcggcggagggaggagaggggagagattgcggcggtgggatgaggatacgctggccggaggaggagagaaatcatatgcctccggaggtggtggaccatggcggcggcggcgcaatggtttgccggcggcggcgcaagggtttgcccgcggccgcgtgaaatcgcaatgtttacgtgcagtaacgttggtgggccatgtttaacggcccatttgaaatggacgaaggccttattttcggctgtgtatgttcgcgtggggaaagtccgctttacgttcccgaaggttttagagcgtcatctaactcgtatagctaggataaaattaagtttctcggtcgttctcactctgtcttaaataaaaagaatttttaaagagatataatatattttagtactatgtgttttaaaatataagagaccctccaaaatttgtaggacggagggagtgtttaagttggttttgacttgtatatcgcctacattacttgttgccttatttttcatcctatatccatatggctcctacacgatgtagaggcaaaataataagtaaataaaataaaaacacccgtggaaattaagtcactaagaatcttgttagaaaaatataaaacaatattatgcattattctaagcactaagattttaaatcatagtactcacaaatactatgcacgcgcgaataggctttcaataaaattttagtggtagatgcgtgtcactgatctctgtctctttgggcatgtcatccatgtaataaaaaaaaccttaaattcagcggttcaacttgggtgtgcaaatatatgcatgagtgtggtgtgtacatatgcatcatccgtgtaatcggaaaaaaaaggcaagagatgagaaagaaactagagcaatataaaattgcgtgtttttgcgtacgcgttaattagaaaagagaaaattttacaaaaactcaggtttttgggtatctataatgcaaaaccccaggttttacaaattgtttcataaaatcctaagttttgggtaaagtgtttcataaaaccccatctaaaagcttatattgtctatccaactaacatatttatctataacaattgtaaaaatggtatgagatatttttttttaagttcatgtacacgtgagagcattaccaagaaatccctacagctactcccaatttcaaacttttgggttttttctaagataaaaaatggatccaacagatatcaaaactatagctctgaaaaaatttgagaccctaattccgtgctttcaacagtagttgatgattatagtatgattttttttacatttaatcaattattgagttaggattatattgagtttctagtgcactaaaaagtaagaaaaaaattaagctagacgagagaaatgtgtgctttgagtcgactaatgtgaatttatgaaaaataatcatatgtaacaatgaaataggagtatttcatataaatacgaggtttttctgaaatattttgttctaaaataatgcgttcttggaaacaaaactcgtcagaaaaaattgcctttggtccaagaaaaaaaaaaggaagaaatactcgtatgcattttgttgcgccatagccgctagtccccggctccccggcccttcccacccctatccccggccgccgccactccctccccggccatcgccgtcgccgtcgccgtcgccgctgcagccgccagccatgctccacctccagaaacacctcctcctcctctccctccctccccggcggccaccgcctccaccctcctctccctccgccacc

SEQ ID NO: 2631 - DNA, 2000 bp, Oryza sativa
  misc_feature (31)..(31): n = any nucleotide
  misc_feature (34)..(34): n = any nucleotide
  misc_feature (65)..(65): n = any nucleotide
  misc_feature (91)..(91): n = any nucleotide
  misc_feature (110)..(110): n = any nucleotide
  misc_feature (114)..(114): n = any nucleotide
  misc_feature (338)..(338): n = any nucleotide
  misc_feature (693)..(693): n = any nucleotide
  misc_feature (698)..(698): n = any nucleotide
aaaaagggaaaaataccgaaacgaatccgantanatcgacgcggtaaaaagagtttaaaaaaatnaaaagaaaactgtcctattccaaagnaaaatgaattatatgtatntggngagaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccagcgngaaaaaagatagtccgatccgaaaaaaacaggagaaaaaaaaatgggcgaaaaaaaaatttgtccgataaaagaaaaggaaaaagctgaaaagaatctgactccatcgacgcggtaaaaaaaggcgaaaaaaaactttccgataaagaaaaaggaattatatgtgatgcggtataaaaaaaccaggcgaaaaaaaagataaaagtccgataaaaaaacggggcgaaaaaaaaaaaaatctgtcctatccaaaaaaagccaaaaaggggaaaaatcaaaacgaatccgactccgtcgacgtggtgaaaacagggcgaaaaaattccaaagtaaagggagaaaaaaatcaaaacgancgacnccgtcgacgcggtaaaaaaagggcgaaaaaaatccaaagtaaaaggaattatatgtcacgcggtaaaaaaaatcgatcgggcgaaataaaccgggcaaaaaaaaatctgtccgatccaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtatagtactaatgtataaattaaataaaaaagaaaaaaaagaagaagacaaaaacactcgattgggctacgtatccagcccaaattggatttgcacatgcgagagagagaaaacagcccgagttcatgaaggagacctccatgcagtcacaaaggagacccatgtgaagcatctcaaattgcaaataaataaataaagcaacgccgcaaaatcatcagatggtaaaagaatattttacttaatggaaaaggggggagcaatgctctcctagttcaaaaaaaaaagagaatattttacttccctgaattatttcactagatcatttaactccctaaataatttctcggttcattttacacctcgagcggtatttttcttatttctctctctatatgtcgtaatttgcaatgaaatttggtattatcaattttttatctagtctttctcacaaaatgtcttttctttctcagatttatagaaacattaaaagataactgattgagcaataatttaccatatttcatgataggtaattctgtgataatgcgatcaatatctggatggtaacttatctcaatctcagtaaatatataattcgtctcgaaagccttccacgagagctggatcgctcgagcagctcgagc

SEQ ID NO: 2632 - DNA, 2000 bp, Oryza sativa
actagtatcatatttatgtgtaatatagttaacaaaatgttaaccttatgtgtaatatagttaactacagaaaaataatatatggtgtggattaattgttatttttgtgtttgcaggccggtcccagtgaaaagagattaaagaggattaaattgtttgcaggtcaacgttttattagttcagtgcaatcattccctgattgtcatatttagtcataaattgattgtacatttgtacaaatcgttgaagtagttctatttagatttataggttgcattactatttgaaaatgtgtggcactttatctaagggcctgttcagatttgatgcaattttcaaccataccatttttgggcatagttgccaaaaatgtggctatgtttagtttgttgccaaattttagtaaatacataagaaatcctgtcaaaattttggcaatattgccaacttaccaaaattttggtattgctaaccaaaatttgcaaggtttattttggctacaatctgaacaggtcctaaaagttgatatattcagtactaagtttactattatgttgtttttttgttaggactacaagagaatacatttgtgtatttgacgaaaacccgagttttgtggtccatcaagatctcactattttctttccgaattgtcaatgcatgtgtcactgcaagctgtttggtcgtctatatatgatcaaaagatttatgttgtgtttaatattggattgtaagattttcttatgccatgtatatgtacactttacaactataaatgccttcaacatgcatctcagctcatttggattatactatgcatgtccacacgcagcggagcgcgtgtctcttgctagtatagtatgaagacagactgaggacaacacagccatttgtcatgtatttgtaataaaacaaaaaaaagttctaaatataattgaatctgtgatactttttaaagttaaaattaaggcctaaaagagctttcaagtagagttaaaacatgtggtgtccatcctatgatgtgtgaaacagctattatattagttgcatagttaacacagttatagtaagttgttcaaacacatctcctttttgtcttgacatggtgtgataatatgagtacttaattaaagtaactatagagtcctgtgatggaacttcaatggaaatccctcaagaagacttagtttagatgaccttttttcactagtacagaactccttaactctaacggcttttgccgtgtcgggatcttgcgtgccgtcacagcatcgtcatctcaaacgggccaaaataaacaccgtcaaagatatagtcgtacagacgtaatacatacgcatgcatctaaagcccgtcaccgatgattcctatcggtgacgggcttatgtttaggcccgattgagattatctttgtaatctttgtcagcccctaaacgtatgcctgtcaccaataaatctcaccagtgacgggcactaaactaggcctgattgagataaaattaaggtatcgatgacgggcttagtataaatctcactgatgtttgtcatcggtgacgggctcagtattacacccgattgagataaatgagtgctcgtcatcaatgtccgttcagtgaccgttactaatatttattgcacactataaatacttcacccctcctccccaagggaatggttattccactgttcactattttggtgggagattgagggggcgatttttgtctcttttttccaagaaaaaagaaaattcataaaagtaagtgaaaaatactaatcaattccaattaatttagtaatacttatcttacaaaatgtttatctaatattttgttcacttttgcagcgatggatcgaagttggatgtatagaagaactgtgcgacgtcatagcaaatagtatagaaattgagtattaaattttataaacaccgcggaggaggataggaaaagaagaaacaagattacatatgttgtcaatgtgcatattgcaaaaatgag

SEQ ID NO: 2633 - DNA, 2000 bp, Oryza sativa
ttttttttataatccacccttagtgttggatgtacttcctccgtctcaaaatataagaacttaggaccggatgtgacgtctcctagtgcaacgtatctggacagattcctcgtttagatatattgtactaggaaacatcccatttgattccatattcttatattttggaatagaggtagtatgcaccaaaaccacatcaatattatcaatattgtaagatgcacaagtataaataaaaggaaaaagtccatatacccttaaactatggaaagaagttcgtctagcaccttaagtttaaaaactggatatccaaccccgtaaactttgtaatgcttgttatattacaccataagttaattttgaatagtgtttttttttgtgtatttgctagcttaaatgaacgattttgaatattatagcatgtttacgtattgtcaatcatcgattaccaatttatacagtgataccatactacattcctatgtgaatgcgagaaaaaaaataatggtagaatgaaagacttaggtggagattttaacatatatatccaatgcatatgtcacatagttaaactcttccaacgtatatgtaaattagaataaaatcattttacaaaaacatattaagttttaatatgaaatggtgttgtataatttgcaagttgaatatatgattttaaagtttagggtgctagataaaccttgaatcaaactttgaagggttatttatataaaaaaatatggtagtatttttaacccaaaacaaacatattatcaaaatatattcaatattagattctaatattttcgatgttgctgaatttttctaaaaaggttaaacttaacagaatttgactagaaaaaaatcaaacggctattaataatagcgaagtgagtaatattttttttcatatggtacaacgaagttaatatattttttcctaacaaaaaatagtacattacaactattctaatgaaatagttgacgttatgatacctaggtacagggtatgatgtctggtaccctaacactaaatctgatacatacgataccataggtatgtcagcatgatatatatgtactttaggtactaaagagtatcatgtctcataccatagtaccagatccatgaactatatatggtaccacacgtatcaaatctagtaccacctacaataccgtgctaacgttagcacataattactctgttctataatgtactccctccggttctataataattgacgttttggacaaggttgagatcaaacttttataactttgaccattaataacttcaaaagtatttagttttaaaaaactagaacaaatgaatctttgtggaagaagaagcggttcgccagccgctacattcagggaaacatatatagatttgtctttcaaaacactataataaaagttaacatgcatttatttattgtgtatattataatagaaaaataaggtcaaaggtatattttgtagaccgtgtcattgtccaaaacgtcaattaaaatgaaattggagggagtaagtatttttagttgtgtagaaatattaagaaagtagataaaagtgattagagaatgttgattagagaatgtttgtgattggcggagaagaaaaaatagatgaagaaattggttttgattgtttgagagaagtgggtagataaagaataaaacttaattttggaacaagctagtgagctaaaaatagctagtacattgtaaaacagaggtagttcaaactattccgttggaacggcgtaacaacaattaacccaattttcctagtagtaataaatataaatataaaaccaattcagagaaattcagggaagaaaacgcgtcggctctcgaaccttcttgcattgtgtcgtcgaaggcggttggaccattcggcggccgcaccctcgatccaaaatccccaattcgccttccacgaaaccctaaccctagttctccgtctccggcgggctctaccggcggcgaggcaag

SEQ ID NO: 2634 - DNA, 2000 bp, Oryza sativa
  misc_feature (544)..(544): n = any nucleotide
  misc_feature (548)..(548): n = any nucleotide
  misc_feature (567)..(567): n = any nucleotide
  misc_feature (570)..(570): n = any nucleotide
  misc_feature (574)..(574): n = any nucleotide
  misc_feature (576)..(576): n = any nucleotide
  misc_feature (579)..(579): n = any nucleotide
  misc_feature (594)..(594): n = any nucleotide
  misc_feature (596)..(596): n = any nucleotide
agccacactagcatcacatgattcaaaatagacacttgagatacatcctaacactgtagcaacttactatgaaaatgtattgtttcgattttaatgtggtgaatcggttttggccgttaaatctttagattgtgtacaattgctgttgtgcagttttacctcaatcccttgaatacatcgaagtcacacatgcattcaggtggtgtttgaaaatgataaagatgaaaattaaagtgacacacataaaaagagaaatattagcacataattaattattataaacttaaaaagtgaatatatttgatattctaaaacaacttttatatagaaagttttttatgaatagcttgaaaaacgtgctagtaggaatcgaaataaaatgatttgctctagaaaattcatggaaatgctgtctttctctcactctctctctctctctctctctctgaattctgaatcgatggttgctgacctgaaattcagaatccgacgagacagtcagccaggccattttgtactgtactacatgaatgacacctttatnaacnccaacatgttgacacgaanaanggtntnaanaattcgagaatgcanangcctacaagctcaatcgaagtactgtagaacatcactgcaccactccatgctttgttttttttttcctctcctcattgttcttggggaatgagctatgtcaccatttcaaattcaaaatgtttaatttagaaagatttcgatttcgaaattacttagtagtgctaaactgctaatcactgattaactgagccaatgatcagagcctgtttgaagtaatctacacagatcgcgcgtatcgtccgtatcatctcgtaactcgcggtcactcactggttggaactagaaatgcgttcctaattaaccacacctttgtactattaacttgcactaatactagtaactctgtactagtactagtgattagtagcatttagcacgagaggtagccatggaaagaagagaagcatgcagctaacgcaaggcacaaaagcaaaagaacaccaccctaatcagcactaacgcgatcgctaaagccgattttttctcacagaaaagaagctgaagttgagtgagtgataatactgcactaaagccagggacatcagatgcaatgatagggagagagcacacaactcgttctgcattacatgcaaacaagaggcagatcatacggctaatggtagggcccaccataatagtatgattaatccggttcatacttcattaacccctttatatggtttaagttgtgcaaaactattaaagttaagcaagataagagaatcttaactgacatggctaaattttttttaataaaaagaatcttaatttcaagatttgatttgattttaagtatggtgaaataaagaacaattgattttacggcatgattttttaaagatatatgatcatggcatccggaatatcgtgttatgtgctaaaacgcctgtaatcacaatacatataaagttacaagatactccttccatcctatttttgatcatcacctaaacacagagactgaaacaaccaaatttccatcattctataattaattctcattagttaagatggtatgttgcttcgtgtctcgtgaatagtaccaagttttaaatattgcatgtagttgcatcaataaaaattaatcttgattggttgcatgcagcatattcaatgatgctcatttactctttacacaaacaaataaagagacatttgttataggatgattattttgaaaagacctcgaaaatcttaggtgatgattaaataaggataaagaaagtatttatactttgtaattaagcctcatttgatgccatgacactgtccaagtgtccatttttgctctaagcccattaatccaccatgattaagcggctaatataagtagcaagacgcagccaccgtctcctgccctcttgtctcagcttcagctccggagccacgagctctcaccttgg

SEQ ID NO: 2635 - DNA, 2000 bp, Oryza sativa
gccatgccttcccgtactctgttatccgctgatctggcaacctgacatacattcatgctagtatttcacagtaactatgcaagcgtaaaaatggaagttacattggatacaactgttagctgatcagcactcagcagtagcaggaaaagtacgtacagtgcctgtggaattcgctaacaatactgcgtaaggtgaaggtttgcagtcacacatgcatttttgacgattctgaccaaattcacacttcatcagaagtggagcactcaagctaacccatgcgtgtacatgcacccatggttcactgatgacagccatgaggataaatgtggcatgcgttaaaactgaaaactggaatataagtgaaggaaacaggagagtacaaactcacttttgctagtaattgggcttgaccttttgtgccatatccaggcccgctatggccttcacatacttgcgcaatcttacacttggagtatgtctatttcacctcccttgtgctcttgccctcggtcaaatcgcatccctcaaccgtaaaaccgggtatcgtttttgagggtggtttttttgacgtggtagcctagtcattgaaaaaaaataaaaaaaaatatatacattgggtctacatgttggtgactaattttattcttccttctctaccactcccttctctcctctccaccctctctccacgggcgaggttgatgatctacacgatgaattcatatggtcctcctaaacaactccattgtgtggtacccaaaagccgtcaagctttgcttccacggtcacaccgtctttctcaagtgcttccaccactggtcacgtggcaggtccttccacgacatgaagcctaatctcaccgagtgtcgcatgtggagttcggagatggcggtggccacaataatggaggtgggcttaatagatgcctcgtgtgtggaggaggcagcgtatcaaagttatataggccttataatccaatcaagtttaagaagagtaatgtaatgtaagatacaaatggatcaacgaataatgtttgataagaacaaggatctatttgattgggcttaaccttgggcttcactttttccgaagacacgaattaagtttgataaggataaggttgtgtttgattggactccaacttcacttttttttctaaggctaaagtctaaaataaaaatgggttagagtgatcctaaaaaagaactagagagacggtgtggatgctccataattctgctccaaactccactttcagtagttatatttagaagtaaaagcccttctaaacatgtactaaatacactgagtaagagcacaaggtatgaagatgcacaaggatgagcaacttagttggtagcacaaggtgcattctttcaccaaagaaaagtcttgttcatccccataaatttcagttggtgatgtatttgcaaattggaattctctatgcaacctcgcaagaatggacaacatcacgggcctgttcattttgatgccattttcaaccttaccaaattttggtaaagttgccaaaaaaaaagtggctatatttagtttgctgccaaattttggtaactatataagaaatcctaccaaaattttgacatagttgtcaaaattttgataggcaatgctaaaatttggtaaggttttttttggcatcaaagtgaacaggccccacaacagcatacaaggaaaagtaacggcacatccttttcttgattcttgtccttgctcccaagtcatcagtttccaaagtaaagatcacaccagcacgttggcgatggcgacatcctcaaaaagaaaaaaggaaaaaaagagaagagaaggtcaagattttactagcacgtagaaaaaggaaataaaaactgaaaaggaaaggaaaacgagaggaagggtctctgtccagtccagtccacttccggcccatttactacggagtagtatacaagtctactaccacgccgtcgccggaggccggcctcattcggcaaccaacc

SEQ ID NO: 2636 - DNA, 2000 bp, Oryza sativa
cttgatgctgtgttggccactgatgggttcaaacatctggaggcgagctgtccctcggtgttgactgaccttgtcaaggttgcccgtggaagaaagaattaaaatgcaggtacgtgcgtatcagagatgtcatagctgaactgttctattgtgaaattttctctaggatttggcaatgcatcatctctgtttgtgctagaagttttgattgattcttcccagtcatggagtagtgcatactttgtacaagcccattatttgtcactactcactagtactagctagtattaccttggtcattcttgtatttttctcacgtgttagtacaatactactactgcactgcagaaatatgcttctgcgtttcaagcctttcaggctatgagaacatgcctgttgccactagtaatcagtacgtttatttttcagaaacatttctttaagcaggagaacctgttttttttttttcagaatcatcactagcttcgctctgttcttaatatttatttatgggccatttggcatctgagcaaaaattttcctattgtgcaggtaataagcagagaagatttcaagttgctcctggatgctggcgatgagctgctgcggacttgctgagagcaaacaaatcttcaatttgcttatatgtttgctctatccttttcttttgtgattttgccattggatctgttgtgtgatgcccatgatcatacggttctcttctgcagtgggcaattcgtagtaattagacgcaaccctgtctaatccctctgctactctgtctgtgtagggcctttcatttcagtttaatctgtaattgaaacgggtatatcccggttcagaaaaacatattggagtagttctcgccttcaaagaatcaaatccctctggggaaaatagattgacatttaggaatggagaggcacaatgcagtgatcagttttcaggctcattgccggtcagttttggcagggagatctgaaacaatgataaaccttggttctgaaaattttgtgctaaaacttgttttgttgcaaaacctgattttgcacagttgaactgctgactcaggatcaaatttattccatttctcatttctcataaagaaatttgctcttcaatgtacgatggagtttattttcctttgaacctgcataataatataccggtacgtgttaatgacagcagattggacacagcaggtcttgaactcttgatgaacgaaacatccccggcccaaccgaggatcacgcggcccacatcaaggattcggccgacgcgatgtccacgtcatcgctggctgccacgacagtatggattggacaagctcaaattttatttttcaatgttcaatggaggtttttttttcttttttcagaaaacctagacaacggtatcctgttggaacgggatactcttctataagacatacctgttgtggtaccagctacatagtacccgataactgtgatacctgttacccaacacctgtaatacctaggatctgatacctatgatactcgtgcaagagaataattaatatgtctatcctgttgcaacgggatcccgtagcagccctctccttttttgggctcagaacctccacagatacctgtccgtttgtagaatcccataagaattcgtcgacactgcggcggtgcaatatcattgcaaatctccggctcgtctaaaagttcagttcatcaaggggacaaattaaaaggagaaaaaacgaaaaattagttggatgttcattgaaatttttagggattgatggtttagcccttgttgtttaccttgtttccgaaacatttgtatatttctggtttgcttttgcgaactatacctgttattaattgtagatggtgggtactaaaacagactcctgtaacaagttatgtctctttgtaaatctagtgataaaacgtttcgatttgaaatccacgaagggatatatatatagccggtagttaacgctcgatcgacgcctgagcccagag

SEQ ID NO: 2637 - DNA, 1649 bp, Oryza sativa
acaggtttaggccgctcagaatcgtagtacctactcctgtgtttgggactatgtgtgtttgtgttacaaaaggttccttacatcgagattagctagggttctatttgagctaggttcttttaaaaaatcccccttttctcagtagccggactcatccttttatatcctaagtagagccgacgagtacattcttgcatgggaaagcgactatacttggtcttcttaaccttgtcccatctgttacattagtctgaacataatcattgctactgatcaggcctacgcttgtgccctagaaggacttagtaggggcccgagacaactagagaagactcctagcgccacatgttctgaaactgggctcagtgggcccaaatgagaacaccgtagatttgccacccgccttatttcttcacggcgaagtcatgaactgctcaccagcgctcaacgcatcatcctgctactatttcttcgggtgacgcaggtagcttgattacttgcatgtcatttgagctgtaattctcactgcgccgctctgctatgacttaatgccactacttcttgtcccatcgctgggctcactaccctgcatagaccatcggacgaatccaattgacatgcattgccagccacacctagtaattacatgcctaagcccttctttcgaactgtattagtgtcccgaactgctacatcctcgggactaatcttcttctgggcacgattcacgcccggggcatggtccgtggccgaggcccttaggtactcccgaggtcccgtgcgctcccacactgcttgataagaactcttgttaactttgacaagcttctcgaagatattgatgaaggagtgatggacataaccttggaggatatgctaacatccgaaggtatccactttagtaccttgaatatacagatcttgtaggtttccacactcttcttgataccttgtagatatagatcatttatgtctgggcactcttcttgaggctttccaaatgaaaacctttaaaagcatcggtgccccaaccccgtttggatacgggccttggttctcattcatctccaattgtcatcttccacttccagggtttctgacgtgacaatgaattatatatgtggtaggaagtgattttgtgggcccccggtatcccagggccccggaggaatggggaccccagttcctgtttctccaacagttgcccctagcctcggaattaggatggaaaattgtttgtcgctgggtgcgggccttttcttcaaagccatcgatcgagtcagccttgcaggtcccacctgttagcgaggatgtaacaaggccaagtcccatcggtctcatcttctgtcagggacggttttccaagctttaggccacgatcatacatggccataacttcctactgctaccccatgtttcgaggtgttgctggtgcaaaaactaagcggcgcggtgagggcctaaaaaccctacttcccacagcgattcattttccgcttccttattttcatgtctctcgccattgccccccatctgtgaaatatccatcaccaacctccgccctcaagttccctgcattcactgccacctttcttctccacaccatcgctgccacaagcccttggcagagagcgcacttcccccatctc

SEQ ID NO: 2638 - DNA, 1390 bp, Oryza sativa
  misc_feature (5)..(5): n = any nucleotide
  misc_feature (12)..(12): n = any nucleotide
  misc_feature (26)..(26): n = any nucleotide
  misc_feature (28)..(28): n = any nucleotide
ggggnggggggnaaaagggggttttngngggggggtgttgagaatgacatgtggggcccatgtgggccacatcattttaattattttttttaactgacatgtgggatcatagttgtattattttccaaatcaaattaccacgtcaatgccacatcagatgaagaccgagtatatttagccacgtcagctaaaaccgccgtccaaactgccatgggacttatattgcactgattttgacagttgagggacgaaaatcggactcgttcataagttaagggacctcagatgaactttttccattcagtcttggggagtctaggggattatcggagtatatgggcctgtgaggtcacgtgctctggtgggcttttttctttttcaaaatgggcctgcgtaaggtttattgatttcatttcggccttttactaatttatgcccaacccaaaactttgtatgggtttcttttagatataagttcagttcaggtcccttagtttgtctatgaattcgattttcatctttgaacccaaaaaatagatatgatgggcccctcaactattaaaaccggtgcaacattagtctgaaggcactatagatggttgttttgtcctatgtcgcacttggactatggtcagcctacatggagcgccacataagcggtcaactctggtcaaacgcactttagaccaactatggttcactaaaacaagatcatcgatcttaatacgtaattgataagtctacggacctatatgatacatatgctcaagtttaagtatcgaccatgtattttactcttaaaattatttccataatcatgcaccagttaggaaaagcttcaacaagcaagcaagccgaacgtatatgcgccgtattttggacaggggagtcaaatcaaccacatcaccatgcatatttctacatatacactggtcattttttttgggtacatcggaaatcattttcaccggatttagcccagacaaccagtatcccaatgagtgattaattacttgtattatactcattgttgccttgttggctctttgaggtcagaaagggacaattgaaaggcctcgattgaacaaacgttaggacatgatgcgcttctatataaattcaaggaacaaaaaagcaagctaattaaggttttgtgttctgcataattaatccattaagtatagtgagatctgaggtgaggagaggattaattaagacaaaatctagccaaacttgtgtgaatctccctctaatccatatgcatgatcccccccctcttgctttgcaaatactgtgagcttaattaattccatgtctctctctaattctgcttttgatgttgcaagttgcaagaagcttcacctctcctagggtttatacaagcagcggc

SEQ ID NO: 2639 - DNA, 2000 bp, Oryza sativa
  misc_feature (1100)..(1100): n = any nucleotide
  misc_feature (1103)..(1103): n = any nucleotide
  misc_feature (1107)..(1107): n = any nucleotide
  misc_feature (1109)..(1109): n = any nucleotide
  misc_feature (1117)..(1117): n = any nucleotide
  misc_feature (1120)..(1120): n = any nucleotide
  misc_feature (1127)..(1127): n = any nucleotide
  misc_feature (1186)..(1186): n = any nucleotide
gacaaacaatggcatcaactgcccaactaaatcgccaatttcggtgagatttggtacaaatttgctttggtgagaaaaaaaaacaggaaacaaatttcaaagcagttgctagaaaaaaaatcaccagaaaaacggcatgtttttggctcaaattgatcatcaagcgaaaaaaatttgattcaagcatacaacaaagcaaatctagagtggatactagaaaaattcttaaacctgctcgattccacaagtttctaacggcgattttagccaagcaaaagcgaagaactcacgacactccactagtccacttctccagacgagactgctgctctgtagcgtggagcccccacttggggccaatttatagcggaagcagcggactctggagccaccccttgccgtccgatcctaccaacggcgtcgtacgagccgtcggatcggcagcggaggggtgacaggtgccacgagatatttctttgctaagctcacgcgagaatgcacctggaaaaatgtcacgccggattgcatgcctgggcttgatcagtttggcttggtttacttttgcggtagcgtagcggtggaaagcgagtgcaaaacgaaattagaggacaataatgacaaaaggagtagatggattttttaaaagtcttttgctcgtgtgtgccatacggttcctacaggtcgcaaggcatgacataaaaatggggtggagaaatgctcaattcatggtagaaaaggtacaaaactccgctagcattttcgtcatgccatcatcattcttgttgttgcgaagaaaataactgtgattacgtgaaatcctgatctaatcggaatatcaagacgaaacgaagaaaaaatgcagtgagctacatccacattttcaggcttctttttagaaaaaaatggtcacgccttgtggtcatcttcgtcgcttggtgtttccacaaggaaaatagtgtgacattaccatgtggggagcgtatcctatgcacacaggccctcacgtgtacacaccgtgtacaccaactaaaaattatcacaaaaaattctagaaaaatttatacatgtactttcaatagtattacatctacgtgcaaaancgnatcntnaaattcantcnacctttncaaaaacaaaaaagataaaattatgacaaaattgtaaccttaaaactgttagatttttngtttttttttgttacggctaaaatataatgaatttgacgttaagattttaaccctaggtgtaatacaattgaaagtatatgtatgattttttctagattttttggtgacattttttagttggtgtgcacgtgtgtacacgtgagggcttgtgtgcataggatatgttgcctaccatgtgagctcagagtcaggaatggttgttggcgtgttgctatgatcacacaaagttctaggcaagctaagaactacaactcgcaaggctagttggttagtacttgttcatgtgttactttcaactctggtaggcatttctcctatcaaatgtttcaatagctttgtgttataatcactacttcctccgtcccaaaatatagctacctagtacaggatgtgacattacctattactactaatttggaatgtactaggctgtctcgattcgtagtactaggtaatatcacattctatactaggtagctacattttaggacggaggtagtattagcttagagcgtagacaaagcattaaattgatgtggatattgagcaggaaaattgagtatgcgggtaatgttcattagaaacttaggatgtgttcgcacgagcctgttcccaaccagaacagcgcgcacggaaaacggaacagtccattagcacgtgattaattaagtattagataattattttttaaaaaatagatcaataagattttttaagcaactttcgtatagaaactttttttttttgtaaaaaacacattgtttagcagtttgaaaaatgtgcacacagaaaacgatgggaatgagttgggaa

SEQ ID NO: 2640 - DNA, 2000 bp, Oryza sativa
ataaacatatttgttccacatatgatatttgattagggatcctttagaaatagtaacaaacaacatatagagtctcatgaaagaataatatattcattaaccaataatgagttatctatttcaaggaacaatgtcggataaatatgtaaacatagtatgtgatacaatcatctctatgattgcctctagggcatatcactaacaaaagccgtcactcgcccttcaccaccggatttggttctttggtgccaagccccttgctttcccttcaccgctgcatggtccatcgtgaccgagcatcgcttgcccttcaccgtcatgccatagtagccacttcgtatcccacatcttcaatatcttcaccttgtcattcatggtattttaggtgtaatgatatcacttgagcatcaacacctttgcaatctttgggacctatttctttcatttaactcaataaaattattagtcacaatgatccggttgtcaacttccacatgttgaccaactgatcgcatgtataaaaggatatgaataaatgatgagtattaatcaacaccacaagtgtcatatactcaattatatgctcacatgtaaagttcccaattaaataaaagtgaataacttggatcaattacattcataactaaagtataggatttgctccccctaaatgtatgcatataaaatatttgtgtgaagcaagagtatgcataaaaagatattaaacattgagagcttatcctatacaagaatagaaggcacttatcaaatatagacaataaaataaaaacataccttcatcatctccatgttctcaatgtaaagagactaaacaagatatggctcaaacaaaacattagtctcacatgcttatgtaatcacatgaaaatattatatatgaatatatcaatatgtgcacggatagaaagagtgatacatatagcttgatctccatgtatttcatccttgtgatttaggtacaccatcaatgaacgtttttctctcaactcatatgaagtccagaaatcacctctcacatattccactttcatatccatatgagagtagtagacaaagaaatgcttacaacaatgttagtctcatgtaattggatttgtcattaatcatcaaaaccaaattaatggcacttgaacttccagaggctaatccacaccgtccaggcaaagccctggatcggatgacggtaaggagggttcggccaaaccccctggttcggccgaaccaggagccggcccagtccagcccaatttcagctggcgacctcctttgttgcttctcttcgcagacttgtgaattttggcccaattcatcgtgtcaattctgagttcttggcccattcttacataagtctggttctcgacatcgtccgattgatttatcgtctgtgttgatgtctattctcctccactttatggctattctctgcaaaaaggttagaaaccgaatactagtggaatattattattctaacatatttatgcattgcaagcatcactagttctcgtctattttggtaaaattgacggtcgaaactgatcgataacgaccatcaacagaacacgcttctggcgatttccagctccgcggcgaaaccaggggcgattgccagaatgaagaagaaggtggtggtgcaagtcgctggtggttttaccgatagcgaagggacttccgatgggatgcctacttcgccggcgccgtgacgtgttgcccaccaaaggagacacttgtcgccaccgcttgccagtgacgccgaagcgcctacggggggtagtgcttcggcgccagccgcaactccggttgtggcgattgagtcagtggaggtgaacacttctgggccgagagagtagaaacggtcccttcgacgagccatcagcgggaagggaaggcgccggcagtgacagtgtctgacatgacactcaccaacccgcacctcgtctcctcggatttcgcttctcggccagagatcgcccccttcgtca

SEQ ID NO: 2641 - DNA, 2000 bp, Oryza sativa
ggtatatggtccgaccatttttagccctagctaggaacaatactacctccatcctatattacttgtcgttttgactttttacttgtaatgattgaccattcgttttatttgaaaaattagtgcaaatataaaaaatgataagtaaactacatttaataataaaataagtcacaaataaaataaataataattctaagtttattttgaataagacgaataatcaaacattaaaaaaaactcaaggcaacaagtaatatggggcgaaggtagtacattaacatgggcaaattgtacgtaggattattatcttctatatagatatatgatactatggcacaggtacctgaactggcatttatgaatctaaaatggtacaatggtagtatagcaagtttgagcacaatcacatagagagtaattcttaatagaggggcttacctttaccgcgcactgcaggaagggactgaacacctggcactgttgggccatctaatgaggagacaaagtgttaatctattggagtagcaggattgacagggttaaatgcaagcctcctgttaataggtcatcgaaatggatgacgaaacactgacatggagatccctatttcaggagttgagataaaagatatggtatgattagagctttcactgttaggagcacctagaagacaaagaaataaatcatcaataagttttccgctcaacgtaagaaaactgtagttgagaattgagaaaatgcaaagaaagttgaatatgcgaataatgcgtaggagtagcacctagcctgttctctgtctcatttgtccctaagttagttagctgagaaaatggtgttggtgttagagtgtcaggcaccacatccatcccaatcaccaaaccactcctagatatttatacaaaatggcaaaacaaaatcataaagccagcagatgagtacacaatggagtattatggaaagctaagcatgaatctaaatatggacacctttaatatgtgtatgttgtggacttggggcagcaggcaactatcccataaccactgtagcaggtcaaattcaattagaaaatgcttaattagtagggattattgaatcacatgcttgacaataagtaacttgcaccattaaaaatacaggtcaaggaaatctgtcatggtggtacataataaatcaaagaacgacatttccaagggcctaagggtttcttctgtacaacagtggggatagaaggattttcttgccaggactgccgtgggaaaaagagggcattgctccctcacgtgatggcgatggccaccggagaaccaaccggtcaagcaaaaggtcgtcggtggtggcgcaactgagtggactgtcactgggagaggagaggctgctgcagctcgtggatggcgacggccgtggacagatggaatggagatggtggagacgaaatcaccgagcagaagaccgcggccgtccacagctaagccaaagaaggcgcaaaaacacactgggcaagggagacggcgatgccggcggcggcgctggatggatcgacggaggaagcgtgtggactgcatgcagaaagagaagctgggggatgaatcatccggtggggaaaaaaatagacccccctggagagcagccgaggcttcctgggaagacacgcttaagggcagagatgcttgcagccacaatcgaaaggtgtggacaacatgcaatgattgtagtttctacagtagcaagacagcacgtggcagttcatctgaaatggtattaaaaaaaccttaagttttattgatgatacaaccaggactagacgaacaattaaattcaaaacaacaaaactagccgaacaatgacacgtcgctttcgtttagtaatacgggaccttttcatttttccttttccggcgagacaaataaaagtcgctttcgtaagccaaaggcccaaaaccagcctccgtctccgtgtcacccctggctggccacatcccccaaactccggtgactccggcg

SEQ ID NO: 2642 - DNA, 1224 bp, Oryza sativa
  misc_feature (3)..(3): n = any nucleotide
  misc_feature (9)..(9): n = any nucleotide
  misc_feature (17)..(17): n = any nucleotide
  misc_feature (34)..(34): n = any nucleotide
  misc_feature (37)..(37): n = any nucleotide
  misc_feature (42)..(42): n = any nucleotide
  misc_feature (54)..(54): n = any nucleotide
  misc_feature (63)..(63): n = any nucleotide
  misc_feature (66)..(66): n = any nucleotide
  misc_feature (88)..(88): n = any nucleotide
  misc_feature (106)..(106): n = any nucleotide
  misc_feature (148)..(148): n = any nucleotide
ccncttggnttcaaccngggaccaaaaaaaaacnagnacggnaaccacaaattnacaccaagnacngaagtttttaacaacatgtttnaacaaggccgccaaacgnaatttggatacgatcaaggaaccaaccgggcaaccacaaatntttgcaccaaacaggacaactgcaaccctaaattcctctgaacacgctcttgacagaaccgatcgaaggagaaagaacacaaaatcagaggaaatcatcaaccaaatcagtcaatcaatcaaaaaaaaaaagagatggtcaccttgggcagggcaagtgagagggggaggagatcagggccagagagggaggggctctccaccagcctcctctttattattacagtgatgacctcctaatccaacacattttttaggcagttattaaagagggcttttgcctgcttaattattgcctaggatgctctgtcatcctaattttaaactccccaacaatttcttgttgatttttctctatgctcttttctcccgtgaaaaaagtttcagtggtggtgccatttcgctttcatccaacccagaaatagatcatgaaaaggaacataaaagcgacgaaaagaaatatgcttttttttctaaaagattatttcccatttattctctaatagatttaatcatgtgctgatgacattattatgattccttaaaaaaagcaatgcgcgcgctccgagccggttcacctttttaattgaagtacagcgatatttaccaaatttcgatcaaacgtattatgaattcttaaaaaccattaaaattttcacttccaatttgctttcgtcccgctttgaacctaaaattttttcactgttttcgatcggttttcgtcaaaagcatactaccactagttgttgcattaatgtactataaataagacacatattttatctcgacttttggttaaaaaaaggcatatataacttactttaaaatataaataaatctattttcggtttattttaattaaaacttaattaatcatacgctaatagttccatctacgtacccaaccttaataacgggcctaaagcaggctaacgtgggccgtattacgggccggtttaggctgggcctgagttggtccagatatagtgggccggaatatcgcgaggtgacgctgacgcgtccatcgcgcacgacatcgcccccgtcaccctctctgcgctgctgctgctgcttccg

SEQ ID NO: 2643 - DNA, 2000 bp, Oryza sativa
  misc_feature (892)..(892): n = any nucleotide
  misc_feature (896)..(896): n = any nucleotide
  misc_feature (899)..(899): n = any nucleotide
  misc_feature (901)..(902): n = any nucleotide
  misc_feature (905)..(905): n = any nucleotide
  misc_feature (907)..(907): n = any nucleotide
  misc_feature (923)..(923): n = any nucleotide
ttttttaaaaaaagctaatctctatactgtgctctcattttaccattgtgaacttatcttgttgattgttgcacagtatgtattagtagcatagtctaaacaaatggtgataataaacattccatagcaataccaaagaaagaaatactagctgataatacactacgccctgtttggtgtcaaacatcatttaagatacagccacaggcataagaattggctaggaaagatggtgccaacagtcaagaaaccgcttcgtcgaagcaatgttgcatcaaagggctaaaggcaacatgactcaaacatgtttgtgaggtgttgttgcatttgaagtttgaactattctgatggcacgttctagtgattcagcttcttggctgcttttgaggttttgcctatcagggattactgcatagcaaggcaaagcatgcttccaggttgaaaatcccttaagttgcccatgacatagatagctcgatatgggcataggaactagctccccagcatgaacgatgatatcaccctccttgcaactacaagtttcttttcaaatttcagatgcaaaactacaacaaaaccgcaagtacaacttccatttcagatttcagatgcaaaactaacaacaaaaccgaaccattccactttcagggacacagtaatcaatcaaattccagattccccgatactacagtaatcaatcaacccaacgacttctttttctcccccctatttccaggatgcagtgcaagagcaagacgaggcgggaccttgttccagacggagccgagggtggtgggcgcgggcttggcggcgaggtcggcggcgtcgatcttgcgtggcgcaggaagcggcgcggcgtcgcccgtggcctcccgcacccagtaactgtacnacgncgncnnctncnccgccgccgccgccgncgtctcctccatctccgcccctcacctgcttggtgggctggaccgggctgcctgcctccgatggcgtcttcgcggcgagacccggcaaaaataattaaaaaaaaaacctcttttgactcgttcaattccttttctttttttggcactcgtctccagactcttcgggaaacttcccccacgcacgtgcacattaatcgaagctaaccacgtggtgattagatagtactgtagattagcattaggtttcgtgttaattaactagtaacacctttttgagcaagtttaaatgtatagcccgctactatctccaattcatctataatcaatctaatagccaattcatacaacaattgcttactatactattaatatatggtcccacctgtcatgcacacattgcgtcttgaagtctacgctgcagctggctatagatctgtagcccgctgctcttctctctcatcttttatctcattaaaatatgtttacagctagctaatagcactgctattgtatctgctcttagtattctcattggaatcatctatacctttgtcaataaaatttgttactacaaaaatttaacagatatagttacagtataatcatgatgtaattttattataactctaaatacaatacaatataatttaactttcaaaagtttcttcatgatatgtttttttttgaagaaatgaaggtcgtgagaacgaatcctctcatacgtgcgtgttgtggcctttttactttctcacttgtacaaattttaaaacaaatttaacagtttaaaattatgtgaaagttacatgcaagttatagtataattatattacaaatttttactgtaattacatccgataaattttgtcaaaaaaaatatataacaaaactgttaacgaacaccttttgtggatcgatccgaacaactctgaactctgaagtgaaatcccttttcggttttcgaatcggactcacacctaaatctcctcatctttttatatcacgagctatcgtgcaatttatcgttgatcgatcgaatcgtggtgaagaaatctgcaacgaaaaccgatggacgccaac

SEQ ID NO: 2644 - DNA, 1643 bp, Oryza sativa
  misc_feature (364)..(364): n = any nucleotide
  misc_feature (679)..(679): n = any nucleotide
cccccccccccccgggcttgacaagttcagcaaaaccgtagagaaagtgggctacacctagcttagcctatccaatatccgattcaaaaagagcttggattgctaccttttctatctctgtataaagtcaaattagtcccagtgttgggaagagcccactgtcaaaagatcgttttgctaggatgctgcttgaatctagttacttccaaaaaaaggcatttgggaactctatacggtatggctacaaaccgaatgaagaagtcgtaatcaggatttgatctatctggatcagcacattttattacaacttctttaggagtatgacatagcccccctccctcccagatctggccgaaggagggangggggaggctggccacagcgaatacggcacggggcagcggcggcggccacgacgacgggtcggggcggcggcggcagccacgacgacgggtcggggcggcggcgacgacaacgcgcggggccgcggcggcggctccccttccccctcccagatccggccggaggagggaagggggaagcccgtggcggtgactacggcgcggggcggcggcggcgacgacgacggcgcggggcgcggctcccctcctttcccctccaaaatccggccgaaggagggtggcggcagcgaggcgcgtggcggcgtcggcgagccgcngccgtgattttttttgttcgtttcatggatttttgcaggagggctgttgtcccgactgtgaaaatcgttgattttcaccgttgttgtgctacaagtggtccaacccttcgcttgcaaaattcacttttgtctgtctgcgaaaatactttttctagtagtgaatgttgttctttggatggatatcaccaaggacatattactcgaaaatggaaaggcatttgggcaattgggcttgggatagtcagtgagtgctggcctgctgggtagatcaggggctaagggcatctgcctcaggttattggacgttgttccaagttccaacaacgaccaaagcacgatgttgttattaacagcatccacatctggatgccctgcaacatatacatagcacccatcccatttttccaaattacttcctccataagaaagtatatgatgtacttttataaaaataaaaagtataaatcttgaccaacaattaatatgattacaaacacacttaccaacagttaatcagactattcacatatctctggatgccctcactctgcctcccaccccacctgccatcgaatgctccccctcaagttgcatcgccccacacaaccactcaagccaagtttagttccaatttttttctttaaatttctaacttttccatcacatcaaaacttttctatacataaaaacttttaacttttccgtcacattgtcctaattttaaccaagctttcaattttagcgtgaaccagtccattgatagctccctcctcttggactacctccacaaaacaataaaggccgtggctgccaacatactggcctcgcgccaccccaagtaacattgcttgccttcctcggctcaaatgaggcgagcagaggagaggagcactgctggggtgatagttttgacgatggaatagcaacggtgatatgcgcaggacgcatctcatggtgcggctca

SEQ ID NO: 2645 - DNA, 2000 bp, Oryza sativa
tgccagccgttccaacatttcatcaatgaagggtagcgaaaaatgatccattttagtagccttgttaagcttcattgttaatcccggcatgcaggagttttaagacctctttctttacaacctctcgcattgcattattgagccttcgttgatgttccctggagggaatactctcggggtcaataggaatacgatgggtgcaaagcgcgggattaattcccctgagatcttgaagcgagtagccaagaacagaacgatgcttttccaacacggtgagaagacgttgagtctcatcttcagagagcttgtcactgaatataacaggggcttctctgtcattgtgtaagaaggcatagcgtaggcctggaggtagaggtttgagctcaagcggaggtcgaggtggtggttccatgattggcaggttgagagtctcaccgggatccacttcctccttgatgaaatcggggacctcatcttccagaagggcctcgggagactcatgagggggaactgttgtaacctcgtcggctggctcaatttctgggagagagtcggtcaaggcgatccttgcccgtgagaatggaactgaaaattcattccctcccagcgttattttgaggctatctaatcggggtgtgttgataagaagtttcttaatgggcagctcgattaggatgtcgaaatgttgaatttcaaagacatggaaatccaagatcgcatccctgtcttcaaagcagacaggcacatcttgtacaatcccaaatccttcattgatatttccatttggatgcttgaaaaatttgtttgtcggggtcactgccttatcgcttaaataagcgaatgcaaaagactcggagacgagattggccccgacagttggactatagagaataccgacgttgttcccttccagatggtaaggaatgattcggggagcggtatttatccgaattacttcggatgaaagctctgcctcccttagccattcgtcgctcattacggacgttaactcccggacagtttattgaaggaacccgagttcgatcggatagggaggcagcagaggaacgagtggtctctttttgctaaaatagttcagggtattaccatagtcttcgtcaagaccatccctgaacagaattgcggcacgctccggagtttgaatttcttcattctcaacagacggctgctcaggaaccttctcatcaatcgagctagcagaagtggatggttcgaagagtggctcgattgtcagaggttcctctatcttggacacggatgcctccagctggggttcatcggattgcatcatgcaggaagtattttctagaatgcgatccaaaattgttcttccttctgacggcgttttgtgcatgaacgatcctccggcggttatgtccagatagaatgtagactccttatccaaacccgtatggaaatgttgcagtaacacatactcgggtaaggacaaggttggtccggactgcactaaaatagtgaatctcgaccaggctgcaccgattgattcgtttttgatctgcttaaaactgagtatttctactcgaagggcagtaatacgagtaactaggaagaaggcaagacaaaatctgtctcgcaacttttcccaactaccgtttacacatccaacggtaaagtttaccattgctttgttctctcttgaagggagagcgggaacaatttccaccacaaagtttcttgcctcatgccacgaatcttaaggcacgagcagacttgttcaaagtctcgcagatgatggtagggattttctagatcaaagccagaaaaaggattttccctaaccatactaattagttcgggacgaatttcatagccagttgtataaatgggctctgatgaaggaagtggcttacagaattcgccccgaggagcagacagctcagaaagaggttgctccatagtcaagaagagtttgacaggaatacttctctaggatagcaggggtaaaggtagaataagaa

SEQ ID NO: 2646 - DNA, 2000 bp, Oryza sativa
agcagcagcaagcaaccaagctgagatcgatcgatatatcgagctggcaggagaaaattaaagcggcagcatatatatgcaggagaaatttctccgggctcgcctgatccatcacacgcggaccgaagcaaacccggacgtcgagatcaatgcagctaagggtaaggggtaaggtagatgccggcggccggcaggggagggagagaggaaagaaagggtcaatgcagggggccaaaccgtggggcacatgtgttccccgttccaaggccacatgcatgtgccttagccgctttttgtttccaccacgctcccttctccttcttctttcgccttgccattgtctgtagctccccctcactctcctcacggaagcagggatgatctaactagctgcctgctactaaaacacaaaagcgccattgtacctggtgtgtttttttatatataacaagatgatgtcttctcatttacatgttattacattgtttatccgctgactacgtggctatcctctataaaccgggatttcaatactattatggtggcatcatgatagttggatcaggtggcacaagagattttatacatatgaatatgggtggcgatctagtttacggataattgatagtcattaatctacatgttcttttatgcttggaaagggtgttttggttcatttggctgtatgcatcatatgcagagaccaggggaggattcagtgcggttgtatcatcttagtgtaattgactgagtcttaataaaacctctattatcttagaaaaaaaaggcattgtacatatcatatctttatcaatatgtgcctgcacatgccacataagatatacataccagacaacggcaggttttaaacaccgctccatcaccaagtactactctgggggcggtttcatttatgtctgattggtaaaacttcagctccagcttcatcttttctgaagctagagtccatcaaacggtttcaatttcacctaaaaagaaagcggagggactaaagtgctatcacataatgaactagcgacatgaagcgggtttcagactgttccacaactccatttcagaacaaaaaatgcaccttttcacaaaaattgaaaggatgtggttaaactagcgagtcaacaaatactcaccgtacatgtacggactcactcatatcccttaggtccaaatactagggatattccgattaatgtacacgtgccttcaattatatatccgataccaaagccaaatcaacacatcacacacatcctaaatatatctctgcagccacacgcatgattaagggcatacattgctttcatactcacaagtcacaattcatggtacatgtgtatatatatggagttcaactaagtatatttgtattccaacaaataataattagcagcaacacacactcttcatattcttatagtcccatatggaggactatcctgaaaatgacatatacagtacatcatgtactccaactaataattaacaacaacacacttctcatgcatattaattgtcacttccatggactctcctgaaaatgacaggcaccattttcagttccatccaaaaagtaaagagtgacaagctagaacatgttaataatatataaatttatacagcaatgcatgcatgtttaaccaacacaagttgatcggagagcctcggaggcaaatataatactaagagcggcggtaaagattctctagcagcactagtgtcgtccttgcatgtgtgccattcgttcattcatattctcatcactagtgaaatttacttagattccatctcactcatcacaactatcaaagcttagctaagctactagctgcttcttctcctataagtagggcgatctcactctctcgcagcaagccaattaagcgaattaagcacacatcaattgaccaaacctatctctctatctctctcgagctagcgagctctaggtgttcgacaccgaacaaggcagctagctagtggcg

SEQ ID NO: 2647 - DNA, 2000 bp, Oryza sativa
  misc_feature (1376)..(1376): n = any nucleotide
catttcggggttcacttataacaatatcaaatcacttaggccctctttgtttaggtttagggttattggtttagacttttaagtcagcttattggcttacatgatttataagtcagtggatttaatgttctaagtttagtgctagagttatacatctacctcatataagccaaaaaagtttctccaacgtaacttttggcttaatagtgttatagtggtttatggctttaaaaaagtcaaacgaaaaagctacttgtttatttagatttagactttttggcttataagcctaaacaaagagggccttagagggtatccgatttttttttataaaaaaaaacattgagagggaatccgaagctgctgtagtttttagtgctacactgccattttgtggtaccaaaatttgcattggcatctccttattaagaactgtaaaatatctttacatagtaatatggagaaatgctgcaaatacttaacgtttgcttgtgaaagtcccaaagttgccatccacacccttattgcaagtacttgtggcaaaggatttttttttcatcgctatctttatactgctagctagtaagtttctaaaagcttggtattattagaatgtattaaagtggatgtaagtggggatgacaatgaaccacgtagagcttcccacggaaatggaacagactgttcattactaccaacttcaacttgatacgtgatgcgtcatgcacctttgatccaatccatatccaaatatatccgaatggcagttgggttggattaaattagttttatttctgcatcaggtagttgactgtaataccattatctgcagttcaagtttgtttctaacaatggcttgcacagcaacacttcctcaaagagctgataattttttttccttgaaaaattaaaattattgcaattcgagaaaatgtagctgtgcatccagcttctaatgttacaactgttattcataacttctaatactctgtttgaatttaatactagtgagaaagatccagggaagagtttatgtatatggatttgctagcgatgaatgtgacaagattagatatctcatcaagagacatttctctgtatatttcctgctaagattgttggaaaaccaaagttgggtgttaatccttgctttcagaagtactctttatccagaaataagaacacggtagcttgggcatccaatagctattcagtgaacacaatttgtcttgttcgacagtacaagaactttacacctttttaagcattgtgaccattgaaattatttttaaaaagtaaagcaggatctccactgtgaccattgtgacctttttaacggagggagtatttacttccttcctttcaaaatttttttngttcctttcaaaaattagtatttgcttcccagaaggtttcagtttcttccttgaccattggcttgtcaaattcttttcagtgctttcctactatgatgctctgccttctttttttctgctctgccaaatgtttgttcttccaactgaaacgtgaaaaaatgttggttgaaagaagaaattacgttggaatatgggcgttcagagttcagttctgtacatcctgagacaagaaattatttattagtagaaggttcatattaatcgtctgccagctgatctactgaatgcaattatttacggagttgctagaaatatggtgctatatgctacagtcgattttttttcagccacttacacagtagttacacctcatttacaccccatttacatatgtaattagtatgtaattttcgaatttacatatgtaattttagtacttacatatgtaattttgagacttacattgtaaatacactaaaattacatatgtaattagggacttacaatgtaaatacatgtcgactattttttttgatggaaaatatggcgccataaatatagcatctcctctcttgcttctgatcaccattatttttcaggtctcgaatacccagacttcgagag

SEQ ID NO: 2648 - DNA, 2000 bp, Oryza sativa
  misc_feature (1080)..(1080): n = any nucleotide
aatagtttaaataatgttaaaccatatatattcaggaagcaatattctagttaacaaagtagtagcacatacataaacaaagtagtatgacacaacttgagagtagcagcaaattaggacacataaaattgttatggggtgcttattactccttagagcaagtataatagtgagctataagcctactataagcttatgtgaaggagagaggtaaacaaaagagaagggtgttggctctcatgcaagagctagcttaacacaagcttcaagacaaatacattaaatgtataagtgagagatagagataggagaagaaaattatagctaatcttatagctaatctattatatgtgttgactttaggatgggctaatagtaagaagtggactatattattatccttgctcttacaaagttacgatagttatgggggctgatggccactaaacagcatcttattgatatgcgtgttagtcaaaaggtcattgttaatttaatcgttctttcactaatgaccatagtacaggcaacacgaagcacgttgaaacgtacggtgaaactcaaccaattggtgaaagcagcatccgatccattccatcacttgggaacattcacagccctcagcaacgcagcatgctgaaccgtgaactcgaccaacctatcggcgtcaggcacgacgtccaccacggccgggtgtgcgcagaagcgatctgcccaagcagccagattcggaaccttggtctcgttgaggagctcgacgccggcgatcttctccaccgccctgatccatccgaggaatgaccccagagcgatgtccaggtagccgatgttgtcgccgccgaagtattgcttcccttggctgcacttgacaaatgcctcctccagatgctgcagagcggtggacatttcgcccgcggctttgtccttgtcttcttccacggatcctctcaacacccgaatccctggaaggaatctgcatcatcaaagcaagagcaaaaattatctaagaaaacaatcgacatatatgacggaaaatgatataactgattaatgcgcattattgaccatcatatttgttantttttttcaactcgtgtaaattgaatttgaattacatgtttgcatatttgtactacttaccatcttctataactttctgaatctgatatggaaaaacgaggggataccgggatagttaccttgtcatcgatgtactttgcccagaaccgctcgacggcgcggccgtaggggtcgcgggggagtatggacggggcgccattggaggccggccagacctcgtcgatgtactagacgatgatgagagactcggcgatgggcttgccgtggtggagcagcacggggatcttcttgtgcaccgggttggaccggagcagcagctcgctcttcttccccaccgtctcctgcaacatctcgtgctccacgcccttcagcttcagcgccaccaccacgcggttcatgaaggggctcgcccagccgcccaccacgcgcaccgccgccggatcgcctgaactgttagtcgacgacattttcgctatctgcttcttcttggtgcagtgaggaggttgctgctgatgttcatgtgtttatatatacgcaattatggagcgcttttcgcttactatattggaagcttcgacgaccacttacgtgcgtcgttgtgtgtgtcatatggtttatttttttctcggtggcgtgatgcttggagccttggactagtatattgggctgacgtctcttgatgtgttcccttttgtcatgtgaggaggattttctgtggttgctagcgatggaacaatttccacagccactagtcgttgagggcgtgtgacattgtctatccatgtaggtaaattgtgcgccgaggagagaggagggttggggaccatgtctacaccgggtttgcgcgcctccacttgataacgagagcctctttagagaatacaacaatgttgtttgaaaaaggggaagcgcatccgtgc

SEQ ID NO: 2649 - DNA, 2000 bp, Oryza sativa
  misc_feature (157)..(157): n = any nucleotide
aatcatggtaagagttgtaatcggtagtatctcttcggaaatattgctcggttggtcggtaatcgactatatttatcaattagacatcaatatgatgctgaaagaatttagaaaaaaaaaatcaaagggtatgacgctgaaagaatttagaaaaatntcaaaaggtaatcaatatgatgttaaaagaaattagaaacctttgtcgtcgtcggagcatgccgccaaggaagcggtgaggctgttccttggtgaggaaacttgttcccagtgctactacggagggaggcgcctatggtttcctcccccagatctggtcgacgacatggtgatgatagcgaagcggcatggcatagctgccgggcgacgatggtagagcggggacttctctctctctctctctcccctccctctgtcccctttgcattcgttcgtgacagggtggcgcggcatcggaaacaggtggtgagggcgaccttggctgttgggggcggcgtgacgaagatggagacgagtgactactgagcagcggaggcgtcatcctctcctctccctgcctcgccaaccgaggtggcgcggagcatcagtggaacatcaccgaggtgacaatgactttgggcgttgtggtaggattggagggggcggctagtggggtcggtgtcaaccatggaggtaggaagcatggtggtgatggcggaagacggaggccagtcagcacactgataggtagtgcacgacggcggcgagggtgttcttagaggtggaagggtcgattgtgccggcacactagtggcatgcacatcgacgaagccacgagcctaggtggcagtggtggtggtggcagagttggcgaatggtggtattggctggtcaactcgacatcgcgttaggagcaaagtcgagcgcagtgggcagcgttaagggcagtggtggaggtccgcggcgaaggcggtgtggcttctactagcacgatggagtttgtccgggtggcatgtggtcggtgcttgataatgtcaaggcggcttggcggactagttttgacccttgtctttactcatgggggacggaggagcttgcttttagcagcgagggggcgtggaggaggaagggaggatcagattcgcatccctcgaagagtcgaagtttgcagcaacaaggaaaaacttgaagctagtcttctagtcctttttcttttcggttgattgtttttctttgtatttcagtgttgagatgtcgagtgtatgtacttgtataatgtttggttgtgtatatccatctatgaacggatttctatccattatcttaaaagaaaaaataatcaaaaggtaatatgctgctgaaagaaattagaaaaaaaaaggaaggtaacggtcggaacggtaacactacttatacgaacaatggtctgtcagaaatttttgtgaccgttttcatcgttatgtttgacaaactagttatagagtatacactacaatatcaattaaaaagtgcaaaccaacaagaaatatttttctacattactcagtacaatttttttctgttatggactatgcaacataactactctaatatatcaacgttttgtagataatgttctaatatcaattaatacattactcagtacaaactttttctgttatggactatgcaacataactactctaatatatcaatttatgtagataatgctctaatatcaattaataattgcaaatttgggtagtagattgaattaaaatatagccaaataaaatgaaacatttcagcattatacttagaagaagtataaaattttcacacacgcaaacaaaataaaagtaatgttcgtggtcggcaggattcgaacctgcgcgggcaaagcccacatgatttctagtcatgcccgataaccactccggcacgaccacttcttgtttaaattcctcacattattctacataaagtaatcaaatatgattttctcctgatatttcaccatccgtaccgcacgtgcagggcagacg

SEQ ID NO: 2650 - DNA, 2000 bp, Oryza sativa
  misc_feature (1390)..(1390): n = any nucleotide
  misc_feature (1470)..(1470): n = any nucleotide
  misc_feature (1472)..(1472): n = any nucleotide
  misc_feature (1530)..(1530): n = any nucleotide
  misc_feature (1871)..(1872): n = any nucleotide
  misc_feature (1874)..(1875): n = any nucleotide
ttcgactttattcagttaacgcgttgttaattcgtggtcgatcgatctagtttgtaggtgtagctgccgcaagataatatgcacaagcacatggatcagattaatagctgtcgttttaggcactacgccatttatgtggatcaggacacatgttgcaacttgcaagtgacatgaccgcaagtatatgcattgaactagtctaaaaataataataataaaaatagtctaaaaaagtagtatatgcattgaaccagtcaagtaaacgcaagtaaactaggtactttgatagtctgattgacacagacatatgtagcaactaaccggagtgtgtatggggcacaacgtacgcattcaaaacgttgggcattcaggcatttcagggttatgggtcgtaagtgaaaaaaaaatgtgaccactaatggaaaaacgcagttaatttacagcaagacttttatacccttacctttagttagtggaccaaaagatatagctaagtgataaaacgatgaaaaattcccaataaatcctaagagtacgctttaaaactcaacattattaattgtctttgaaacaagcaagcctaatcaacaattctgattttttttttggtggatggcacatggagcagtgttgatatgcttagatcgaggtcgtgcgtttggcggcgaccttcgtgagcgtggttagcggacgggaaccgcggcaggatgtggtgtgtactttgtggcagtatccttgcctagtcggctttgatgactttggaggtggtaatatctaggtcaacgactgatattctccgatgttactccagttctatttaggttcgatgtcagatgtgagcaaaattcgattagcacaataatcagccgctgatttcacagaagataaggacttcatacaacacaaaattcgattagcacaataatcaaccactgatttcatagaagataaagacttcatgcaacttataagccattgagcagaaacaacgaatggctatgtagattctcgccaaacatagattaaagtttagcaatacctattatctttatcttaaggttggtatttttaattcgtagccattcgatccagccacaacctacgtaataattggttatagcttctttgtagcatatgttgggatgaatttcattttaaaaaatgtgtattgctagattccaagagcataaaaatttgcgaaaattaggtcacctaaaaattacacattcataagcctaaaactgcatcggtatgcaatatacaattttacttatttttaactataatattattcttatatatagttttgatttattaatttgtatctgagcttgagtacttctaaaaaaaaattaaatctttatctttcatgtagtttggtaatatttantttttaggttagaatagtttacaaagtagcgtgcctcgctataagacatgtcacgtgtgtttgtcaactttaaatatganancccttataacatgctttaaggcatgttaaacttgagtatgaagtatgaatcttttcantcccccccccctctcttcttattcccctttcccttttaaaagttgccaactatgcaaggtcaattagcagcacttctctcacgcatatgcaagtagctagtagtgcatgtgcatgggcgactgacaaggagcattctcgtaagaataatcaacaccttatccctatcgatgcctatcgatgtactcgtttacttggaagtttggaagttcacttgccggttcttacattctaaaccccgcgtggtacgcgacgttattagatactacatatactgtgtacctatatgtttctcccactagctagctaattaattaatctctcgtacgtttctatatatatnngnnaccgcgagatcgatccaagccacggtatgctatgagctactgaaacctacctagctactcaaaagatcgatctagcttggcgagcgtgaggtggtgaggtacgtttacgtacgtacgtatactca

SEQ ID NO: 2651 - DNA, 2000 bp, Oryza sativa
ttgttattttatattcgtaaactgccttataatgaatcaacaataagtgtttaatagtctgggaggtaattggaatacggcaaaaactctctgctgttacgtagtctgtcatcactaaattccttcgagacaatcgaagtcagaagagtgatttacctctgtttccatggtgaatacaatgtgttgttgctttgcagtatgtttagctagcacttgttaaactacaagctggactagcagctccatctgcatcaatgctttctggatctccatatctcaccatctgctcgcaaaactatctctttgaagctccctacttccttccagccaaccaatatttcctacacagatataaacagatacacttgatgggtccaaagtccaaactgttactagctccttaattacatcgatgatgaggtacatatatgatggctattcatgatttggcttaactaatcattctcaaacaaagtaaatacaagctgtaattaaaactggagtgtcagcatgtattcgtgaaccctcgttgaacatttaaacaagcttgaactatatataatgatgcgtaaatgggtagaggtatagactaatcaccttgatcttgacttcaggaaaccatgcatggttgcatatgcataaggaggaagatgagcgataatgtctggagagcagacaactgacatgcatatactaggtgcttctctaatgcagaggcttcaatgaaatgacgtgcggcgttccattccctggcatatattcctgccttgtgcttcctttgaattgcttttctgcaaagcccccaaatcggtcatatgctgcacgcagcatcaatcatcaaattctttgcttgtatctgtgtcagatgccaggctagctgggacctgccatgaaagataactaaaggtaaaggtacaaggcaggtagagacatgtacgatccaattggggatgggaatggatcaatcgactgaagatttgtctggttaggttaggcctacatggaagaagattagtacggtaatgtaaaactatttcgacccagtgattgatagaataatcttgggcatttgtatttttcttaagtttagctgcatttcagttcgttagttgtttcctcatgcatgtaataagctgactgaaaataagtttagctgcattacagttcgttagttgtttcctcttaagtttagcctttttttagtcgttgtggccgagctgggaacggatcgtgggatggcacgaattctcagatctagctgtttaatcggtcaagttttgcatgtagcaaactcttaagatggaggtgaataaatagaaggagaaaaaccgaaaagctgcagcggcattacgcaacgcaaaaccagtcgttcttgttgctctgttttcttcgtgctctgttcttcagtccattgttcacgtctggaaatattcagagatagtaggatagccatagatcgagtgcagagtgagggaaatttgctgacaattggtatcagagcgaggttccggttccgtttttgatgttgtcggatgcgcgctacattccgccgccgaggcgtggtggaagtgacggtagtagcagcgagcaggggagcggcagtgcaaatggcgcaacgatgccgctggtgccgctgtccagagatggtggcacagctgcgaggctgccaatgcgacgaggacgaactaccccagctgggagatcgaccccggctacgtgaagtaccgcgaggatcgtgtggccctctctgccatactccaggccattccgcgggagatgttgcgcgggctggcgaagcatgacacggcgaaggcggcgtgggaccccatcaagaccatgcgggtcggtgtcgaccgcgtgcatgaggccaaggagcaagggtttcgccggcaatttgaatcgatgcggttcaaggagggagagaagccggaggagtttgcgatgtggctgacagccgttgttgcgaacatttgcgacattggcggagtcatggaggacga

SEQ ID NO: 2652 - DNA, 2000 bp, Oryza sativa
  misc_feature (260)..(260): n = any nucleotide
  misc_feature (285)..(285): n = any nucleotide
  misc_feature (331)..(331): n = any nucleotide
  misc_feature (443)..(443): n = any nucleotide
  misc_feature (567)..(567): n = any nucleotide
  misc_feature (581)..(581): n = any nucleotide
  misc_feature (583)..(584): n = any nucleotide
  misc_feature (969)..(969): n = any nucleotide
  misc_feature (985)..(985): n = any nucleotide
  misc_feature (998)..(998): n = any nucleotide
  misc_feature (1028)..(1028): n = any nucleotide
  misc_feature (1051)..(1051): n = any nucleotide
  misc_feature (1229)..(1229): n = any nucleotide
  misc_feature (1251)..(1251): n = any nucleotide
  misc_feature (1299)..(1299): n = any nucleotide
  misc_feature (1383)..(1387): n = any nucleotide
  misc_feature (1403)..(1403): n = any nucleotide
  misc_feature (1459)..(1459): n = any nucleotide
  misc_feature (1471)..(1473): n = any nucleotide
  misc_feature (1477)..(1477): n = any nucleotide
  misc_feature (1479)..(1480): n = any nucleotide
  misc_feature (1484)..(1485): n = any nucleotide
  misc_feature (1487)..(1487): n = any nucleotide
  misc_feature (1490)..(1491): n = any nucleotide
  misc_feature (1497)..(1498): n = any nucleotide
  misc_feature (1502)..(1502): n = any nucleotide
  misc_feature (1513)..(1513): n = any nucleotide
  misc_feature (1521)..(1521): n = any nucleotide
  misc_feature (1524)..(1524): n = any nucleotide
  misc_feature (1526)..(1527): n = any nucleotide
  misc_feature (1529)..(1532): n = any nucleotide
  misc_feature (1536)..(1536): n = any nucleotide
  misc_feature (1656)..(1656): n = any nucleotide
tcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcntataaacaataacaaaactctgttntttactctctgtaaaattctcccgttggttcaaatttaaacagagntaaaacatgcaaaaacaattcaaaattctattgtaattgcatgaaaatatacaaaatacatgttcagaagcatttctcacatttatctattctctaaacaattttcacgttngttcaaattgcttagaaataaacacaatcattaaacatattgaaaatgcttccttcggcgagggacctaaagtgaacttttccggcctttgccggttggcccatggccaccttgcgcgcgggcnagcgccccttcccntnncccaggccgcaacctgggcctgggccggaaagccgccgccgcgcgctccccacttgggccgctttcggcccggccgccgtcggccgtccgatcgctagggtttcgatcggacggtcgcgcgggcggatcgggcaaaccaaaccggccccgaacgccggcgccgaaaccctaggtcctcttctcttctttctcttgcggttgcacggagcggcgtcgccgtcgccgaaaccctagcacagggcccggcggcggcacggcgacacggcggcgccgtcgcactccccatcgccggtgcgcgcactcactcgagggtgagtgcgctgccgtcgagcggttgtgccgcggcgccccctccttctttctcttgcgggcgtgcgccgtgccnagcggcgttgccgaanccgggcggagccnttgagccgcagcgccatggccgatgccctngcggccgccacgccctctattcntttctcttctccgctccctccaccgtctctaaccccttcaacgcgagtgaagagtgagagaccggcgaacgacggagatggtggcgccgccgcgggcccccttgccggcgcgcgcgtgcacccgcgggtgcgcgcgcggctgtcgagtggctcctcggcggtgcctctttgcccctcnccccctccgtggccggcgtcancgacggccggcgacgaggtaagattagggttagggtttcgatcttttngatccgttggatcgtttgcttttctttgctttggatttctttcttctctgtggatgtctatccccgaaccaaactaaacgctannnnngctctgataccattgntagggttgtctattggatcacctaggtttagatctagtcgggtggttctatttgcnatggatgaacannnatanannaatnnanaannaggganngagnggatttagggntgtgaccngtngnngnnnnggangaggaagtccggccggccatcgtcgttgtcgtcgctgggcttgacgtggacggcggcgacgatggtgctcggttccgatggcggtgatgcgcggttgcagcagtcgtacggtgtcgacgncgaggtcgtggcgcggcggtggagtcttcccgtcactggctgcgccccctcgatcggttagggtttatggggtggagtggcggcggcgacgaacctcgttccttgtgtcgttgtaccgtcccgtcctccacccctctttatatggcacagtgtgacgggggcccaccagccattgggctgggcgcccccgatcagggcgcgggtcaaggcccccttgagccgttgggctcaaggggagggagaggagaagagaaaaggaagagggcgcaagggccgatggcagcggcgacgctgctccgctcggccgctccgcccggcggaatcatgcaaaatttccactgaca

SEQ ID NO: 2653 - DNA, 2000 bp, Oryza sativa
cggggaggagaggagaggaaggggtggaggggagttgggcctgggagagaaaagagagaaggaggcccaattcgaacagtgagctttcacaattttctcttaggattttatagaattgaattttgaggagatttccaagggtttgaatttgaaattttgacctagggcttcatggaattttaaaggcaattctaagagaggatttgagatctaaatggcacaaaaacaattaagaaccaaattaactccacatttttaaataacaaatttttaaataaaagcaaataaaatacgggtgctacactttaccaaccaaccgaccggtggctttttggttcatcatccgccgtcccacatgtacgtcgtcgagcctagccagcaaattggtgcatgtcattcatctcactgtttaatccgttgagcgagtagggtttggtgtttctagtggtactatcgaatcgtaaatcggagaaatagtttatgagaaaaaaatatttaaagtgacgagaaaaaagaaaagcgtccgcaaaatgagaaaaaagaaaaagaaattagctagtactcatcttgcatacatgcaacggtagcaaggagccccatttttttttccaaatcgggctaccgagaagaggattgtcgtgcatcttccgtaacaattctccaactagttacacgatctacagaaattgatcagctagccatgtaagcaagccgaacaacgtacgaggcgagggctaggtagctaggatgtcagaaatggcggttgccttagccgtgttgctcgtcggccttgcgccggcgacaccatcgtcgtcggctcagcaatagccgggaatcatttatcatgaaacttcgtataccgacggcatggcagataaatggatggatcgaggacgacatcctgagcaggctgcgccaactcaagccgatcgatgtgttgcctgatacaatatgattgtgttctggaagggtcgttgttctgttgttggtacaaagtctttggtgctgttagtctttggtttgaaaggttctgcaatgtgagctatagtgtccctagctgttagtccaatctatgtgttctcgtttccttgtcttttgttttagcagcagggttccggaagtagattttgatccatcaaggatatatcttttcgttatttacatgtcactcaaatggttataatctttttttttaaaaaagaagacatattaacatgtgatatatcactccacaaacatgcaagttcaaattcaacttttacatctcacaacggaaaaaatagttttgactgtgaatatacattaactagctatggtttatttttttttgttacgagatgtagaagttgaatttgaaattgcatgtttgcggagtgttatatcacatgttaatacatcttcccaaatttttttcacaatcatatgagtggcattcaaataatgaggggatatcctatagagggatcaaaatagtttccccgtgtatgtttcagactttgtatcctgttttggcccagttctttcagtaaaataccctgatttcaataaaaactttgtatattgacgattgtgaggttctagttaaccggagaagacgtagacctgatacaaagtctacctgaaaaccatcgcaagaataattccacatcctgattcctgcagaaaaaatatcaatcttttacaatttttccctctgctaccctatggggcttaaaagaaagaagaacaaagatcaataggcaaggtaatacttgactggtccaaactgaggatgtgctgagtggaacacgtgcttcgatcggaagcattgtcgtcgaaaaaccgcgtccgtggtatacgatgcatcttccttaacaaccctcccactaattaacgaagcgtgtgtatgtattatgcacgatcgatctatttatacggagatcactcagccgggccagttaattaataagtaagcaaataaaacagcaagccgggagctagctagctagctaggatgtcag

SEQ ID NO: 2654 - DNA, 2000 bp, Oryza sativa
gcagctccaaaaggaaaggatatggcaccaccgatcgtagtgtgtagttaaggaagattttaacacgaatttaatcgcggtgattgcgcatagacaacggatggaaatggtctttggcacgatctcctcccgatttccaaatcgagacatcaaaattcctaacaccatgttgtctggcagaaaacatctcacatcttagtttgaaccaagaggttaaaaaagtatgctagtaagactaactatttagggagtagaaatacttgtatccaatggtatatctaggatttagtgtataggtggtccgactaaaataaattgtaaacaccacaattatagcaatgctaatatatacaatattcaagtgtaaataatatagaataaaccaaaaggacaccatgatatattagtaaggtgaattcacgtgatgtgtttgtgatgtcgtcaccacatctcgtgggtaaacagcgaacccggacctcacctcgacttcacagggggatggcacgaagttgtggcaacttcgttcagagagaatgtgttgtcgcggcctgcaagctctcatccgcatgggttcatgtcctatccgagcaaactcgtggcattacagtattttagtacaataccgtcgattatctggatcaacaatattatttatattgttatgtgttggatctacataacgatagcgacacataaaccttgaggtaatactctaatctagttgtgtatcagtatatgggattatcttgtgcctaagggtttgtgtatgatgaacatggcgccattatgatgtgttgtatctatcgtctggagtcaccccaatctcgggactctgccccctcttatgtaagatgataggaaggattaaaaagaaggttatctagtcggttgcaactaaattctcctattctatatctagaagggcttattcactttgctaccattttcaaccttatcttttttttggcaaagttaaaaaaaagtggttgcatttagtttgttgccaaattttagtacgtacatatgaaatcttgctaaaatttaacaaccttgccaaaattttggcaacattaccaaaatttgacaataccaaaacttggtaaggttgaaaatagtagcaaagtgaacaagcccgaagatattcggaatcatcgagatgtagtatcccagtatttgctagaataaggcttgctatgagatatccggggtaccgtgtacactttgtgtcccagaaaaaactcaatcctagatatgaatatgaacatacgtgcgttcaggttcgtacctaagattggtttttttgggaccgagggagtaccccacaaatacttcatttaaacttgtttaaaaactgaatacaaatccatgttctgatgaaatctcgcaatatatgattggaaaatcgttttaaaatggaaaaaaagaaagcctaatgggccggcccgttaactggcagcgacactacttggcaacgagccacgaccacctcccgcggcttgagcggttgagcccaaatcaactgcattggcgaaaaagaattccccaatttgccgcgatagtcaagcgacgacgacgtgctgaggcgatggatgtggcgtcgtcgctgcctgacgacgtgctcgcggccgtcctccgccgcctcccgccgcgtggcctcgcgcagcgtcccgctgcgcctgcaaggagtggcgccgcgctcgtcgtcgactcccgccgcctcctgcgcgcggacctcctcccgctctcgctgggcggcatcctcctcaactgccacgactcgcggttcacacccagttcctctcccgccccaccacgggcgccgccgtctcctgccgcctcgactacaccgtgccgccgccgccgccgccatgccccccatctaatacgtcaagggccactgcaacggcctcctcctctcctacctccaggcatggggaaaacgagtacctggtgttcgaccccacacttacgcccaactatgagttgttcatagtgcccga

SEQ ID NO: 2655 - DNA, 2000 bp, Oryza sativa
  misc_feature (1842)..(1843): n = any nucleotide
ggggacgcgcgcgggtgcagcccatgtgcctcctccccttgtctcccgggctagctactccccacacccacacccacagcgacgcgcgcgccaccaccaacgcccccggccctcctctcgcgctacctgacgcttcctttcctctcgcatacacacttgcgcggactagctctgttgctttctttccggctacctggaagacgcacgatccgaacccctatccaggaccatctcatcccatctctctgcatgcattgcatggcagctatctttacttgtgtgcctacattctgactgatccagtacacggttttgtatctgccttcttctggttctcggcgcataggatcggatcatcgtatgacacacatgatcgctccggatattccttatatctgcagtgtgctacaccacacacgacgacgcggtaaaccgtacgtgcagactgctgatcgatcgaaaattcgaaattcagatacagtgcacgcaccgcatcgtatggttattatgagtgcacgtacggtatgattttctgaacagatgtttcagatcaaagctgcgtatgtacgtgctcgaactcagataattcagcagttctctctctccctctctctctctactcctctctcaaaacaatagtgcttatatgcgatggtactagatccgattatcgatggagcagcaagctttctactctctccgtcgcataataggtgatgttttttactttttatttgtaaagtttgaccattcgttttatttgaaaaattagtgtaaatataaaaaaaagataagtcatatgtaaagtacttttgataataaagcaaatgataaataaaataaataataattctaaaattttttgaataagacgaatgatcaaacagtgacaaacaaaaattcaaaaagacaagtaatatgggacggaggtagtacaattcaaaagaggataaatagttggctagttagctagtggtagtactagtacagtcagccatggatcgaacaattaacatgctaccgactcaggcgagaatctcatctagctatagccaaagctcctcctctccccgatcttttcaaagaaagcgagagccctttccaggggcaagtgccaccttgtcgagccggccggccgctctttgtgctgtgctcttgctggcctagatcgtcgtgcattctctacccccactaatcccaaaattatgcactgacacatgcattcatgcgtgcacccatccggcccctacttcaccaaagtaagtgtgcgtgtgacagtgtcagacagagtatccattccaaggggataacaagctaactttttgtcggtcggcatgactacggtaacactagcagcactagtgctcatgatcacaaccagataaacagcaatgcccagtcatcaactggccttgcgttatatactacgttcagcaatgaacataacgtcttttttagcgatcgatggatcagaatttgatcgtgagtcgttgctagcttttgggtgatcgatctggatgagaaagcaacaaacgggggaggcatgcacacagcagcggctgcgtgtgtaccgctcctatctatatatattactcgtaggtctctctctcgagacacgcacccggccttacttaaacatcaactggtgtgtgcctttgcagtggctgtggtggtggtggtgcgtggtcctcttctccatccagagacaatccagttcagttcagtttcctctctccctcctgtcctcacctcacgcttgacaagagagagagagagagagagagagagagagagagagagagagagagagagagagagaaaggctgaactgagctgagctgnncgagctagttgtgcgagacggcatggaccgatacggcgagaagcagcagcagcagcagatgtttgcctcctacgtggacgcctccctcctagcagccagcggttcgtgctacttagcttttgcttgctagctcccgccattttcttgcctctccatc

SEQ ID NO: 2656 - DNA, 2000 bp, Oryza sativa
actggcacgcatacatggcccagtccagcagtagaccacagaagatccaacacgaagcagtcaggcccggaaaacaacaactcacggagcacatgaccactgggccccatccatccccttacattgttgcatgcccaacgctaaagaaacagatcaacacagcaccgattcattgtgtcaatgcctcaatggtacatgttaacaactgcacacatacatggacatatgtgcaagaaaagattgtgcaaaccttttgaaattttcagaatatttatagagatatatcatgaaagaaagaacaataaccaatcaatgaattaataatgcatatgcttccaagatgaacaaaactggcgataatatacagatgccatacatacatgtcctcacactgcatataattaatttaagtacagacaaaaattataggcttacacgtctaaccataaagaggggaagaaatggtagagaaaaataatgaacaacaataatggaatatctgcatcatcatgcatatgtgtaagagcaaagaatggtggtggtgactggtgacatggcacaacgacgacatcgatcatccctctctagctagggcttgaggcgtccatcaataatggcggcgatgaaccctagctagctatagctagttaggcctttggtgcctcctcctcctcggccttcgccggcgccgcctcagcggccgccggcgtcgctgcggcctcgactgggggctcggcctcggcggcggcaggtgcgctctcaccggcggctgcagctggctcgtcggcgggggcggcggcctcttcttctttcttctcctcggcttcttccttcttctcctcgccggcggcgtcggtggcggcggcggcggcggcggcttcctccttcttctcctcttcggcggcggcggccgtagcctccttgggcttgatctcctcctcgtcggcggggagcaacgtggagaccttctcgaaggtggcgaacaccgggccggagagcagcgccgggccgaccttggcgatcccctcgctcagttgcttcgctccggggaactctgatcaatccaccatgaaaatttcacgtagctaattaatgatcagcgaaattatattaaaaaagaatttgatgagatgtgtttgttgattatatattaccgattttggcgagatcgtcgacgaacttggtgacggcggcggagttcttcttgatcccggacaccttggccctgtccttgatcagaacctgccaaccatggacacatcaaatgtttcagtgacctatacttaattagctgtaaacttggcagatagtatgagctaagctaagctagctggctggcagtcttttactgatcactactcatatgtgtagggtacatgcatatgcatgacgcatcactgctcatcactgagccagcgagggcgactagacgtacagaacgcatgcagcatgatgcagccaagcatcgatacatcaggatcatcacttcattagttgcatgattagatgggcctaagtctcaattaccgcaaactaatacgtgcagttggcagcactgatcgagttaattaactactgaattagtaggacggatgatacggttggcgtgtgattagtttctgaattatatttaccttgagcggcgcaggagcagcctcgtagatctcgacgaccttgggctggaggtcagccttcttctcctcgaactcgccgttgatcccctcctgcaccaccaccaccacaatcatcagcatctcatcgcaatcaaccagatcgatcgaccagacgaatcaaacgacggcggcggcggcggcggcgtaccttagattcatcaaacgacttgatgagttcggcggcggcagccttcttggcgttgccgcccttggcgaagacgaccttaatcttcggcagaaccttggtcttccagtaatccatggccggctagatcgatcgatctaccactgatcggcggcggcggcggcggtggcgaggctaagcaa

SEQ ID NO: 2657 - DNA, 2000 bp, Oryza sativa
  misc_feature (29)..(29): n = any nucleotide
  misc_feature (86)..(86): n = any nucleotide
  misc_feature (90)..(90): n = any nucleotide
  misc_feature (93)..(93): n = any nucleotide
  misc_feature (116)..(116): n = any nucleotide
  misc_feature (125)..(125): n = any nucleotide
  misc_feature (177)..(177): n = any nucleotide
  misc_feature (190)..(190): n = any nucleotide
  misc_feature (199)..(199): n = any nucleotide
acgacgccaactcacaggtggccgggctncacggcggcgacccgtgcgcggccggcggcgccgcggcggcggcggccgcgttgggntgcntcnacgacgacgtcgccggaggccangccgccgcngccaaacgcttggaggcaggcgtacacctgcaccgagctgctctccaggctnatccccaacaagncgttccccntcatgccggtgagctgctgtccacggccaccgtcgtcgccatgatcggtggcgaggacgagctcctcacaatctcacatgctttacgcgtgccattgctgcagcattgcctggggccggaggaccagtacctgtcgatggagcatggcatggtggcggcggcgcaggagccggtggaggcgtcgacggcgagctgctcctacgttcccagcgacgagaactccggcacgccggtcatggcgtacgacagcaacccgccgccggcgaacatcgcctgacctgatcgatcgacctcacctaactaacctacaaacttaatacatgtacaatactacatcgaaagaatcactagtgaactgaataatctcgcaagcttgaggacacgtggcaacgcacacgcatgtcggcattgtgtaaactacagaactgatgaatatattatctggtcataaagttcacatcaagatcatatcgcaaatgcaacgaaccaaccactgaaatctgaagctgaaattaaatactactcctaaaatgattagatgctttaatttcttaccatactgtctgattaagtcaggaaaacacctgaagagtggtgaagagatagtgcaatcctatgcaaggaagatattactgtaaacatgtaaagatgtgcagtgcagtgcagcatcatctttctgaatctctgacagaagggcactaaagccatgagtcagctggaatgttcttgttacaatcactaatatctatccaggcgattctttcatatttaggttccttagccatgaattaaccccccatcctcacttgtctttattttggaacaaagacgagtagagtagtatgagtgagtgctgccttttgcctttttcgaggttaagcaacttgtgctagttttcttcctctctccatgtgtgttcaacagagcatgcttctcatatgctgatatcttgcaatttgcacacacttctcacctgctgtaaacttgtcactcagctttaaccacaagattacagatatttgttttgactatgacagtatgaccaatgccattggttgcctcctacagtaaattatatatacctaacagaagtcacaaactcatgcttacttgattgatagtggaagaaccttttcttttgcttttgaaagaaagaagagcacattccaatttccaagtagctgtaatgagcctgtaatataatgctgtttgaacaagccagaagacaacatcaaacaggcagcatcaaatcggttgtttgctgaggcctgagggtgacaaataactaaagctttagtatttgcccagctcaagaaatatgcttttgtgagaaaaagcaggctccaatcaattgccggcagcaagccaccatgccccacttcacacctttactcgaagctgctctgaattttcaaatggcgaaacacaaggcaaatggcccccattttgccacccttcctcattttttcaaaagcttctcttttatctatccctctctctttaatttggacccccattagctgagatagctatagccctccttttattcccatcactccattcattgttcttgttcttgttcttgctcttgctcttctctctagcttttgctttactagttagttggccattgtttgcactcgatcttggtggtgatatgagctgagctcttctctagctcatcttcttggtggatcttgtggtgttcgtcttcttggtggatcttgctgctggtatagctatagttcaagattaatggcgactccttaccatgtccagtctccaagaagcatcctactga

SEQ ID NO: 2658 - DNA, 2000 bp, Oryza sativa
  misc_feature (1859)..(1859): n = any nucleotide
ccgcggcggcggcggcggcggcgcgctgtcgagcggggacgctacgccgtccatgagcgcccgctccgacttccccatcggcgacgaggaggatgaggaggaagacgacgacgacgagatggtgtcaaccggcggcggcggcggcggcaaggaggaggacgcgaaggagtgggtggcgcaggtggagcccggcgtgctgataaccttcgtctcgctgccacagggcggcaacgacctcaaacgcatccggttcaggtgtgttcttgagcatgctcgagctaaattctgcatttccagtgcataactcggttctttgatcagtgaaagactgaaaattctacttatttgcattagtccttagcatatatgattgaaagtttagtttgcgctcgtatgaatgattgaattctggtcgtgctaaatataaattagatcaaagtatattgaattgagatagtaactttgcggtgtaaatgggggcgaaatgtcatgcttaggagctttgttctgaacctgcttctttagtcaagaagcaaactggacaaaagcgagtagttttgacttttgatagccagttaaaatcaaacaagcccctatggatgaggcagtaatttctcccaagcccctatggatgaggtagtaaattttcattgatcattgcctcggggcactggcaatttatggagaacagcacaatagattgttaaatcttcatacttcaactagccatgttttagttttttttttccgattgctctgtcaacattgctattccttctttaccttttgcaataatttttcgtggtctagtttactactggtcacactttgtggcattctatttgtattatttgttttatctattgaaaaggaaaatttcattaagaggtagcttatactgattgccgtaagtcaattttaaacactggatggaggggtgtgagttttaaaattcttgtacaccccaatttcttacttaactggaatcctatttttactcgagggtggataaaaagcacacccgtaccattggatatgctaccctgtatattaacttcactttttccctcactcctatgcaacctcatagccgttacgtattcgctaaatagtaaatcccttattattttagattttacggctggttatgctcataatgggaacaatctggtgtagggttaatggagattacattagaaagtgataccttgattgtcaactctatgacaatggacctcatttaagatttaacccctgatgtgctgcagccaggtcgaaatcctgatgtgtcagcatgcatgttatgtccagttagtagactcagaattttaagccatacattattaaagttaggggatcatgtcagttgttcaccctggagggtttatagggctagaagatctagtaaacaacaggctctatgaaactttaaatttaccagtactatgtgggggcaagtccagctcacacatttgtactttatctatatcattcatttgctttaggggctgcttctgctccaggaagaggtagtattagcatgggatagagacagcaaaggcccacaagccacatctcatctaggtagtcaataaagaagctatatggaaagagagcaatggcacaaagaagcgtaacttcttctgctctctcttctttggccgtttgttattgagaaatggttggaggcttctggtcttattaatatgtaatagggtccctccacaccggcttatcaggggaaccatccaacctggacctctgattagcagcagctttcctaatggatggacttttggttcttatgctgctgcacttgtaatgagatcttaaaaactaccactgcagacttaatctgnacactataaaagaaaattgtgcatgtgaaaatatgcccattataaatttgtagtgttcagattgagtttagaatggttgttttaagatttgtctataagcagggtatactgttaaaataatattcttggagggagttcctc

SEQ ID NO: 2659 - DNA, 2000 bp, Oryza sativa
accgttcgtcttaataaaaaacttttgtgaaatatgtaaatgtatatgtctacataaaaatatatttaacaataaatcaaatgatacgaaaagaattaataatgacttaaattttttaaataagacaaacgatcaaatatgtttaaaaaagtcaacggcgtcaaatatttaaaaacggagggagtatatgtgactcgtcacccgcgtaccatattccttcgattttgctagatattggtcatcaaatttctccccctaatatttgtcgtttttctgaccataggatttgtgctacgattcgtgcacatatgggggtggggatgcagctgcgtcaagtgtaatcagaccgcgcctgtagtcaaatttgggccatccctgtcaaatttcgggctccgcgcttttctgtccatagccgttgtgttttcctcaactctcttctcgctctctttccttctctttttttcttttcccttcagggcctgttttagtttcccaaaaagtttttacccaaaaacatcacatcgattacttagacacatgcatgaagcattaaattataaattaaaaataaaaactaattgcacagttaatggggaaattgcgagacgaatcttttgagcctaattagtccataagtgctacagtaacccacatatactaatgacgcattaattaggctcaaaagattcgtctcgtggtttccaagcgagttacaaaattagttttttcattcgtatccgaaaaacccttccgacatccggtcaaatgtatgatgtgacacccaaaaattttcatttcgcgaattaaacggggcctcattgttccttcgattttggaaaaatgtttggcactatcgtagtacttcatcactgtatcgttgtgaaaaatcggcccataatctcaccatttccagttcggcctatttgcaaaaaggaaaaggttaacttttcatccctcatctggctgagtttcaattacttccctcaaccataaaacgagcataatgtatccctcatcttctaaaaccataaaatgggtataacatatctcttatcttctaaaaccagtgtaaatattgagagtgattttgaatgatgtggcgctgatgtggcactaaataaaaactcatgtggaacccgcatgttagtgaaccaaccactctcccatcacccacatcacatgtcagtggcccctcccattgagcacaacaatgttgcccatggcttacgaatatcagggtttacattaccggttgacaattaaatttcgagccccatcggtatcacggttttcgataaatttcgaccaaatctattgtttaacctttgaaattccaatcaaaacttaattttgagccgtgtagaaacgtcgaaattttgcggaattcgaccggttttcgtcggaattataaaccctgcttacgatgacttcttcaagggctgccgctagtcgtcgctcctgcccaccgaagcagagcgtgcagagttcccatcgctgcctctgcccccgcagagtttgcctgcggagactgccaagatggcggcccttcgtatcccgtcagggcagcggcgggaagagcttgctgtgcagccgctgcttgaggagctcctgcgcttgatcggcctcctcccacacttcttctcatcttcgtcgtaggggccaccatggccaaggaggccatggcgcagtcatccccatcgatttgctccctctgcttgctcacctgccgccaccaatcgagttggaagaccttgaggagaaggcagggaaaccaagagaaagagggtgtggaggcggagggatatggccgcgtccgtacccgctcgctctccaatatcggttgccgatggtttcggtattcacccgcatcgccactcttgccaaaccaagcttgcaccggagttcccactctggtttctagtgccccggtgccacattggagcggagcgccccatcccctccattgcttcctcattgacgcgtctacctgctgacaaaag

SEQ ID NO: 2660 - DNA, 1173 bp, Oryza sativa
  misc_feature (7)..(7): n = any nucleotide
  misc_feature (63)..(63): n = any nucleotide
  misc_feature (65)..(65): n = any nucleotide
  misc_feature (88)..(88): n = any nucleotide
ggggctncttttcccccccccggcccattttccttccccttccctttctttctcccgggccgnanttctctcctctccttcccgtccnattccctcctttcctcctcccgcctaggcctgccccggcccaagccgagccgcagccctcccgcgcacgcgcgccgcacgcgcgctgaccgcgcggactggtgggtcccacccacccggtcgtcgtcctcctcccgcccggctcctccttctcccatgaaaccctatcaatttcctccctcaaatctgcgcgaatcaattcccttctttccaaattgattagggggaattaatcccatttccttcctcttcaatcccccctaatttccaccttgaatggcaccctcaatcgcccggaacggccgcgccatccccggccaccttccatggccgccggcagccattctcggcgccgttccgccctctcccgtgcccggctagctcccctccgctataaaatgggatcctcttcctctgttctctcattttagcctcctcccgtgccaccccgtggccgcaccgcctctccccgcagccctcctctctctctcccgtgtcgccggccacctccagccgcctttgccgcctcgcccatgcaccggtaggccgtgctgtcaccattctcggcgtcgcagccgcctcctctcccccggcctgccctccatttcgcgcggtgaccgccggaggcgcgtcctcgtcgacgtccagtggtgttgccgccactgcaccacctccagttgccgacgtcgccatctcctccttcggtaccgcggcatcgacctccaccctagcctctccttccacctcaccgacgtttccttcggccactccttcctccgtgcccgtgtgccggccgacgtcgtcgtctcctccggcatcgcagcggcaacgtcgccctcggcctcgcctcccctccacccgtaccccgccggtgtttgtcatcgtcgtctccatccgacgtcgccatcccctcctccggtcggccgatcctcctcgccggcacgtcatcttgctgcgccgccaccgtcgtcggcattgcagcggcgtgttccatgccgtcctcgcatccgtgcagctgctgccggctgccctcgtcgcctccccaccggcccggtcatcatcgccctctcgtcattcccggtcgtc

SEQ ID NO: 2661 - DNA, 2000 bp, Oryza sativa
agcttgaaccatcactcaaattaattaaaggcagatttacccctcgagtaattaaactccaacaagactcatagaaacattcatacaaaaacatttatatgtattacatgaacttagggtttattaagtactaactttctcttattcatattataaaatgttttaagttttaaatagtttcatgtatggacccatgtatgtgttttatatttgtttaaattcatatggatattagtaaatctaaacgatggatgaaaaggccaaaacatcctgttgtcgtttgggtatttaactgagaaaaaaaatttcacgaataattttgaacttctctcaccgaatagctgacgtgcacctaaatccattggtattgtatagagaactcttttaagtcctcgagagatgtcccttcaatatttgttcaaaaataccatccaaaaaagttattaatttttcttaaaaaaatgacaacgttcatacaatatacatatataccactctgaaaaatttaactctaaactcaacttacattgagaaacacacacaaaaaagacgacaaatctaacgtataaacagtaccgacactgtgtgtagattgaatttgaactttggtggaaacagatgtcacactatactctacaattgtcaaattttatcaaaatttttcataaccatttatattagagaaaacgatacacacaaaacattctctcaagtgattaaaatcctctttttggcgacatgtacctctcattagctcatcgatgatgctgtataatcgggtgggagcacctcggatgcctttgcctattgaactgtcaacaacatctagctatcagtgtttattctctttcagtggactcttcttcgaactgaattattacctgaaaagattttagaagaaaaactattaccggcatttcaatgaaaacatgtacatatatgcatatgcaagagaatcaatttagaattccagattcgatggagacacactaccacctcgatagattaggatgactagctagctagctaggattgccttgaatgaattgcagagacacatcaatgaccagttagttaagatcgaccaacaaatatataatttaaaaacatgattttgccggacaacgcattctccaattatatatatgctcctggattttacattttgtccaataaaaaaacatcttaattacaccactggtgtgagagaaattaatttgcttccctctatacatatataatagcaaattaaataatgaattaagctacatattttttcctctgaaattaataaacccaagaaggaaacgaatgaataaattaaagaggagctagcaggccacatgtgcacagtgcagtaaccaatatatacctaaagaacaaaacctgatcgaggagaagacatgtcatccaatcatacactgtacgcgcacacacacatgagacatatatacaccgatctgatctgatccaatccttgcttaattcttctccggctggccggcctctcctatagcttagcttagcttgcgagacttcgttccactagtcttctcctaatttcttcctcctgcaaatatgcgtagtcttctgtcatcgtcgaccgtcaagtgtgtctctcgctgcacacggagatgcatgcacctcttgattgattgctcggtcgactgattgcttcttacacaccgcaactcgctctaattagttggtttagcctgtttagatttgtagtattagaatcgtcacattcaatatgtactagatttatttattttgagacgagctagagccgcttgattattgtcgatcggtactagctagtgctacttagtaagccggctagtggagtactcaatctctgctactactcggctagcagctggctgctgctgcagcagtagaacatcaagagaggaggttaattagctagtacgtagtaccttggctgctttaatgaactcgatcgatccacagctagctagcatagcagagcagcagta

SEQ ID NO: 2662 - DNA, 2000 bp, Oryza sativa
  misc_feature (181)..(181): n = any nucleotide
gcacagttcatcaattgaagtaaatatttactaatgtgagattcctgtaggtcaccaaactgattacaaagactgcaacccaagtatcatccatgcagaatgataggtgacaaacagatggctttaccggcttcacaatacattgagtaagttgatttctcgccccccccccttccccccnaaaaaataaaatttctgactgactaatatcttccaatgcaacgtacaaatattgatctcataccgttaaacgtgttattggtaagcacgtagcgagatttgatataagttaaattccacattgttttatgtttttctaccctacatctctaccagctttatagctatttggaatataagagttctccatcaacgtagatggtgtcatctagtttgcatttacatggcccccacatcagcctgttgaaaggtgttgtgtgacatgatggacctgacgaactggggtgtcatatgctgatttagtggtatatcaccgatcagttaatcaataagctgcccttcttctacgagctgcacatgtaacagttaatcgatggtgacaaatgtggcaattaatcaatggcgatcaagatgtgtggcctttgatgtccacgatccatcaatatccattagcgtcttatataccatcaatcttgccatgatttggccttctttggatggttgtggacgcccaaaatttgacacattcctgaacaaggttttaaatactggttttaaatattgcctccagcctctaggaaaatactggttctagatactagtttccataagcaaccgtgctgttcaaactgcatcttctaggctgccggatgggttctgttaacattcacatcgccacagtgggtttcttcgactcaagcgctttcatgacaggtttagtcttggtttggtatttgaagcaggtatgctaatttttttccaattacttaagagcttaataaatggtcgtagtcaatctacacacagctagcaacttgggttttggcaccgagtagctctcctctcaatcataacattgttggcattgactatgggtggaatcatgctcgagtgatgagctatgccagcatactatcattgttggcattgactacgcgtggaaacatgctgccagcgctaaaaaattctatcattgactctttaaaaggatattttgggagatagttggtgtatccagctgctactgtttcgggaggactacatatatttaaatattgtatgtgttgttatagttttataaaaaaatcaaacattattccctttttttaaatatccatctaaaatggtaaccaagtaccccttccagctttatagttcttgacgttttggacaatgacatgttcaacatatctttgactacgacttttttttatcatataataaaaaataagtaaatatttaatcttttttttttcgaacggtcaggctgttgccgatgttttatattaagaagaaggtgtcccattttaaggagcaaacgggatcaaaccttacagtgtccagttaattagggaaaactgaacgaaaaccacaactacaacaccacgctaacaactaacctaacctaaactaccacgatggagcccgacacaaggcatcggccaagctttgtcacaatggtgataaaatagcccacacatgttatcgttgccgagcttgccgcccaagcgacacagcagcttcgacttcactgcgatgctaccctaacgccaaaagaacaagcataaacgatacccatgaaggacatcagcccaaacagctaaggaaccacttcctacacacagctaacatcaacaaccttataaagagattgcggtgtgtcatcgttgccgagcttcgtcacacccctacaacgaagcagctctgactctacctagtagtaaccaaataagaatgatgaacacccgccgtagagtaagaaacagaaccaagacagagaagacctcgtcaaacaccttaggcttgaagagcttcagagg

SEQ ID NO: 2663 - DNA, 161 bp, Oryza sativa
  misc_feature (9)..(9): n = any nucleotide
  misc_feature (49)..(49): n = any nucleotide
  misc_feature (57)..(57): n = any nucleotide
cagcacacngtactgaaattaactgacacgtacgtatcctaggctgtcngctcggcngtgagggtgatgaaggaaaggcggcgtgaattcaatcaagctggaagggagcgcgccgtcgaggatcagcgcggcgagggccatcgtggacgccgggatcgccg

SEQ ID NO: 2664 - DNA, 2000 bp, Oryza sativa
cggagaggaaatcgcctgggaatcgcttcgtgcaccgaggggatcatcggagagagaggacggagtttgcttcggcggtgaaaacggaggaaacggtgtgagatttctcggggacaacggttagtatttaaagcgttggaataacggtcggaaaacggcaagtgcaatattctctcgcagtcgacgtatggcaaatccgaaacattatccaaaattctggacttggggggcatgtgttagtcggacagggttagccgattgagccgaatccgacaatatgacacggcatatgttgtcgggttagaatgacgtgcttcatgatgattgccacacatggatagagtcctaagaaggcaattgtatctattaagtaggatattttatgtaatttccttagagatatgtttgggcaaaagtctgctgcaaagacttatggtatcttagagtttgttagagataagaaacgtgtccgatatggacatattttgtaatttttgggtataaatagacccgagccccatataatcgaactaacacacgttcactacaatctcggcgcatcgccgaccctttttactttcattttgttttgacgagttcttgctttcgggttgagctgcatcggtttcgatcttcaactagaggtaaaactcgttatggcggcttgcgttctcgggattagtgcttccatctttatgatacactaatcttgtttatgtaattcgtcgagttttcatatatcttatataatctctggcaatatcgctatctaacctctaatcggctaacgtctgttactagaaggcagccgattaggttaaatatcgatgctgacttagattatataggatatctaccactctatgaaacatccaacgacttgattgtctagatattgtccttcttttcatacttatagctgcatcagttgagtttaatcttatgagtgatgattagaatctcaatctctaggctgcctttggctgccgattagggtagcgtcagagtttcagccgatcttacctgatttaactaccattttctcatatgcttaattgacatgttaaatctgcccttaagtatattaggcttttgtttggtgtattctacttgccttaatatcttgatatagagtggtatcggagtattagcctatacatgctagatctatctgatcggctatgctatgaacatatatagtctcgttgttaacatatacttcgatctatgtgatttatactgtctcgtcatggcgacagatcaatcccaatcacttgatttaagtatatagcgacataaggattatatattgttaatatctacaactgatcgagtagatttaattagttctttcttacttattcatgattgccgatcgatccacatatgacatcggctccaagataaatgatacttcatcggcaattagccgatcggctatcgtttatggatttaaccgtggtttctttgtctttgtttcttgttgattgcaggatcaaatcaactggcacgctcatacacctaaaggcaagcttctggacttacactggagttaagcagatctcccaggcctcgtgtttttacatggaataagttcaccggaggtccctcaaattgacaccgagattttttaaggtccctaaactagaataccagaaatgtgtacccctaaaattactaaatccgagattttttaaggtccctaaactagaataccagaaatgtgtacccctaaaattactaaatccgtccgtagaaggtccctcggcagtattgactcagtttttgcccggttttgttgacgtgtcgcgctgtgggacccactggttagtccaccaattggggagttaatagacggggttaaagggctctgtcctcgctgtttccaggcgttgccgcgacattttcctcttctcgagctgaaaccctagcttaggtcggcggcggcggcggaagcggcggcggcggcggcgggggcgacaagaggaggtgaggctagg

SEQ ID NO: 2665 - DNA, 2000 bp, Oryza sativa
aaccttggtcaactggctgcctgctcctctaaatgttttttttaaaaggatgaactagcatggtgatccgcgcagattacacggctagcatcattatattttctttcatataatagtataaatgttttctcattgtattattaaaatatattaaaatgataacgtaattttaaattttgtactaactttacgaaactactaatgtgtaatattcatattatattttatatgcattttatatgcatgttagttattaattattttaatatcaaattttagttatatctaaattatattcctatatggactatagactcgcctttcaatatttcttttttttattccgaattttcgttatgtgtacattgtatttctatatagactctaggctcttctttcaatattatctatttttaattctaaatttttattatttctaattatatttctatctggactctaaactcatctttcaatattctttaatttttaatttcgaatctcagttacttctaaattctattcctatattaactttagactcttctttctatgtttttttttaatttcgaattttagttatttgtaaattgtaatataaactctaagctctacttttaattttattatgtttattccgaattttaattagttttaaattcctatataaactctgtactctacttctaatattctttatttttaattccgaatttctattatttcttaattgtattatatatggactctatactctacttctattgtactaactttacgaaactactaatgtgtaatatttatattgtattttatatacgtgttagttattaattattttaatatcaaattttagttatttctaaattatattcctatatggacctagactcgtctttcaatactttttttttaattccaaatttttagtattttttattccgaattttcgttatgtgtacattggtatatctatataaactctaggctcttcttctaattttatttatttttaattttggaatttttattatttctaattatatttctatgtggactctaaactcatctttcaatattctttaatttttaatttcgaatttcagttagttctaaattctatttctatattaactttagattcttctttctatgttttttttaatttcgaattttaattatttgtaaattgtattatttttatatgaactctaagctctacttttaatttttttatgtttattccaaattttaaatagttttaaattcctatatagacactgtactctacttctaatgttccttattttttttccgagtttctattatttattaattgtatttctatttggactctatactctacttctaatattcgttatttttaactctgaatttctattatttcttagttgtatttctatatggactgtagtctcctcttccaatattccttattttttaattccgaatttcaactatttccaatttgtatttctatatatatggactctgtttttcttcttctccgattaatatgagaatttctagaccgtgagagcgagcgtggaggctcttttttctattcttttaataagttaatagatgattgaatagctgaattttttgtgataagtattcaatggtacaaagaatgaattcaaaattcaatgcaacaatatgcttcaaacaaccttggtcaactggctgcccgctcctacatccacatgcatgcttcacactgccacctagattaattacttcctcacgaagcaccaagtcttagtcgatcaccaaatcatttgcacgaatatgccttctcccattccttttctagtaaattcacatcaattttaataatcaataatcatccaaacattagtgaaagtagtactatatatatatatgtgtacaaacattacttctgcccaaccacggttagccacatagtagtaattaatcagctagtcagcttacacttgtctacacgcggcgagcgg

SEQ ID NO: 2666 - DNA, 2000 bp, Oryza sativa
  misc_feature (910)..(910): n = any nucleotide
ctgttcacctctagttatcatgtactattctctagtagtagatatgttaccatttgaggctggcaccagtccctctttatttatttggaactggttttgggcagttagtgtgtcggtgttatgggcccagggtacgtacggagggaaaaggtcgcctcaatcccacgtggtgtgcacccggggctggcgtgctggctatcttccacaaaaggggtcgggctgccctgaccccctccacacaccaccacgcgtgtgtggcagcgcccacccactacatttattgaggagggttaacgcagcacgtcacattaaatgcagtgtgcaggcgcactaaccggccactctaaatcagaatgattgatgtgacggcgggcactcagatatacattctcccccgcgtcaccctccctcacgggcgatacgggaggcggaaaccgccagcgtcgccgctccacccttcctccctctgccgcctcgccgccgcccgagcggccgcggcaaagccgcgcggtcgcaaggagggcggcagcggggcttcgtcgccttcgtctgcctctcccgtcggcgggtggggggcacgcgagacagagaaggccgcccagatccgggccgccgtggccggatctggcggggaggccgccggtggagggtcggcctaaggtggcggcggcagttggtggcggcggcagttggtggcggctggcggcggggaaagcgacgacggtaacgggagtaacggcggcgtcggggaatagtgaggaggcgccggcggcaggaatggagatggcggcggggaatggagggtggcggcgaggctgaacgataacgggtggatctggcggcgaggctggcgacggcggccggatccaggcgttgcgggccgatttggcccccccgcatggcgacggtntcggggcggctgtgttggaggttgcggcggttttgcgaacggctgctgctggcgtcagtggctggtggcggcggtagcagcgacggcagccggctttgcggcgaccgtgcctgaggaggcggcggcgacgtcggcattgaaggcggggaaggagtcggatgtgaggtgacggcggcgacagtgaggtggtggtgaccgtgtcggtggttggaggaggcatggcggcctcggacggcttgccgagggcgtggcagacggctacatcgaaccgacgtagcatcttttggaggaggggtcggagaccggcatgacgcatagtggcgcagccgatggcagcggaggccggctcggtgcgagaggcgcgggcggtggagatggaggccggcttagcacatgaggcgcggccgatggagggaggccggattggcgcgagaggcacatccggtggaggaggccggcttggcgcgagaggcgcagccggcggtcgaagaggcgacctcggtgcatggtggagctgccgttgggtgtggtgcggtcttcggcgcacgaaggttggccggcggggggcgtcggtgcaggggccccacatgtcgacaaagtttgagtggtggtggagcatcggtgcgtcagccgtggattcgtaggtggcgagcggcgggtgaaaacctagcccggccttagccgaaccgacaacgatggttaattccccctcctgagggcgttgtcgtgctgtcttacccctcaagggcggttgccgggcgtaagcccagtcttggctcctttgagccctgacggacggcggcggcggttttccgtcgcttctcttcttgaagacgttgttttggcaaccccttgctgtagggcgatctcgtatgtgttcctttgttggtctagcggcggccggtcacgcttagcggcggccggtccggtgctaaccttctcctgtcgtgtgtgttgacgctgccggtgtgtgggtggtggtatattttttctttttcctggttatgaccctccagggttgtaatcttgtaattttttcgtgctctatcaatagaacatcgcaccatcttgtgcgagtcgttaaaaaatg

SEQ ID NO: 2667 - DNA, 2000 bp, Oryza sativa
catattctcatttttccgtgtctttgtattggcgaatcttacttgttggctctgctttaattcttcaagagagcatgttaaggccctttagattgtcgtaacctgtgcgcgcttccccctttgtttgaagcacttcagagtaattaatttatctagttctattaaatccttgtatccttgtcttcttcatttgctgacatttgtcgtgatcagtttgttctggttcagttaggttggtggtataattttgttctattaactaaaagatctctcttcttgtatgctcaaaataactaaatagcacgattaactgtttgacaatccaatggttccaaccgtacagtctgttttgtctggaattatatgttctttactctgtctgctttgtgatataggctttggctctttgcattagagatttgcagtcagtgctattttggcaactttgcattgaaagataaactattcctccatcgagcggaggatctgccccaagtttttttttccccgggtagtgatgcccccaaggttaatgttgtttatttgcctctgtcaatgtttttcatggctagttggttgcgaaagtgagttagagagctctgatggtgtcacaggggtcaccgggtcagggggtgtcactgattgaaacatgcgtgtttggccgtgttgggttggttgcttgattagcatgtgcctgagaaagttgcacgcccgagacttaaactgatattgtcgtagcttttgcctgaccgggcaagcctcccgcgatcggccccatcgttttacttattcgtggaataaaccaaacaatatatttgtaaacgaaaagtaatttataaataaaattttcatatgcgtgtatttagtgatttaaaagtaatggctggaaaataaacttcgatgaaaaaactctaaaatcaactctaaattaaggttaaaaatttaaaatttggctgagaagcataagtataaatgaaaagacgccgatagttgtttcggtgatgagttgagcgcgtgcgcggcaagccaacgccgccgtcagatccatcggtgcacaggatagagaaatctaagacgtagtcatggagctttgtggaatgggggtttgctagctgtgaaattcttatccccttctaccttgcttttcgagaagatgtcggcagaactctcttgtgattaaaaagttgagcagtttcgcctggatctcaggcgtccgaattcgcacgccggactcatgctaatgatgcgttggagctactcaatttatcaggcctccaatcaaacaccttttaggcaagtcacaaggaggcatcatgttaggcttcttctatccaggtagtaaccaaaacaaacctacaatttgacctattcgtcgtgactgaaacaccacggcacagacaacattcttcatgtttacaacaagttccgtagtaccggtagtctacaaaagcattcaaactgggaacttcgtctacacatcttgcaggttttgcttcagaaactgcccctctaggtccttatttggttgtcctgagaacgagctggattgggctgcaattcctgtggattggacagacgcggagtgaaacccggcccacataaaaatgtgcattcggttaagcccatcgcggattgaatcaagacggaataagttcacctaacgtccctcaactttacatctagtctgtctgtctgaggtccccaattcgcaataccagaaatctctatccctcaactattacaaatcgtacaaaaaagatcccgatgcaatattgacccattttttccctgtttcattgacgtggcatacggtgggttccacatgtcagcataatctcttctcatcttctccttttctttttcttttttctttaggaactctttgtcttgcgttggcgtcagcacctccttcaccgcggcttccatggtgtgtcaccacaacttgttggcccgccgcaccgcacgcgccatcttgcacatctccccgccgtctcgtgggc

SEQ ID NO: 2668 - DNA, 2000 bp, Oryza sativa
  misc_feature (225)..(225): n = any nucleotide
gatgtgacaacaatccaatatgacttgctaccaaactagctagtcctatatggagttacagtatattgcaaccttatttggcacaaatcacacccgtaccttaagaaaaatatcgaagctaacaccgccggaacgcgcgagcacaaacatatcgcattcctattctttttttttctttttagagaatcgcattcctattttttttaaagagagaatcgcactccnattttttttttgagagaatcacatacgtgatctttttttttttggagaatcttctttccctatatatttcaccaccgatttgtgcattatgagagatgtacgcgagggcacctcgaacaagctagttctccctcgcacgtgcctgcatgtttgggacagtttagggccaataagaagttcatacggtatttcttttaacttattttttgaattctatctttggttgtgtatagattccaacttttttctttaaacttttaacttttccgtcatattaaatgtttggacacatgtatgaagcatcaaatgtggacaaaaagaaaaactaattgcacagtccgactgtaaatcttttgagcctaattacttcatgattaactataagtactacactaattgcatagtgctacagtactacagtgattagccataacttttccgtcatattaaatatttggacacatgtatgaagcatcaaatgtggacaaaaagaaaaactaattgcacagtccgactgtaaaattgcgagactaatcttttgagccaaattatgtcatgattagtcataagtgctacagtaacccatatgtgctaatgacggattaattaggctcaaaagattcggctcgcagtttacagtcggaatctataatttgttttgttaattagtctacgtttaatacttcaaatgtgtgtccatatatgtaaaaaaaaaattcggcatggaactaaacactgcctttgtaaagtttctacgtttctacatggaagcttctacaaaagaaaattttcatctcaaaagttgggtagaatcaagtgagatatagttcgttcgtggcaagcgctctggaatgctagaaaatcagaaagaaacgtgttaattaatattttgaaaattttagattattctcttcatcttaaaatatagaaaaaaattacaaaagcaaccctataagtcacttaaagtttgacgttccatcacataagttattttgttgtaaatgctcacccatctactcaattttatagtaaaaaacaccttaatgcgcaagtgcttaatcaaattaacccattatcgctgatgtagaactaccacatgctaagctagctgagttagtcttgtgcaagtgcttgcattagacttttcatattccattcaacattttggtgcatatagagaaactcagtgcaacaacgtttcaactctcatcagcaattctatttgtggaatctttcaaaaaaggtcaaaagtactctagaattatttaattttagtaaagatcatattgacagttcgcaatttatgaaaacatgtttattcggttaagcacagattaaacacaagttaaagacatgtttaaaggtaaagcttatcatagactcttaatccaaagacaatagaaaaatatataacatttactgcatcgaaataatttttattatctttctttccttttctctgtcctaatgcaaagtttccttctacaaatgttgagagtcaacattaagccattgttattatgcataacaattactcctaactactatccttctctttcttctatgttaagttaccttattaataactctaaaagcctgctattaattatcattgtatgtgctctaatgttgcaaatttaaacaaacagaccatgtaatatataaaataatatattagattattcatgaatgctaggggacgggatactgtaccccaataggataaccagctagcgtcatcagcgactggcaagagcctatgagaggaagcatcg

SEQ ID NO: 2669 - DNA, 2000 bp, Oryza sativa
gccatttctaacacggacggtaaccaatactgactgaaatggtcattggaaacggcagccgaaaatcttaaaaattttcgtaccgttttcaccactaatcggagccgccggatgggggggtcggcctgaccttcggaaacagtcgtgctctgaatcgcgcgtattgacatttccccctagcaactcttcagtactccacaatatcgatgcttttgagatagctactcggtgaatgagacagtccagtgatgctacctgtgagaactgagagcacaaaattcagcaacttcgttattgcgtttacgtgctaaaacgtggtgtttcctgtctctctgtctcgggtttctgccctgctgatgccaccaaagacgaccgttaaggttcgcttcgactggaacttgtactggtggtccgtcggctacacggtcaccattctgagagcaggtaaaataggtaaaatagaaggctataaaccagctataaacatattttaaaataataaagaaagagagagaagagcagcagactacatatctgtagcccagctgcagcacgaactctaaaatgtaatgtgtgtatgacaagtgagaccatgtattaatagtataataagcaactattgtatgaattagctagtagtgggttatattattaaacttgctctgagcatcgtcaatgggcatcggcaattcggcatcctgcaacctgaccagaagtgcagaaaaaaacgttggtgccgttctggtcatcatcgccagcgcggacacgcggaacgcgacgtcggccgccgttcgcctcggtggtacatgcgtccagtgcacgctggcgctcagctcctccagctcgctgcactcctctcgtagacgcggcccccggcggagaacgcgcggccggcgtcgaccacgacgtcggcgccagcagcgaggaataggaggaggcggggaggcgaggcgccatcaaggaacggcccgagcccatcatcgcaggtggcgaggatggaaggatgcagaacgggaaagaaggttgtgcttggagtgtgccaggagagctggagatgaacaagtgaggagatatgccctgcaatagtgcaatttgtcagcgggagaccgaggcgtacccggagaaatgtttggttcatgcctgcatacgtgtggagctgtgggctgggacaacatgggccaaatgggatggaatgtcagatcggggtaaaaggcctagtttcgtagacttgtggccttttgggcttacgagctttgacggccttgggaaaataggccagctgttgggttggaacttggatctggatctgaagtctggaaaggaataagttcatctgaggtcccttaactcgtcaacgaatccgattttcgtcattcagccagaaaaccagatacagtaggtccctcatctatcaaaactggtaaagataaggtccctcggcggtttagagagcagttttggctgacgtggcgtccacgtggttaatttgactcggtcttcgttacgcgtggcattgatgtggcgctttcgtggcaattctatcacagaaaaaattataaaaatcgtggccccacatgttagttacacaaaaagaaaattagaaatgttggggcccaagtgggccccacatccctctcccttctctctcttcttccctttccctctcagggcctgtttggtacagctccaactcctaaatttaactccaggagttgagtctggagtggagttgtggagctgcctaaacccagctccacaactctagttcattttgtgagagagctccacccagctccactcccagttttggtagagccgaaactgtttggctgagctccagctccagaaggggtgaagctggagctggagctgtgccaaacaggccctcactctctctcttcttcccgggagcgccggagcggacgggcgagtgggcggcggagcagcagccggcgacctcagcgaagcggcgcccttgctgccgccttccctcttcggcg

SEQ ID NO: 2670 - DNA, 2000 bp, Oryza sativa
  misc_feature (251)..(251): n = any nucleotide
  misc_feature (494)..(494): n = any nucleotide
  misc_feature (1252)..(1252): n = any nucleotide
  misc_feature (1260)..(1260): n = any nucleotide
  misc_feature (1391)..(1391): n = any nucleotide
  misc_feature (1477)..(1477): n = any nucleotide
gccggggggctgccgctcctcttctgcccactcgccggctgccgaccccctcgcaccgttgctcctgtccctccctctcgtcggccggcgcgcattgcctcctccctcgcagcgctcccgtcggacgccctctccggcagcgctgcgcgcgcagccgctaatctccctcccacccgtcggccggtgtgcgccgccgatgctctcccgccggcagctgcgtgcagctcccccctgccgctcctctccctccntcccgccggccggcatgcgtcaccgctcctctcgcgtcggaggtacgcgtggcgtccttggcgaggtcgtcgccgctccgcttgtgcctctgctctgcccgctgccgccgttgctccgctgcgaggacgagggagagcagagaggaagaagagggagagccgagagggcagggaatgacttgtagggcccacgtgggccccaccagtatttttttgtgtagctgacatgtgggcccacgtggnccctgctatttttaaatgatattttgtgtagctgacaagtgggcccacggttttattattttccaagatataattgccatgtcaatgccacgtgggacggagagctagtcaaacctgctacgtagacgccacataaaccaaaaccactgagggacccgctttggttttgatagttgagggacccgttgtatctagttttctggttgaaggatggaaatcagattcgttgacaagttaagggaccttaagtgaacttattccaaggtactttgacgcgagacgaagctgtggcccaatttgaagccggcgtgaggcccatgaaccaaccacagtttggccccattttgatggttaaaaaaggaataagttcatctaaggtcccttaacttgtcaacgaatccgatttttctctctcaaccgaaaaaccagacacaacgagtccctcaagtatcaaaaccggtgcagatgaggtccctcggcggttttgaggccagttttggatgacgtggtgcctatgtggctaatttgactcggtcttcatctgacgtggcgcttacgtagcaattcgacccgaaaaaataataaaacccgtgggacccacatgtcagtttcacacataaattaataaaaaatggtggggcccatgtgcgccccacatgtcattctcacccctcttcttcttcctcctctccctccatctccctctcttcgtctctctcccctatcctctctccaggtgcgacggagaggcagcggcncacggctnccggcgggagagaagggagcggcgcggcggtggaggcacggctccggcagctgtgggcggaagaggaaggggcggtgggagttggccctggctgcggcagacggtaggacatgagctgcacaaccgaggcncccccggcgccgactccttattgatgtcaccggcgccgccaaggctgacgaggtggacgcggtggtggtggaggaggaggaggacngcggcgcggcgcggttccatgagcggaggctggtggtggtgtttgtgctgccgtcccagccgatgtgcgccacgtgctggcggtggtggtccgccgcgccgccaccctcgccgccgccgcctagacacgtacacaacatcactaataccaaactcctaaatcaccccgcaaaaaacaatcgacaagatagagcagaagtgaagaataagcatccaagactccaaacaacgaaccttggggcttcttgccgctcttgccgccgccatcgacgacgtccacgctggatccattgcggcaggtggagaaggggatcacgatgaaccggtccatccgccgctgctccttgccactattactcatggctagctagccactgctagctaagctgatactatcttggaatcaaattgcttgccgctttggctgaacctgtactggtacgatcatttttagtaaaagaaagggttaattaagaaatggggttcttgacccttgctaaaaaaaaataatcttggaatcaaat

SEQ ID NO: 2671 - DNA, 2000 bp, Oryza sativa
  misc_feature (1693)..(1693): n = any nucleotide
tttagatttccgcttacttttccattacaagaacttcaatggtattaacaattaagtgctaatcttctatatgatgcactattcaataaattggagattatgtttgctccatttccttttcatttcatggcagacattattatatatgtactagaaagagtggtgaacatttttttttaagatttgatctattattgatttcacacagacatgcatcagctatcaggaccagttggaataattgaaatgctaattgagaactttgcatgcaccacatagtacagcaactactcaagccaagttctatttactagtgaagccatttccaacttatatcaatccatttattaggaatatgcatgtacattgtgtgtttactgagtttttacttgtagaatgtaccatcctagttatatttattttaaataaaactcccttagttgatctctgcaaattaggtggctagcttgtccttgcagtgagttgtcgtagtacaaatttgaaacagtcttcgggcttcagattttccatctacattaattatgaaaatgtcacctacatacatctcaattctaatataagttaacatttgcaagtgggagccaattaaactgtacttcagcacttatcttctttttatttatttactagctatgatttgcgacctgtgggtgagcaatcaacttcttgctgaagtgtcagagaagggtacctgaaggaacagaagatcaacactaacttaaaggctcatacatcatgtaagctaaaatcagtttgttcccatagtttgtgagataaattgcaatccttgctgcttgtaaattgtaattgaatctgttacgattgcaattatactgcttcaacataaatttctcataaaatggaactggtaatttaatattggtggattgtgagaatatcgaagctatgctacagattgaattaaatggaactacatcagttatgttattgacacttatcctgcacatttgacactgatcttcaattctgtattgaaatagtaggtgttgcatagattacttatcattaaatggagtattattataatctatatatctgacccttaatacttttgtctttctgataatctgattcaagtttttagatgctcaacttatcatggcggtcacaagatattttggagtggcatttctctacaagggaaatgccttgcctgttgtagatttgccatcgttttgtctcattttgtagattgtataggagaatttctctttttgtacaactaacctatgtacatggcatttgtaattaaatggaattggtatattcagtactagtggaatgtggatgcatgagaactgttggtggtatattcagttctagatcagtaggatttgattccatgaactatattttttttaacccaatgcagggcacactaacagaatatatgttagaaaaactgatatatgcaaactgcgtatctgtcagtaatccgttaactgtcggtaaaggaccatctgtcggtaacttccgtctgtcggtaattcatttgtaggactgtcgagttatatgtcagcaaacatttatctgtcggaaaagacctttgccggcagcacttggcctgacagaccctatctgtcgggaaaagttatgctgacaaataatttgacagcatataggtcctttcctgacagatatgtagtaagcnaacttggggcatggtgtagtgttacccgggcgaccgttcgcctacccaccaataataaagcgccacgtgtcgcaagggtaggcgaaacagtaaattcccaccgtctgagcggcacagtaaaaagcccacgaagggaaggcccaacactgttccgttcggcccgggaaaagaaaatatataaccaccactcgcaggaggcgaagcgcggcaaaataataatagccgcacaagtaacaaacttcattcgcaggaataatgtaggtttcagcaggagcatcggtcgaaagggggcgccacataccatacc

SEQ ID NO: 2672 - DNA, 2000 bp, Oryza sativa
gtctccttcctcatttagctatttgaacatgaaatactagcacagttatttttcatctgataagaaatttaatactacttatttagatgtttaaaagaagcttggcatttattttaagggcttgaagtagagctcgtattttgatgtaactctcctttaaatttattatgtgactcatgctctgttcaactaagaaacattaatcctgttgtttttctttaaagtttttttttccgaacggaacattttctttacaagttatcaatagaagcttcacactgatttacgtgaagattttggagtagtagcttagtttttttttttgacttagtggatgcattattcccaaacacggggagaagttaaactcactagctcatttatcagtgccatgtacaattgtgcaaaatattattgaagtgaagtatgtgtgtattttgtttataaactacatttgattcctctcaaacttgagaaagttgagataaagaaaaggagaaaacatttcatgtttaaatagctaaaaggagggagcatagacagttaatcctgtacgttccttacctgttggatggtggatccgtggctactgccaaagttgcagtcactcccaatccccattgcacgcctgccctgtagtgcaaatcatatcatattaatttgtttttacaattgcataattgcattgcagcgatatatacgacgaagcaaatataaaagagaccgagtcaatggtggcaacgtgatgtgcaacttggaggacgacttgtgttacatagggcttacatttgtttctttcttcatcttccttttcttttcttaaaaaaacaaacatgaggacaaagcctgcattgtcagataggtttcacactcacacctatggctatactttagtttggctatcaactctcaagtcgacgaggcacatgctatctggacttccaacttttgtcgtccgagcagaaaagaaaattattgtttgccggcgagagaagcacacagaccactatattgaatcttttttataattctcatttaatatttcattagttctctttgataattgaaaaatattgaaattgtcaagtgtcaaccattctttgataataatttgagggtgaatagccaatctagtccctcaagttttaccagacgctaaagttagtccttcaggttttattttgtacatataaatcctttaaaagtatttattttggtttaaaattattcttggacccacttaatatgccacatggatatttctagtcaacgtttctattagaaaattttccctttgcccttaatatgcatacattagaaaagagataaacaatatgaataaatagcactgcagatgtacttcctattatttcaacatgtgcacataaaggttgagcttaatggctatcatatatacacttggaagcacgtacttattttcattttacataaactactatgcattatctataaacaaattcattgcatgcaaatttcaatgaaaaaagactatgtttagctatgtggtttctaagtggatttaaaaataaatttgaactaaaatgaaaatttgaaggtatagcatggatagactaaaagattaaggactaaactgagtctgagatgaaacttggagtaccacatttgctattcatccataattttatggtttaaattggcatcgggagaataagagagagagagaaaagggtaatagttagacatgttgagattataaaagagtgtcttgattgcttcaattttgcgttaccttaccatttcttatatagttgtatagagtatattattagaatattgattgaaattttcagcctccaaacaaccccgccaacccccttcctctgtctcctataattaaacccggcggccggcgaccaccaccaccattacgacgcgcgcgacgtcgaccaaagcaagcaaccaattcctcctcctcctcctcctccctctcctcttcctcctcctccgcgtcgagcgcc

SEQ ID NO: 2673 - DNA, 708 bp, Triticum aestivum
cgagcatgagtcacgagagctcgatgttcaaccagagacgcagagcctttcgaggaggcagaaagatgcctaagaacaaactacccggcaccaatatgtgacggaggcgctgcttcctctgcttctatcctcctctgatgcaaggttgttaacgtctcctcttgcctatgggttactaaggtatttcagcggagaagaacttaaacacgagcttgacgacatcgacaacctatccgcggagaggctggacgaactgtcggggctgtttctcaaggacttcaagaatggccggctggatcaccgtggatggccagttggagggttctcggcctacaaagtgtccaaggccctgatcaatgcttacacaagaattctcgccaagaagcacacctctatgcgcctcaactgtttagatcctggctatgttaagacagacatcaatttccacaccggggttctgaccgtggaggaaggcgcgagaggccctgtgatgctggcactcatgccaaaggaagggccgacgggatcctacttcaatggcacagaacaagcagccttcatgtagcgattgcatttttcttgtgctctgggtgttatccgtaacttatgcctggtgaactacgagtatattttcttaagatgattcatgttatatatactgtactactccctcggtcctgaaattcttgtcacggtggcaattttgga

SEQ ID NO: 2674 - DNA, 1002 bp, Triticum aestivum
  misc_feature (573)..(573): n = any nucleotide
aaacctcagatctcacccatcccacgccatggacgacgacttcgacatccccgcgggcgacgacatgatgatgggagacgggatgggtgacttcggcggcgccgaagggccggggatgaaggtgggcgaggagaaggagattgggaagcaggggcttaagaagaagctgctcaaggagggcgaagggtgggacacacccgaggtcggcgacgaggtcgaagtccattacactggcaccctccttgatggtaaaaagtttgactccagccgtgatcgtgatgacactttcaagttcaagttgggacaaggtcaagtaataaagggatgggatcaaggcatcaagaccatgaagaaaggggaaaatgctcttttcaccattcctcctgaattggcttatggcgaatctggttcacctccaactattccgggcaatgccacgctgcagttcgatgttgagctgctttcttggaccagtgtcagggacattgcaaaagatggtggcatattcaagaagatattgaaggagggagataaatgggagaacccaaaggatcctgatgaagtatttgtganatatgaggctcggcttgaggatggtactgttgtgtccaagtctgagggggttgaatttactgttaaagatggacacctctgccctgcactggccaaagctgttaaaaccatgaaaaaaggagagaaggtgctcctcgcggtcaagccacagtatggatttggtgagatgggtagaccagcagctggtgagggaggtgctgtgccaccaaatgccagccttgttattgaccttgagctggtttcatggaagactgtcacagaaataggggatgataagaagatcctcaaaaaagttctcaaggagggcgaaggatatgaacgtcccaatgagggtgcagttgttacagtcaaaataactggaaaacttcaagatgggacagtattcttgaagaaggggcatgatgaacaagagccatttgaatttaagac

SEQ ID NO: 2675 - DNA, 864 bp, Triticum aestivum
cagtttccatgaaacaactcaaggtcataatatgaccagcattggtggcacagcacctccgtcgccagctgctggtctacccatctcaccaaatccatactgtggcttgaccgtgaggagcaccttctctccttttttcatggttttaacagctttggccagtgcagggcagaggtgtccatctttaacagtaaattcaaccccctcagacttggacacaatagtaccatcctcgagccgagcctcatatttcacaaatacttcatcaggatcctttgggttctcccatttatctccctccttcaatatcttcttgaatatgccaccatctttgcaaatgtccctgacactggtccaagaaagcagctcaacatcgaactgcagcgtggcattggccggaatagttgggggtgaaccagattcaccataagccaattcaggaggaatggtgaaaagtgcattttcccctttcttcatggtcttaatgccttgatcccatccctttattacttgaccttgtcccagcttgaacttgaatgtgtcatcacgatcacggctggagtcgaactttttaccatcaaggagggtgccagtgtaatggacttcgacctcgtcgccgacctcgggggtgtcccatccttcgccctccttgagcagcttcttcttaagcccctgcttcccgatctccttttcctcggccacctttcatcccgggccttcggcgccgccgaagtcacccatcccgtccccatcatatgttgtcccccgggatgtcaagtcgcgtcctggcgggcggggaaccggggtggctggggagcggaggccccaggtggctcgaggcgagccaaaaagccggggtttcgc

SEQ ID NO: 2676 - DNA, 865 bp, Triticum aestivum
ccaaaccctagcgagctcccttccgcctcccccaagacacaaacctccagatcacacccatcccacgccatggacgacgacttcgacatccccgcgggcgacgacctgatgatgggggacgggatgggtgacttcggcggcgccgaagggccaggggatgaaggttggcgagggagaaggagatcgggaagcaggggcttaagaagaagctgctcaaggagggcgaagggtgggacacccccgaggtcggcgacgaggtcgaagtccattacactggcaccctccttgatggtaaaaaatttgactccagccgtgaccgtgatgacacattcaagttcaagctgggacaaggtcaagtaataaagggatgggatcaaggcatcaagaccatgaagaaaggggaaaatgctcttttcaccattcctcctgaattggcttatggtgaatctggttcacctccaactattccggccaatgccacgctgcagttcgatgttgagctgctttcttggaccagtgtcagggacatttgcaaagatggtggcatattcaagaagatattgaaggagggagataaatgggagaacccaaaggatcctgatgaagtatttgtgaaatatgaggctcggctcgaggatggtactgttgtgtccaagtctgagggggttgaatttactgttaaagatggacacctctgccctgcactggccaaagctgttaaaaccatgaaaaaaggagagaaggtgctcctcacggtcaagccacagtatggatttggtgagatgggtagaccagcagctggcgagggaggtgctgtgccaccaaatgctggtctatgttattgaccttgagctggtttcatgga

SEQ ID NO: 2677 - DNA, 551 bp, Triticum aestivum
tttggagagagggctttcaccagtggagctcaagattgaggacatctcgtatcaacacagtgggcatgccggggtagcaggtagcgatggagagacgcatttcaatgtgcgggtggtgtccaaggagtttgaggggaagagcatgctcaagagacacagggctgtgtatgatctcctgcaggatgagctcaagagtgggctgcacgcgctgtccatcgatgcaaagacaccatctgaagtctagttaaaaccaagatggtgtcatcgacatattgcatcactgataatcagttcttgaggatgattgtaaaattactttgatgggttggtgtcttggtgatccatagcttcattgcatattgactgtaccaggttagcagcaaggacaatgagcagaggagaaagggggtctccttctctaactcctatggaactcattgagcaatatagcaggagtgccttatttgaagatcatgtgtatccaaatgagccatccagggccaaaatctttagctttgagaatatccacgatggtatccgtgctcaataag

SEQ ID NO: 2678 - DNA, 584 bp, Triticum aestivum
agtacacaagaatcacaggacggtcagtgggttcccttggcttcgcagtgcacaccgaggctaaattggggtggctcggagcttcacctgacggcgttcttggttgtgaccccgacggtgggatcctggaagtcaagtgcccatacaacaagggtaagcccgagcttgctctgccatggcgtatcgtgccatactactacatgccgcaggtgcaggggctgatggagatcatgggccgagactgggtcgacctgtactgctggacacccaacgggagcagccttttccgagtgcctcgggaccgcgcatactgggagctcatccacgacgtgctgcgcgagttctggtggggcaatgtgatgccctccagggagctggtgctgctggggaaggaggccgaggcaagatccttcgagccgcagcccaagcaccggctgacaaatctagtgatagttaagagcaggaaactagcttctgaagccaagttgttatgtagggatgttggtggtcatgtagaattcttcccataagtgtagttctggcggtggttgtacactgtattctgtttattcgttaaatgaaaa

SEQ ID NO: 2679 - DNA, 616 bp, Triticum aestivum
ctgggaaccaatcatgaaagtatgctgtagagcagtacacgagcatcacaggacgtcagttgggttcccttggctttgcagtgcacaccgaggctaagttggggtggctcggagcttcacctgacggcgttcttgggtgtgaccccgatggtgggatcctggaagtcaagtgcccgtacaacaagggtaagcccgagcttgctctgccatggcgtatcgtgccatactactacatgccacaggtgcaggggctgatggagatcatgggccgagactgggtcgacctctactgctggacccccaacgggagcagcctgttccgagtgcctcgggaccgcgcatactgggagctcatccacgatgtcctgcgtgagttctggtggggcaacgtgatgccctcccgggagctggtgctgcttgggaaggatgccgaggcgagatcttttgagccacagcccaagcaccgactgacaaatctagtgatagttaagagcaggaaactagcttctgaagccaagttgttatgtagggatgttggtggccatgtagaattcttcccatgagtgtagttctggcggtggttgtacactgtattctgtttattcgttaaatgaaa

SEQ ID NO: 2680 - DNA, 637 bp, Triticum aestivum
gatccacccatgctccatgcctgggaaccatcatgaaagcatgccgtagacagtacacgagcatcacaggacggtcagtgggttcccttggctttgcagtgcacaccgaggctaaattggggtggcctcggagcttcacctgacggcgttcttgggtgtgaccctgatggtgggatcctggaagtcaagtgcccgtacaacaagggtaagcccgagcttgctcttccatggcgtatcgtgccatactactacatgccgcaggtgcaggggctgatggagatcatgggcagagactgggtcgacctctactgctggacacccaacgggagcagcctgttccgagtgcctcgggaccgcgcatactgggagctcatccacgacgtcctgcgtgagttctggtggggcaacgtgatgccctctcgggagcttgtgctgctggggaaggaggccgaggcgagatctttcgagccgcagcccaagcaccggctgacaaatctagtgatagttaagagcaggaaactagcttctgaagccaagttgttatgtagggatgttggtggccatgtagaattcttcccatgattgtagttctggcggtggttgtgcactgtattctgtttattcgttaaatgaaatc

SEQ ID NO: 2681 - DNA, 885 bp, Triticum aestivum
cgcggcaggtcgacgtcaacggcgatccatggccgaacatctcctccggcgccaaggatcgtgtcaagaagatgctcaacatcaaccccaaggagaggctcacggccttccaagtcctcaatcacccgtggatcaaagaagacggagacgcacccgatacgccgctcgacaatgtcgttctcaacaggctcaagcaattcagggccatgaaccagttcaagaaagctgcgctgagggttatagctgggtgcttgtcggaagaggagatcagggggctcaaggagatgttcaagaacatcgacaaagataacagcggcacaatcacgctcgaagagctcaagaacgggctagcaaagcagggcacaaagctgtcagacaatgaaattgagcaactcatggaagcagctgatgcagatggcaatggattgattgactacgaggagttcgtcaccgcgacagttcacatgaacaagatgcatagagaggagcacctatacacagcattccagttcttcgacaaggataacagtgggtacataacaagagatgagctcgagcaagccttgaaggagaagggaatgtatgatgccaaagagatcaaggagatcatctcagaggctgacactgacaatgatgggaggatagattattcagaatttgtggcgatgatgaagaaaggagcaggcagcaccgagccaacgaacccaaagaagaggagagatctagttctagagtgaaacatacattttagctcaaacagggagatgtgcagcaccaccagtgcagagtgcataatggaaccctctttccagatgcttctcagcttgagctaaaaccgtggacagatttgtacaatctactcactagttgctagaggatatcact

SEQ ID NO: 2682 - DNA, 611 bp, Triticum aestivum
  misc_feature (473)..(473): n = any nucleotide
attatgcaagctcattgataggatatgagccaagtggttactcgaatgagaggcacacctggatatttagctcctgaatggttgacatcacaaatcacagaaaaggcggatgtctatagcttcggcattgtggtaatagaaatcatcaatggaagaaagaatctcgacccttcccggtccgaagagagcatgcatcttattacccttttggaaaaaaaggtgaagcatgataacttggtagatatgattgacaagaccagtaacgatatgcaagcacacgagcaagatgtcattcagatgatgaagctcgcgatgtggtgtttacaaattgattgcaaaagaaggcctaaaatgtccgaggtagtcaaggtcttggaaggtaccatgaatgcagagagcaatatagatcataactttgttgcaacgaatcaagtgaattttcgcattgctgacaatgcggcttcttcagttcnacctctagcctcacatgtatcaggccccaggtgaaatgaggcaatcctgacaagataggcaattagattatgagctggacaggagattttcttaagaatagcaaaagccatgatctgttgtattttgtcaaacaacaa

SEQ ID NO: 2683 - DNA, 751 bp, Triticum aestivum
gagactcatggatatgtcaggaagaagtttcttctcctttcaacaatccctgtcttgatagtagcgctagctgtcttggttttagtgaatgttctggatgtcggaaccatggtgcacgctgcgctctcaacgatcagcgtcatcgtctatttctgcttcttcgtcatggggtttgggcctatcccaaatattctctgcgcggagattttccccacctctgtccgtggcatctgcatagccatctgcgcgctaaccttctggatcggcgacatcatcgtgacatacactctccccgtgatgctcaatgccattggtctcgctggagtcttcggcatatatgccatcgtttgtgtactagcctttgtattcgtctacatgaaggtccctgagacaaagggcatgcccctggaggtcatcaccgagttcttctctgtcggggcaaagcagggcaaggaagccacggactagttgctctgatccggtgatccgcgtcgctggtggtaattttgtggtgtcataactactactacactggttaacctgcgatgctttggtgaagaaacttcaaagagagcagatacggaagactttacatcgtgaggctgaattgtgtcgtcgtaggccggcttttggaagtaggatatgtacttagatcatctgctcttttcgctttggaactttctatttgtgttattcagaatttcttgcccatgtaactagtgctgttatcacaatttatcgtcgattatgt

SEQ ID NO: 2684 - DNA, 778 bp, Triticum aestivum
ctcctttcgacaatgcctgtcttgatagtagcactagctgtcttggttttggtgaatgttctggatgtcggaaccatggtgcacgccgcgctctcaacgatcagcgtcatcgtctatttctgcttcttcgtcatggggtttgggcctatcccaaatattctctgcgcggagattttccccacctccgtccgtggcatctgcatagccatctgcgcgctaaccttctggatcggcgacatcatcgtgacctacactctccccgtgatgctcaacgccatcggtctcgctggagtcttcggaatatatgctgtcgtttgcatactggcctttgtattcgtctacatgaaggtccctgagacaaagggcatgcccctggaggtcatcaccgagttcttctctgtcggggcaaagcagggcaaggaagccacggactagttgctctgatctggtgatccgcgtcgctggtggtaattttgtggtgtcataactactactacactggttaacctgcgatgctttggtgaagaaacttcaaagagagcagatacggaagactttacatcgtgaggctgaatcgtgtcgtcgtaggccagcttttggaagtaggatatgtacttagatcatctgttcttttcgctttggaactttctatttgtgttattcagaatttcttgcccatgtaactagtgctgttatcacaatttatgtcgtttatgtttttgtcttgctcggtcgattcagtttatcctttttgttgccactagttctcagttgccag

SEQ ID NO: 2685 - DNA, 659 bp, Triticum aestivum
ggtgaatgttctggatgttggaaccatggtgcacgccgcgctctcaacgatcagcgtcatcgtctatttctgcttcttcgtcatggggtttgggcctatcccaaatattctctgcgcggagattttccccacctctgtccgtggcatctgcatagccatctgcgcgctaaccttctggatcggcgacatcatcgtgacatacactctccccgtgatgctcaacgccatcggtctcgctggagtcttcggcatatatgccatcgtttgcatactagcctttgtattcgtctacatgaaggtccctgagacaaagggcatgcccctggaggtcatcaccgagttcttctctgtcggggcaaagcagggcaaggaagccacggactagttgctctgatccggtgatccgcgtcgctggtggtaattttgtggtgtcataactactactacactggttaacctgcgatgctttggtgaagaaacttcaaagagagcagatacggaagactttacatcgtgaggctgaatcgtgtcgtcgtaggccggcttttggaagtaggatatgtacttagatcatctgttcttttcgctttggaactttctatttgtgttattcagaatttcttgcccatgtaactagtgctgttatcacaatttatgtt

SEQ ID NO: 2686 - DNA, 619 bp, Triticum aestivum
aaatgtttatgaacatggacacagacaacagtgggacaatcacatatgaggaactcaaagcaggactagccaaacttggatcgaagctctcagaagctgaagtaaagcagttgatggatgcggctgatgtggatggcaatggatcaattgactacgttgagttcataacagcaaccatgcatagacacaagctcgaaagagacgagcatttgttcaaggcgttccagtactttgacaaagacaacagtggcttcatcacaagagatgaactggagactgctttgattgagcatgaaatgggcgatgcggataccataaaggacatcatatcagaagtcgacacagataatgatgggaggattaactacgaggaattctgcgctatgatgagaggagggatgcagcagccaataaggctcaagtagtctttccttagaaatggtgtaccattagcaactgttcttggttccttttttcgctgctgcacggatgagaagttctctttggcgttgttgagatgattgtgtatatcttgtggccttttgctcgtgcatgttgttcctctagtgttttggacctactttcttctgcaagctggtttttgcaagtacatctaata

SEQ ID NO: 2687 - DNA, 498 bp, Triticum aestivum
ccaacccaaagcccgtattttccctgtcacaaaacaatgagttgcagtactgtaatgaggtggcttcagagctgaaatcgagaggtatccgcgccgaggtatgccacggtgaacgtctgccgaagttaatcagaaacgccgaaacacaaaaggtgccgctcatggcggtcgttggccccaaagaagtcgaggccaggacgctcaccatcaggtcccggcataacggggagatgggcaccatgcccgtcgacgatttcatcagcaaaatccaatcggccgttgctgacaaatcttccctgtagatatcccagtctgttaaaacttcagttcatatcgtagagcagtagatcttctgctgcacatacaccgtacagcgcccaccggagtgcttccgacgaaaccgagcgacggaggtccaacaattttgtgcagaattgccatcacgacacactatatagtcagcaacagaagcccagcattcttgattgtacatagatt

SEQ ID NO: 2688 - DNA, 727 bp, Triticum aestivum
gatatagtcactatggcaaagggcatagggaacggaataccggataggagcggtcgttaccacacctgagattgctaaggtgttaacccgcaggagctacttcaacaccttcggtggtaaccctgtcagcacagctgccggccacgctgttctcaaggtactggagaaggagaagctgcaggagaatgcgttcgttgttggctcctacctgaaggagaaacttaacgctctgaaagagaagcatgacattatcggcgacgttagggggaaaggcctccttctcggggtcgagctggtgaccgatcgccagaagaaaactccggcgaaagctgagatcgcgcaggtcatgaaccacatgaaagatatgggcgtgctggtggggaagggcggtttcttcggcaatgtgttcagggtgacgcctccgttgtgcttctccaaggaggactccgacttcatgatcgaggtgatggacatcgcgctttcgaagctgtgaagaggcactgctctcatcgataaataagagatgatctgcgaaacagcacctcgttgtctcgtgttctgtcttgcaaacccatgatgcgcacatgcgatctgcgcctcctgaacattagtatgatgtactgagtaggagctctatgtgaccaataagttcttcgtaataagatattcagatgtgttatggcagcttttatgatacatgtatcctgcattcttcctgctatccaga

SEQ ID NO: 2689 - DNA, 780 bp, Triticum aestivum
ggtagcgcgcactgggagccacttcggggattcgaagggcagggtgtcatcctgatatagtcaccatggcaaagggcatagggaacggaataccgataggagcggttgttaccacacctgagatcgctaaggtgttaacccgcaggagctacttcaacaccttcggtggtaaccctgtcagcacagctgccggccatgctgttctcaaggtactggagaaggagaagctgcaggagaatgcgttcgttgttggctcctacctgaaggagaagcttaacgctctgaaagagaagcatgacattatcggcgatgttagggggaaaggcctccttctcggggttgagctggtgaccgatcgccagaagaaaactccggcgaaagctgagatcgcgcaggtcatgaaccacatgaaagatatgggcgtgctggtggggaagggcggtttcttcggcaatgtgttcagggtgacgcctccgttgtgcttctccaaggaggactccgacttcatgatcgaggtgatggacatcgcgctgtcgaagctgtgaagaggcactgctctcatcgataaataagagacgatctgcgaaacagcacctcgttgtctcgtgttctgtcttgcaaatccatgatgcgcacatgcgatctgcgcctcctgaacattagtatgatgtactgagtaggagctctatgtgaccaataagttcttcgtaataagatattcagatgagttatagcagcttttatgatacatgtatcctgcgttcttcctgctatccagaa

SEQ ID NO: 2690 - DNA, 913 bp, Triticum aestivum
ataggagcggtcgttaccacacctgagattgctaaggtgttaacccgcagaagctacttcaacaccttcggtggtaaccctgtcagcacagctgccggccacgctgttctcaaggtactggagaaggagaagctgcaggagaatgcgttcgttgttggctcctacctgaaggagaaacttaacgctctgaaagagaagcatgacattatcggcgacgttagggggaaaggcctccttctcggggttgagctggtgaccgatcgccagaagaaaactccggcgaaagctgagatcgcgcaggtcatgaaccacatgaaagatatgggcgtgctggtggggaagggcggtttcttcggcaatgtgttcagggtgacgcctccgttgtgcttctccaaggaggactccgactacatgatcgaggtgatggacattgcgctgtcgaagctgtgaagaggcactgctctcatcgataaataagagacgatctgcgaaacagcacctcgttgtctcgtgttctgtcttgcaaacccatgatgcgcacatgcgatctgcgcctcctgaacattagtatgatgtgctgagtaggagctctatgtgaccaataagttcttcgtaataagatattcagatgtgctatggcagcttttatgatacatgtatcctgcgttcttcatgctatccagaaaacaaagcattgccacatttacttgtcagaattccaggtgattcaaaagaataatatgaactgaccattaacatcctaagcaaaaatgtttgataatcaaccggatatggaacattactgtggttaaattacagccatagctaggccttttcaggaagatggtgttattgagggacagaaagaacttgtatatttacattactaagtttttcaagttgttataaaggc

SEQ ID NO: 2691 - DNA, 568 bp, Triticum aestivum
ggatacagaatcttggtggagaaccagccagtgtacattcacccaagcagtgcgctgttccagcgccaaccagattgggtcatttaccacgagcttgtaatgacgaccaaggagtatatgagggaggtgaccgtggttgacccgaaatggttagtggagttagcgccaagattctacaagggtgcagatccaaccaagatgagcaagaggaagcgacaggaaaggattgagcctctgtacgacaggtaccacgagcccaactcatggcgtctcagcaagcgccgagcttgatggtccatcataataccctaccacaagttttggcggaactgtaaatatttgtgctctgctcctagacactgttgcactaggtatttttacctaccggagtctagtcctggataccgttttatcttgagactagttgtatggatatttacacttcagcgcgcgaccattaatgggtgattcagtttttccagtttcggataatttagataatgaaatttgtaactaccaaacgttcggattttgtgattagatccggacgaactggatcaccatcgga

SEQ ID NO: 2692 - DNA, 1067 bp, Triticum aestivum
aagccagtgatatatcgggatttcaaacgttcaaatattcttttggatgcggaatacaatgcaaactctctgattttggacttggcgaaagatgtccctgagggtgataagacacatgtctctactcgggtcatgggaacatacggatatgcagctcctgagtatgttatgacaggtcacctgacatcaaagagcgatgtatacagttttggagtggtgctactagagatgatgtcgggcagaaggtcaatggacaagaacaggccaaatggggagcacaatctggttgaatgggcacgcccttatcttggagaaagaaggcgattctataggcttgtagatccccgtctagagggaaatttctccataaaaggcgctcagaagacggctcagctggcacatgcttgccttagccgggatcccaaggctaggcctctcatgagccaagtggtggaagttctcaagcctcttccaaacctgaaagacatggctagctcctcctacttcttccagtccatgcgccaagagcgtgccgcaagccttggcaacccaaatggtagccaaagcatgaaggcacagagcacctttgcacggaacggagtgcagccaatgaggagcctctcctacggtccgcacgcttctccgtaccgtcagtctccaaggcccaacgacaaacagccctaagactcacctgttcatcatgactggttcaatgttgggttctcgtcgagcactgatgggtaaatggcgcgtgcattggctgtggcctccgttgccgtggatagacagatgccctcaaggatgattagaattccgcagtgaagatttcttctcgttgcttagctttttagctgcttctgtatctattactctgggaacattgacttgggagggggaatcagacagggttctgtttgccatttgaacaatgctcagatggatgcttagaaactcccctgattggagaatcaaccatcggcacaggaagaagagcctggtgcatgtatggctctcccgtttcttattcagagcagatttttttacttgttaaagaaaaatcaaagaca

SEQ ID NO: 2693 - DNA, 657 bp, Triticum aestivum
tcgtgactgaggaatgaccacaaggatgttacaagcaaaattgagaagaatctggaagttttacactctacaaaattaacaagaaatgagcaatcaatcccaagaagttctggtatatcagctccactgcatggtggattgtctcaaaatgatcctatggaagaggatgtggtaaccagacttccttttgccataattgatgacattgcagatggttctcctgctgctttggatggcttgctgcttggggatgagatagtgaagtttgggagtgtagaggctggtggcagactgcaagaaaggcttgtttctgaagccgtttccaatgaggataatcaagtatctctactcatcattcgtcagggatcaccaatgaacttgacaatcacaccaagaaagtggcatggaagaggacttatggggtgccatttccgaatcttatgaagggccggtctatatattcaactgaagaatggcgtgctttcacgtctgcacttgtgctgacagctcttgccgctcaacgtttcaatcgagtcgaagtaaactgataacctgaatgcctgtacttactttacctgtagctgcgcttaaagtacatgccacttgtggaacctgtagttgccttggttacagctttatttggtacattcctatagc

SEQ ID NO: 2694 - DNA, 979 bp, Triticum aestivum
gggaggagtccatggagatgagcggccttcgagctgtggaagcacgagaagccccccaagatcttccccatgcccccgccgctgccgccgctgctggcggcggccggggcggggggctacgacgaggccacgctcgtgccgccgctcaacttcgccatggtcgacgacggcatctaccgctccggcttcccggccgccgccaacttccgcttcctcaagtccctcaacctccgctccgttgtgtacctctgcccggagccgtacccggagaccaacacggagttcctcgagaagaacggaatcaagctccaccagttcggaattgagggccgcaaggaaccattcgtcgagatacccgatgagaaaatccgggaggcacttaaagttgtcctagatgtaagaaatcaacctttgcttattcactgcaagagaggcaagcaccgaactggatgcgtcgtcggttgcatgaggaagttgcagaaatggtgcctgtcttcggtcttcgatgagtaccagcgcttcgctgctgcaaaagtgaggagcaccgacctgagattcatggagctgttcgacgtctcgagcttgaagcacctgaccaactcacattgttaaccaagggcgagtgatcgctcgccccgccgtcctccctgattctagtacatccctccggcggtcactggaccgaatcagcagtgaataatttttggaacccgtagaatgaatccatgagatagtgacgagacctctgcaaaaaaagaagattgaagaagaacttgagagctctattttttccctgctcaggtccctgcagatcctaagaaccagaaagttgtgggtaggattgcaagaggttttctttttcttcggttactcttgcgatgaattcaacattgttttcgggtactgaagctctgtactcgagcagcattgctaggcagagagcttggctcttctttacatgaatgcatctaaattgatc

SEQ ID NO: 2695 - DNA, 873 bp, Triticum aestivum
gtacccggagaccaacacggagttcctcgagaagaacggaatcaagctccaccagttcggaattgagggcccgcaaggaaccattcgttgagatacccgatgagaaaatccgggaggcgcttaaagttgtcctagatgtaagaaatcagccattgcttattcactgcaagagaggcaagcaccgaactggatgtgtcgtcggttgcatgaggaagttgcagaaatggtgcctgtcttcggtcttcgatgagtaccagcgcttcgccgctgcgaaagtgaggagcaccgacctgagattcatggagctgttcgacgtctcgagcttgaagcacctgaccaactcacattgttaacccagggcgagtgatcgctcgcccccgacgtcctcccagattctagtacatctccatgctgtcctccggcggtcactgaaccgaatcagcagtgaataacttttggaacccgtagaatgaatccatgagatagtggcgagacctctgcaaaaaagaagattgaagaagaacttgagagctctatttttcccctgctcaggtccctgcagatcctaagaaccagaaagttgtgggtaggattgcaagaggttttctttttcttcggttactcttgcgatgaattcaccattgttttcgggtactgaagctctgtactcgagcagcattgctaggcagagagcttggctcttctttgcatgaatgcatctaaattaatcagaggcttttggcatggcatgcgactaattgggctggcattggcacacatagaacttaatgagtaatgagcgtatgaatggcggatgatactaacatgtactcccaccgttcgtaaatataagtctttttagagatttcaata

SEQ ID NO: 2696 - DNA, 1135 bp, Triticum aestivum
atcacgcacacaaagcacacccatctcgtgggggattttacggttctgcccctgtccctgcccccgtgcgcgaccgggcgccatcatgaagctggaaatcatgcccaggcagagggccctggaggcggggcagcgggaggaggccatggagatgagcggcctcgagctgtggaagcacgagaagccccccaagatcttccccatgcccccgccgctgccgccgctgctggcggcggccggggcggggggctacgacgaggccacgctcgtgccgccgctcaacttcgccatggtcgacgacggcatctaccgctccggcttcccggccgccgctaacttccgcttcctcaagtccctcaacctccgctccatcgtgtacctctgcccggagccgtacccggagattaacacggagttcctcgagaagaacggaatcaagctccaccagtttggaatcgagggccgcaaggaaccattcgtcgagatacccgatgagaaaatccgggaggcgcttaaagttgtcctagatgtaagaaatcagccattacttattcactgcaagagaggcaagcaccgaactggatgcgtcgtcggttgcatgaggaagttgcagaaatggtgcctgtcttcagtcttcgacgagtaccagcgcttcgccgctgcgaaagtgaggagcaccgacctgagattcatggagctgttcgacgtcgcgagcttgaagcacctgaccaactcacattgttaaccaagggcgagtgatcgctcgcccccgtcgtcctcccagattctagtacatctccatgctgtcctccggcggtcactgaaccgaatcagcagtgaataatttttggaacccgtagaatgaatccatgagatagtgacaagacctctgcaaaaaagaagattgaagaagaacttgagagctctattttttccctgctcaggtccctgcagatcctaagaaccagaaagttgtgggtaggattgcaagaggttttctttttcttcggttactcttgcgatgaattcaccattgttttcgggtactgaagctctgtactcgagcagcattgctaggcagagagcttggctcttctttgcatgaatgcatctatattaatcagaggcttttggc

SEQ ID NO: 2697 - DNA, 564 bp, Triticum aestivum
cataaggttgaatgtctacagctttgggattgtcttgtgggagctttataactggcatgcttcctttcacaaacatgacagctgttcaggcggcttttgctgttgtaaataagggtgctcgtccagcaatcccacatgactgcctgccttccctaacccacatcatgacgcgctgttgggatgcaaacgctgaagttcgcccaccattcaccgagatcgtctgcatgcttgagaacgccgagatggaggttgtgagccatgtccgtaaagcacgcttccgctgctgcgttgctgaacccatgaccaccgactgaaactaaagcaggttagactatcgcagcgggcattagggaagaaaacaggtaaggatgaagaaaagaggcaatgccaatgtgttcatcgttgtcagtgggtggggtctgtgtgcctttaccagtgcgcattctgtcttgtgtaagttgcacacctcaagtaaaagtaatttcgtatagatgttgccttgtatgctaacaaagaccaaatggagcttttccgtgttaataatatccgcttgctcttgtactc

SEQ ID NO: 2698 - DNA, 698 bp, Triticum aestivum
aattgcagcagacagatccactaagactgctgactttggtgttgctcgaattgaagtgaaaacagaggggatgacaccagagacaggaacctaccgctggatggcaccggaaatgatccagcacaggccttatgatcataaagttgatgtctatagcttcgggatcgttttgtgggagcttataactggcatgcttcctttcacaaacatgacagctgttcaggcggcttttgctgttgtaaataagggtgctcgtccagcaatcccacatgactgcctgccttccctaacccacatcatgacgcgctgttgggatgcaaaccctgaagttcgcccaccattcaccgagatcgtctgcatgcttgagaacgccgagatggaggtcgtgagccatgtccgtaaagcacgcttccgctgctgcgtcgctgaacccatgaccaccgactgaaactaaagcaggttagactatcgcagcgggcattagggaagaaaacaggtaaggatgaagaaaagaggcaatgccattgtgttcatcgttgccggtgcgtggggtctgtgtgcctttaccagtgcgcattctgtcttgtgtaagttgcacacctcaagtaaaagtaatgtcgtatagatgttgccttgtatgctaacaggacctaatggagcttttccgtgttaataatatccgcttgctcttctacttg

SEQ ID NO: 2699 - DNA, 696 bp, Triticum aestivum
acagacagatccattaagatttgctgactttggagttgctcgaattgaagtgaaaaacagagggggatgacaccagagacaggaactaccgctggatggcaccggaaatgatccagcacaggccttatgatcataaggttgatgtctacagctttgggattgtcttgtgggagcttataactggcatgcttcctttcacaaacatgacagctgttcaggcggcttttgctgttgtaaataagggtgctcgtccagcgatcccacatgactgcctgccttccctaacccacatcatgacgcgctgttgggatgcaaaccctgaagttcgcccaccattcaccgagatcgtctgcatgcttgagaacgccgagatggaggtcgtgagccatgtccgtaaagcgcgcttccgctgctgcgttgctgaacccatgaccaccgactgaaactaaagcaggttagactatcgcagcgggcattagggaagaaaacaggtaaggatgaagaaaagaggcaatgccaatgtgttcatcgttgtcagtgcgtggggtctgtgtgcctttaccagtgcgcattctgtcttgtgtaagttgcacacctcaagtaaaagtaatttcgtatagatgttgccttgtatgctaacaaagacctaatggagcttttccgtgttaataatatccgcttgctcttgtactcgtg

SEQ ID NO: 2700 - DNA, 649 bp, Triticum aestivum
  misc_feature (61)..(61): n = any nucleotide
gagctcatggttatttgattgatcagttcttaaaggaccaagtcaatgatcgcactgacanatatggtgggagcttagagaatcgctgccgctttgcattggaagtagttcaagctgtagtcgatgaagttggagctgataaggttgggataaggctctctccgtttgcgaactattcagaggcatccgactcaaacccagaagctctaggcctatacatggcacatgcactaaacaaatttggaattctctattgtcacatggtggaaccacggatggtgaatattggtgaaaagtttgaaactccccatagtcttcgccccataagggatgcttttaagggaacatttattgtagctgggggatacgacagggatgatggaaataaagcaatcgccgacggctatgctgatttggtagcatatgggcgcttgtttttatccaatcctgacttgcctcggaggtttgaaataggtgctcctctcaacaagtacataagagatactttctacctctctgatccagttattggttacactgactacccatttctgccgtccgatgtctagatgggcctttcaggaatgaatccccaccccatcagatcgtctacctcatgtatcagtactatgttcacggaatacggtca

SEQ ID NO: 2701 - DNA, 783 bp, Triticum aestivum
ttgtaatcaacgatttagggctgctgctagaaatgcaattgaagccggatttgatggtgttgaaatccatggagctcatggttatttgattgatcagttcttaaaggaccaagtcaatgatcgcactgacaaatatggtgggagcttagagaatcgctgccgctttgcattggaagtagttcaagctgtagttgatgaagttggagctgataaggttgggataaggctctctccgtttgcaaactattcagaggcatccgactcaaacccagaagctctaggcctatacatggcacatgcactaaacaaatttggaattctctattgtcacatggtggaaccacggatggtgaatattggtgagaagtttgaaactccccatagtcttcgccccataagggatgcttttaaaggaacatttattgtagctgggggatacgacagggatgatggaaataaagcaatcgccgatgactatgctgatttggtagcatatgggcgcttgtttttatccaatcctgacttgcctcggaggtttgaaataggtgctcctctcaacaagtacataagagatactttctacctctctgatccagttattggatacactgattacccatttctgccgtccgatgtctagatgggcctttcaggaatgaatccccaccccatcagatcatctacctcatgtatcagtactatgttaaaggaataaggtcattgatttcatgctcatgtgtatcggcacggtatggataaaatatgtaatcatcattgcattta

SEQ ID NO: 2702 - DNA, 855 bp, Triticum aestivum
  misc_feature (36)..(36): n = any nucleotide
agagctcagttgtcgcacagacacagtaatcctctnttgagcctggcatactgttgccactcatgctcacaagataaacagtgacaacgacctgcggaccaagctgcaggagctgggctctatgacccaaatgcaggatccgccattactactccttgagaacgagtcatatcagttgtgcctcactatcctccagaatatattcttggacagagctccagatgaagggagcttagaggtcgaaacccaccttgttggactttgcaaggaggttcttgaggtatacttgagcacagcaaggcctgctcacctttctggtggtatacagccgcttggtcattggcttattccggtcggttcgtcaaagcggagggagcttgcagccagggcaccgcttgttgtgtcaacattgcaagctatcagcggtctcggcgactcatcgttcgagaagaaccttggccagttcttccccctactagctggtctcatcagctgtgagcatggttcaggtgaagtgcaggtggccttgagtgatatgtttagcacttgggttggcccaatcgtgcttcagtcatgttgatgctgaagcaccctgtgatatagtatacctccacatgtaagttattctttgttccagacttccagtgtcatatctttctgttgctccgtttccccccattttgttgtgttcattattttagtcgttgtgggaagtggtgtcttgagccgaactgatcatgtagatcctttccccttttatgctcttggttttctgcattgggagcgtgtatgtacaagatgattaaattatatgccttagtatatagttcaccaagttattgggcagttcgttct

SEQ ID NO: 2703 - DNA, 642 bp, Triticum aestivum
atcatgtggacaactgctgtatgcagcttgtgcaaaacctgaacagtttgatgttatggtcaccccaaatctttatggcaatctggtgtctaatgtggctgcaggtattgctggaggcacgggtgtcatgcctggaggcaatgttggtcaggaccatgccatctttgagcagggcgcttctgcaggaaatgtgggaaatgacaagattgtgcaacagaagaaagctaacccagttgctctgtttctctcgtccgccatgatgctgaggcatttgcagttcccgtcatttgccgaccggctggaatcagcagtgaagagtgtcattgcagaaggcaaatacaggaccagggatttgggcggcaccagcaccacccaggaagtcacggatgcagtaatcgccaaacttgattagccgcaaattgcgtgcttttcgagactagtttttttgcgcccctcggactaggccgttagtccggactgattttcgtttattgtagctttagattgtcattttgttcagcgaatcactgtaaatcttccggtgcgttctttctggttttgcttcagaataatttgagcaactcaccagaaacttgccaagttataactggaaataagatcgaaaatataaagaaacgatct

SEQ ID NO: 2704 - DNA, 687 bp, Triticum aestivum
tgccgtgaggttgcgacgaagtatcctggaattcaatatagtgaaatcatttgtggacaactgctgtatgcagcttgttgcaaaacctgaacagtttgatgttatggtcaccccaaatctttatggcaatctggtgtctaatgtggctgcaggtattgctggaggcacgggtgtcatgcctggaggcaatgttggtcaggaccatgccatctttgagcagggcgcttctgcaggaaatgtgggaaatgacaagattgtgcaacagaagaaagctaacccagttgctctgtttctctcgtccgccatgatgctgaggcatttgcagttcccgtcattcgccgaccggctggaatcagcagtgaagagtgtcattgcagaaggcaaatacaggaccagggatttgggcggcaccagcaccacccaggaagtcacggatgcagtaatcgccaaacttgattagccgccaattgcgtgcttttcgagactagtttttttgcgcccctcggactaggccgttagtctggactgattttctttaattgtagctttagattgtcattttgttcagcgaaccactgtaaatcttcgggtgcgttctttctggttttgcttcagaataatttgagcaactcaccagaaacttgccaagttatataactggaaataagattgaaaatatcaagaaac

SEQ ID NO: 2705 - DNA, 795 bp, Triticum aestivum
  misc_feature (4)..(4): n = any nucleotide
  misc_feature (6)..(6): n = any nucleotide
  misc_feature (18)..(18): n = any nucleotide
gcgntnaatgtacatatncattcctatcaatacagattggacagctgtccacagttcctccgaagcaaagaagcctggaactagccagggagtatgcacataacaaacttagtctacccaaagaggtgttccagggtggctttatccttgagaagatcgatggtccactgtctacaggccatcttgtccttgcagacactgatgtcaagaacaacccggcagttactttcaactatttcagccatccacaagatctcagccgttgtgtctatggcatcaagaccattgagaaaatattgaagacaaacagtttcgctcatctgactcctgatgatgatgctggatatgaaatagaaagggtgctcaacatgagcgtgcgggctaacgtgaatctgatacccaagcataccaataccacagaatccctggagcaattttgcaaggacacggtaatcaccatctggcactaccatggtgggtgccatgtagggaaggtggtcgaccagcagcaccgagtgcttggagtctcagggctccgggttgttgatggctcaacgttctctaggtcaccagggaccaaccctcaagccacggtcatgatgatgggcaggtactttggagtgaagatcttaaggcagcggctaggacgagcagctggggtgtagtagattcctgaacacctgccttttatgatgtgtgtgtgacctagaaaagaaatcactaatttttgctgggatccagtgtgaatcaccaatgtaagacattctaggagtttcatctgtacccagtaactat

SEQ ID NO: 2706 - DNA, 730 bp, Triticum aestivum
cccaaagaggtgttccaaggtggttttatccttgagaagatcgatggtccactgtctacaggccatcttgtcgttgcagacactgatgtcaagaacaacccggcggttactttcaactatttcgagccatccacaagatctcagccgttgtgtctatggcatcaagaccattgagaaaatattgaagacaaatagtttcgctcatctgactcctgatgatgctggatatgaaatggaaagggtgctcaacatgagcgtgcgggctaacgtgaatctgatacccaagcataccaataccacagaatccctggagcaattttgcaaggacacggtaatcaccatctggcactaccatggtgggtgtcatgtagggaaggtggtcgaccagcagcaccgagtgcttggagtctcagggctccgcgttgttgatggctcaacattttctaggtcaccagggaccaaccctcaagccacggtcatgatgatgggcaggtactttggagtgaagatcttaagggaacggctaggacgagcagctggagtgtagtagattcctaaacacctgccttttatgatgtgtgtgtgacgtagaaaagaaatcactaatttttgctgggatccagtgggaatcaccaatgtaagacattctaggagtttcatctgtacccagtaactatttgtcgcgtatgatattgcccattaaattgttactcaactcatcttgagcgct

SEQ ID NO: 2707 - DNA, 524 bp, Triticum aestivum
  misc_feature (49)..(49): n = any nucleotide
  misc_feature (496)..(496): n = any nucleotide
cacacgaaattcatcagcaacctcgcggatggatatggtacatggtgtngcgagagaggtgttcagctctcaggagggcagaagcaacgcattgcagtggcccgtgccatcttgaagaacccagtaatcttgctactggatgaggctacaagtgcattggacagccagtccgaaaaggttgtacaggaagcacttgagagagtgatggtcagcaggacaagtttggtcgtggcacacaggctcagcacaatccaaaactgtgaccttattgccgtgctaggaattattgtggaaaagggcacacactcgtccctcatgtcaaagggttcctcgggaacatattataacttagttagtttgcaacaagggggcgaccaacactaatatttgcatgatctaccatacatcagtctttttcaaaattttaccttttttagatcttttcgaattagaactgcaagcaagaatgataaacagatcactgtaagctattttncctcccgttgttgtatccgtatatacaa

SEQ ID NO: 2708 - DNA, 686 bp, Triticum aestivum
acaatgcccataatgatgtcaagcctggcatgttcttgtaacccgccgaaaaaggaaagcacctcttgcaacttggatggattttgggagttcgcggcctgcaaagaaatcaaattcgttctcgttctgaagcattacggttgcaggaatgggctgccgagcattgctctgcaccttttcgcgcacctgaattgtgggactgcccaagtcatgctgatatcgatgagaggacagacatttggtcgctaggttgcactctttatgcgatcatgtatggtgtttctccctttgagtatgctcttggtgaatctggaggaagcttgcagctggccattatgaacgctcagttgaagtggccagcgctaccgagcgctccctaccctgacgcacttcacaagtttgttacctggatgcttcagccacagcccgagatgcgccctcacatcaatgacatacgtctccacgttgacaagcttgtggagaaatactctccttaaagccagcttgcatattctgttctgactcgtttcttccttatacgattgcaaaaggggacatgttgtaagactcatgctctaggccttttcatcctttggaataggctcagtgtcaattctttatgtaactttcaggctgttaccgatatgtcgttctctaactcttgggaactatattagtcgcttatc

SEQ ID NO: 2709 - DNA, 697 bp, Triticum aestivum
  misc_feature (551)..(574): n = any nucleotide
cgggctgtccatcaccggcctgcgcttcttcacggtgtacgggccctgggggcggccggacatggcctacttctccttcaccccgcaacatcctgcaggggaagcccatcacggtgtaccggggcaagaaccacgtggacctcgcccgcgacttcacctacatcgacgacatcgtcaagggctgcctggggtcgctggacacggccggcaggagcacgggcaccggcggcaagaagcgcgggccggcgccgtaccggatcttcaacctgggcaacacctcccccgtgacggtgcccaccctggtggccatcctggagaagcacctccgggtgaaggcgaggaagcacgtggtggagatgcccggcaacggcgacgtgcccttcacccacgccaacatctcgctcgcccggcagcagctcgggtacaagcccgccaccaacctcgacgccggcctcaagaagttcgtcaagtggtacctctcctactacggctacacccggggatccaagaacttgtgaccgccggcctgcgccccgccgcgccgcccgaannnnnnnnnnnnnnnnnnnnnnnnaacccgtgctgattctttatttggatctccttctccgaccactcccggatcaaacatttttagtcccatggatgatggataggatggatcgtacgccgaacaataacagcattcttgtcatca

SEQ ID NO: 2710 - DNA, 765 bp, Triticum aestivum
  misc_feature (97)..(97): n = any nucleotide
acgcggccaccaagaaggccggcgaggagatcacccactcgtacaaccacatctacgggctctccatcaccggcctgcgcttcttcacggtgtacgngccctgggggcggccggacatggcctacttctccttcacccgcaacatcctgcaggggaagcccatcacgttgtaccggggcaagaaccacgtggacctcgcccgcgacttcacctacatcgacgacatcgtcaagggctgcctggggtcgctggacacggccggcgggagcacgggcaccggcggcaagaagcgcgggccggcgccgtaccggatcttcaacctgggcaacacgtccccggtgacggtgcccaccctggtggccatcctggagaagcacctccgggtgaaggcgaggaagcacgtggtggagatgcccggcaacggcgacgtgcccttcacccacgccaacatctcgctcgcccggcagcagctcgggtacaagcccgccaccaacctcgacgccggcctcaagaagttcgtcaagtggtacctctcctactacggctacacccggggatccaagaacttgtgaccgctccgccgcgccgccggaattcttctcctcccccaacccctcctgctgattctttatttccgaccactcccggatcaaacattttcagtcccatggatggatgatggatggatggatcgtcgtcgaacattaacagcattcttgtctcgattctttttggggaaatacgttttatggtgttctccgatca

SEQ ID NO: 2711 - DNA, 666 bp, Triticum aestivum
cgcttacgcggcgaccaagaggccggcgaggagatcacccactcgtacaaccacatctacgggctgtccatcaccggcctgcgcttcttcacggtgtacggtccgtgggggcggccgggacatggcctacttctccttcactcgcaacatcctgcaggggaagcccatcacggtgtaccggggtaagaaccacgtggacctcgcccgcgacttcacctacatcgacgacatcgtcaagggctgcctggggtcgctggacacggcgggcaggagcacgggcaccggcggcaagaagcgcgggccggcgccgtaccggatcttcaacctgggcaacacgtccccggtgacggtgcccaccctggtggccatcctggagaagcacctccgcgtgaaggcgaggaagcacgtggtggagatgcccggcaacggcgacgtgcccttcacccacgccaacatctcgctcgcccggcagcagctcgggtacaagcccgccaccaacctcgacgccggcctcaagaagttcgtcaagtggtacctctcctactacggctacacccggggatccaagaacttgtgaccgctccgccgcgccgccggaattcttccccaaccccccctgctgattctttatttccgaccactcccggatcaaacatttttagtccc

SEQ ID NO: 2712 - DNA, 700 bp, Triticum aestivum
gtttgtcgtcctcgcgacatcaggccagcaacgtgtgctcgacagtggcatgaatgccggctcggcgacttcggctcgcgatgctgtatgaccacctgccgacccggagacctcgcatgttgttggaaccatagggtacctagccccggagatcggccgcaccagcaaggcgaccatcctgaccgacgtgtttgccttcggcatattcgtgctggaggtcacctgtgggcagaagcccatcatgcaagattcgaaggatgatcagctcatgctggcagactgggtggtggagcactggaacagagggtcactggttgagacggtggatagcaagctccaaggcgactacgatgccgatgaggcgtgtgtggtgctgaaggtggggttgctgtgctctcacccgtttcctgaagcaaggcctactatgcggcaagtcttgcagtacctgaatggtgatatgccggtgccggaactagttccggcgcacctgagcctccagatgctggcgttcatgcagaatgaagggtttgattcgtacatcatgtcctatccttcgtcggtggagagcgttaacagcctcactagccttgtgcacgagagataggatagggtgttaacattggtttctttgtatgtattccttgtatcttgtatatgggcaattaagctcatacttgtgtatggtatatttgctcatcaa

SEQ ID NO: 2713 - DNA, 689 bp, Triticum aestivum
ccagagctcggcgtggcgcatgaacaggcgctgacgggcgagcagatggtggcgttccaggaggccttctcccctcttcgacaagaacggcgatggatgcatcagcttggaagagctgccgcggtgactcgctccctcggcctcgatccgaccaaccaagagctcaatgacatgatgcgtgaattcgacatggatggaaatggcaccattgatttccaggagttcttgagcctcattgccaggaagatgcaggatggagatggagatgaagagctcaaggaagctttcgaggtcctggacaaggatcggaatggttttatctcccctgttgagctgaggacggtgatgatcaatctcggggagaagatgaccgacgaggaggttgaggagatgatcagggaggcggacactgatggcgacgggcaggtgaactacgacgaattcgtgctcatgatgaagaatgccgagcgcaagataactgggtgaacaaaattaaatatgctgtttgctctaaaaatatatatgctggcgatagatgtgaaaccactggttctcagattggatgcactgtctccgttgtaaattcgctgcttgtggtactgttattttctgaagccactgtaagcttgtgtattcatcttagaagctgtttgtgcactatataaacggcaattgccacatatatttac

SEQ ID NO: 2714 - DNA, 598 bp, Triticum aestivum
  misc_feature (7)..(7): n = any nucleotide
  misc_feature (30)..(30): n = any nucleotide
  misc_feature (37)..(37): n = any nucleotide
gacaacncaaagcagcgtctctaatgttancagtaanagatgtcaacatgttcagaacaatgactggctgtcagaatcaaagacctggccagggtggtataggaactggttcaagacataaggttctcaaacatacaagtctccgaagttcaaacacctattatgatagaccagttctattgcgacaaaagaacctgcacaaatcaaacatcagcagtggcagtatcaggcgttcagtatgagaacatcagagggacatttacaatcaagcctctccattttgcatgcagtgacagctcaccttgttcagggatcacacttaccggagtacaacttaaacccgtgcaaatagcccactaccacctaaacaatccattctgttggcaagcttttggggaactcttcactccaaccatccctcccatagcttgtctgcagattggaaaacctgctgggaacaacttgcagtcataccatgacatatgctgaaacacagatagtatcctcatccattagttggtgcttattcatgagtggtcgttgtgatgcttccgaccctttgcaccattgcttcgtcatgtgcatatatacacagtta

SEQ ID NO: 2715 - DNA, 576 bp, Triticum aestivum
tcatcaaagatgacgttaagaaaagaaaagaagatgcattctctcaatggctcttggaagttgctgatttttctgccttgcctggcaaaggagttcaatgtttgatcaatgggaagatgattctggtgggcaaccgtgctttgatatctgaaaatggggttaacattcctgaagaggctgaaagtttcttggtagacatggaattgagcgcaaagacaggcattcttgtagcatatgatggcgacttcattggattaatgggggtaaccgatcccttgaaaagggaggctgctgtagttatacaaggcctaaaaaagatgggcatttatccagttatggtgacaggggacaattggaggactgcactggcggttgcaaaggagattggaattgaagatgtgagagcagaggttatgcctgccggaaaagccgacgtaatccgctctttccagaaggatgggagcgtggttgcaatggttgcaatggttggagatgggatcaatgacagatatatagctaatactccactctaagacagatatccaacatgcatctcaaagtactaagtaaaactaa

SEQ ID NO: 2716 - DNA, 800 bp, Triticum aestivum
tccgcgacgcgtggcgcaaagacagcattctgtagcatatgatggcaacttcattggtttgatggggtaaccgatccccttgaaaagggaggctgctgtagttatagaaggcctaaaaaagatgggcatttatccagttatggtgacaggggacaattggaggactgcactggcagttgcaaaggagattggaattgaagatgtgagagcagaggtcatgcctgccggaaaagccgacgtaatccgcattttccagaaggatgggagcgtggttgcaatggttggagatgggatcaatgattcccctgccctagcagcagccgacgtcgggatggccatcggtgcagggactgacatcgccatcgaggcagcagactatgtgctggtgcggaataaccttgaagacgtcatcacggcgattgacctctcacggaagacgttcagccgaatccggtggaactacttctttgccatggcgtataacatcgttgccatccctgtggctgccggcgcactcttccccttcactggcttgcaaatgccgccgtggctggctggcgcttgcatggccttctcgtcggttagtgtagtatgttcctcgctgctgctgaggagatataggaaaccaaggcttaccaccgtcttgcagataactgtagagtgattccaacctggaacctaacccgcctgtttttgtgtgtgacatttctacttgaaagaaatggatatggcatctgtttgtaactcagtgatgatacagtttttgacacctgtgcttgtaaatagcacatatatacaca

SEQ ID NO: 2717 - DNA, 554 bp, Triticum aestivum
tgcctgccggaaaagctgacgtaatccgctctttccaaaaggatgggagcgtggttgcaatggttggagatgggatcaatgattcccctgccctggcagcagctgacgtcgggatggccatcggtgcagggactgacatcgccatcgaggcagcagactatgtgctggtgcggaataaccttgaagacgtcatcacggcgattgacctctcaaggaagacgttcagccgaatccggtggaactacttctttgccatggcgtataacatcgttgccatccctgtggctgccggcgcactcttccccttcaccggcctgcaaatgccgccgtggctggctggcgcttgcatggccttctcgtcggttagtgtagtatgttcctcgctgctgctgaggagatatagaaaaccaaggcttaccaccgtcttgcagataactgtagagtgatttcaacttggaacctaacccgcctgtttttgtgtgtgacatttctacttgaaagaaatggatatggcatctgtttgtaactcagtgatgatacagtttttgacacct

SEQ ID NO: 2718 - DNA, 749 bp, Triticum aestivum
ctggtttcgacacgcaagatgaagatatccaggaacattgtcaggtctaatgggcaactaggcactgaatcggagattctgaccatcgatataaaaacccggatggaagaaagggaccaagatcacatttccggacaagggcaatgagcagccgaaccagctcgccgccgatctcgtctttgtcatcgacgagaagcctcatgatgagtacacgagggaaggcaacgacctgctgatataccagaagatcgacctggtggatgcattggcaggaaccacagtgaatctgaagaccctcgacgggcgtgacctggtgatcaagctgacagacgtggtaacaccgggatatgagcttgcaatcgccaaggaggggatgcctattgtgaaagaaaatgggaggagaggcaatttgagaatcaggttcgatgttgatttcccgaagagactgtcatcggagcagcggcagaatattaggaaggttcttggagggggagggcagcctcagcagtaatgatgacgttccggaagcaaattcagctctcccatagttgtccatgaaatgcagactaattcagatgttcttctttggttggcttgtatgtctagttacttttggtttgcgggtacttattcctgatctgctcctttgttgaagaaatagcgatagtaattgttgactactccatacagattacggtgtaatgctaatttgttcacttattgagtcacatattacatatgccgaaaat

SEQ ID NO: 2719 - DNA, 536 bp, Triticum aestivum
ggagcgattctacaatcctgattcaggcaccatctcattgcggcttgagtctatttcagactttcggtccaataaagcaaatatggaaatagctgactcttttgcttttgttgaatcggtggccattgcacttgtttgagatactccaatagttgctaaaaccagtgcaaagaaaaccttgaaaacatcaccaaaacttgattggccatggcgcacaaattgtgctccaacatagaaacaaagaccatatgtaaggtacagcatcaagaatgagaaaccaaatccgatgcctccaactattcctgttctgactccttgactcattgaggcttcacatttatcatcatatattcttgtaattcttttctcagaacaaaatgaagcgacggtcctaatactactaattgcatcagtggccacttgacttgcgtcttcatacatcatcttggcatcttgactgaaacccttcaagaacttcacttgggcataaccttgaaggcccactaatggaatcacacagaggatgatcaaagaga

SEQ ID NO: 2720 - DNA, 782 bp, Triticum aestivum
tcacatatcgtcactatgccctctattgaggtgggcacagttggtggtgggactcagttggcgtcacagtctgcatgcctggacctgctgggcgtgaaaggcgccaacagggaatcgccaggatcgaacgcgaggctcctggccaccgtggtggcaggcggggttctcgccggggagctgtccctcttgtccgccctcgccgccggccagctcgtcaagagccacatgaagtacaacagatccagcagagacatgtccaaggccgcatctctaagttcttgattgattgactcgacgagctgcagcccaagaaaccaatggagaaatctagagtgtggcttgattctacacacaggaagtgctcatcaacatcaagctgagaagagtttgaccagtttctttctcgatgctggccggtgtttctgtcgtcgttcttcgcgtgctgccgctgctggcatcgtcgacggacggccccgggcggcaccggagaagctaacctttttagcctgtttgtgttcataaggctttgtggttggttgggttggttaccttggcgcgcaaagtgtggggatctttttgtagcatcgaagtgtagagatctctctccttgcttcaggaagccagccttgtagtggtatctgtttcaccttttgtttgcttctttttcctttatgctagtcgaacaaatattacgaaaagatatggtaacgtgattgtagaaaaaatgtgggtctcggcggagattcatacacaagaagcaataggaaggcggcatccagtcc

SEQ ID NO: 2721 - DNA, 633 bp, Triticum aestivum
ctattacttgtgcacccaaagatggaaggttctttcttcggcaatatggatcagagaaactacgtcatgagtggcgggcatccaaggacacctttctatcaggcatttctcaagttggcgaagtccatatggttgttgcacaggctggcctactctttcgacccaaaggtcagggtcttccaagtgaagaaggcaagcgagttctcggagattcacatggtaagtgttgtgaagaacatcatcttggatgagaatgccgagaggcctagagtcgacttgatggtgatgcctggtttcttgatcgggactagcgtcatacagtctcgagtgtacctttctggtgtgaagtgtgccgactaataagtgttagggttgcctgagaagattccgggcgtttcacacatcctgcaagatcatcgtacatcttgtatgtaatgccgcctctccaaaatgttatttgtatgaaatgtggtagcaacaccttttcgtaaaaaacatagtatgctttggtcattcgaggactgtaatgtgtgctttgtctgttttgtaatatatgtaaatcctgtctttggtctacatataagttatgaaaaattgtcaatgtggtgtggatgtcgctatctgtatggtgat

SEQ ID NO: 2722 - DNA, 636 bp, Triticum aestivum
gatccttggatgattgagccttacccagattcagttttcggaaagttcttcagaagcaaatacctactgcttgtgcacccaaagatggaaggttctttcgtcggcaacatggatcagagaaactacgtcatgagtggcgggcatccaaggacacctttctatcaggcatttctcaagttggcgaagtccatatggttgttgcacaggctggcctactctgttcgacccaaaggtcagggtcttccaagtgaagaaggcaagcgagttctcagagattcacatggaaagcgttgtgaagaacatcgtcttggatgagaatgccgagaggcctagagtcgacttgatggtgatgcctggtttcttgatcgggactagcgtcatacagtctcgagtgtacctttctggtgtaaagtgtgacgactgataagtgttagggttgcctgagaagattccgggcgtctcacacatcctgcaagatcatcgtacgtcttgtatgtaatgccgcctctccaaaatgttattcgtatgaaatgtggtagcaacacctttttcgtaaaaagcatagtatgctttggtcattcgaagactgtaatgtgtgctttctctgttttgtaatgcatgtaaatcctgtccaaa

SEQ ID NO: 2723 - DNA, 710 bp, Triticum aestivum
gtaccaggataaagacatagctggagattgacagacataatcgccagcaatcaatcgcagtacttcagaaggaagctataggtggtctacgctaaatgagagcataccattaagtgagcaagaagatctcattgtttggatgagaactgctgccctcccaactttcaggaagctgtatggcagaattgagaaagatatcaatgcaaatgataatgtaacagtggttatacagaacaactataacacatatagttttggaggatcaaaagcgttggtcctttctactgcatcttggattggagggaaaaacaacttcattggcatggcatatctgactattggtggtttgtgcctttcccttgctatgggcttcttagttctctacatggttaaacggaggaactttgcagacccctcgaacctgtcatggaatagatgaatagagttaactattagactggagtatcctgtctgagaataaaagatcattcaatgggtgaattcctccaattggatctatgggtgtctgttcttattcccattcactgggcttgtcatggctcacaggcatgaggatcttgttgactttggagccctaatagcatcatacatacatgaacagaatgtattgtgatcagttgacttaaaccttatctgaccttatctgaccataccgagagtcgtttctgaatgcttattatgaattataa

SEQ ID NO: 2724 - DNA, 614 bp, Triticum aestivum
gccgagaattatcctgcattcgaggtgaacgccgacctagagggctattccagcagaaggaagatctccgagcaggtgcagaaagggtcggagaaggtcgcgaggctggacctcgagctccagaaaatacagtacgtgctgctgaagctcgaggaggagcacgagttcaagagggtcaaggtctccgagaagcgttcgcggctgctcttgagggactacgtgtacgcaaagaaggacaagaacgacgccggccagaagaagaagagtagggtgcccttctgcggctgcgtgcgccccaaaacaatgaccgagccttaaccgtttcgttctgtaggcggcccaacaggctcgtgctccttctgatttggagctgcagcaagtgatgtctttagtatctcttctgtatgggttgcatgataatgttaacaaggagctcatgcattcagagttttgtccttgttcagaaatgtcctctagtttaactagttaatcctactgataccgttatgaatcgaagcattttgtaattccgttgcccttcgctggttctatatgtctgcgatgacgatatatgagaatgcttctttcagggatataattttcactcccctttt

SEQ ID NO: 2725 - DNA, 716 bp, Triticum aestivum
gagaagctcgccaccgatgctcagggcctgctaatcatccaagcaagcatcgaggaagtgaagcagaaaatcgagggaacttccaagggcaaatctcccatgagctcagagtacagcagtatcagggctcagctgcaggagatcgagggctctgtcttggaacagataggtttcaacagcagtttgtacgaagaaggctgagaattatcctgcatttgaggtgaatgccgacctagagggctattccagcagaaggaagatctccgagcaggtgcagaaagggtcggagaaggtcgcgaggctggacctcgagctccagaagatacagtacgtgctgctgaagctcgaggaagagcacgagttcaagagggtcaaggtctcggagaagcgttcgcggctgctcttgagggactacgtgtacgcaaagaaggacaagaatgacgccgggcagaagaagaagagtagggtgcccttctgcggctgcgtgcgccccaaaacaatgacggagccttaaccgtttcgttctgtaggcagcccaacaggctcatgttccttctgatttggagctgcagcaagtgatgtctttagtgtctcttctgtaatgagttgcatgatgatgttagcaaggagctcatgcattcagagttttgtccttgttaaaaaaatgaggcaatgtccccctagttttaactagttaatcctactgatactgttac

SEQ ID NO: 2726 - DNA, 617 bp, Triticum aestivum
tgtgcagaagaatcaaatggcccatcacctcgagtatcaaggcgaccgcaagggcgaaagctgcagttgaagcagcaggtggaactgtaagattggtgtactacaacaagcttgggttcagggcactactcaaacctgaatggtttgcaaagaagggccgccttataccaaaagcggcgaggcctccacccaagcaacgagacaaggttgatagcattggccgactacctgctcccacaaagccacttcccttcacaccggaggaattagagtttactgccaagcgtgaagctgctaaagtgatcgctgcataggagggagtacaaatcactgaagaagcccatccaaacttttattacttacataagtcttgcaccgggcatgtataacaatcacttgctctttcctataggtgtattccttgtgggatccttgtgtttccttgtcatttgtgctacgcgggaatgacattttcttcttcaggtggcagtagtacctcctggtaagcaccagggctggccagtaaaatatcctgtaacagtcttttgagagatcagttcattgttttttgagagatcagttcattgttttcattaatagaaacttctttctctagg

SEQ ID NO: 2727 - DNA, 797 bp, Triticum aestivum
agaccgctttcactcacgttccagccctgtggactggggaaattgcgaagctcatcaatgctggaaaaatgattcctctgaattggatcacaatgaagaccctgaaggatacaagtgccattgggaaacaaataaaggatgggattcggttaatgggtcgtggtgcagaagaaatcaaatggccaattcatctcgaggtatcaagggcgactgcaagggcgaaagctgcagttgaagcagcaggtggaactgtaagattggtgtactacaacaagcttgggttcagggcacttctcaaacctgagtggtttgcaaagaagggccgccttataccaaaagcggcgaggcctccacccaagcaacgagacaaggttgatagcattggccgactacctgctcccacaaagccacttcccttcacatcggaggaattagagtttactgccaagcgtgaagctgctaaagtgatcgctgcataggagggagtacaaatcactgaagaagcccatccgaacttttattacttacataagtcctgcaccgggcatttataacaatcacctgctcttccctataggtgcattccttgtgggatccttgtgtttccttgtcatttgtgctacgcgggaatgacattgtcttcttctggtggcagtagtacctcctggtaagcaccagggctggcgggtaaaatatcctgtaactgtcttttgagagatcagttcattgttttcgttaatagaaactttttctctaggacatacttcaggaatgtctgccaacactataggacaaag

SEQ ID NO: 2728 - DNA, 569 bp, Triticum aestivum
  misc_feature (9)..(9): n = any nucleotide
  misc_feature (29)..(29): n = any nucleotide
  misc_feature (33)..(33): n = any nucleotide
  misc_feature (62)..(62): n = any nucleotide
  misc_feature (89)..(89): n = any nucleotide
  misc_feature (108)..(108): n = any nucleotide
  misc_feature (202)..(202): n = any nucleotide
aagctgtcnggggttccccgttcgagccngcgntgatcggctccggcacggacctcgaccangccacgctgcggtgcctcctggccgancacctcggttgtgggcgcncaggacgtgcaggcgctacatggtcggcgagcacggagacgggcggcctggcgctgtggtcgagcgtccgcgtcggcggcatgccggtgatganctacctccagaagacccactcgtcgttcgatgcaaaggctttggaggggatccggcgggcggtggtgggcggcgcgcgagaggtgatcgggctcaaggggtacacgtcgtgggccatcggctactcggtagccagcctggccaggtcgctcctccgcgaccagcggcgcgtccacccggtgtcggtgctcgccaaggggttcctccccggcgatgcccacgaggtcttccttagcctcccggccaggctcgggcgccgcggcgtgctcggggtcgccgcggagctggagctcaccggcgacgaagaaacgacgctccgccggtccgccgagacgctctggggctactgtctggcgctcggcctataa

SEQ ID NO: 2729 - DNA, 569 bp, Triticum aestivum
aattctgggcgctacattatgtgatgctctgtacaaaggggctgtgaagaagggttcagcatacccaagtgagatccacaagaaggatttagggtcaacatttgttaaccgtatgcaaattcatcatagagtagctagaggaaatgaggtggtcattcgcaagggcgccatacgcactgttcaaatcatgacagaaagaaggcaagggaacaagaagatgacccgagtctctggattggaatgctttttgctggatgctgactccttggcttctgaactacaaaagaaatttgcttgcagcaccaccacagctgagcttccaggtaaaaaggggcaacatgaggtcttgattcaaggcggagtcattgaaaaccttgcaaagcacctcgttgaccatcacggtgttccgaagagatatattgaggtttatgacaaaacaaagaagtaggaggggtgtcagactcctgggagtgccgtcataacattgttgaattctggttcaagcttgttgtgtttcagacttgttgtgaaaatgtgaaatgttctctcaatgctatattcgcgtttgt

SEQ ID NO: 2730 - DNA, 648 bp, Triticum aestivum
atcgtttgttttggtcaaaatataagttgcggccctgaccaatagttgcgcgggtcgcaacagttagtacattcatgtattcctcgaaataagtaacgggtttgagttctctctggtgcacaaccgtgaaaagctcacatatataatggagtggacggaatttgatcgcgccaccaacacacctacttgaacacctgttaccactgcgccaaggtctgctctacattgttataggcatgcacatcttatttgaccctgtttttacattcaaattcaagtttatccgtatttgtttgaacggtagtactgtttcttaggaggcagtggaaacacagaccgagggaaaaaaatcctggttctaacacaaggcttctgcatatcttgacaggaatttgatgacaactccgcttcaagtcaagtcttctggctcttgaaagaaagtgagctgacgccaagcaattccaatatattggatgggcggtattcggtgtttggatatgtaaccgagaatgaggatttcttggctgatctcaaggttggggacgttattgaatcgatccaggttgtctcaggcctagacaatcttatcaacccgagctacaagattgtagggtagcatgtttctgtatataagagttttttgacagg

SEQ ID NO: 2731 - DNA, 781 bp, Triticum aestivum
taacaggttcgagttctctttggtgcacaaccgtgaaaagctcacatatataatggagtggacggaattcgaccgcgccacctaaacacacctacttgaacacctgttaccactgcgccaaggtctgctctacattgttataagcatgcacatcttatttgaccctgtttttacattcaaattcaagtttatccgtatttgtttgaacggtagtactgttttcttaggaggcagtggaaacacagaccgggaaaaaaatccctggttctaacacaaggcttcttcatatcttgacaggaatttgatgacaactccgcttctagtcaagtcttctggctcttgaaagaaagtgagctgacgccaagcaattccaatatattggatgggcggtattcggtgtttggatatgtaaccgaaaatgaggatttcttggctgatctcaaggttggggacgttattgaatcaatccaggttgtctcaggcctagacaatcttgtcaacccgagctacaagattttagggtagcatgtttctgtatataagagttctttgacaggcaattgttctacggtattaataccgatgtcatgcgctgcaacttctaaccttgtactattgttttgtttcccgtttttatgcttatggttttgcattctgtggaattcaacagataatagatagaatcaaagattaatattaacacgtctcctgaacagataaggatcatgaaatatgactgtgtagagcctcaagttaaaattaaggattattgaaattcgga

SEQ ID NO: 2732 - DNA, 965 bp, Triticum aestivum
tttcgggtcttgctgaatcaaagagagcaaacggagaaaaaacattggataaattagctgttggacttgaagagcttcaacgaattattgaggatagaaacaggaatgcggtagctccaaagcagaaagagcttctcaattatgttggaactgtagaagaagatatggtcgatggcttcccctatgaagtaccagaagaatacaacaacatgcctcttcttaaaggaagagctactgtggatatgacggttaagattaaagataatccaaacgtagaagattgtgtatttcggatagttctggatggatataatgctcctgtgacttctgggaacttcgtagatctggtggaacggaagttctatgatggcatggaaatccaaagagctgatggtttttgttgttcagacgggagatcccgagggaccagccgagggttttattgatcccagtactggcaagagtcgtaccatacctcttgagataatggttgatggtgacaaggcgcctatatatggcgaaacacttgaggaacttggtctttacaaggctcaaacaaagcttccttttaatgcatttggaacgatggcaatggctagagaagaatttgatgacaactccgcttctagtcaagtcttctggctcttgaaagaaagtgagctgacgccaagcaattccaatatattggatgggcggtattcggtgtttggatatgtaaccgagaatgaggatttcttggctgatctcaaggttggggacgttattgaatcaatccaggttgtctcaggcctagacaatcttgtcaacccgagctacaagattgtagggtagcatgtttctgtatataagagttctttgacaggcaattgtcttacggtactaaaaccgatgtcatgcgctgcaatttctaaccttgtacaattgttttgtttccctttttgtgcttatggtttggcattctgtgg

SEQ ID NO: 2733 - DNA, 755 bp, Triticum aestivum
gtctccgggcacgtcaaggcgtgacgcccaagcgttccagcaggacacggagctgtgaagaagcggtccgccactacaagcggtgatccaaccagttcgagcagaaaggacggtaccggaacgtgctcgacatgaacgcccgcctcggcggcttcgcggcggcgctggcgagttacccgcagtgggtcatgaacatggtcccgaccgtggccaactccagcgcactcggggtggtctacgagcgcggcctcatcggaagctaccaggactggtgcgagggcacgtccacctatccgcggacctacgatctcatccacgccgactcggtgttcactctgtacaagaacaggtgtgagatggacaccattctgctggagatggacagggtcctgaggcccgagggcacggtgatcatcagagacgacgtggacatgctggtgaaggtcaagagcgtcgccgacgggatgaggtgggacagccagatcgtcgaccacgaagacggcccgctcgtccgggagaagatcctcctggttgccaagacgtattggactgccaagaaccaatagcaccagtggagtatagcatctatatagtattgctcataagcacatcgctcagaagatctcaaagttggatcgccatttgttgtagctccatgaactgcttattttatgctctttatttatgtctttatataggaaattcgtctccaagtaagttgtaaaacacagcataatttgtatgtgtcacttgaa

SEQ ID NO: 2734 - DNA, 791 bp, Triticum aestivum
tcggaattcccggggaagaagcgggtccgccactacaaggcggtgatcaaccagttcgagcagaaaggacggtaccgcaacgtgctcgacatgaacgcccgcctcggcggcttcgcggcggcgctggcgagctacccgctgtgggtcatgaacatggtcccggccgtggccaattccagcgcactcggggtggtctacgagcgcggcctcatcggaagctaccaggactggtgcgagggcacgtccacctatccgcggacctacgatctcatccacgccgactcggtcttcactctgtacaagagcaggtgtgagatggacaccattctgctggagatggacagggtcctgaggcccgagggcacggtgatcatcagagacgacgtggacatgctggtgaaggtcaagagcgtctccgaccggatgaggtgggacagccagatcgtcgaccacgaagacggcccgctcgtccgggagaagatcctcctggttgccaagacgtattggactgccaagaaccaatagcaccagtggagtatagcatctatatagtattgctcataagcacattgctcggaagatctcaaagttggatcgccatttgttgtagctccatgaactgcctattttatgctctttatttatgtctttatataggaaattcgtctccaagtaagctgtaaaacacggcataatttgtatgtgtcacttgatcgctaaattgcatcaagtgattaatagaagtactgtttgcgagttactccctctgtatcaagatataagatgtttct

SEQ ID NO: 2735 - DNA, 617 bp, Triticum aestivum
gtttatgaccgaggattgattggcattttaccatgactggtgtgaagctttctcttacttatccaaggacctatgatcttatccacgctagtggccttttcaccttgtatagcaataagtgcagcatggaagacatcctccttgagatggaccgcatcttgaggcctgaaggtgctgttataatgcgtgacgatgtcgatgtcttgacaaaggtgaacaaacttgctcggggcatgagatggaacacgaagctagttgaccacgaggacggccccttagtgcgcgagaaggtcttgtatgctgtgaagcagtattgggttggcggaaaccagacggccgcatcgtgaagaacatattctaacacggggaattctgggatccacctttgaagctggcgtccaggaattgagatatggagtcatcaggtgcgaacaaaaatggcctactctcctccggggtaccaatgaagcaatcaaggttgattggcagcagtatattgttgtaacagttttgtaatttaatttcattcgtcattcggcatgaagttactctggttaattgaaggatgtattgtcaagaaatattattgctttagtttctgtaatgttgctgatgct

SEQ ID NO: 2736 - DNA, 626 bp, Triticum aestivum
gccttttatgagagaggattgatttggcatttcaccatgactggtgtgaagcgttctctacttatccaaggacctatgatcttatccatgctagtggccttttcaccttgtataacaataagtgcagcatggaagacatcctccttgagatggaccgcatcttgaggcctgaaggtgctgttataatgcgtgacgatgtcgatgtcttgacaaaggtgaacaaactcgctcggggcatgagatggaacacgaagctagttgaccacgaggacggccccctagtgcgtgagaaggtcttgtatgctgtgaagcagtattgggttggcggaaaccagacggccgcatcgtgaagaacatattctaacacggggaattctgggatccacctttgaagctggcttcctggaattgagatatggagtcatcaggtgcgaacaaaaatggcctactcttctccggggtagcaatgaagcaaccaaggttgatcgagagcagtatattgttgtagcagttttgtaatttaatttcattcgtcactcggcatgaagttactctggttaattgaaggatgtattctcaagaaatattattgctttagtttctgtaattttgctcatgctgcaact

SEQ ID NO: 2737 - DNA, 759 bp, Triticum aestivum
tcctcgggagaacatgaattacagagaccgcattgcccaccgcagaaagaaaagttgcactgcctggtaccaccgcctaagggatatgttgctccattcccatggcccaaaagtcgggactatgttcctttcgcgaattgtccctataagagctttctctacttatccaagaacctatgatcttatccacgctagtggccttttcaccttgtatagcaataagtgcagcatggaagacatcctccttgagatggaccgcatcttgaggcctgaaggtgctgttataatgcgtgacgatgtcgatgtcttgacaaaggtgaacaaactcgctcggggcatgagatggaacacgaagctagttgaccacgaggacggccctctagtgcgcgagaagatcttgtatgctgtgaagcagtattgggttggcggaaaccagacggccgcatcgtgaagaacatattctaacacggggaattctgggatccacctttgaagctggcgtccaggaattgagatatggagtcatcaggtgcaaacaaaatggcctactcttctccggggtagcaatgaagcaaccaaggttcatcggtagcagtatattgttgtaacagttttgttatttaatttgattcgtcactcggcatgaagttactctggttaattgaaggatgtattgtcaagaaatattattgctttagtttctgtaattttgctcatgctgcaacttctgaatgtttgctttattaccaggtaatccca

SEQ ID NO: 2738 - DNA, 553 bp, Triticum aestivum
  misc_feature (51)..(51): n = any nucleotide
  misc_feature (230)..(230): n = any nucleotide
  misc_feature (311)..(311): n = any nucleotide
catcatgggttccccggcgactcaccaatattccggcggtgtcttcttccntagcaatccacttcccgacccgactacccctttcaagcccccgaaaggtcaacttcaccacccgcatctaccaccccaacatcaactccaacggcagcatctgcttggacattctgcgagaccaatggagccctgctctgaccatctcaaaggtgctgctgagtatctgctcgatgctnacagacccaaaccccgacgacccgctcgtccccgagatcgcacacgtctacaagaccgaccggtcccgctacgaatcgacngcgcgcgagtggacccgaaagtacgccatctaggccctcgaagcgcaacaaaggagcgtcaagactgggtgcggcggagagcgtgtcttttgtcgttagcatctgcgaaagggaggccaggatgatggttgttaggggcagactttcatggtagtgactgatggggggttttacacttgtactacggcatgcatgctggactggggttcatagcatctggctattatcactcttaccacaac

SEQ ID NO: 2739 - DNA, 632 bp, Triticum aestivum
gatctacgagtaatataagggatggaaccacctcaagggactatttctgtttgcgaagctcaaaggaaaaccggggagaccttcttaaatgaaaaaagctccagatcccatcaaatacttaaattgactgttgaaagttctgctcgtgaattcttaggaaaggacaagtcaaccacccttgtggctagtgtgaactttgttgatctggcaggaagtgagcgtgcatctcaggctatgtcagctggcacaaggctgaaagaaggttgccacatcaataaaagtttgctttcccttggcaccgtcattaggaagctaagcatggggagtaatgcacacgtaccgtatagagattccaagcttacacgcatattacaaccttctttgggaggcaatgcaagaaccgcgattatttgtacactcagccctgcaacaagtcacattgagcaatcaaggaatacactgtttttcgggagttgtgcaaaggacgtagttacaaatgctcaggttaatgtggtcatgtctgataaaacactagttaagcatttgcaaaaggaagttgccagactggagagtgagttgcggcagccagtttcaaactctagtctggaagcacaggtgaaggcaaaggacaa

SEQ ID NO: 2740 - DNA, 1075 bp, Triticum aestivum
agtgaggtgagccgctgagtgacaagagattgcaaggggtgagcctgccgagtgggagtgcatcaatgacaccaccatcatgttccggagtaccttcccggatcgacccacggctccaaccgcatacacatttgacagggtatttcattctgagtgcagtacgaaagaagtctaccaggaaggggtcaaggaagttgccctctctgtagttggtggcattaactcaagtgtttttgcgtacgggcaaacaagtagtggaaagacatacactatgactggagtgacagaatgcacagtagcagatatatatgattatattaacaagcatgaggagagagcattcgtgttgaagttctcagcaattgaaatatataatgaagttgttagggatcttctgagtgcagaaaatactcctcttagactttgggatgatgcagagaaaggcacctacgtggagaatcttacggaggttatattaagggactggaaccacctcaaggggcttatttccgtttgcgaagctcaaaggagaacgggggagaccttcttaaatgaaaaaagctccagatcacatcaaatacttaaattgactgttgaaagttctgctcgtgaattcttaggaaaggacaagtcaactacccttgtggctagtgtgaactttgttgatttggcaggaagtgagcgtgcatctcaggctatgtcagctggcacaaggctgaaagaaggttgccacatcaataaaagtttgctttcccttggcactgtcattaggaagctaagcatggggagtaatgcacacgtaccgtatagagactccaagcttacacgcatattacaaccttctttgggaggcaatgcaagaactgcaattatttgtacactcagccctgcaacaagtcacattgagcaatcaaggaatacactctttttcgggagttgtgcaaaggatgtagttacaaatgcccaggttaatgtggtcatgtccgataaaacactagttaagcatttgcagaaggaagttgctagactggagagtgagttgcggcagccagtttcaaactctagtctggaagca

SEQ ID NO: 2741 - DNA, 471 bp, Triticum aestivum
  misc_feature (64)..(64): n = any nucleotide
  misc_feature (159)..(159): n = any nucleotide
  misc_feature (170)..(170): n = any nucleotide
  misc_feature (172)..(172): n = any nucleotide
  misc_feature (190)..(190): n = any nucleotide
  misc_feature (234)..(234): n = any nucleotide
  misc_feature (301)..(301): n = any nucleotide
  misc_feature (310)..(311): n = any nucleotide
  misc_feature (316)..(316): n = any nucleotide
  misc_feature (328)..(329): n = any nucleotide
  misc_feature (331)..(331): n = any nucleotide
  misc_feature (375)..(376): n = any nucleotide
  misc_feature (461)..(461): n = any nucleotide
  misc_feature (466)..(466): n = any nucleotide
acaaacaatgagctgcagtactgtaatgaggtggcttcagaactgaaatcgagaggtatccgcnccgaggtatgccacggcgaacgtctgccgaagttaatcagaaacgccgaaacacaaaaggtgccgctcatggcggtcgttggccccaaggaagtngaagctaggantntcaccatcaggtccaggnataacggggagatgggcacaatgcccgtcgacgatttcatcagnaaaatccaatcggccgttgctgaaaaatcttcgctgtagataccccagtctattaaactccagttcntattgtagnncactngaccttctgctnnanatacaccgtacaggagcgcctccgacgaaactgagcgacggagnnccaacaattttgtgcagaactgccatcaccacattatactccagtcaggaacagaagcccaacattcttcattgtacataatttntgacnacaat

SEQ ID NO: 2742 - DNA, 905 bp, Triticum aestivum
gccgctcggaatgtcattgaggcaggattcgatggtgtcgagatccacggagcacatgggtttcgtcttggagcagttcatgaaagatagctcaaacgaccgtactgacaggtatggtggcagccttgagaaccgatgccgctttgccgtggaggtgattgatgctatcgtccatgatattggcgcggatcgtgtcggaatcaggttgtctccgttcaccgactacatggattgcttcgattctaatccacatgtgctcggtacctacatggtacaacaactcaataagcacaaagagtttctttattgccacatggtagagcctcacacgaccattgtggatggtcgcatgcagatatcccatgggctattgccctttaggaaagcatttaatggcacttttattgccgcgggagggtatgatcgagaggaaggcaacaaagtggtgattgatagttatactgatctcgttgcctatgggaggctatttcttgctaatccggatttgcctaagagattcaagctagatgtccccttgaacaagtatgaccggtccaccttctacacgcaggatcctgtcattggttacacagattatcctttccttgatgactcaaatacagagtagttcattcacccaacttcaattacttatgtggttcacttatgtagtatgcaatgatttattcaatatgtgagttcacacatgtgcattgtataattttcacaaataatttatttttgttttccactgtaatgccaaaatatagggatattcatcttgtgacaaattttcgtacgcatttgtttttattttggtacaagggtggattcaattttttcttcattttgaaaataaacccgagagatatgcggttgtagcatgtaatggtttcactcactca

SEQ ID NO: 2743 - DNA, 769 bp, Triticum aestivum
cgcgttcgagggcctctgcaagaccatcaaggacatcctgggcgacaaggtggagaaggtggtcgtctcggaccgcatcgtggactcgccgtgctgcctggtgaccggcgagtacgggtggacggccaacatggagcggatcatgaaggcgcaggcgctgcgggacagcagcatgggcgcatacatgtcgagcaagaagacgatggagatcaacccggagaacagcatcatggaggagctccgcaagcgcgccgaagccgacaggaacgacaagagcgtcaaggacctcgtcatgctgctgttcgagacggcgctgctcacctccgggttcagcctggacgaccccaacaccttcgccgccaggatccaccgcatgctcaagctcgggctcaacatcgacgatcaggatgctgaggaggagggtgctgacatgcccgcgctggaggaggagggcgccgaggagagcaagatggaggaggtggactgaacctgaacctgaacctgaaggagatggaacaacagagtcagtcgtgtctgtccatgggtgagttgagttggagttctggtggtcgtttggtggtcgctgcgtgtccaggtagaagctattattagagcgtcagtgtcgttgtgtttgatgagtgtcgaggtcaagtctcagtgtcacttggtgtcttatggagaagtctgatatgtgaggactgaagggagtttgttccggattctgaagtgaaagagaagggttttgagtctgaaaaaaagtgcccattga

SEQ ID NO: 2744 - DNA, 907 bp, Triticum aestivum
caggaagctgcagcattggtcacaaccttcaatattgaaattggtatatccggtgctatattgactaaattggatggtgattccaggggtggagcagcacttagtgtgaaagaggtgtctggaaagcccatcaagtttgttgggcgaggagagcgaatggaggaccttgagcttttctatcccgaccgcatggcacaacgtgtatcgggaatgggagatgtcctttcatttgttgaaaaagcacaagaagtcgttcgccaagaggataccatggaactgcagaagaagatcatgagtgcgaaatttgacttcaatgactttttaaagcagacacaaaatgttgccaaaatgggatccatgagccgtgtaatcggaatgattccaggcatgaacaaggttactcctgcacaaatccgggaagctgagaaaagacttgcattcgtagagtcgatgatcaatgcaatgacagccgaggaaagggaaaaacccgagttactggccgaatcacgcgagaggaggattagggtagcagaggagtctgataagacagaacaagaggtgagccaactggtcgcgcagctcttccaaatgcgcgcgcagatgaagaaattgatgggtatgatgcaagggcaagaagcaattgcaggaatgggagatctcatggactcgctcaatgctgacgagaaggcacctcctggcaccgcacggcggaggagacggcggagcgagccgccgcggcagagggagctggatgcagtgggtggcgccagtaggccttgagttgatgtgcactggagctggaatttttcactggaagagttgtggattggcatgtaggtacgggtcctgctgcatggtgtaatatttcctgtacattttggcatgccgagtttaaggttaatgggaa

SEQ ID NO: 2745 - DNA, 729 bp, Triticum aestivum
ctcggggacgcgctgcgcagaccaacgcggacgtcgtcatcgcgtccccgagacggcgtcgtggtcaccgcgcgatacgggacgaggatcgtggccgacgtgatgctggacgaggccgccgatcgggcgccgttcgatctgattatcgtgccgggcggcatgccgggcgcgaagacgctgggcggctgtgagcagctcgtcgctctgctgaagaagcaggcggaagcgaacaggccgtacggcgcgatcggcgccgccaccgcccacgtgctcgagccccatggcctgctcaagggcaagaaggcgacgacgtgcgcatccatggccgggctgctcgcggacggtggcgagtgcgagaacagggtggtggttgacgggaacgtgatcacgagtaggagccccggcaccgccatggagtacgcggcggccgtcgtcgagaaaatgatgggccgcgacgaggcgcggcgactggcggaaggcctgctcttcttgagctgacccccgtgaccgtgtggtggagcttcacaggctgttgttgcgctggctcgcctgatcatccgacaataacagccgacaacggtggtggtcatcgtcatctaagtcccgttcattcgtactgttcactgtcactttacatttaacatgtcatcagtacggtagtctccactgagagcgactccggacatggaggagaactacgccacacccaccgttcatcaaattacttga

SEQ ID NO: 2746 - DNA, 782 bp, Triticum aestivum
tcccccgaggtcagtcgtctcgtccgtgctgcgtttctcctcctccccgcattcgccgtctgcggttctctccaccgaacaagctcacacatcaagacaataaatagagcctgtctgtttggggccaatcaaaccaaacaacaagttcatgtctgatctcgacgtccaggttccaactgcttttgatccgtttgctgaggcaaatgctgaggactccggcgctggtgctggatcaaagaactatgtgcatgtgcgtgtccagcagcgcaacggaagaaagagtctgacaactgttcagggcttgaagaaagactacagctataacaagattctcaaggatctcaaaaaggaattctgctgtaatggtactgtagtccaggatccagaactaggccaggtcatccaactccaaggtgatcagcgtaagaatgttgctactttcctagttcaggctggacttgcaaagaaagagagcatcaagattcacggattttaggcaacacacaaatgcccgtgtgctgtcaccgaagcctggaagttgtcgtacacttggtattgtcacatctaagacatttgaattgctagtagtcgtgtgaggcatctgtgtttgatgcacttttacatccaagacatttggattggcatcggtgtgttgatgcaagttgtcctttaccatggtttgtatgcgccagccagtatggcagtatggtttatcccaggttattgtgccacgtaaataaatgtacttcaggcttatcttttcatggttgtgtgctctgttc

SEQ ID NO: 2747 - DNA, 797 bp, Triticum aestivum
gaggagacagatatttcccccgagccgaggtcaagtcgtctcgtcccgtgctgcgtttctcctcctcccccgctcctcccccattcgccgtccgcggttctctccaccgaacaagctcacacatcaagacaataaatagagcctcgtttgtttggggccaatcaaaccaaacaacaagttcatgtctgatctcgacgtccaggttccaactgcttttgatccgtttgctgaggcaaatgctgaggactccggcgctggtgctggatcaaagaactatgtgcatgtgcgtgtccagcagcgcaacggaagaaagagtctgactactgttcagggcttgaagaaagattacagctacaacaagattctcaaggatctcaaaaaggaattctgctgtaatggtactgtagtccaggatccagaactaggccaggtcatccaactccaaggtgatcagcgtaaaaatgttgctactttcctagttcaggctggacttgcaaagaaagagagcatcaagattcacggattttaggcaacacacaaatgctcgtgtgctgtcaccgaagcctggaagttgtcgtatacttggtattgtcacatctaagaccatttgaattgctagtagtcgcgtgaggcatctgtgtttgatgcacttttacatccgagacatttgaatttgcatcggtgtgttgatgcaagttgtccttcaccatggtttgtatgtgccaccagtatggcagtatggtttatccaggttattgtgcactaaataaatgtacttcaggcttatctactcatgg

SEQ ID NO: 2748 - DNA, 707 bp, Triticum aestivum
tcctccttcccgcattcgccgtctgcggttcgcaccaccggacaagctcacacatcaagacaataaatagagccttgtctgtttggggccaatcaaaccaaacaacaagttcatgtctgatctcgacgtccaggttccaactgcttttgatccgtttgctgaggcaaatgctgaggactccggcgctggtgctggatcaaagaactatgtgcatgtgcgtgtccagcagcgcaacggaagaaagagtctgacaactgttcagggtctgaagaaagactacagctacaacaagattctcaaggatctcaaaaaggaattctgctgtaatggtactgtagtccaggatccagaactaggccaggtcatccaactccaaggtgatcagcgtaaaaatgttgctacttttctagttcaggctggacttgcaaagaaagagagcatcaagattcacggattttaggcaacacacaaatgctcgtgtgctgtcaccgaagcctggaagttgtcgtatacttggtattgtcacatctaagacatttgaattgctagtactcgtgtgaggcatctgtgtttgatgcacttttacatccaagacatttgaatttgcatcggtgtgttgatgcaagttgtccttcaacatggtttgtatgcgccaccagtatggcagtatggtttatccaggttattgtgcactaaataaatgtact

SEQ ID NO: 2749 - DNA, 720 bp, Triticum aestivum
gcaacaaggcagacagggcaggagtacgtggaggttttcagagcaagaagcaggattactacagcggcatagccgccgaggtgaaccagggtgcggtgctctccttgagccggagcaccggcactcgtcgcctcctctgcggtccaggaggctgtctgaagacaagagcagcatggagtacactgaggtgctgaagctgcgcgggctcccctactccgccagcatcgaggacatcatcaagttctttgtggagtacgagctgacggaggagaacgtgcacatcgcgtaccgcggggacggcagggccactggcgaggcctttgtcgagttcccgacggccgaggttgccaagactgccatgtgcaaggataagatgaccatcgggacgaggtacgtggagctgttcccgtcgaccccggaggaggcgagcagggcgaagccgcgaggcaggcagtgagcggtgtcctgccagacgctgagcactgggtgtgagaacagctgctgcatctcgttccagtttcagccttttcgctcttcatgctttattataattgtatcatcaatcatgtcggattgtgtttagtttgggctcctgtttctagctttgtggagacattttctgatgcgacttgtctcgaactgcctgcctcttgagggaaaaagtggtgtatgagatactttgctgagtgtgtaactgttaccatcctttgtttaaagaga

SEQ ID NO: 2750 - DNA, 736 bp, Triticum aestivum
caagcggagtttgcgctgcaccgcaacaggcagaacatggggcaggaggtacgtggaggttttcagatgcaagaagcaggattactacagcgcaatagccgccgaggtgaaccagggtggtggtgccctccttgagccggagcaccggcactcgtcgcctcctctgcggtccaggaggctgtctgaagacaagagcagcatggagtacactgaggtgctgaagctgcgcgggctcccctactccgccaccatcgaggacatcatcaagttctttgtggagtacgagctgacggaggagaacgtgcacatcgcgtaccgcggggacggcagggccactggcgaagcctttgttgagttcccgacggccgaggttgccaagactgccatgtgcaaggataagatgaccatcgggacgaggtacgtggagctgttcccgtcgaccccggaggaggcgagcagggcgaagccgcgaggcaggcagtgatgggtgccctgccggatgctgagccctgggtgtgagaacagctgctgcatctcgttccagtttcagccttttcgctcttcatgctttataattgtatcatcatgtcggattgtgtttagtttgcgctcgtgtttctagctgtgtggagacattttctgatgcgacttgtctcgaactgcctcttgtgggaaaaagtggtgtatgagatactttgccgagtttgtaactgttaccatccttcctttccaagaa

SEQ ID NO: 2751 - DNA, 749 bp, Triticum aestivum
gcgtcctctccttgagccggagcaccggcactcgtcgcctcctctgcggtccaggaggctgtctgaagacaagagcagcatggagtacactgaggtgctgaagctgcgcgggcttccctactccgccaccatcgaggacatcatcaagttttttgttgagtacgagctgtcggaggagaacgtgcacatcgcttaccgtggggacggcaaggccactggcgaggcctttgtggagttcccgacggccgaggttgccaagactgccatgtgcaaggataagatgaccatcgggacgaggtacgtggagctgttcccgtcaaccccggaggaggcgagcagggcgaagccgcgaggcaggcagtgagcggtgccctgccagacgctgaggcctgggtgtgagaacagctgctacgtctcgttccagtttcagccttttcgctcttcatgctttataattgtatcaatcatgtcggattgtgtttagtttgcgttcctgtttctagctgtgtggagacattttctgatgcgacttgtctcgaactgcctcttgtgggaaaaagtggtgcatgagatactttgctgagtttgtaactggtaccatccttcgtttgaagaaagcatttgtacctcatgttattattcttttttgtgttgttctgtgggcagagattatctgtaaccttttgattgcttttgttgtattttgattactcatcatgcaaaaaccctcgattatgttaaaaaaggct

SEQ ID NO: 2752 - DNA, 703 bp, Triticum aestivum
cagatctgttattgatgggatcgagcatatcgcaatggtgaaaggtgagattggagatggtcaagatattcttgtgagggtccattccgagtgtctcacaggagacatttttggatcagcaagaatgtgattgtggtgaccagcttgcaatgtcaatggagaggattgagaaggctggaaggggtgtactagtttatcttcgtgggcatgaagggaggggcattggtctgggtcacaagcttcgtgcttataacttacaagacgaaggacgtgacactgtggaggctaacgaggaactaggactgcctgtggactcgagggaatatgggatcggtgcacagatattacgtgatctaggagtccgttcaatgaagttgatgactaacaatcctgccaaatatgttggtctgaagggttacgggttgagcattgttggtagggtgcccttggtaactccaataaccactgagaatcagagatacttggagaccaaaagaacgaaaatggggcatgtatactccaattgaccatccgacccaaagcaacggaacagattagaagcgctaggccaactggacttgcttccattcacatttttatctgatgatattcttctacagttgagtttttgggattatttcaatccatatgttccaggttaattgttttcgaggccatgataggtggaaatataaatatttgg

SEQ ID NO: 2753 - DNA, 398 bp, Triticum aestivum
tctggcatgtttgaggataagtccaacaaagagtcaaaattcacatctaccaacacagctgcaacaatcatcacaaagcttgaagacattgcaaagcgcttgcggctaagactcattaagagagacggtgggttgttgaagatgcagagctcgcaaccaggaaggaaaggcgtaatgtccatagataccgagatatttcagattgcaccaaattttcatctggtggaaatcaggaagaccaatggtgatactctcgagtatcagaaggttgaacatgatatgagaccggctttgaaagacattgtttgggcttggaaaggtgagcagccctagtaatagtgtgactactgagtaagcgtagaaattgcaagaatgtgcaatgtttacatgttggagca

SEQ ID NO: 2754 - DNA, 638 bp, Triticum aestivum
catccagtagctgtacaaccgagacatacaagaagcaacagagctcactaacttgaatgcttttgacatcatttctctttcttctgggtttgatctctctggcatgtttgaggataagtccaacaaagagtccaaattcacatctaccaacacagctgcaacaatcatcacaaagcttgaagatattgcaaagcgcttgcggctaagactcatgaagagagacggtgggttgttgaagatgcagagcttgcaaccgggaaggaaaggcgtaatgtccatagataccgagatatttcagattgcaccaaattttcatctggtggaaatcaggaagaccaatggtgatactctcgagtatcagaaggttaaacatgatatgagaccggctttgaaagacattgtttgggcttggcaaggtgagcagccctagtaatagtgtgactactaagtaagcgtagaagttgcaagaatgtgcaatgtttacatgttggaatcaataatgcacttgtctaatttttgtaggtagtttagtgtgttcactgtcatgtttttattatgaaatgctacttctgtattgaccgttattcaattgaaaacatgactattttaactttggtacttgttactactatggattg

SEQ ID NO: 2755 - DNA, 621 bp, Triticum aestivum
tcgtcggcgccgttcgcatgcgccgccccgccgaaattccaggccctccgcgccgcccgcccgccccgccgacgtcgccccttacaccgcccgcgtcaccggcgtcgcccgcggcgacttcttctaccagtgcgtctacctcctcctcgagcccacccccgaggtgatccacacaagcgaccacttctgcgcccacttcgggtttcagagatcaaccccatatatgccacatgtaagcctcttgtatggggatctaacagacgaagagaaggaagcagcaaggaagaaagtagaggaaatggacagtgaaatttctggactgcagttcgagatctccgagctcgcactttatcgaaccgacaccgaggataaaagcttggagtcctgggaactggtggaggtatgccaccttgggaagaagtgatcggttcctcccgatgatatgcttctgctgtaagttgtgactgctcttggggtcttgtaatattatgttttcacctttaagtgtttgatgtaatgatgtgaatgtctagcacccctgttgctttgaataaggaataatgtgaacattggacctaccttggggcttaccttgccacttgtgggttttaatacaagttg

SEQ ID NO: 2756 - DNA, 651 bp, Triticum aestivum
agaatcttcgcgtgaaagaactgaaacctgagactgcattgacagtaataaatgaggatgctgaggaaatcctcgaaggcataaagcccacccctacacttgtctttggatcacttctgggcctctcagcagctacttttgctttgctagaatgggagacgactttgcagtacatcggtgttcttagtcttgggttgacgatctacctgcggttctcttcatacgagggttcggaggatttcctgcaagacctaaagctgttgctgtccccagtaagagtgggcgcggaagcgttctcatgggcagctaagaagctagagcctaacaagattggcctggcaacgtccccctccacaacggcggtgcaggaccgagttctcaaagctgcagcgaagcacgaatcgaagccatctgatgcggaggagtccaccaagacagacagttttgcctccgaagcatgagaagctccctgtgagcgtgtgaactggatccgtagccacttcgccgtcagtctggtgaattgatgtttttgatgttagtaatggtaccatgagccgccgtgacgacgaccggcattgtaaatttataagcagcagtttatattaaacacttgttagcagaagtcttcagttattggtccagtctcagtgc

SEQ ID NO: 2757 - DNA, 616 bp, Triticum aestivum
agaatcttcgtgtgaaagaacttgaaacctgagactgcattgacagtaataaatgaggatgccgaggaaatcctagaaggcataaagcccacccctacacttgtctttggatctcttctgggcctctcagcagtgacttatgctttgctagaatgggagacgactttgcagtacatcggtgttcttagtcttgggttgacaatctacctgcggttctctacgtacgagggttcggaggattttctgcaagacctaaagctgttgctgtccccactaagagtgggcgcggaagcgttctcgtgggcagctaagaagctagagccgaacaagattggcctggcgacgtccccctccacgacggcggtgcaggaccgagttctcaaagcggcagcgaagcacgaatcgaagccgtctgatgcggaggagtccaccaagacagacagttttgcctccgaagcatgagaagctccctgtgagcgtgtgaactggatccgtagccacttcgccgtcagtctggtgaattgatgtttttgatgttaataatggtaccatgagccgccgtgacgacgaccggcattgtaaatttataagcagcagtttatattacacttgttag

SEQ ID NO: 2758 - DNA, 840 bp, Triticum aestivum
agctttggtgttcagcaaccttatcctggttaaaggaggtttcaaatcttgggcaaagaatcttcgcgtgaaagaactgaaaccagagactgcattgacagtaataaatgaggatgctgaggaaatcctcgaaggcataaagcccacccctacacttgtccttggatcccttctgggcttctcagcagtgacttatgctttgctagaatgggagacgactttgcagtacatcggtgttcttagtattgggttgacgatctacctgcggttctctacatacgagggttcggaggatttcctgcaagacctaaagctgttgctgtccccagtaagagtgggcgcggaagcgttctcgtgggcagctaagaagctagagccaaacaagattggcctggcgacgtccccctccacgacggcggtgcaggaccgagttctcaaagcggcagcgatgcacgaatcgaagccgtctgatgcggaggagtccaccaagacagacagttttgcctccgaagcatgagaagctccctgtgagcgtgtgaactggatccgtagccacttcgccgtcagtctggtgaattgatgttttttatgttagtaatggtaccatgagccgccgtgacgacgaccggcattgtaaatttataagcagcagtttatattaaacagttgttagcagaagtcttcagttattggtccagtctcattgcctctcaccaaaaatagagagaaatgctagcagaacttcacttgaaatttttgtacatgccacaccatgcacaaaaaaagagaggtggcgcaagcagattcattctgtggttaagaatggcaatttgtgtgtca

SEQ ID NO: 2759 - DNA, 641 bp, Triticum aestivum
cttctcgcctgaccgctgaaggcctgattggctcgtacatccacgataaccgtatagggtgcatgattgaaatcaactctgagaccgactttgtggctcgcaatgagaaattcaaggagctggtgaatgacctcgcaatgcaagtggtggcatgcccacaggttgaatatgtctcaatggaggacataccagagagtgttgtcagcaaggagaaggagattgagatgcagagggaggacctgcagtcgaaacccgaaaacatcagggagaagatcgtggaagggcggatatcaaagaggctcggagtgatggccctcctggagcagcccttcatcaaggatgacagcaagacggtgaaggatctcgttaaggagacgatcgccggcctgggggagaacatcaaggtacggaggtttgtcaggtataccctcggcgagaactgataaatgagacagtgacctccgctacaatccatggcatcaggagccgggcacattttgattcatcgtggtgcatagctgctgctagtttgtactgagttccatgtataattttgtatcacttgttaccattgttcctggttacaaacaacacacttttttgcacaccttcaatgtagatgacaggagagatcaatatat

SEQ ID NO: 2760 - DNA, 741 bp, Triticum aestivum
tgcaagaaagcgctggctgagactgggggtgacttcaggggctcaggagttcctcaggaaaaagggcctctcgtccgcagacaagaagtcgtctcgcctgaccgctgaaggtctgattggctcatacatccacgacaaccgcataggatgcatgattgaaatcaactctgagactgacttcgtggctcgcaatgagaaattcaaggagctggtgaatgacctcgcaatgcaagtggtggcatgcccacaggttgaatatgtctcaatggaggacataccagagagtgttgtcagcaaggagaaggagattgagatgcagagggaggacctgcagtcgaaacccgaaaacatcagggagaagattgtggaagggcggatatcaaagaggcttggagtgatggccctcctggagcagcccttcatcaaggatgacagcaagacggtgaaggatctcgttaaggagacgatcgccggcctgggggagaacatcaaggtacggaggtttgtcaggtataccctcggcgagaactgataaatgagacagtgacctccgttacaatccatggcatcaggagtcgggcacattttgattcatcgtggtgcatagctgctgctagtttgtactgagttccatgtataattttgtatcacttgttaccattgttcctggttacaacaacacacttttttgcacaccttcaatgtagatgagaggagagatcaatatattgtccaaaaagg

SEQ ID NO: 2761 - DNA, 641 bp, Triticum aestivum
cgtgggtgatcccaggcgagatattcctggtggaggtccggtcgacggggaatatctgggcgtcgttcgggtggtcgtggggtcccctgacgtgggtgatccccggcgagatattcccggtggaggtccggtcggcggggcagggcatcagcgtggccgtcaacctcggcgccaccttcgtgctcacgcagacgttcctctccgtgctgtgcagcttcaagtacgccacgttcatctactacgcggcctgggtcgccgtcatgacagccttcgtggtggcattcctgccggagaccaagggagtgcccctggaggccatgggcgccgtctgggcgcggcactggtactggggacgcttcgtcaaggtgcagcagccgcccaagaacaccgacgcgctcataaactgacgacgtttagcgcctttgtcatcgtggcaaagatgggtatgggtgtggctttgatctccgtacccgtacgtgtttgtgtctgtgtgttcgtgtgtgggtatatggagccgcagtgctgcttgtggaaagatttgtgtttcttttttcttttcgttttcttttcttttgtggaaaaatgattgttgtttcgtgctgttgtagtacgtccattcgtcattccggattgaataacat

SEQ ID NO: 2762 - DNA, 895 bp, Triticum aestivum
gaggcttacttgttgtcccagttcacttagatggaaccttgcaggatgtaactaaatccatgcaagaaaagaaggagtacctttcaacaatcaccattctccagatatttcgccagctatgtgcaggactgaagcatatgcacagttttgagccaccatatgctcacaatggagttaaaccagacaatgtcctcataactcagaggaaggaacagcctcatcttgctatcttgatggactttgaaagtgctcgcccagcaagaagagctattagatcacaagcagaagctttgcagctgcaggaatgggcttcagagcactgctctgcacatttccgggcacctgaattatgggagtgcccgccccatgccgatattgatgagaggacagatgtatggtctttgggatgcaccctttatgctatgatgtatggaaagtcaccatttgattatgagctcgatgaatctgctggcgaaagcttagtaacagtcattaaaagtgcacaggtgaagtggcctactgagacgggttcgtcctatcctgacactctccgccagtttgtaacctggatgctgcagccacatcctgcagttcgtcccaatattgacgatattatcatccacgttgataaactcattgcgaagcactcaacttgatgagtaaatggaactgcttcaacagaaagaagaaaaggaattcatatgtaagtttatagaacatctgcttgattcattaaaagtgacatgttccttaatagtcattgtatggaaggaaaaaagaggatgttttctgtagcaggcttcaccgatttaagaactggctgttcctgatgtctgtagatgtatgtaatttttgtgccaaagtgagattcaggggtcaataaatgtatcatcat

SEQ ID NO: 2763 - DNA, 770 bp, Triticum aestivum
atggaaggagcaacccaactggcaccattggtgaacctttttctgcatcagccaatgcatatgaaatgaacaacatagatacatatggcaacaactctatttatggtgactcaacctggaggttcacgtcatctgagatagatattcctccttttgataatgatcttggaaatatcgatccagatatcaaatcgaacatgccagcaagttacatgggcaactatactgttaataataatcagacaagcagaggtatcacttcctaggtgagaatattattatagtcatatatatgacttgggataggcaagacacccattatatcaggtattcaggtgcagtactgtgaattggtgatatcagattaatatacaggttagttaattgtttctagctaaccagaggtgtggtttacggacaccaaccaacatgctagaggagcgggatacaaacattttgtgaaggtttcagattttagtttaattttctacgtgtattaggtcttttggttttccaatgagatgtgcagtggtgattgcggcacacacttagaaggtgttccaacataagctggaattctgtcatacggacgacaaacttgtataccagggatgctgtattatcttgcccatttatggcaacattagcttgcgtgtttttcctcttttccttttttaaccatttcatttgttactagaggatttggtcggctttatactagtaaaaactatttgggggtgccaatgccatcctggtccccattaataaag

SEQ ID NO: 2764 - DNA, 682 bp, Triticum aestivum
aacaacggctccgcgacacggccgccatcgcgtcgtcccgcgccgccgagctgtacggcatggagatcctcgccgacggcatccaggacgactgcggcaacgtgacccggttcgtgatgctggcacagggagcccatcgtgccgcgcacggaccggccgttcaagaccagcatcgtgttcgcgcacgacaaggagggcacctccgtgctcttcaaggtgctctccgccttcgccttccgcgacatcacgctgaccaagatcgagagccggccgcaccgccaccgccccatccgcctggtggacgacgccaaccgcggcacggcgaagcatttcgagtacatgttctacgtcgacttccaggcgtccctggcggagccgcgggcgcagaacgcgctggccgaggtccaggagttcacgtcgttcctgcgggtgctcgggagctacccgatgacatgaccccgatgaccgccggctcctcctccaccgtcacatcgtccgactcgtagctccctagaggtatcgaggagcagtaggggagtcggttaatttgtggtcatgtcgtcggcccgctcctccctcgttggcagctggggtaattagttttgttcctcatgtttcttgtcataatacatgtaaaatcgtgccatttgagccagttaagttaatacgcagtggatatacc

SEQ ID NO: 2765 - DNA, 707 bp, Triticum aestivum
gcctcgcgacacaccgccatcgcgtcgtcccgcgccgccgagctgtacggcatggagattctcgccgacggcatccaggacgactgcggcaacgtgacccggttcgtgatgctggccagggagcccatcgtgccgcgcacggaccggccgttcaagaccagcatcgtgttcgcgcacgacaaggagggcacctccgtgctcttcaaggtgctctccgccttcgccttccgcgacatcaccctgaccaagatcgagagccggccgcaccgccaccgccccatccgcctggtggacgacgccaaccgcggcacggcgaagcatttcgagtacatgttctacgtggacttccaggcgtccctggcggagccgcgggcgcagaacgcgctggccgaggtccaggagttcacgtcgttcctgcgggtgctcgggagctacccgatggacatgacccctatgaccgccggctcctcctccaccgtcacatcgtccgactcgtagctccctagaggtatcgaggagaatcggtggagcagtagggacgtcggttaatttgtggtcatgtcgtcccactcctccctcgttggcagctggggtaattagttttgttctttatgttccttgtcataatacatgtaaaatcgtgccgtttgagccagttaatacgcagtggaatatagcctgtgagatacaacatgactgcatgtcgt

SEQ ID NO: 2766 - DNA, 607 bp, Triticum aestivum
gttcaaatagcccaactgacactaaaaatcaagcacttgtcatccgttctacacaaaaaggataagcactctcgaaaggggctccaggacatggtccagaggaggaagaagtacctcaagtacctgcgcaggaccgactgggattcgtactgcctcgtcctgtcgaagctggggctccgcgacacgccggagtacaaggcgcccgactacaagaagacccagccgacgaaggcgcagtcgaagaagagcaagagcaagaggaagagaaagatgaaggcgtagagctccgctgcccgggacagatgatgattttccacactcttcgccttctctttggccttgagaactccgttggcggtagaatccatcgggtcgacaggcaccgatgctcaagatatctctgctcggccaggtctttgcagtgttgtaattttttgatccacttcttctgtaataaccagtcgcttgacatagctgcatgtttttcttgttctgtagcaacagaatgtttgttgatcctaggtctcagctctcccctgccctgttatcaggccaatggattgaggaacaaacgggatgatgattacttgtttcttcatttaatcat

SEQ ID NO: 2767 - DNA, 761 bp, Triticum aestivum
  misc_feature (7)..(7): n = any nucleotide
  misc_feature (28)..(28): n = any nucleotide
  misc_feature (30)..(30): n = any nucleotide
  misc_feature (58)..(58): n = any nucleotide
  misc_feature (65)..(66): n = any nucleotide
  misc_feature (711)..(711): n = any nucleotide
actattncaaacatcggtggaaagccgntnccggagtacatgatgagcaatcttccgncgcaggnngagttgctagagaggtatttctatcctgatcacatgtcaggcgaagagaagatgaaattggagcttcagaaggtcagggatgagttcaagatgtccgagaatgactgtggttccgcacgagttcaaatagcccaactgacactaaaaatcaagcacttgtcatccgttctacacaaaaaggataagcactctcgaaaggggctccaggacatggtccagaggaggaagaagtacctcaagtacctgcgcaggaccgactgggactcatactgcctcgtcctgtcaaagttggggctccgcgacacgcccgagtacaaggcggccgactacaagaagacccagccgacgaaggcgcagtcgaagcagagcaagagcaagaggaagagaaagatgaaggcgtagagctccgcggcgcgggacagatgataatttcccacactcttctccttctctttggcattgagaactccgttggcggtagaatccgtcgggtcgacgggcactgaggctcaagatgtctctgccctgccaggtctttgcagtgttgtaattttttgatccacttcttctgtaataaccagtcgcttgacatagctgcatgtttttcttgttctgtagcaacagaatgtttgttgatcctaggtntcagctctcccctgccctgttatcaggccaatggattgaggaacagacgg

SEQ ID NO: 2768 - DNA, 535 bp, Triticum aestivum
  misc_feature (11)..(11): n = any nucleotide
  misc_feature (37)..(37): n = any nucleotide
  misc_feature (52)..(52): n = any nucleotide
  misc_feature (479)..(479): n = any nucleotide
ccgagttggtngcccatggtgcccgcaggagccgttncttttcgccggcacnatccacgacaacattcgcctacgggcgcgagggcgcgaccgaggcggaggtggtggaggcggcaacgcaggccaacgcgcacaagttcgtgtcggcgctgccggaagggtacaagacgtgcgtcggggagcgcggggtgcagctgtcgggagggcagcggcagcggatcgccatcgcgcgagcgctggtgaagcaggcggccatcatgctgctggacgaggcgacgagtgccctggacgccgagtcggagcggtgcgtgcaggaggcgctggaccgggccgggtcagggtcagggcgaacgaccatcgtggtggcgcaccggctggccacggtgcggaacgcgcacaccatcgcggtgatcgacgacggcaaggtggtggagcaagggtcgcactcgcatctgctcaaccatcaccccgacggaatntacgcgcggatgctgcagttccagcgcctcacgccccacacccttgccgtgcccag

SEQ ID NO: 2769 - DNA, 795 bp, Triticum aestivum
tgctggcgctcatccagcgcttctacgagcccagctccgggcgcgtgctcctggacggcaaggacatccgcaagtacaacctcaaggcgctgcggcgagtggtggccatggtgccgcaggagccgtttcttttcgccggcaccatccacgacaacatcgcctacggccgcgagggcgctaccgaggcggaggtggtggatgcggcaacgcaggccaacgcgcacaagttcgtgtcggcgctgccggaagggtacaagacgtgcgtcggggagcgcggggtgcagctgtcgggagggcagcgccagcggatcgccatcgcgcgagcgctggtgaagcaggcggccatcatgctgctggacgaggcgacgagtgcgctggacgccgagtcggagcggtgcgtgcaggaggcgctggaccgggccgggtcagggtcagggcgaacgaccatcgtggtggcgcaccgcctggccacggtgcggaacgcgcacaccatcgcggtcatcgacgacggcaaggtggtggagcaagggtcgcactcgcacctgctcaaccatcaccccgacggatgctacgcgcggatgctgcagctgcagcgcctcacgccccacacccttgccgtgcccggacccggaccctctgcatccaacgtttgatacatcttccatgcacggttccactcgcgttttgctttaggatcttcttttcttctaaaaaaatttgttgctggctggcgggaggagggtggtcacaattgacaagccgtatgtgctgccaatgccatgatccgtattacac

SEQ ID NO: 2770 - DNA, 619 bp, Triticum aestivum
cgggtcacccgcaccgagttcgctacagccaggcgccttccacgaccccacctacgaggacgtctgcaccggcgccaccggtcacaacgaggtcgtccgcgtccagtacgaccccgccgcctgcaagtacgatgacctcctcgacaccttctgggcgcgccacgacccgaccacgcccaatcgccaggggggcgacgtcggaacccagtacaggtcagggatctactactacacatcggagcaggagaaggcggcgctcgagtctatggagaagcagcagaaggctcagaaccggaagatagtcactgagatcctcccggcgaagaggttctacagggcggaggagtaccaccagcagtaccttgcgaagggcggtcgctttggcttcaaacagtccacggagaagggctgcaacgaccccatccgctgctatggatgaacgagcctggtgacctgaccagcatggaagcacacaggcagcaatgttatagtcagataacgctgcctgaataatggtggatgtcagctgaatttcactacagttttcctagcttgtgctgttacctaaatgcaaggattgtaagagagaagaaagttattaccattataccttattagt

SEQ ID NO: 2771 - DNA, 747 bp, Triticum aestivum
gcagttcggggccggctgcgtctggggcgtggagcctggtgttccagcgcgtgcccggggtcacccgcaccgaggtcggctacagccagggcgcctttcatgaccccacctacgaggacgtctgcaccggcgccaccggccacaacgaggtcgtccgcgtccagtacgaccccgccgcctgcaagtacgacgacctcctcgacaccttctgggcgcgccacgacccgaccacgcccaatcgccaggggggcgatgtcggaacccagtacaggtcagggatctactactacacatcggagcaggagaaggcggcgctcgagtctatggagaagcagcagaaggttcagaaccggaagatagtcactgagatcctccccgcgaagaggttctacagggcggaggagtaccaccagcagtaccttgcgaagggcggtcgctttggcttcaaacagtccacggagaagggctgcaacgaccccatccgctgctacggatgagcgagcctggtgacctgaccagcatggaagcacacaagcagcaattttatagtcaagaatgctgcctgaataatggtggatgtcagctgaatttcactacagttttcctagcttgtgctgttacctaaatgcaaggattgtaagagagaagaaagttattaccattatactttattagtgttgaattaccattgtaatttagtgttgaattgccatcgtacttaggataaattatggcctgagtaataaa

SEQ ID NO: 2772 - DNA, 713 bp, Triticum aestivum
agctggtgttccagcgcgtgcccggggtcacccgcaccgaggtcggctacagccagggcgccttccacgaccccacctacgaggacgtctgcaccgggcgccaccggccacaacgaggtcgttcgcgtccagtacgaccccgccgcctgcaagtacgacgacctcctcgaaaccttctgggcgcgccacgacccgaccacgcccaatcgccaggggggcgacgtcggaacccagtacaggtcagggatctactactacacatcagagcaggagaaggcggcgctcgagtctatggagaagcagcagaaggttcagaaccggaagatagtcactgagatcctccccgcgaagaggttctacaaggcggaggagtaccaccagcagtaccttgcgaagggcggtcgctttggcttcaaacagtccacggagaagggctgcaacgaccccatccgctgctacggatgaacgagcctggtgacctgaccagcatggaagcacacaagcagcaatgttatagtcgagaacgctgcctgaataatggtggatgtcagccgaatttcactacagttttcctagcttgtgctgttacatacaaaggattgtaagagagaagaaagttattaccattattccttattagtgttgaattaccattgtaatttagtgttgaattgccatcatccttaggataaattatggcctgggtaataaag

SEQ ID NO: 2773 - DNA, 756 bp, Triticum aestivum
aaagttcacggcctgctagaaacatcggcgttcatgatctatggtcatccaaagggatgattgtagacgatgaatacgtcatttggctcggcaacatcatcagagatccttggctggctcgagagatacccgaaattgcaatgggtgcctaccagcctcatcatgcatggtcttcgaagaagggtcatcctcacggccaggtatatgggtataggaactccctctgggcagaacaccttggtatggttgatgaccacttcaaggaaccttctagtctggaatgtgtaagattagtgaaccaaatagccgaagaaaactgggaaagattcgcatcagaagagatgaaaacgttgcaagggcacctcctcagatacccagtgaaggtagagtccgatggtaagatcgtcccgctgcccgaccaagaatgcttccccgacgttggtggcaagatctgcggcgctccgacctcgcttcctgattcgctgacgatgtagcatcacagtactgacttctcttcagggtccaagctggttcttttgctcacctgtaaaacctctctgaatgtcttgccgacggatggtaatctgtgatcacacactgtgtggcgtatagggaaagcacgggctgttcacggtgtgttgtagagttgtgcctttgtaagattttttctacagtctgtacatgagacaggacagggtcattgatagttttggacatctctactgcgaactgttcacaaccattttcatttggtgc

SEQ ID NO: 2774 - DNA, 663 bp, Triticum aestivum
ttcatgcaaaagggatgattgtagacgatgaatacgtaattttgggctcggcaaacattcaatcagagatccttggctggctcgagagataccgaaatcgcaatgggtgcctaccagcctcatcatgcatggtcttcgaagaagggtcatcctcacggccaggtgtatgggtataggaactccctctgggcagaacaccttggtatggttgatgaccacttcaaggaaccttctagcctggactgtgtaagattagtgaaccaaatagccgaagaaaactgggaaagattcgcgtcagaagagatgaaaacgttgcaagggcacctcctcagatacccagtgaaggtagagcccgatggtaagattgtcccgctgcccgaccaagaatgcttccccgacgttggcggcaagatctgcggcgctccgacctcgcttcctgattcgctgacgatgtagcatcacagtactgacttctcttcagggtccaatctggttcgtttgctcacctgtaaaacctctctgaatgtcttgtctcgccgacggatggtaatctgtgatcacacattgtgtggcgtatagggaaagcacgggctgttcacggtgtgttgtagagttgtgcctttgtaagattttttctacagtctgacacacacaggcatgcca

SEQ ID NO: 2775 - DNA, 664 bp, Triticum aestivum
catcgatcagagatccttgctggctcgagagataccgaaatcgcaatgggtgcctaccagcctcatcatgcatggtcttcgaagaagggtcatcctcacggccaggtatatgggtataggagctccctctgggcagagcaccttggtatggttgacgaccacttcaaggaaccttctagcctggagtgtgtaagattagtgaaccaaatagccgaagaaaactgggaaaggttcgcatcagaagagatgaaaacgttgcaagggcacctcctcagatacccagtgaaggtagagcccgatggtaagatcgtcccgctgcccgaccaagaatgcttccctgacgttggcggcaagatctgcggcgctccgacctcgcttcctgattcgctgacgatgtagcgtcacagtactgacttctcttcagggtccaagctggttcttttgctcacctgtaaaacctctctgaatgtcttgtcttgccgacggaggataatctgtgatcacacattgtgtggcgtatagggaaagcacgggctgttcacggtgtgttgtagagttgtgcctttgtaagattttttctagtctgtacatgggcaggacaggacagggccattgatagtttttgacatttctactgcgaactgtgcacgtacaagggggttca

SEQ ID NO: 2776 - DNA, 673 bp, Triticum aestivum
actggggggactctggacctgcatgcactgaatgtccagatcttccttaagatgcaccggtcagattatgctgacaagcaactgaagatcatgcaacaaaccgacgaggaccatacactgacacaactagcaaatgcttggctcgatattgctgttggtggctctaagatccgggaagcttatctcatattccaggacttcgctgaaaagtaccctatgactggaatggttcttaatggcaaggcagtttgctgtatgcatatggggagctttgaggaggctgaaactctattgcttgaagccctaaacaaggatgcaaaggatcctgaaactcttgccaatcttattgtatgtaatctccaccttggcaaaccgtcgtcacgatacttcagccagctgaagctgtcgcaccctgatcacgtgctagttaagaccaccacgtcagcggaggataatttcgagagggcactccaagccgtcgcctgaaacacccctgcctcattccagtttgcgcattgagcatcccctgttccattttgaagtgctttaacagagtgaattgtattggttttgctttatattgttctgtggtaacacaccgctcggccaaccctgtactcaaacacaaacacctgctgtatgaacggatatatatgtagaatctccaatcatg

SEQ ID NO: 2777 - DNA, 776 bp, Triticum aestivum
catgagcaagactacaatgaggctctcaagcacacacacactggggggactctggacctgcatgcactgaacgtccaaatcttccttaagatgcaccggtcagattatgctgacaaacaactgaagatcatgcaacaaactgacgaggaccatacactgacacaactagcaaatgcttggctcgatattgctgttggtggctctaagatccgggaagcttatctcatattccaggactttgctgaaaagtaccctatgaccggaatggttcttaatggcaaggcagtttgctgtatgcatatggggagctttgaggaggctgaaactctattgcttgaagccctaaacaaggatgcaaaggatcctgaaactcttgccaatcttattgtatgtaatctccaccttggcaaaccgtcgtcacgatacttcagccagctgaagctgtcgcaccctgatcacgtgctagttaagaccaccacgtcagcggagggcaacttcgagagggcgctccaagccgtcgcctgaaacatccctgcctcattcgagttagcgcattgagcatcccctgttccattttgaagtgctttaacagagtgaattgtattggttttgcattatattgttctgtgtaacacaccgctcagccaaccctgtactcaaacacaaacacccgctgtatgaacggatatatatgtagaatctccaatcatggcatttgttgtcaacatcggtatcttgttatgttgtgctgggctggctaattcttccgccagtga

SEQ ID NO: 2778 - DNA, 623 bp, Triticum aestivum
  misc_feature (218)..(218): n = any nucleotide
  misc_feature (344)..(344): n = any nucleotide
aagcgcttggagattgccccatctgaagtcttatccatgagaaagtctgccgttccaatgagcattctttggcaaatccacagtatttccttgttggcgctgccgaggttttcactaatataggtctacttgagttttcgtacgatcaggcaccagatgccatgaggagtttatgtactgcatttgcgctcgtcatggtctcagcggggagctatttnagctcattcatattgaccctggtgtcgtatgttacaactcgaggtggagatcctggatggatcccggataacatgaatgaaggccatcttgaccggttcttttggttgattgcagggatcagcttngtggaatttgctggtttacatcagttgtgcgatgaaatacaaatataagaatgtgtgatggtcatacctactgtggaataagttcttgtaatttcagattccatattcatgggggcagttcattgtatagactaagacatcacatgagctgcccttctcagaaagtcctcaagaaaaggacttcaattcttctagtgatgtattttagacaaattattagtttggtgagtgtgttttgtatgaaatttgtaacaccagagttatacaaagacaattttg

SEQ ID NO: 2779 - DNA, 708 bp, Triticum aestivum
cattgaagcccatctttgcccagaccgtcggctgcaaagttgattacatcatccataccggtaaaagtctccacagtttcggtcatgaaaaatgtaaactacctgccgaatgcactcaccaagctggaaggtgaggaaaatggtgggtttaccggcatctggttggatgatgaggatttcgttgctgagggttcaaacatgaatgttggctttgtgacaccgaacaaggaacttctcatgccccgcttcgacaagatcctgagtgggtgcacggcaaaacgggttctggcccttgccgagcagctagtggagaatggaatgctcagtgggatatcttcaaggaatgtgagtgtccaggaagggaaggaggccgacgagatgatgctcattgggagtggaattcttgtcaaacctgttgttcagtgggatgatcagatgattggctccggtaaagaaggcccaattgctcaaacacttttcagccttattcttgaggacatgagatctggtcccccctcagttcgtatccctgtcccttactgaaaccccctgcattatagtccttgcaggatacacgtgaacaaagacataaatactgtaaatttcatgtgtcacataaaagctacatgaatatactggcagcagtgttcctgttggtctttgcaaaaatcatttggaaccattcttgtgtgtcaaccttatgccttt

SEQ ID NO: 2780 - DNA, 879 bp, Triticum aestivum
cttcatctggctgtagaaacccagctctttacgctgtcgtcattgaaagtccatctttgccagaaccatctggctgcaaagtgatcacatcatccataccggtaaagtctcaacaatttgcggtcatgaaaaatgtaaactacctgccgaatgcactcaccaaggtggaaggtgaggaaaatggtgggtttaccggcatctggttggatgatgagggtttcgtcgctgagggttcaaacatgaatgttggctttgtgacaccgaacaaggagcttctcatgccccgcttcgacaagatcctgagtgggtgcacggcaaaacgggttctggcccttgccgagcagctagtggagaatggaatgctcagtgggatatctttaaggaatgtgagtgtccaggaagggaaggaggccgacgagatgatgctcattggaagtggaattcttgtcaaacctgttgttcagtgggatgatcagatgattggctccggtaaagaaggcccaattgctcaaacacttttcaaccttgttcttgaggacatgagatctggtccaccttcagttcgtatccctgtcccttactgaaaccctctgcattatagtccttgcagaatacacgtgaacaaagagataaatactgtaaattccatgtgtcacataaaagctacatgaatatactggcagcagtgttccttttggtctttgcagaaatcatttggagccactcttgtgtgtcaaccttatgcctttttaggcatgttaaaccaaaacactcttctactctagtttgctgcacatatacctactattgaagtgtagagacgaggcttttagtgaaatgtttccttttctaaacgaggtttgcgttaatatgacgaaa

SEQ ID NO: 2781 - DNA, 681 bp, Triticum aestivum
tgcgttcacattggctactagagcggccatgtgattcccctatctttatcagtttggcttgtggaagcctttcgggagttgcgtcatcaacttttacatttccattggatcttgtaagacgccgcaagcagttggaaggtgcagctgggagggccaatgtctacaagacaggacttgttggaacgtttgggcatattattcagacagaaggttatagaggattgtatagagggatcttgcctgagtactgcaaagtggttcccagcgtcggcctcatttttatgacatacgagacactgaagtccatgttcacaggaggggcatcagatgaatagatctccaatgtctgatcatgcttgacagttttgacacctgggccagagtagcattggaagtgattagggagggagggggaggaagagatgtgtttgtagcatatggtaggatttaggtggtgctaaattttggagttcataacgtagcagtatcatcaaacagtcttttatgtggctataggttttcttgtagtgcacccaagaagatcagtaagtgccataggtcttccaaaattttgctgtccacccttgttttgtgtatgttcacattttcagttggtaatgtactggctatcatcttcagcctggcgatttcatacctctggaatacggcctctgatataat

SEQ ID NO: 2782 - DNA, 1031 bp, Triticum aestivum
ggacattcttgctggtcggccaatcacggtttatgagagctccggtggaggcacacaccagaccaccatttcccgggatttcacctacattgatgatattgtgaaaggatgtattggggcattggatacagctgggcggagcacaggcagcggcggcaagaagcgaggcccagcgccattcaggacatacaatttggggaacacttctccagtgccggtgacacagcttgtggatttactggagaagatgctcaaggtgaaggccgtgaggagggttgtcaagatgccaaggaacggggatgtgccgtacacgcatgctaacatcagccttgcacagcgggagcttgggtatcggccatccactgatctccaaacagggctcaagaagtttgtgcggtggtatcttgagtactacaatcctgagttggctgtgaagcagaagcagcatggcagtagcaacggcaagggttcacgcggtcggaatggcagcacgagcagcgcaagatgactgactattcagtttctggatggccctcttctgacggtgtgtatcagagttctagtccagtacttaattcatcagattttgagaggcccgttttacccagcgccttcaagtgaaacgaaacaagcatgaagtagttagtgttgaaaactgttgcttctgtttgcttccctgtagctgcgcatcactccctagttccattagttggttcttaggatgacactgctaggaagatttttcaatcattttggggagcaggctgtgcattgcaaagactacgatagattcttttagtgacatttgtaccacgagagagaaggaagtatatcatgactgtttcttttgttcaattgaagtagcttcgatcaatatttagttctctctggagcctgaaccctacatcttactgatattcatgctagtttcctgtatggtggtgcatattgcgtgcacttgtggtataaaacatgtctttgccatgacatcttaaaatctagcttttcctttgtggatacactcatgtgat

SEQ ID NO: 2783 - DNA, 680 bp, Triticum aestivum
ggatctttatagccaagcaggaacgtaaagggggcccacaaaatttcgaataccccaggaacttcccatatcaagatgacagccaagaagcagccagcaatcttaatagccataactgatggtatctcattatacttgttaaacaggccaagtgatgcgtacaccataagtgtaaatagggtgtgcattgggcagatatagtacaacataaaatcattgtcaaggacaatgcaacagaaagccacaaagaaatttagcctccacatcatctgtgcaaatcttgcaatgctaaaatctttcttgatataatagtacgagaaattcccaaatccagtcatccaaacatagcaagcaatgaaaacacggattgcattatatatttctgatgcgccaaaatagtggtacatcagaaataagacctgcatccaccctttccattcctcagtttggtggcgattaagataaagtatggactttccagaaaatgctgatttctcctggtgcttcttaagtgaagtaagtgctgatgctatgatgagaagaatgtacagaaacagaaacagggctctgttgtagttcttcttgggctctggtaatatgttggtccggtccccatgtgtcacaaacaaaacaaaagagggcgcggcctaaaaagacccagtatatagcgcggaggaagg

SEQ ID NO: 2784 - DNA, 640 bp, Triticum aestivum
caaaggactcccctcccccctggtgtacccccagctgatgtctatctttttggccttcttgatgaggagcagaagagtaccctacctggaaactttgagcgacactgggggatcttctcgtttgatgggcaggccaagtacccgttaaaccttgggttaggcaacccggtgctgaagaatgctaaagaggtgccctatcttccgtcgcggtggtgcgtcgcgaacccggctcagagcctcgacaacgcgtcaactcacctgaagcttgcttgcgacatggcggattgcaccaccctctactacggagggtcgtgcaacggcatcggggagaagggcaacgtctcctttgctttcaacagctactaccagatgcagaagcaggatgccaagagctgtgattttgatgggcatgggctgataactttccttgatccatctatgggtgaatgccgctttcttgttggcatcgatgatagcaagagctctgcggttgcctcttgtggcaattgctgtggggtcttctgtggggtgtcgattttcgctttgtggttgttcatgtaccttaggatgatgagctctgcctgatggttgaaatgatctattggggcatgataggcgtgcctttgtgaaatactactag

SEQ ID NO: 2785 - DNA, 454 bp, Triticum aestivum
  misc_feature (308)..(308): n = any nucleotide
ggaaatgtttgtagacttgcatcctttcacaaacacatctccttacactgtggttgagaccatgtccttggctaaagctcttatactttttcgtgaagttggattaagacaccttttggttcttccaaaaacttccaagagggcgcctgttgttggcatattaacacggcatgacttcatgcctgagcacgtattgggtctccatccgtacctgttcaagagcagatggaagaaggtgcgatttggcaagacagccttctccaacttcttttgacaattgccatagtagctaatgattcggagaattnaccaagcgacagcatcagtacattgtatgggaaccatcgggtggtagtttataccaaccatatacggataagctagttgtattatagcggcaatagcattttctggtatcacattacaatgtatgttgctcctgagagatgttctg

SEQ ID NO: 2786 - DNA, 981 bp, Triticum aestivum
ctttgctttcggtgcgtggacatggtgcttcaaatggaggtgttcttgccggtctggctgcctgcggtgtgatgatgagcattgtttctaccgcttgtgatctgatgcaggacttcaaaacaggatacctgacactggcctcaccaaggtcaatgtttatcagccaaatcataggcactgcaatgggttgcgtcattgctccctgtgttttctggcttttttacaaggcctttgaagacgttgggatcagtggaagtgagtaccctgcaccaaatgctgccatcttccgcagcatggcaatactaggtgtcgatggcttctcatcgccgccaaaaaactgcatcactctttgctacatattctttgttggagcaatcgctgttaacttgataagagatcttgttcccaagaaggtatcgagatttatgccaatcccaatggcgatggcgataccattctacctaggaccatatttcggcatcgatatgttcatcgggacagtgatcctttttgtctggcaaaggctggacagagtaaaatcagacacatatgcacctgcagttgcttccggcttgatttgtggcgatgggttgtgggttttgccccagtcaatgcttgctcttgccaaggtgaaacctccaatctgtatgaagttcctgtcaagaggggtgaacgccaaggtggatgctttcatcgcaacattatcatagaatgttcgtcgctgttgtcaatcaaagattcaggttgatgccagacatgtatgaaatttgaatttgtccatttatttgaaaaaataagccagtgtagtgtagttgatatgactagggtcccgttcggtatccctccgctcctggagcagatggagctgcagttagaaatctcggagcgggcgaaacggtgctccccagatccgcggattttgaggagccggtggattgccgaacaggccctagatataaaactatgcacaaagaaatgaac

SEQ ID NO: 2787 - DNA, 591 bp, Triticum aestivum
gggagcattatcagtttttctggtatcagatgcttcgagctttgaaatatatgcacacagcaaatgtctatcaccgagatttgaagcccaagaatgtgcttgccaatgcaaattgcaaactcaaaatttgtgactttggtttggcgagagttgcattcaatgatgcacctacgacagtcttctggacagattatgtggcaacgagatggtatagagcacctgaactttgtgggtccttttattccaagtatacaccagctattgatatatggagtatagggtgcatttttgccgaggtgttgattggaaagcctctatttcctggtaaaaatgttgttcaccagctggatttgataactgatgttctggggacaccttcattagatgctatttctcaggtgcggaatgacaaggcaagaaatatctgacatgcatgcggaagaaacagcctgcttccttttcgcagaaatttccgaaggctgacccattagcattacgattgcttaggaggcttctagcttttgatccaaaggatcgtccctctgctgaagaggcattggcagatccatactttaatggactagcaaaggt

SEQ ID NO: 2788 - DNA, 617 bp, Triticum aestivum
cgtggagcttccacatagcagcaacgatctggatgagtacggctgcatggcaagttacaatagcgcggttgtctactacaatgaactgctgaacaacagcttggccgaggttaggaagacgctgcagaatgcgtcgatcgtgtacgtcgacaaatactctgccatgctcgagctgttcaggcatccagaagatcatgggctcaagtatgggaccaaggcttgctgcggatacggtggtggagcttacaattttgacccagatctgtactgtggcaccagcaagattgtcaagggcaacattgcgagtgcgacggcctgcggagacccgcagaactacgtgagctgggatggaatccatgccacagaagccgcaaacaatatcatagcatctgcactgatgagtggctactactcgtatccaccttccgatctttcaaaactttgccggccatgaccccatagcctgatctctgatcaaagcacaagtttactcagagatagtgttgctcaaacaaagttattccgctgtcagataacagggcaagtttagtcagagacagtgttgctgacaccagattactcattctatcagttaaaagatgtgtagaatgatacag

SEQ ID NO: 2789 - DNA, 568 bp, Triticum aestivum
  misc_feature (8)..(8): n = any nucleotide
  misc_feature (505)..(505): n = any nucleotide
attcgtcntcctcaagctcctagcatcgggcttgtgtactcccagtggcatatgagatcatggagaagaactcagcggacgtgacgcagggcaagttctcgcgccggaacctggtgccccggctgctgctgcggacgctctacctggccttctgcgcgctcatggccgcgatgctgcccttctttggtgacattgtcggcgtggtcggcgccgtggggttcatcccgctcgactttgtcctccctgtcatcatgtacaacatcgcgcttgcgccgccgaggaggtccacgctgtacatcgccaacacggtcatcatggccgtcttcacaggcgtcggggccatcggcgccttcgcctctatacggaagctcgtgctagacgcgggccagtttaaactcttcagcaacaacgtagtcgactgaagtacgcacaactatgtagagactagtttgttaggtgcttagcccttgatttcttgaggtataggcgtatagctaagtaattnagctttgttcctccccttttacatagttattaatttacacgtacgcacgcatgcatccgtgga

SEQ ID NO: 2790 - DNA, 982 bp, Triticum aestivum
gtcaaatcgcccccttggatgagatagtcaaattgaaggagaagtatctgttccgtgttattctggaggagtctcattcgtttggtgtgctcggcaagtctgggcggggccttgccgaacattatggtgtaccgattgacaaaattgatatcatcactgctggaatgggaaatgcattagctactgatggtgggttctgtacaggaagtgctagagttgttgatcatcagcgtctaagcagcgctggctatgttttctctgcctctctgccaccctatcttgccagtgccgcagtttctgctgtaaactacctggaggagaatccttcagttctcgctaacctaaggagcaatgttgcgcttctgcatgcaggactgtcagatgcaccaggacttgagatttctagccatgccctgtcaccgatcgtcttccttaagctgaagaaatcgactggttctctggccactgacctagatcttcttgaaaccattgccgagcaggttttgaaggaagattccgttttcattgtggcgtcgaagaggtcaactctggacagatgcaagctccccgtcggaatccggctgttcgtttcagctggtcacactgaatctgacatctccaaagtgtgttcatccttgaagaggatttctgcgtcggttctttcagatcacgtttgacctggtttcccttccaaatatgacaagggcttggtggtttttgacgccgtgtgtactctaaaggctgattacgtgtttggtaaatgtacataacagttatgtacatttctggatttcatgagttccatatgttgttgtcgcccatacctgctagtgaaaattctgtaaacgctgtggttagagatgatgagttgtgctgtacatttgactaatttccatgttgtaaactaggcatatatgtcttcagtatcctcggcatgcctgaatgtagcatgcactctctgcatctttccttcaccctgagc

SEQ ID NO: 2791 - DNA, 621 bp, Triticum aestivum
tgaaatacaagtcggagggtcatgacatggtcattcttgccggtgatgagtatggagccgggagctcccgtgatagcgccgccaaggggccattgctcctgggcgtcaaggcagtgatcgctaagggcttcgagcgcatccaccggagcaacttggtggggatggggatcatccctcttcgcttcaaggctggcgaggatgcagattcactcaacctcagtgggcatgagtgtttcacgatcgacctccctcgcaagattaccgagattcgtccaggccaagatgtgaccgttacgacacaaaatgggaaatccttcacttgcacactttgcattaacacgcaggtggagctggaatactttaaccatggaggcatcctcccctaccttatccgcaaattggcatgaccgaccgaggaactacatttaaattgtattatctatatgcaatgtcatgaatttattctttataaattgattatttgtaccccttgattccattttgactttcattttttaataaatttgtgatgaaacattaaaaaagacatagcggagcttcgacaataattaagaggggacatttacttgatagtgtattgataatttattagtgaagaca

SEQ ID NO: 2792 - DNA, 703 bp, Triticum aestivum
tgccaacgacgagatcgtgtgagagggctttgccaaacattaggattgtgaacaagcttttggagggagagtggggcctaaaaccatccatgtccctacggggggagaagcattacgttttcgacgctgccatgaaatacaagtcggagggtcatgacatggtcattcttgccggtgatgagtatggagccgggagctcccgtgatagcgccgccaaggggccattgctcctgggcgtcaaggcagtgatcgctaagggcttcgagcgcatccaccggagtaacttggtggggatggggatcatccctctccgcttcaaggttggcgaggatgcagattcactcaaccttagtgggcatgagcgtttcacgatcgacctcctggcaagattaccgagatccgtccaggccaagatgtgaccgttacgacacaaaatgggaaatccttcacttgcacactttgcattaacacgcaggtggagctggaatactttaaccatggaggcatcctcccctaccttatccgcaaattggcatgaccgaccgaggaactgcatttaaattgtgttatctatatgcaatgtcatgattttttttataaattgattatttgtaccccttgattccgttttaactttcattttttaataaatttgtgatgaaacatttaaaaagacatagcggagcttcaacataattaagag

SEQ ID NO: 2793 - DNA, 768 bp, Triticum aestivum
atggaatttacggaatgaaggttgctcttgaggctgccagggacttgctttcctgcatagcgatgaagctaaagttatataccgtgatttcaagacctccaatgttcttcttgactcggaatataatgcgaaactctctgattttggcttggcaaaagatggcccaagtggcgataaaagtcatgtttctactagggtcatggggactcaaggatatgctgcccctgaatatcttgcaacaggccacttgaccacgaagagcgatgtctacacctatggtgttgttcttctagagttgctgaccgggcaacgtgctctggacaagaaccgcccgcctggacagcataacctggtggagtgggcaagaccttacatcaacagcaagaggagggtcatccatgtcctggacccacgattggggtcgcaatattcgctccccgcggcgcagaaggcggcagcgcttgcgatgcaatgcctgtcgatggacgtccggtgcaggccggacatggatcaggtcgtgaccgcgctggaaaagcttccggcggtgaagaaaacatacaagtaggggagggttgctggttccatgtgtcctccttaacctctctggagcatcacctactccttgtaagcaacacttcagggagtagagacagtgaagagctgccggacttgaggcgaagactagcctttgaatctgtcaagagaatgtagaatatatatcgccatgtgtacagctagctggtagcctgttactttgctgtcagcctg

SEQ ID NO: 2794 - DNA, 619 bp, Triticum aestivum
aggcctcaccaagcaacctaacatcaaaccactgaatatgtttttctagagggaagttgcgaactccttagttgccggccaacaaaattccttatgcctaggttcaagttgattagcattgttgtttacgtcgaaaacatagatagtcacaattggcgcatcaccgtcattgtagaaccaatgtacaatgcctgctggtagtgcaatgacatctccttgtctgaaacggtgcactttttggtgctcatctttgaacttttggctttggctttgaccctgtacggattgtgcttgcccatatttttgaaactgtttttggaatgtctctgggcatccagggaaagacaatccggcaaaaccacttccttggatgatgtagactaatccatgagtgttgtggtatcgcggtaacaaataaccatgaggttcgattacacgacggatgacaaatacaccaatacaacgaaattgctcattttcctcatcaaaatactcggtcaggcctgcttgtgacctcacttgacgaagtggtgtagatgcttgtagcctattgaatgcacactctccggaaaccccttggcgagagctttgccatgggttaaactcatgccaaacaaat

SEQ ID NO: 2795 - DNA, 1010 bp, Triticum aestivum
cgcgcagggaggacagggaaagagatgctgaaaaactgagcgaaaaggaacgagaaaggcttgataaagtgtctgcgctcaattctaaggaagccactacccacaaagctcctgctctctctgccaaagagaagtacttatgcaagccaatatcagagcttgacctctcaaactgtcagcggtgcactcccagttaccgacttttgcctaaaaattaccctctgcctgcttcaagttccagaactgaccttggagtctctgttctcaatgatcattgggtatcagttacctcaggaagcgaggattattcatttaaacacatgcgtaagaatcagtatgaagaaagcctgtttagatgcgaagatgacaggtttgagttggacatgctgttggaatcagttaatgtggcgattaagcgtgttgaagagttgattgaaaaaatgcaagaaaattcaatcaaaccagacagccctatacgcatcgacgaacatttgacctctttgaatttgaggtgcatagaacggttatatggtgaccatggccttgatgtcatggatgttcttcgtaaaaatgcgagtgtggcattaccagttattttaaccaggcttaagcaaaagcaggaggaatggtcaaggtgccggtcagattttaacaaggtttgggctgaaatatatgccaagaattatcacaagtcccttgaccatcgcagtttctatttcaacgacaagatacgaagaatctgagcacaagaggtatgcatttatgatactgcaactgaaatcatcaggctgggtcacaatgggagtaccataggtagtatcatgcatgccaactatgcattttagcttatgtggcacacaattaaatgaggaaggagagggttgataccatactatgataccgtattgtattaaatgatgtactattgtgtgtcttgcatggcaataaatgagactgctatgaaccagttatgatactatgataccaagtcttgcatggcaataaatgag

SEQ ID NO: 2796 - DNA, 530 bp, Triticum aestivum
  misc_feature (60)..(60): n = any nucleotide
  misc_feature (84)..(85): n = any nucleotide
  misc_feature (191)..(191): n = any nucleotide
  misc_feature (194)..(194): n = any nucleotide
accagacagccctatacgcatcgacgaacatttgacctctttgaatttgaggtgcatagnacggttatatggtgaccatggccnngatgtcatggatgttcttcgtaaaaatgcgagtgtggcattaccagttattttaactaggcttaagcaaaagcaggaggaatggtcaaggtgccggtcagattttnatnaagtctgggctgaaatatatgccaagaattatcacaagtcccttgaccatcgcagtttctatttcaaacaacaagatacgaagaatctgagcacaagaggtatgcatttatgatactgcaactgaaatcatccggctggtcacaatgggagcaccataggtagtatcatgcatgccaactaggcattttagcttatgtggcacacaattaaatgaggaaggagagggttgagtatcattatatgatacccgtatacatgataatatgattaaatagtatgtataataacatggactataagatgagactaaatataactaacacagttattaatga

SEQ ID NO: 2797 - DNA, 601 bp, Triticum aestivum
aagaagtattccatggagggttcattctttcgaagattgatggcccgctgtctactggcaatctagttcttgtggacactgatcccaacagcaatcctatcgtcaccttcaactacttcaaacatccacaggatctgagacgatgtgtttacgggatcaagaccatagagaaaataattagtacaaacactttctctaatttcactcccaaagatggtggatattcaatggaaaaactgctcaacatgagtgtagcagctaacataaacctgataccgaagcatacaaatgacagcacatccttggagcagttttgcagggatacagtggtcaccatctggcattaccatggtggatgccatgtaggcaaggtggttgaccagcagtacaaagtgattgggacctcaggcctccgggtgattgacggatcaaccctatccaggtcgccaggaacaaacccacaagccacagtcatgatgatgggcagatacatgggagtgaagatcttaagggaaaggttaggacgagcggctggagtataatagatacttggacattattatcttgttcaccatgtaagaatgtgacttaggagaaaagt

SEQ ID NO: 2798 - DNA, 820 bp, Triticum aestivum
gggatttaaacacaaactggatgactgcagttgagatgctggatgatgatatttatattggtgcagacaattgctgtaacctgtttaccgtgttcaagtccccatatgggttccttgagcccgttggggagtaccatctgggggacgtggtgaataggttgcatcacggttctctggttatgcaccacgcagattcggggacaggccagtttccttcagtcatctttggcacggtcaatggcgccatcggtgtgattgcctcccttccatatgacctatatgcgttcctagagaagccgcagtccgttcttgtgaatttcgtcaagggtgttggtaaccttagccatgcagaatggcggtcattctgtaacgccaggaggaccagttctgcccggaacttcgtggatggtgatctgattgaatctttcttcagtctgagcccaagccagatggtggaggttgcgtgcgcgatgggtgtccctccggttgagctgtataagcaagtgcaggagttgaccaatctacactagtaataagtaataagcatagcaacgtacagtactctagctgcctaccatcatgtatagctctagtgaatattcctactattaactcgttgccagcgtggtacagtagaatagatgcatgctaaaggtgatatttccagttctgggcccaacttcatggccgctcaactgctggtaacccagtgttgtagatgcaggtaacagccttcggtctaattacttcctttttgctttattattggagagaaatttggttgtagctaaggagattgtacatttggttacccttctga

SEQ ID NO: 2799 - DNA, 864 bp, Triticum aestivum
cggagcttcatcatgaacccagatgactacattgtggagtatgccatcaaagtaaccgagagtgcggccggggcttccgccgtaatcgtcaacaactttggagaacttcaagggttccttggaagaccccaaggtcaacacgatcggcccgctcactctgctagccccacgctcgacgggtaccaccggtagcctcagcctgtggaaggagcaggaggagtgcctgcagtggctccacggcaaggagaccgcctccgtcgtctacgtaaactttggaagcatcacggtcatgaccaaggagcagctcctggagttcgcgtgggggctggcgaatagcggcaggcagttcatgtggatcatccggcgtgatctcgtcaggggcgacgcggcggtgcttcctcctgagttcatggcagagacggcaggccgcgggttcatgacgtcctggtgcccgcagcaggaggtgctgaaccacccggctgtaggcgtgttcttgacacacagcggctggaactcgacaatggatagcatgtgcggcggcgtgccagtcatcagttggcccttcttctcggaccagcttaccaaccgtcggtaccaatgcaacgagtggggcgtcggcatggagatcgacaacaacgtccagcgcaacgccgtcacaggccttatcacggaactcatgcagggtgagagtggaaagaagatgaggaagagggcagaggaatggcgggagaaggcaatcttggcggccaagcccggcagttcgtctcaccgcaatctcaaagagctcctctgtgatgtatgcctaagaaatagttcagatcttccatgtgtagtttttttaaaggacttccttggacgactgtg

SEQ ID NO: 2800 - DNA, 503 bp, Triticum aestivum
tgaaatgcttggaactactgacgagaatgagcctctccaggccatgatgaaggatcagtttggtaactatgttgtacagaaagtactagagacttgtgatgatcagcagagagagctgattctttcacgaataaaggttcatttaaatgcactgaagaaatatacatatgggaagcacattgttgctcgagtggaaaaacttgttgctgctggtgagaggaggattggacttcagtcgtcgcagtatccttcctaatggcataggaatgaccatgtacagctaaccatggccaccgagatctaccttctgccgcctgcttttgggctgcttcaagccaagttagaaataaacatgttgtactgagactttgtacattttgtagtttgagcttatagtcgtgtcagggtttggctcagcgagtttatctacctgatgccaccgcggagaagataggcgtcatgtataagttttcgtctaggtgtaaaaaggggaggagagtcga

SEQ ID NO: 2801 - DNA, 686 bp, Triticum aestivum
agacacatacttggtttgatctgcacccatcttcaaggacaaggatggcaaggagaagaccgggttcagtgggcgttatgggaagcaggatcgccgcgccgaggttgctgaagctcagtccgcttgattcaatcttggctgggaatgacaacaaattccatggtggacaattttcatgggtaacggagaacgggaagcaagaaaagcatctcgtcgcgacagtcggcaagttcagcctcatatggaacttccaaaaggtgaaggacagcaaccatcactgctaccgcgaccaggagggcctgaagagctgctactgctacaaggtcgtcctcaaggaagagtccatcgtcgacagccggttcatgcacgagaacttcgcaggatccgactcccctgaagctcccctggttgtcgccaccccaatgaaagttagctccttcagcatcgcaagcaagcgttgattctgaaccgtagtgttagaagttacgggcctctatgcagattggtcactcgtctagttttttctggttcttttcagtgtagagtcatgtacttatttgcttgcggttttagacttgcgtgtttgcttgttgataaaacatatggcctcatcctgaatgttcggacaagagtgtagtgagtagtgttctgtgtgtgtaatgcaaacatcattttcacgcgtgtgc

SEQ ID NO: 2802 - DNA, 539 bp, Triticum aestivum
  misc_feature (126)..(126): n = any nucleotide
tgtgatgtcagtcctatttgttgtatgcagcctcacgatttcagatgtcttcgctagtattcttgggttcctacaaactggttggtgtattcttctgattgggcaggcaatgcgctccactgattnaagaagactacgctgtgggactccatcatggagctagggagggcatacgacaacatcatgggtcttgttctcttccttcccatcggcttcttgtcgtggtttcccttcgtctcagagttccagacacggttgctcttcaaccaagccttcagccggggcctccagatctcaaggatccttgccggccagaaggacattggggagttcgagtgaccagtgaattcgcataggcgggatacatgttgcaggttcatgtgtcatgatcgatttttgggcgtaggttcctccatggtgtgatcgacccttaaaagaatagtatatggcatgctaggggactaacttcaactcgttggtatagaaccaaggtgctcataaaagtatgtatattttgtcattctgtgccgccatttgca

SEQ ID NO: 2803 - DNA, 653 bp, Triticum aestivum
atgcctggttatctgacggttctagtagttttgaagatggtttccaataggacggcagaaatttgggacagacttacagcttaatgttccgcatcctgaaggccgtctctttcatggcttatctctgtgatgtcagtcctatttgttgtatgcagcctcacgatttcagatgtcttcgctagtattcttgggttcctaccaactggttggtgtattcttctgattgggcaggcatgcgctccactgattaagaagactacgctgtgggactccatcatggagctagggagggcatacgacaacatcatgggtcttgttctcttccttcccatcggcttcttgtcgtggtttcccttcgtctcagagttccagacacggttgctcttcaaccaagccttcagccggggcctccagatctcaaggatccttgccggccagaaggacattggggagttcgagtgaccagtgaattcgcgtaggcgggatacatgttgcaggttcatgtgtcatgatcgatttctgggcgtaggttcctccacatgtgatcgacccttaaaggaatagtatatggcatgctaggggactaacttcaactcgttggtatagaacgaaggtgctcataaaagtagtacgagaaaattccttattcgaca

SEQ ID NO: 2804 - DNA, 782 bp, Triticum aestivum
tctcttcgtttcgtgatctaccagtatggtatagtgtaatcatctcaacattgcacgccccagcacagcatcctggtttatggattgtcatggctggttatgctgacggttctagtagttttgaagatggtttcataggacggcagaaatttgggacagacttgcagcttatgttccgcatcctgaagggccttctctttcttggctttatctctgtgatgtcggtcctatttgttgtatgcagcctcacgatttcagatgtcttcgctagtattcttgggttcctaccaactggttggtgtattcttctgattgggcaggcatgcgctccactgattaagaagactacgctgtgggactccatcatggagctagggagggcatacgacaacatcatgggtcttgtcctcttccttcccatcggcttcttgtcgtggtttcccttcgtctcagagttccagacacggttgctcttcaaccaagccttcagccggggcctccagatctcaaggatccttgccggccagaaggacattggggagttcgagtgaccagtgaattcgcataggcgggatacatgttgcaggttcatgtgtcatgatcgatttttgggcgtaggttcctccacgatgtgatcgacccttaaaagaatagtatatggcatgctaggggactaacttcaacgcgttggtatataaccaaggtgctcataaaagtagtatatgcatattttgtcattctgtgccgccatttacatactactactattttgtgcaagtggt

SEQ ID NO: 2805 - DNA, 679 bp, Triticum aestivum
acttcagacagggcctagttttactgaaactgctatggacggcttgctcaaggaacaaggtcttagcggaaggtggctatgaaaaaatatttaaacagacgttcgagattctgccggatgagcagctgaaaatgtcctacgcgtgctatctatcaacatctgctggtcctgtcatgggagttatgtacatttctacagctaaaattgcattctgcagtgacaatcctctttcttacaaggcgggaaataaaacagaatggagttactacaaggtggtcattcctcttcatcagctaagaacagccaatccttcagtgagcaaagtaaatcctgcagaaaagtacattcaggttgtctcggttgaagggcatgagttctggttcatgggtttcctgatgtacgacaaggccgtgtccagcctgcaagaagcccttgacggtgctcgtgagttgcaaccataggtagatatcagagggaagtttcagttacttcagcctgtaacatccccaggggtatcgccggttctccacccgatgtcttccgctctgagcgtctcctgtttaagacatatccttcatgctgtgccccttggagctttcggttcggtacactcacgagcttgtatacagtgtttgaagtgtttgttcttgttcattgcgtaccccgtgttgtaatgatg

SEQ ID NO: 2806 - DNA, 1048 bp, Triticum aestivum
tctcactggttttacggattgctgatttgtgtggtcaagcaagaaatatccatttcctcttctacctcgaatctgacacagctatgtctgttgctgcggaaatggttgaacagttggagctagcagactgcgatgttactttcattgctgattttattgaccttctgatagtcaatcttgttcctggtcggaaactggcaaatgatgcagcgatgagtccatatgtggaatctaaaacgtgtggaagtgagcaagtaactatttcccagcagaacccattagagatgccacctgattatgtgttagttcaaagtacaatgcatcctaaagatatcagtgcatcgccgaataaatatcttgaatctgtcttaagtgcaactaacctagaggggccaaagtgctctgaggggtcggacttttctgcgcagcttgctgggagttctgaaagtccgagatacgatgggactggtgactgtgggactatgtactgtggtgggtacaaagagggaatccacaaactagactgcaaccatgttctaggtgatgggtcaaggaacatttcgattttccatatagatgaagcatcgcctccttcggagctggtgagtggttgctcgtcaatttccatcaccgatagtcaagatgtgctgaatggggagcttgatttgattgaagtcgagtacaaagattggtttgatgaattagcaaggatgcgggaagaagctatggaaggaggaggacaggagaagtggttacaatataatgaatgatgtttaagttcgagtatcgtgtgtgtcttgtctgaaacatcatcggaatgtctttagatgttcctctgcctcctgcttctacagttttgtgttttggtcatgcaaatgtgggttataataatcggtaggatcattgtcatcgatgtagatttgcactgttgcccagtgcgtttataattagttagttctttagctagctctgagttttcccagcattacaactttgactttgatgtgtcatcgggaaaacgcaaccgttgtagatacacggctgcaga

SEQ ID NO: 2807 - DNA, 761 bp, Triticum aestivum
  misc_feature (695)..(695): n = any nucleotide
gcccgctcccgctgctggcgccgagctcaaacatcagcatgagcttgtggaagcaagaggaggagtgcctgccgtggctcgacgacaaggagcctggctccgttgtgtacgtgaacttcggcagcaccaccataatgaccaacgagcagctggtagagttcgcctggggcctagccatgagtggcaggcatttcctctggatcatccgtcccgacctcatcaggggtgacaccgcggtacttcccccggagttctcggtcgaaaccgctgagcgtggtctcatttcctcctggtgcccgcagcagcaggtgttgaatcacccagcagtgggcgtgttcctaacacatagcggctggaactcgacactggatagcatgtgtggcggcgtgcccgtcatcagctggccattcttcgcagaccaccagaccatctgccggtaccaatgcactgaatggggcgttggcatggagatcgacagcgatgttcgacgtgacaccgtctcaggacttatcacggaggtcatggagggagagaatggcaaggtgatgaagaagaaggcgcatgagtggagggaaaaggcggtcaaggcgaccaagcccggcggctcgtctcgccgcaacttcgaagagttgatccatgaggtgctagctcctactcctagaccgactcatgacataaagaaataatagtgtacntgctccaaggtttcacaatcccggtttttcggaggaggccggaaaatcccttcttttggaggaggt

SEQ ID NO: 2808 - DNA, 848 bp, Triticum aestivum
ttcaaaagatgggcggattgacaacaaaaataacacatcatgctctttcagagcatcccactcagattttatctgtgatctgtagcttgatatgctaaaagtaacatcagcagttacagcagaaggcttaacctctccaatgtttggttgcttcacttgtgtgatcctaaattctttgattggaacagccatcctggaccatccacgaaaggaagtgtccccctcattgttgatgtaagcatgtaaatgaggaacagcttcctgaatatcttcacgaatttcatatgttgattcaagacgaaagagattaaaattcctcagcaagtaatcatgaagtgtcagaaattggagattgagttttgggagggcaagacagccttctccagaataattgatgctaggaacaaggctctcatcccacatgatctgttcatttggataaagaggaagtgcattaactgcatctttctgggattgacgcttctcaaaaaaagcaactacgacctcgataaggaaatcacgccttccagtccatggatccttctctgaaattattttaagcttattgcaaaccagatcttgcagttccatatctgacaagacaagcagcttctttgttaaatcagcacgcttatggattgaaccaatattacacaaggcaaggtctcgcaacttaggcacttgtttgaatgctagcagctgaaaagcttggaaacgagaatagtgagcttgcaagacatcatcatcactaagctgtgtcccagaatgatcgttaatctcaaagccttcatagaactgaagtaagtccaccaattgtgcaaaaagacgcccttttcatgagcataaag

SEQ ID NO: 2809 - DNA, 793 bp, Triticum aestivum
cttgtagacagcaaggacatcagggactacaacctgaagtggctgaggaggcagatagggctggtccagcaggagccgatcctgttcaacctgtccatcagggagaacatcagctacggcaacgaaggcgcgtcggaggcggagatagtgcaggccgcaacggaggccaacatccatgagttcatcagcggcttgtcggcggggtacggcaccgtggtcggggacaaagggagccagctttctggggggcagaagcagaggatcgccatcgcgagaaccattctgaagaagcctgccatactgctgctggacgaggcgaccagcgccctggacggcgagtccgagagggtggtgatgagctccctcgccgcgaaggggtgggggaagagcggtatcggcgaggtgtcgtcgagcacgaccacgagcatcacgatcgcgcaccggctgtccacggtcgcgggcgcggatgcgatcgtcgtgatggagaaaggcgcggtggttgagatgggcagccatgagacgctggtctctgcgagcaatggtgtatactcgcggatgtacccgtgtgcaggtcaaaaggggcgaaggactgagtttcttttcatgggtttctgatatggctgcagcaattagaaatttaagcatcatttgcttattttcggtcttgtcttgtcgcttacagccgtgtttccctgtccgtatgccgactcatatatttatagtgtcaaccgcggtgcagtggaaagttcaggtgggtagacttttcgaaaaacagaactacaaattactccct

SEQ ID NO: 2810 - DNA, 623 bp, Triticum aestivum
gtggatgaggtctcttttgatacggttaacgatagcagggacaattgcgctcttccgcataaaccggcttttgtgcattaccttcctaagatgcacctgaatcttgagtgcattgcccacagccgataggacaggactccaaataccaaggacaccacgtggcctttgagtaggtgcagtttctagagatattttaagccttatctctgaaatatcaacaagctctattcgtatctcaggatccacttcagtgacagttgagctgctggaggtgccggtaaagcgaagattgttgtagaaatcaaccagtgcccaaacaataggttcatgaatattcaacctccatgtttggtcagttacccgtatatagacatgcgggtagacttgaataccattcgaagttacattgcttacagcaatgttcgctttgaaaacaggatgatttgaatcaggcatgctctcagttgccaaaacaacaggcattatggacaatggcaattgattatcgagttgcaactggcctatgatcaacttaaatctgctagtggtcccagagtcataaccagtcatgtatgagatgaaaaccttctgcagatttaggtataaaagctctcttggcttat

SEQ ID NO: 2811 - DNA, 732 bp, Triticum aestivum
atatgacgggactgataaccaaggaagcaagttgcacagatcgtcgggaacaagtttacagggggcgacagggttggaagtgaccagcgacgaggaaggtttccatggagcatggttccaggggacggtcgtgaaatccgtcggacacaagttccttgtggagtatgacgcgctgaaggacgacgacgagacgacgcccctgaaggaaaccataggggaggagcacatcaggccctcccctccggctatccccgtcaccagcggcttcaaggtcctcgacgagatcgacgcctacaccaacgatgggtggtgggtcggtgtggtatccgaggtcctcggcgaccgcaagtacaaggtctacttcaaggcttacaaggagcaggacgagtttgaggtcgagcagctgaggcgtcactgcgattgggtcgggggaaggtggatgcaggcttccccggcattggagatgtgacggctaaagggacgcacgccttgttttgtacaggagcctgggatgattagtactctacccatgagagagtggcttcactagttatgatgctcgctgaaccgaagctgtgttgtgcgcatagaaaggccaatttgctggcctttctgcattaccattcctgcagcagctgatctagacgttggtcgaccggagactttcaagtaaggttcgtcgtcgtgcttttatgtaaaccgccgcctaagaacaaacctctgggagcatcg

SEQ ID NO: 2812 - DNA, 467 bp, Triticum aestivum
gctgtccggggaattgtccatgacctgacaagatactcagaaacagcaccacctcccaaacggccaaaaaagttgcagaaactgaacagagagagtgatatagtggtgtccacagcacctgctgcaattccaacttgtgcaagattgttaaggaccatgactccagatccaacaccgatgaaatatacagcaaagagaagccaaaagtctgccttgagcagtgcttcacgaaatctgaagtcctctcctctttttggtcttcttctcgtctgctttacagccccttcaccctccgcatagagaatgtcgatatcgaaggaatcctcatcgtctagatcagtaaggtttgatccggaggcagaaggtggaagaaatggttctgtatgatcactatcagcgccggaagagtccgacgggccttttcttcggttacttggaaacaatgtcattttcaaggtttcaccgcg

SEQ ID NO: 2813 - DNA, 598 bp, Triticum aestivum
gatcgcggccggtcgccggtgttcagtgcggagctcttggcgagatgaaggagagcgtcgacacaacggctgtcgtcaaaatagacgacatggatgcgaaggtgttccaaggcattgctctattttgtgtacaccgacaccttgccggagacgaagagggaagaagcaggggaagacgccatgtctcaacatctgcttgtcgcagccgacaagtataacctggacaggctaaagctgatctgcgaagacaaactttgcaggtgcatccaagtgagcactgtggcgacaatcttggtgttggctgagcaacaccattgcagtggcctgaagaaggcatgctttgattttctcagctctcaggcgaatctgaaggcagccatggccagtgacggctttgagcatctgagccaaagctgccccgctatcatgaaggagttgatctctatgctcagcgccttggttccgtgatgcttacctagtgttctacgaatggtggttggtgttcccaggatttctgtcatcacgtagttttagcaatggcagttcttgtatctagacttaggctatcaggtaaggctgcatcattctagggatgatc

SEQ ID NO: 2814 - DNA, 778 bp, Triticum aestivum
ggcgccccgctgcctgatcgcggcccggtcgccggtgttcagtgcggagctctttggcgagatgaaggagagcgtcgacacgacggccgtcgtcaaaatagatgacatggatgcgcaggtgttcaaggcattgctctattttgtgtacaccgacaccttgccagagatgaagagggaggaagcaggggaagacgccatgtctcaacatctgctggtcgcagccgacaggtataacttggacaggctaaagctgatctgcgaagacaaactttgcaggtgcatccaagtgagcactgtggccacaatcttggtgttagctgagcaacaccactgcggtggactgaagaaggcatgcttcgattttctcagttctcaggcgaatctgaaggcggccatggccagtgacggctttgagcatctgagccaaagctgccccgctatcatgaaggagttgatctctatgctcagcgcctttgctccgtgatgcttacctagtgttccacgaatggtggttggtcttcccaggatttctgtcatcaagtagttttagcaatggcagttcttgttatctagactttaggctatcaggtaagactgcatctattctagggatgatctaaagtagtctcattttgtctgttctgttagctgatggcatctctaaaactctcacagttagtcatggatatctttgctctactcagctagcttggttggtagaatcttcggttgactgcaaatttgctaggccatctttttacatacaagtcatttttag

SEQ ID NO: 2815 - DNA, 682 bp, Triticum aestivum
ctggacttgatgtcacggtgtacaatgtgaggcttgcagactccatggatataagaaagaccccggcttgctccttgtgcgatcttgagccgtgtcggccagtcaagaaatgaacttgcatcaccatccccattgtgaagccaatcgtccaggctgccattctccatgtacggatatatgaggaaccttgaatctccctgtatgctataaccccagagtggtacaaggttgtcgtgctgtgccattgagagtgcatcaacctctgcagtgaattccctgtacatcagacacatgtcatcattaagcttcttgatagccagtttgaggccatcaggtaaatcagccttatagaccagcccataacctccgcacccgatgatgttctcctggtgaaagttatttgtagccttcacaatgtcagcgaatgtgaggttactttcttctcccttgcctcgtggcactatcactaatgattcttccgaaccagattcgatataaaaaaaaaaaaacaacgaaccgaccgagaagggtagcgagcggatctctcgcccagcatcccgtgccgcgcaagagcgactcaagagactcatgagcagaagctggctgcttgagatgtgggtagacgagaagcgacgctcctgcagaacaccacacctaagcgtgaagcgttaaaagctggaac

SEQ ID NO: 2816 - DNA, 565 bp, Triticum aestivum
cctccaatcgccaatgaacagacggtagccctattcttcaacctagttaaagctgctatctaagggtacacatctggcctaggtaatgcggttgttaatgtgcacctaaactatgagaagatatttgcttttgttgaaatgaggtctgtggaggaagcaagcaatgcaatggccttggatggtataatgttcgagggagcaagagttaaagttaggaggccaacagactacaacccttcccaggcagctgcattgggtccgagccagcccaatcccaacctcaatcttgctgctgttcacttgcctagacaggtaacccggcgcaggccgtgatcccatggctcatcccagcggtgatcctgtcgtcggcaaggtgtttttggagtatggatgtggagagattggctagggcgagaccttgctgaaggagactgactatttagcaacatatcttaccaagatttacttggcacttgcttgttacaatagttcgtccaaattttcatgttggtggtatggttgtggcatcgcatggtctgatataaacactgcatcgaggtctaat

SEQ ID NO: 2817 - DNA, 692 bp, Triticum aestivum
tagtagcaactatcacccatcagagtcatctgtgtccattgcctcttacagtgcaacctatcatatggaactacgatcattgcctacggctgtatccaactcctgacatgatagtattggctgacaagagtgagcagaaggccttcaaatatacaggaatcacttgcttcaatcctggttcttttgcgaacgacagcacctttgcagcataccgtccttgcactaaggaggttgagctttctgcattagaaagctaatattgaaggtgggacaaactgaagctgtaatcagtaacaaaccgaacctttgatgagctgcctatcactcctgtacatcagccatcaggactggtgtttatgactttagccatataaactaatgagtccgtttcatggaagcgaatttgcaagcatgacaaagcaacgacatccatagaattggtgctgtttctccagcaaatctgatgctgacatctcaactttgtatcacacattcatagcttcagatagttgtggaccatagtgtttgttacttgttagggtgttttccccacctggccatctgtcctttgtgcagtgtttgtgtaacatgatctcagggtgctttccctaaagtcacagaatggtgctcagtcctgtaatatgtactgtttatgtttgccattgttgtaaaccatgctcaccaagctgtga

SEQ ID NO: 2818 - DNA, 701 bp, Triticum aestivum
  misc_feature (667)..(667): n = any nucleotide
cgctatgttaattggaaaatgggatgaagctatgtattatgtgcttggggatccaagcgctaaacccaagtggtacgacccaatgtcagaagcagttcttttgtgggagagagacaagtctttgaatcaaacccgatataacctttctccatttgcaatttctttaaatgaattgccacttcacatgttgacgctgttgcctcctactgattctcgcctgaggcctgatcagagacatctggaaaatggtgaatacgaaaaggcaaatttggagaaactcagacttgaacaacttcagcggcaggctcgaaggttacaagagaaaggctggcaaccaatgtggttcaggaaggacgaggacgacagctactgctatcttgggggatactgggaagcgagggaaaaaggaaactgggacgggatcccccatatattcggccagagcagtgcatcgaccgggtagtcgcagctataaccctgcgcctctttcttttatggtagtggtgtccacatttcctttacacggaacattgattggcacaaaatgaaaatgtgaatatatgccaatttactggaggtttcacgtagccagaatgtactggcaaatacttgatgagattgtgttactacctctctctcagtttacagggcatgcgcgtgcccctangttgttaatttgatcaacttaatacaagtcgttt

SEQ ID NO: 2819 - DNA, 605 bp, Triticum aestivum
tagtgagaagatttggtggaagccaatcagatccgctgcggttcccgggaaggcctacaacgatgacattgaggtggcacgggagatcaggtcgcagttcgagcatgccgcaactctgcagccaatgtatccaaggtgctcgaggttgggaagatgccttaccaccacaagacctcaggactgaaagtatcctcatcgatgataatctgtggccggccttcagtcggcgaggagttcctgcagtttgtggaggacaaagctacagaacatggcaacctttcttcgacattgcagaagctctacatgtgggaggagaagcttcttgaagaactcaagagtgaggagaagatgagggtgctgtatgataaaaaatgtgaggaactaaaagtcctttatgagagaggtgctgaggctcataaacttgaggcaattgaaacttataccaggaagctatcgacaaaaataagtgttgccattcaggttgtcaacactatctcaaagaagatcaataagctgagagatgaagaattgtggccgcaaacaaatgagctgattcagggttgatgcaatgtggcatgccatgtcagaatgccataaaatccagt

SEQ ID NO: 2820 - DNA, 794 bp, Triticum aestivum
gtcagaaggggctatgttggatcaggcaaaccgcgcaaaggttgaggcttgaagcgattctcctccaagtcacaagctaccgccgaagggattagaatggtctcagagtccatgagagctgaaggcagtgctgaggctgcaaaactgagaattgctgaacagtacatcacagcatttgctgctctggccaagaacaccacgacaatgcttcttccaagcgacgctggcaacccatcatctatgatagcccagtctctccagatatacaagcatataagccagtccagcagcccgaaaggagggaaccaacaggcagaagaagttgaggaagcaggaccgcaagaagagggcgatacgttcggcctgccttctgtgaccagcgcgatgccacccagcacgcaaacaggccatggcagcacgttctccctgcagaagcgtaaagaatgatcagcctgttcaagtaccgaagggaaccctttttagataggagggtgtcactgaaaacagcagcagcatttgaggtttcgagcttaattcatgttatgttgagtcggcttaggttgatatggtaattgaccttacattagttatccaggcgccaaatgcaaaggaggctaggcgactggggagattttgacggcagcctgcaagacttgtgtaatgcaagtatatcgctcacgatgccagcatactcttgatggcaatatttcactgcagccttttattcgtgtgttccgacgtcagttttacatgttcacagtttgcatgtcgtcctactctatttacttctgcaa

SEQ ID NO: 2821 - DNA, 685 bp, Triticum aestivum
gtcttctaatgtgatttgctttggtctgatcctagttctgacacacaagggtggggggagagtgacagaggtgttgcttgtactttcggtgcggataagcttgtagaatttttggagaagaatgatcttgacctcatttgccgagctcatcaggtggtagaggatggctatgagttctttgcagaaaggagattagtcaccatcttttcagctccaaactactgtggagaattcgataatgcgggtgctttgttaagcatagatgaaagcttaatgtgttctttccagatcttgaagccaaagaaacaggagcaccacattcaagaaaaccaatttcaaacaaggcaccgacagtggacaatgcttaacttgtattcagtcacatcgtcatgattgttgtcagctcgaagggggtgatcttatatcccagatccaccagggcatgacattagaagcattcttcagcctggttctcttacgttctccgctacttgctcgcggcactgcattcttgtggatgcagttgttttgtttttgttcgtttctttgcttgattgctgtgtgctctatgtttgagctgagaatatagttatgtagtcataaccgtgccatctatggcacctacgtaaaaaagaaagggattgagttaactatgcatgtaaatttacgacgagtgaagtgaagt

SEQ ID NO: 2822 - DNA, 828 bp, Triticum aestivum
tgtttttctcgcattttcaagaggacgagcggcggtcagcaacaaactggtccactcaatgaggacctcccgggtgttgagaacataacaagatttagctataaggagttggatagggcaactgcaagatttgaccaatccaataagattggtgagggaggttatggaccagtttataagggaacgctcagggatggaacagctgttgcagtaaaggtgctctctttgcagtctaggcaaggcgcgagggaatttcttagtgaacttattacgatctctgatatttcccatgagaatctcgtcaagctttatggctgttgtgtggaaggaagccacaagatcctcgtctataattatcttgaaaataacagccttgcacaaacccttctaggttctcagcggcatagcagcatccaatttaactggagaactcgagtgaatatttgcattggtgttgcccagggactagcttacctccatgacggtgtccgaccacatgttgtccaccgggacatcaaagctagcaatatacttctggatcaggatcttaccccgaaaatttccgatttcggcttagcgaagcttctaccttcggatgtatcacatattagcacaagagtcgcaggaacgctgtaagtgtaaaccatttaatcgaacctgtctgctttactaaatgtttacttgccgttttggggtaaaaaaaaaccatttttggtatatttacttgtgtttctgttctcattatactaaaatgttagtttgtctgatcctttgaagttagtgggtgataggctcttatcgacgtaagcaagggctgcatagggatga

SEQ ID NO: 2823 - DNA, 447 bp, Triticum aestivum
agggatgttcgagaagtacatgggagactgcttggacagcttcaacacgacacggcgcatgatcctctactacgaggacataatcagaaacagaaatgcattattccaggtgcaggaattccttggcgttccggtgaggaaactggtgagcaggcaggtgaagattcatacgcgccctcttccggattttgtcaggaactgggaggatgtgaacagcagactcaacgggacagagtacgcccgttttcttgatggcgcagattacgtgaagtgatgcattcggaattctgatgtaggttcaagatcatttgcaaggggttctagaccacagagtagtggaagtctgtagacctgtagtctccagaggattgattattttgtacaatgaggtagttaaagtgcatgaagcttagagatccatatggaaataatacgggcaaactgtac

SEQ ID NO: 2824 - DNA, 738 bp, Triticum aestivum
ccccggcaaacagctccttcactgtggagtacccgatgtactctacaaccccgggaagcaagatcccaggaagcccgggaggtgtggatccgggaaccgcaaccccgagaacaccgtccccgggtatggtgtccccagacaccccaacatcgagcaaggtggttcccgggaggctgttcgcgaccccgccaacagcaaggtcggagctgttcgacgccgacgatagcgttggcgccccccatatgtttcgacgcatgggggatctcctcggcgaggctgcggcaacaccgcaacagcccgaggaagaggacgttgatgacgacgacgtcttgcatctgatggccagcgaggagccgaccacattcgcggaggccgagcaaaaggattgctggcgccacgcgatgctggatgagctggcgtcgatcaacgacaacgccacttggacactcaccacactgcctgctgggcaccgagccatcgggctcaagtgggtgttcaaagtgaagaaggacgagcacggcgccattgtcaagcacaaggcgcgccttgtcgccaagggctacatgcagcctgagggagtggacttcgaggaagtcttcgctccggtggcaaggctagagtccgtgcggctcatccttgcggtggctgctcaccgcggttgggaggtacaccacatggacgtcaagtcggcgtttctcaacggcgaccataacgaggaggtgtacgtctcccagccaa

SEQ ID NO: 2825 - DNA, 445 bp, Triticum aestivum
aaaccttgtgaagagactctggtccatgtggctgtacttctgaaaagccatgttcttcacgacagggggtaactgatggtgatcaccaattaaaatgcaacgtttgagacgagcatagccatcttcctgccgttgcaggagagttggtataaaagtctctatctccaatatctgtgcactttcttccatcagtaaattgtcatatttgaaacccaattgaagaaagtctcttctcttcaatgctgcatgagtacaagtcatggcaacaatcttagcttgtttagtcattagataatttgctcgctcagctgttgacttcagtaactcaaaagccctgcactcttccagctcttggaatatcgtagaaagatgtttgaaacatcctttggctgcatccatatctttctcaaaggactcaccagtaaacacaggctgtagggtatcc

SEQ ID NO: 2826 - DNA, 664 bp, Triticum aestivum
gcttcgtctgttatggccaactctacagagaaaattagacttgctggaaatcaaaatgtgatggtctgtgagcgaggcaccatgtttggctacaatgatctaattgttgatccaaggaactttgagtggctgagggaagcaaattgcccagttgtagctgatgtaacacatgctctacaacaaccagctgggaaaaagcttgatggtggtggggttgcaagtgggggcttacgggaactcataccatgcatcgcaaggactgctgttgcagttggtgtggatggtattttcatggaggtacatgatgatcccctgaattcaccatgtgacgggccaactcaatggccattgcgcaatttggaggagctgttggaagaattgattgcgatcgctcgagtcaccaaagggaagaaaccgctcaagatcgacctaactccattcaaggaatgatttggcagtggatagcaataggaataaccatgtggctgccaattggtttcaccaatgtggtcgtgtccaggcgagttggctctttgtatgcggtactttcatttaccgttggattcaagctttgttcgattgcctgcatgtattagttcctttccaagcgtagcatatcagccacatattgctgttttgaatcaccttgtctcgagagtcaatc

SEQ ID NO: 2827 - DNA, 805 bp, Triticum aestivum
accttcatgttgggaactcaccatcagattgtgctcttcaaagcccagatgttttgcccatggactttgttcaaaggctacataccatacacatagcactgagctcagccatgcaggaagtagcagtttatgtggggaacagagcatgctcgtagcctgcattctaagccatgttggtggtctgtggtgacatgcttctcttggttgatctctcggtaagcatggaccaactgtttggcttcctggcacctttcaagtcttccgcctcgacttctcggtcgaaccagctaagtgggtgaagatggataagttggacaattgggctctcttccttaccaatgataggagaaaccctacattttcttgcatgaaccccgaaagatggggaggaaagagtaactatatttatgttccaacaaaatcagaagattttgatgagccatggactgcaatagaggttgaacagccggtgcccagctcgactcaccgtatgtcattcagctccgcagccactgcccattgcagtccactaaatagcctctgggtgcttcccagtttggtttacggggttgaccagtgattggtcatcgttgcttgttgcagttgcaaggcttttcttagtctttcacaatgccagtcctgtcgattcctgcttttatattattcaattagccactaggttctgtaactcccatggtttcttgacttgtcaaatgtattgtgtacaagaatgtttatctatattgtctccaggaagtgatcgtcctgcactgatgctatgggattaattgaattcttatgtagc

SEQ ID NO: 2828 - DNA, 301 bp, Triticum aestivum
tggatgcaccaagtatagcctcacgagggtgaactggacagatcaagtggagggccacccacacacgtatcaccctggggaggtgtcggcgaacttgatcagggagctgaggaagtcaaatgcgaaatactcatacatgtttgcacggaaatttgccccagagtgcctcgagccgctgatggagattgcggactcggtcatcctacgtgactaggccagcagcacctcacatttgggtgtgtcggataaactgagatgatgagggttgtgatgcgatgaacaggcacgagctagtccatct

SEQ ID NO: 2829 - DNA, 432 bp, Triticum aestivum
gctggatgcaccaagtatagcctcacgagggtgaactggacagatcaagtcgagggccacccacacacgtatcatcctggggaggtgtcggccaacttgatcagggagctgaggaagtcaaatgcgaaatactcatacatgtttgcacggaaatttgccccggagtgcctcgagccgctgatggagattgcggactcagtcatcctacgtgactaggccagcagcacctcacatttgggggtgtcggataaactgagatgatgaggtaccgaaatgcgcacttgctgctgcactgttgaaagaactaatcttctgtgtaggtgttgtattgagagagttatctctgagtggagtgtacatagtatgaaatccgggagttttaggaattatgcagtctgtatgctttaacacttacataataaagttgcacgc

SEQ ID NO: 2830 - DNA, 474 bp, Triticum aestivum
  misc_feature (125)..(125): n = any nucleotide
ggtagctcgccgtacctaccgcccccgcgggtgtcatctccgggctttcttactccgcgacctcgttcagtatctctacagcgagaacatagaggagaaggaggggctgatcaaagcgatatccntgggggaacaaagacaagttccagctcactccactcccccagcaagttcttgtgctgtggggagagcatgaccagatcttccccatagagaaggcattccaggtgacgaggcagctaggtgcaaatgttaggctggagatcctgaagaacagtggccatatgccccaggaggaggacacaaagaggttcaacgaggctctcctcaacttcctgctgcccactccgagttcatcgctgtaatacaatttcattgtcgattttcgggaagatggttgacaattcctaatttaagctccattttacctgtaagatatagtactacttagtatttttattggtcaatgagtgt

SEQ ID NO: 2831 - DNA, 388 bp, Triticum aestivum
  misc_feature (376)..(376): n = any nucleotide
  misc_feature (382)..(382): n = any nucleotide
  misc_feature (387)..(387): n = any nucleotide
gacttgatatatctgctaaaataccaggttctccaggcaaacctactgcccgattcgtatcagcccttcgagtctgctgcaatcgtcaaattcttctcaatcaggaaaccgcacagcatgtttcaaatgttgttacttggaaacgttcagtctcgtctctatcatcgtcatctaaaagtccacttacgacttcgatgattcaagatgatgtggatgatagtaataatgattttattgagcaatttgctatggtgtctggaagccattcttctacattggataggctacatgcatgggagagaaaattatatgatgaaatcaagaactcattgataatactcgagctgttgtgaaggatctgcactccaggtttctntgcaancccang

SEQ ID NO: 2832 - DNA, 613 bp, Triticum aestivum
  misc_feature (384)..(407): n = any nucleotide
tggatggctccagagatgatgaagcacataaccctatggtcgaaaggttgatgtttacagcttcggccttatcttgtgggaaatgcttaccggctccgtgccttatgaagatttgactccgttccaagcagcctttgctgtttttgataagaatgtgaggccggccattcctgctacctgcccagctgcattacgggttctgatcgagcagtgttgggccttgcaagcagataaaaggcctgaattctggcaaatagttcaattactggacaagttcaagatggttcttgaaagagatggaacacttgacaatatgccaagctcaaactgccaggagaatcatgatcccaagaaatggctagcccactggctccacaagctcannnnnnnnnnnnnnnnnnnnnnnntctctggacctccaccaccaaagcttctgtaactaatcttctctcttccaatctgttctagtccaggtagtccttataatgtaaatatcaaaagtttcttttggtatatatatataaaaaagtcccattagcttgtatttgttgtttcatagcatagtaatgtgaagtatcttcttctgggtttctaatcttactttttttgtcct

SEQ ID NO: 2833 - DNA, 417 bp, Triticum aestivum
cgcaagacggtcccgcttcaccgtgtcatgatcctggaggtcagccagtacctcgagaactacctttggccgcacttcgatccagatgacgcgtcctttgagcacgtcatgtccatgatcctcatggtgaacgaaaagtttcgagagaatgtggcggtatggacatccttccatgcccggaaggacgcgttcaaaggcttcctatggcgcgttctcaagctgaaggaagaggatagggatgttagtatggcagagaagacaaactacctcttgtttatgataaacgcatttcagagtttggaggatgaaattgtccgggaaactatactccaggtggtaagcttaaagttgtggcatactctttcttttggacgacttcagatggagctttgccttaatcctgaattgattaagaag

SEQ ID NO: 2834 - DNA, 510 bp, Triticum aestivum
gccttgatggatttaggaacgcagtttaatgttcttgtagcgactgatgttgcagggcgtggtattgatattcctgatgtcgctcatgttattaactatgagatgcctagttcagttgatacatacacacatcgcatcggaagaacagggcgtgcaggaaagaagggacttgcaacttcattcttgaccctggataacactgatattttcttcgatctgaaacagatgcttactcagagcaatagtcccgtccctccagaacttgctaggcatgaggcgtcaaagtttaagccaggatcagttcccgatagacctccaagaagaaatgacaccgtctatgcatctcactgaagcaatctgccgcagaagaggtggagatccttcctgggtataattcagggccaccaactgtgtcgagatttagtacttatgagaactgggactatgtatcttatttttctgtcggtgccataatgcaagtatgcaactgtcatgcccaaacatcgactg

SEQ ID NO: 2835 - DNA, 833 bp, Triticum aestivum
aggccacagatctgatacccaaagtgatcatggtgaaggagtcaagagcagatgtcacgactccagaagatactcacagatcttggggacaagacggccattgtatttctgcaacacaaagaagtcagcagacaaccgtgccaaggatctggacaaggcaggtttccgcgtcacagcactgcatggagggaagtcacaagatcagagggagatcagccttgatggatttaggaaccgcaggttcaatgttcttgtggcgactgatgttgcagggcgtggtattgatattcctgatgtcgctcatgttattaactatgagatgcctagttcagttgatacatacacacatcgcatcggaagaacagggcgtgcaggaaagaagggacttgccacttcattcttgactctggataacactgatattttcttcgatctgaaacagatgcttactcagagcaatagtcccgtccctccagaacttgctaggcatgaggcgtcaaagtttaagccaggatcggttcccgatagacctccaagaagaaatgacactgtctatgcatctcactgaagcaatctgccgcagaagaggtgagattcttcttgggtacaattcagggccaccttctactgtgtcgagatttagtacttacgaggtacaaacatcataacaattgaaccattatcttttcctgtttgcaaatcagcctttctatttctgtaatctaagtatatttggatatttctgtgatgattcagaactggacctatgtatcttattgtactgtgggtgccataatgcaactgtcatgcccaaacatcgactgcttttgaag

SEQ ID NO: 2836 - DNA, 710 bp, Triticum aestivum
ccagagatactcacagatcgtgggacaagacggccattgtattctgcaacacaaagaagtcggcagacaaccgtgctaagaatctggacaaggcaggtttccgcgtcacagcactgcatggagggaagtcacaagatcagagggagatcagccttgatggatttaggaaccgcaggttcaatgttcttgtagcgactgatgttgcagggcgtggtattgatattcctgatgtcgctcatgttattaactatgagatgcctagttcagttgatacatacacacatcgcatcggaagaacagggcgtgcaggaaagaagggacttgcaacttcattcttgaccctggataacactgatattttcttcgatctgaaacagatgcttactcagagcaatagtcccgtccctccagaacttgctaggcatgaggcgtcaaagtttaagccaggatcagttcccgatagacctccaagaagaaatgacaccgtctatgcatctcactgaagcaatctgccgcagaagaggtggagatccttcctgggtataattcagggccaccaactgtgtcgagatttagtacttatgaggtacaaacatcataacaattgaacaattatcttttcctgtttgcaaaccagcctttctatttctgtaacctaagtatattcggatatttctgtgatgattcagaactggacctatgtatcttat

SEQ ID NO: 2837 - DNA, 675 bp, Triticum aestivum
catcctcacttggcgtccccgcagtgccgccaccgcccgcaggctgcgggtgccacccgtatggccaccaccgtgcccatggccatgttacatctgccagccagcgcacctcctggacgccctcatctgcaacgcaaccgccacccacgcctccccattcccgctcctcgtcaccgacgcgcgcctggacgcgctctcggcgcgcattgccaagtactactcgattcagcgattcgtgtcggacacgggtgctccggcgagcaactggacccggaagcacgacgagaggtacttccactattcctcaggtatgcaggcggtggtgatggcgcttggggtgtgcgaggaactgagcctattcgggttcggcaagccggcaggggccaagcaccattatcacaccaaccagaagaaggagctggacctgcacgactaccaggcggagtacgatttctacggcgacctccaggcgcgaccggagatggtgccgttccttgacgaggcccaaggcttcacggtgccgccggtcaggttgtactggtgaggtgccttaactgtgtgtattactgtgttgttgttgtaaaattgatactactacacttgattgacaaaatgtcaatttagccgacagagaattgtaaattaggggcaatggaagatgaaagtctcactgaa

SEQ ID NO: 2838 - DNA, 710 bp, Triticum aestivum
ctcgctctccttcgtcaactccaacatcctccacctctgcgcgtcccgcagtgccgccaccgccgcaggctgcgggtgccacccgtatggccccaccgtgcccatggccatgtacatctgccagcccgcgcacctcctggacgccctcatctgcaacgcaaccgccacccacgcctccccattcccgctccttgtcaccgacgcgcgcctggacgcactctcggcgcgcattgccaagtactactcgatccggcgattcgtgtccgacacgggtgctccggcgagcaactggacccggaagcacgacgagaggtacttccactattcctcaggtatgcaggcggtggtgatggcgctgggggtgtgcgaggaactgagcctattcgggttcggcaagccggcagggggccaagcaccattatcacaccaaccagaagaaggaactggacctgcacgactaccaagcggagtacgatttctacggcgacctccaggcgcggccggagatggtgccgttccttgacgaggcccaaggcttcacggtgccgccggtcagcttgtactggtgaggtgccttaactgtgtgtattactgtgttgttgttgttgtaaaattgatactactacacttgattgacaaaatgtgaatttagccgacagagaattgtaaattagggcaatggactgaaatttgtaagcagaaataaggcc

SEQ ID NO: 2839 - DNA, 638 bp, Triticum aestivum
gcggggatggggagggtgacgaggacaagggcgcgcgcggcaacgccgtcggtggcacggcgcgaccggggaacctgcaccgctacatcgagtccgagcaggcggcggccgggtggccggcgtggctcagcgccgtggccgccgaggccgtgcagggctgggtccccctcaaggccgagaacttcgagaagctcgagaagatcgggcagggcacgtacagcagcgtgttccgcgcgcggagcctcgagacaggccgcctggtggcgctcaagaaggtgcggttcgacagcgtggagccggagagcgtgcgcttcatggcgcgggagatcatcgtcctccgccggctgcagggccaccccaacgtgatcggcctccatggcctcatcacctcccgctcctccgcctgcatctacctcgtcttcgagtacatggagcacgacctcgccggactcgcctcctcccccgacctctccttctccgagccccagatcaagtgctacatgcggcagctgctggcggggctggagcactgccacgcgcgcggggtgatgcaccgggacatcaagtgcgccaacctgctggtgagcagcgacggcgtgctaaggtcgccgacttcggcctcgccaacgtgttcgcca

SEQ ID NO: 2840 - DNA, 691 bp, Triticum aestivum
aggcttttggcctactgtcatcgagcccagtgacctggcgggtctgtcctcacctttgcactctgcatatggtggtcctgctgagatcatcgtgaatggtgtgtccggctaccacttgatccctaccagggtgacaaggcctccactctgcttgttgagttctttgagaagtgccaggttgaccccagccactggaccaagatttcacagggcgggcttcagcgtattgaggagaaatacacctggaagctttactctgagaggctcatgaccctcactggggtgtatgggttctggaagtacgtctccaaccttgagaggcgcgagacccgccgctaccttgagatgctgtacgccctcaagtaccgcaccatggccagcactgttccgctagctgttgagggagaatcagcaagcaagtgatctcgccacctccatgccgaaagaagggtggcttggattcctgcaaagattgagatttgataatgctttgattttcttcctagacgctgctcttttttaagattcaaggtcgagtcagtgtgctagtttggtttagtagcgggagtgagtcgggacagaggaaaatgtggtgtgtgtcagtcggttggtgcttgtcgtatttcttggatgttaccgttaaataataggaacggccttggtgccgtttctgaaataataatagtagcat

SEQ ID NO: 2841 - DNA, 667 bp, Triticum aestivum
gctcgaccatgtcgaagcgaggaggggagctccgcggggaacaagttccggatgtcgctgggcttgcctgtgcggcgacggtgaactgcgccgacaacacgggcgccaagaacctctacatcatctccgtcaagggcatcaagggccgcctcaaccgcctcccgtccgcctgcgtcggcgacatggtcatggccaccgtcaagaagggcaagcccgacctccggaagaaggtcatgcccgccgtcatcatccgccaacgcaagccctggcgccgcaaggacggcgtcttcatgtacttcgaagacaatgctggagtgatcgtgaaccccaagggtgagatgaaaggatctgccatcaccggacctgtgggaaaggagtgtgctgacctttggcccaggatcgccagcaacgccaatgccatcgtttgagagcctgtttcaagttgtgagactgcttatataatgccagtgtgggttgcagctgttttgcctgggaaatagtggaactctgcgttgctctgttttgtttggcatctcagtttcttagtgaacagaagcctgcctgtctgcttagtttaacaactgtaacttcgttgccagagaaaatggtgaactttgcgtatctctgttttggtttggcatgatgagtttatggggagtattcatac

SEQ ID NO: 2842 - DNA, 541 bp, Triticum aestivum
tcgatctggcatgcgagatctgtttaatagttcttttggtgcaacattcctcacagacacaggaaaggaatcatcatttgcctatcacattcatcaatatgcagatatctacaccagcaagcttgagaacttcttgtcatatgcccctgaatcatggcttcatccacctcacgacataaagatcatgccacataatgcaaaggtgccagcgagtttgttcagcacctcatagttcactgtatccatttcttgtggagagccatggtagtgcactacagagtggtttttgtttgtggccatgggactccatactgtcactgcattcggctaggttatgaagaaaccaacacagattggatccaactgaataggccagggagcaaatcaagatgtgcctattcttgactgacgtaagaatcagtctccaagtgagtaggcgattcttttgtacaatatcgctgtacaatattgtttcaactatgtgtgtcttctaaatacatccgaggcaacgtaacaaccatctgcaatcgtgggcaataaa

SEQ ID NO: 2843 - DNA, 662 bp, Triticum aestivum
actgctctcggccggcgaggcggccgatgttaccttcgaggtcggaggcgagacatttgccgcgcacaggtgcatactcgcagctcgttcgtcggtcttcaaggcggagctcctcggccccatgaaggagaagaccgcaactcgcgtctgatcgacgacatggaagccatggtgttcaaggctttgctccacttcatctacaccgattcgctgcccgcgatcgacgagggcgacgtggcggcgattgctcagcatttgctggtagcggctgacaggtatgatatggagaggctgaagctaatctgcgaggggaagctgtgcgatcacatctgcaaaagcacggtggcgacttcgctggcgttggcggagcagcatggctgtggtgctcttaagaaggcatgcttgaagtttctgacgtctgaaggtaacctgaaggcagtgatggcatctgatggatatgagcacctgagcaacagttgcccatctgttctctatgaactggtcgccaagcttgctccttgatctccttgagtctaaaccccacaagatctggatatttattctgctatttatattttcagaagtgatgataatcccactactggtagtctgttaaggacggtaaagtctatgtgaaaaccaatgttgcttgcgtttgctgc

SEQ ID NO: 2844 - DNA, 655 bp, Triticum aestivum
ggactgtaagggaaaggaggagcagctgcagcatcccatgacatgcaatcatgctctgattccccaaatgaccagacgaacctcagacgccggagcatttggagaaccgttcgcttgtccaattcaggagagggccgatcacccgatgattgataaggctatttctgaacagctcctatctgaagctcaacaagtcctccataattccaaaatgatttcgaagaacaagagaagaagtgtgatatggaccacaataagtgccacagtggagttcctccacgtcacaatgatccgaatagccgagtgaacagttccggaaaagaatttggtagcagaaatgcggagggcttgttcgacagatttagtttcaggaaaggtgtggagaggctgtgcaggcaccctgtgtttcagttgagtaggtccatgaggaaggccccagacgtggctgtgtttgatgctcccagagaagcaaggcaagcttgggtatgatatggtagcgagatagtaattgggattgtatgtaatggtaatggagttatttttgcttcttttttgtttagttgattgattggccgttcctctagtttgtgtgagtagaaacggttagccaagccaattatagtttgtaggtactgcagatttcagtgtacattat

SEQ ID NO: 2845 - DNA, 733 bp, Triticum aestivum
aacagaccagcactccaaagttgtctctgtgcccccaccggagctgaatcagcacctcggtgatctcctcaagaccgagaagggcgctgacgttgtgtttgaggtaggcggggagatgattcctgcacaccggtgtgtgctcgcgtcgcgatctccagtcttcagcgcggagctctttggtgtgatgaaggagggcgacacagccggtgtcatacacatagatgacttggaggcacaggtgttcaaggagttgctctactttgcctacactgactcattgcgagaggcaaaagaagaagaggaagatatcatgtgccagcatctgctcattgcggcggacaggtataacatggagaggctaaagctgatttgcgaggaaaaattatgcaagtacattgatgcaggctctgttccgaccattctagcacttgctgagcagtaccactgcaatgggttgaagaaggcatgctttgattttctcagctgcccggcacatcggagggcagtcgtggccactgacggcttcaagaatttgtgcaagagcttccattctcttgtgatggagctgattgccatgccctcgccaccttagccgagtgttgccccgtattttagcaatggtagttcatggtttctagatggttgatatcaactagatctcttgtttaccaatgtgtactggtatgtggactttgtgacttatgttatcaggcagttatcttgtcatgtgact

SEQ ID NO: 2846 - DNA, 718 bp, Triticum aestivum
gaagaaaatgccgagtcaatgcaggttctgcattatgaagttggtcagaagtatgatgcccacttcgattattttagtgacaaaaagaacataaagcgtggtggtcatcgagttgccactgttcttatgtacctgacagatgtgaagaagggtggagagaccgtgttcccaattgctgagggaagagatttacaacataaggatgaaacgtggtcggagtgcgcgagacatggcctggcagtgaagccaagaaaaggcgatgcgctactgtttttcagtctccacgttaacgcgacaacagatcggagcagtcttcacgcgagctgcccagtagtagagggcgagaagtggtctgccacaaaatggatccacgtccggtcattcgacaaccctccagatgttatggcggacacacggtgttctgatgccaatgagcaatgccctagatgggctgctcttggggagtgttacaagaatgcaaaatacatggtgggcacgaaggacaccctcgggtcttgccgcaaaagttgcggggtctgcgatgcttgaacccccgcaccaatcttaactgaatttgcatggttactgagatgtagattacaaaaccaaataggttcttagtagcatggcattagatgtttgctcttcttgccatgcagtttgacctcagagcatctttgatataaagcaaaaagggaattgactttgtttcagaaga

SEQ ID NO: 2847 - DNA, 731 bp, Triticum aestivum
  misc_feature (53)..(53): n = any nucleotide
aaatgccggaatcaatcaggttctgcattatgaattggtcagaagtatgatcncacttcgatattttagtgacacaaaagaacgtgaagcgtggtggtcatcgggttgctactgttcttatgtacctgacagatgtgaagaagggtggagagaccgtgttcccattgctgagggaagagatttacaacataaggatgaaacgtggtcggagcgcgcgagacatggcctggcagtgaagccaagaaaaggcgatgcgctactcttcttcagtctccacgttaacgcgacaacagatccgagcagtcttcacgcgagctgcccagtagtcgagggcgagaagtggtctgccacaaaatggatccacgtccggtcattcgacaaccctccagatgttatgacggacgcacggtgttctgatgacaatgagcaatgccctagatgggctgctcttggtgagtgttacaagaacgcaaaatacatggtgggcacgaaggacaccctcgggtcttgccgcaaaagttgcggggtctgcgatgcttgaaccccggcaccaatcttaactgaatttgcatggttactgagatgtagattacaaaaccaaataggttcttagtagcatggcattagatgtttactctccttgtcatgtagtttgacctcagagcatcttgatataaagcaaaaagggaattgactttgtttcagaagaatttggatataacctgatggta

SEQ ID NO: 2848 - DNA, 959 bp, Triticum aestivum
cgatttttcccctcctctccgccggcgacggtcctcccgaccggatccagcgcagccaccctcccccctcggatccagcgacgccgcctggcctcccccggtcccaccaccgtaagactcctctcggtccagcgaccttgagcacagagatgcggggagtcggaggtccactgctcactgtcagcgatctcttgagcgacctcgccgtcgaaggaggcgacgaccacctcgacggcggaggcgacgcctctgttccctcttcccccttggcagcgcatcaggtggaggaggccgacccctccgagctccagcggctcttcgcggaagactatgacaatttgatgaagtcgctacaggagaatgacccttcgtggccttccctgatgctgaagttgtgcagggcgttgaagacttccgataagctgctgagctgcgcgaatgtgaaagctgagcagctgctagagaaggtggagaaactggagcatgtcttagagaggggagatcgtgcagtgggatcaatcatagaggttcttcagagcatgcagctcaccgaggatcatcagacctccaaatcgcacccacctagcaagtagtgagctgtggtggcgtagatgttatgtttgattatccaaatcaggattcatgcctttcttgccagcattctagcacaaatccatttactagttcctttgcttcctgaactgaacgaactgaaatgctttatgcttccagggtccatttctctagaagcctgagaagtgttgtggcagtccgccggataataccaaagacgtgcatgttttctaaagatggacagaaaaatatttgtaggaatttaagcctcaatgatttagaagattttcatagatattttgagagattctatttcgtaggatttttttctgctagagcttgttggtttgtaggattgagaactatatatgaatttttatggacta

SEQ ID NO: 2849 - DNA, 530 bp, Triticum aestivum
catggggtgagattgatggaacaccactgaggttggatcctgacgagacaccagggggtagtgagaggtcacatttcaagatcccacctccacctgttcgagatgtgaaggcacacctgctgtccagggatgctgcgaagaagataaaagcgcgaacacatatgtttcacaagccaccattgccatcccctgtgagaggaggcagtgcaagccccaggaatctgtctcctgcagcacagaagtttgtgaggaatgccatcgcaaaatccacacgaaccattgatgagtctctccgtgcaagttacagagggtcgaccccatctgcaggcaccccgaagacaaggttttcaacggacccaggcttgggatcacggtctccttcggcgagaaagggttccacccctccgtggtgatttcagtaaaccccaatgttatatatatccatttcataaactgatagatgctatccatgtattgtatcgggaaaaaatgatggtagttttttcagcctggaaatcttagagggcttg

SEQ ID NO: 2850 - DNA, 669 bp, Triticum aestivum
tgacaaaggaaagaagtatgatttggaggatctaaggaagacaccaaacccgttttacattgaatcagggaagaaagcagacaatgggtacagttttgtgaagacaccatcgccagcacctggtgtggacgagtctccgttcatgacatggggtgagattgatggaacaccactgaggttggatcctgacgagacaccagggggtagtgagaggtcacatttcaagatcccacctccacctgtacgagatgtgaaggcacacctgctgtccagggatgctgcgaagaagataaaggcacgaacacatatgtttcacaggccaccactgccatcgcctgtgagaggaggcagtgcaagccccaggaatctgtctcctgcagcacagaagtttgtgaggaatgccattgcaaaatccacacgaaccattgatgagtctctccgtgcaagttacagagggtcgaccccatctgcaggcaccccgaagacaaggttttcaacggacccaggcttgggatcacggtctccttcggtgagaaagggttccacccctccgtggtgatttcagtaaaccgcaatgttagatatatccatttcataaactgataaatgctatccatgtattgtatcgggaaaaaatgctggtattttttcagctggaaccttagaggg

SEQ ID NO: 2851 - DNA, 530 bp, Triticum aestivum
  misc_feature (105)..(105): n = any nucleotide
  misc_feature (515)..(515): n = any nucleotide
  misc_feature (517)..(517): n = any nucleotide
cacatggtgtcagatgaatagagcagctgtcctctgaagccctggaggctgcccgaatttgtgccaataagtacatggtaaaaagttgtggcaaagatggcttcnatatccgggtgcggctctaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccncntcttaatactgta

SEQ ID NO: 2852 - DNA, 806 bp, Triticum aestivum
taatgggaggaagtagcatacgtgatgggtgactgctttgggaaaggcaaaggatctgagaatttttcaagaggcccatttgttgtggaaaaggagtaaaccaccaaagtttcccactcgatacaatttcactagctttgcgatcacattaaatgaacttacccctggattgaaggaaaaacttccaccaacagactcaagattgcgaccggaccagaggtgcctagagaatggtgaatatgaaagagcaaatgctgagaagttgaggcttgagcagagacaacggcaggcacgaaagatgcaggagagtgggtggaaaccccggtggtttgcgaaggataaaggtagcgacacataccgctaccttggtggttactgggaatccagagaaaagagcagctgggaaggctgcccagacattttcggacaactcccaaacgatctaatgataactgactaggctcatgtaggttacaggtcttctggttctctgtttttcttcttgtttttggatccgttggttccatgtttagtagattatactagagcaattaaatgcctttccgcctgtaagcaaaggctgcccttcagatacattgttttaacgtacataataagagtgtcgtttgtccaaaaggtcactctgaatcaaatgttttcttgtggggatttcactcgcacaagttcagagtggtgttatataggtcatttgtgtatatttgaatatgtaacgtgcattgaagcgccaaagaatattaaagcattcatactgatggtgtaccatctatctatggcatcgagatgca

SEQ ID NO: 2853 - DNA, 734 bp, Triticum aestivum
gtgatctgccatggcgagaaaggtttcttaaccgatgggcgcaagagttttcctagtggacacacgtcgtggtcttttgctggacttggatttttgtcactatacttatctggcaaaattaaggcgtttgatcgcaaaggtcacgtggcaaaactttgcatcgtgattcttcctcttcttcttgcttcgcttgttgggatttctagaatagacaactatcgacaccactgggaggatgtgtttgtcggcggcctgattggatatatcatggcagtgctgtgctatctgcactttttccctcctccatatcaccatcaaggttgggggccctatgcatccttccacatgctggaggagcttgaggcaggcaattcaaataatgcacaaaaccaacagtctgcaggtcagcatcatatcggattgaccggccaacaccataacgggagatcaagaaatgatttggaatctggaagtgtgtaactcacccctctgtggaaccgactagcgtaccttatacagtaagcatgccttaaaaacttttttatgtgtgcaccaagcaagtactaggagtttaggactagatttgtgctatctgcacctcaggtttatgcctgttcctcttgtgtacaaaaactactcgctcagcatattctgacctagttgttctagggccacctgttgtatctaaatcatgtgttaacatcatagaccatgtgagtggctggtggaagtac

SEQ ID NO: 2854 - DNA, 639 bp, Triticum aestivum
ccacccttcttgctagtcgaccgaggagattgcttcttcacaagaaggcatggaatgctcagaaccaggagtgcggctattcttgttgccgatgacaaggatgagcctctaattacaatggatacgcctgaagagacggaagggctgattatttagagaacatcaccataccatcagcgctgataacaaaagcttcggggacagactcaggaaagcagtcgatggcggtcacatggttaatgtgaatttagattggagggagtccctgcctcaccctgatgagcgtgttgaatacgagttctggaccacagtaacgatgaatgtggtcccaaatgcgacagccagattgatttcattaagagctttaaagggccagcacagatacttgagaaaaaggggtacacacagttcactcctcattacattacctggtattgcccggaggccttcacactaagcaagcagtgcaagtcccagtgtatcaaccatgggaggtactgcgcacctgacccagaacaggatttcagcaaggatatgatgggaaagatgtggtggttcaaaatttgcgacagtctgtgtttataaagttgcgaaggagaataagaagccttggttatggtgggactacgttgaccgatt

SEQ ID NO: 2855 - DNA, 881 bp, Triticum aestivum
gctgctgcgaggggaggttcgtcgtggagaagaacagcctcaaggtcacggcgccggactctcttaaaggcagctacgagtgcgccattggcaacttcggcgtgccgcagtacgggggcaccatggtcggcgtcgtcgcctaccctaagtccaaccggaaggcctgcaagagctttgacgacttcgacatctcctacaaggccaagcccgggtccttgcccaccttcttgctagtcgaccgggtagattgcttcttcacaaagaaggcatggaatgctcagaacgcgggagtggcggctattctggttgctgatgacaaggacgagcctctaattacaatggatacacctgaagagagcggaagggctgattatttagagaacatcaccataccatcagcgctgataacaaagagctttggggacagactcaggaaagcagtcgatggcggtcacatggttaatgtgaatttagattggagggagtccctgcctcaccctgatgagcgtgttgaatacgagttctggaccaacagtaacgatgaatgtggtcccaaatgcgacagccagattgatttcgttaagagctttaaaggaccagcacagatacttgagaaaaagggatacacacagtttactcctcattacattaccttgtattgcccggaggccttcacactaagcaagcagtgcaaatcccagtgtatcaaccatggaaggtactgtgcacctgacccggaacaggatttcagcaaagggtatgacgggaaagacgtggtggttcaaaatttgcgtcaagtatgtgtttataaagttgcgaaggagaataagaaaccttggttatggtgggactacgtgaccgattttgcaatccgctgcccc

SEQ ID NO: 2856 - DNA, 734 bp, Triticum aestivum
ctgagattatcaaaggtgagggccacggcagtgctgttgactggtggacctttggtatattcttgtacgagcttctgttcggcaaaacacctttcaaaggttcaggtaaccgagcgactctgttcaatgtcatcggtcagccgttgcgtttcccagaatacccagtcgtgagcttttcagcaagagatttaataaggggcctacttgttaaggagccccaacaacgattgggttgtaagcgtggcgccaccgagataaaacagcatccattttttgagggtgtgaattgggcgttgatacgctgtgcgagccctccagaggttccgaagcctgtcgagattgagaggcagactacaaagctgccagtgtcaacatctgaggctagtgcagcacctactggtgcatcccagaaaggctcggataactatttagagtttgatttcttttaatgaacagaatgttcattttttccatttgtttgcataattagaagttgtaggcttttcgcatgcatgtgtctgacagatgagtcgtatgtagatttttgtgtctgtcaagctattttctgctttgtagtgaacgaattggatgtttcaaatttatattcccccaccagttttgaagtcgctaatctttgtgagaatcttcgcgtgatgtgcagaattaaactcagttttgtaacagcttatgctgttgtaaaaaaagttattactgtcagcaactaaggcacttac

SEQ ID NO: 2857 - DNA, 563 bp, Triticum aestivum
acagctgaaccggggtcaaaaacaggctgctgcaacagaagattcaccttcagtacacaccggaggctgtggagcatctcggcgctcttggctttgaccccaactacggtgccaggcccgtcaagagggtgatccagcagatggtggagaacgagatagctctcggtgtcctcaagggtgacttcaaggaagacgataccgttgtcgtggatgtaagctccgtgtcgatagccaaaggctttgctccaaagaagcagctggtccttcagaggctagaaaacggaagcacagagttggttgccaaggacggaagcacagagttggtcgccaatgactgaggcgtgagaactttagcgtatctttggttagtttcaatgtttatgtagtgagaacctttcaccacgaaatgcatgaatcagaagacggcacatcagcttgttcccttgttctggtttcgtggagtatccaccgaattgtgtcctgcatggctcaggtccagccgggtctgtttgggtccgcatggacaaagtacgcggcccaacgcgacgatacaaatggacatg

SEQ ID NO: 2858 - DNA, 578 bp, Triticum aestivum
ctggactcacagagataaatcgcattgtggagatacagctgaaccgggtcaaaaacaggctgctgcaacagaagattcaccttgagtacacaccggaagctgtggagcatctcggcgctcttggctttgaccctaactacggtgccaggcccgtcaagagggtgatccagcagatggtggagaacgagatagctctcggtgtcctcaagggtgacttcaaggaagacgataccgttgtcgtggatgtaagctccgtgtcgatagccaaggctttgctccaaagaagcagctggtccttcagaggctagaaaacggaagcacagagttggttgccaaagacggaagcgcagagttggttgccaatgactgaggcgtgagaacttcagcgtatctttcgttaggttcaatgtttatgtagtgatagcctttcaccaggaaatgcatgaaccagaagacggcacatcagcttgttcgcttgttctggtttcgtggaatccccagaattgtgtcttgcatggctcaggtccagtcgggtctgtttgggtccgcatggacaaaatacgtacaaatggacacgg

SEQ ID NO: 2859 - DNA, 624 bp, Triticum aestivum
gacaccctcagaaacacaacagacagcaaggatgcggtgtatgaggtaatgaaaaaacaggtgactgagattgctcggcagacattccgaccagagttcctgaacaggatagatgaatacattgtgttccaaccactggactcaacagagataaatcgcattgtggagatacagctgaaccgggtcaaaaacaggctgctgcaacagaagattcaccttcagtacacaccggaagctgtggagcatctcggcgctcttggctttgaccctaactacggtgccaggcctgtcaagagggtgatccagcagatggtggagaacgagatagcgctcggtgtcctcaagggtgacttcaaggaagacgataccgttgtcgtggatgtaagctccgtgtcgatagccaaaggctttgctccaaagaagcagctggtccttcagaggttagaaaacggaagcacagagttggttgccaaggacggaagcacagagttggttgccaatgactgaggcgtgagaactttaatagcgtatctttcgttaggttcaatgtttatgtagtgagaacctttcaccacgaaatgcatgaatcagaagacggcacatcagcttgttcccttattctgt

SEQ ID NO: 2860 - DNA, 717 bp, Triticum aestivum
ttgcgagagctggtcctaagtatgcttcagttccaaccaccaatctgaaggatgacccagatttctataatgatcttctgagggaaaaccttcatatcaggcttaggttggtagtcaactacaaaggccttagcattggtgcagtgagagatgtattcgagaagtcacttggcctgcgtttgcgaaagataaatcccaacactgactatcattgcttgaagacctttgcttcttacttcactaaagatatccctatacctgctggcacaaagatcgacttctgccaaacgtccgacggtcagctaataacagaaattgatggcaggcagatcagtgctgttgagagcaaagacctttgcagggctttcttcgacatgtacatcggcgattcgcccgtatcgttagaggccaaaagggaagtcgcccggaacgtcgccggactcatgggaagatgcggcggatgaaagagggccggtgggtcagagaattcttttgttcttccgttacagcatgtggataggaggaaactaggcgagaatcgttgcgtgtacatacgctgagagatctggtaacctgtaaagtggaaagggcgatgttgtattgttgtaatacacacacatgggagatgcgcatctgcctgctgtgcaaggggcctccgtccccattaggatggagctctttcctttttgtagatgagaggagttgaggatgcttctc

SEQ ID NO: 2861 - DNA, 717 bp, Triticum aestivum
cttcagttccaaccaccaacctgaaggatgacccagatttctatgatgatcttctgagggaaaaccttcatatcagagttaggttggtagtcaactacaaaggccttagcattggtgcagtgagagatgtattcgagaagtcacttggcctgcgtttgcgaaagataaatcccgacactgactatcattgcttgaagacctttgcttcttacttcactaaagatatccctatacctgctggcacaaagatcgacttctgccaaacgtctgacggtcagctaataacagaaattgatggcaggcagatcagtgctgttcagagcaaagacctttgcagggctttcttcgacatgtacattggcgattcgcccgtctcgctagaggccaaaagggaagtcgcccggaacgtcgccgggctcatgggcagatgtggcgggtgagacagggccccgctgggtcagagaattctttcgttcttccgttacagcatgtggataggagaaaactaggcgaggatcgttgcgtcgtgtacatacgctgagagatctggtaacctgtaaagtggaaagggcgatgttgtattgttgtaacacacacatgggagatgggcatctgcctgctgtgcaaggcgcctccgtccccatttggatggagctcttgcctttttgtagatgaggagttgaggatgcttctcccatgatgaaagcaaatatacaa

SEQ ID NO: 2862 - DNA, 746 bp, Triticum aestivum
gagaagctgggtcctaagtatgcttcagttccaaccaccaatctgaaggatgacccagatttctataatgatcttctgagggaaaaccttcatattagagtcaggttggtagtcaactacaaaggccttagcattggtgcagtgagagatgtattcgagaagtcacttggcctgcgcttgcgaaagataaatcccaacactgactatcattgcttgaagacctttgcttcttacttcactaaagatatccctatacctgctggcacaaagatcgacttctgccaaacgtctgacggtcagctaataacaaaaattgatggcaggcagatcagtgctgttcagagcaaagacctttgcagggctttcttcgacatgtacattggcgactcacccgtctcgttagaggccaaaagggaagtcgcccggaacgtcgccgggctcatgggcagatgcggcgggtgagacagggccccggtgggccagagaattatttcgttcttccgttacagcatgtggataggaggaaactaggcgaggatcgttgttgcgtgtacatacgctgagagatctggtaacctgtaaagtggaaagggcgatgttgtatattgttgtaatacacacacatggagatgcgcatctgcctgctgtgccaaggggcctccgtccccatttggatggagctcttgcctttttgtagatgaggagttgaggatgcttctcccatgatgaaagaaaatatacaagcc

SEQ ID NO: 2863 - DNA, 540 bp, Triticum aestivum
gcgcgtcgtcgatgccgtcgagcgcgggcgccccgccgccctacgacccgtcgcgcgccaccacgtcgtcgctggacgaggcgtccgtgtcggtgagcaacgcgagcgacctggaggcgacggagtgggtggagcaggacgagcccggcgtgcacatcaccatccgcgagctcggcgacggcacccgcgagctccgccgcgtccgcttcagccgggagcggttcggcgaggagcgggccaaggtgtggtgggagcagaaccgggaccggatacacacgcagtatctgtagcagcgagcgggacaccactgaagcagctaacacgtacgtacgtcaggtgactcaggtccggatgggactcgtaggttagagtgatggtgatggtgtgatacttactgtactaaagctagtgctgccgttagtccattcgtcttgagaggcggcaggttgatggttcatgctgctgcgccttgtgtaaaatgtgtttaccggacagttaccggttcttttttttttggatcggtttgtatgttcctgaaca

SEQ ID NO: 2864 - DNA, 557 bp, Triticum aestivum
  misc_feature (539)..(539): n = any nucleotide
ccccgctcaaggccatcgacttcggcctctccatcttcttcaagcccggtgagaagttctctgaaattgtgggaagtccctactatatggctcctgaagtgctgaagagaaactatggacctgaaatagacatttggagtgctggcgttatcttgtatatattgttatgtggtgttcctccattttgggctgagactgaacaaggagtggcacaagctatccttcggggaaatatagattttaagagagaaccctggccccatgtttctgataatgctaaagatctagttcggcagatgcttcagcctgacccgaaaatcaggctaacggcaaagcaagttcttggtaagatgtacatagtggtagtgctttcaaaccggcactgtgttatgttagtttcaatatcctcaaagttcccaaaacatcaaatttgtgtaagttcctactgtttggtgctgctttaaacttcagcctgaaccccctttcatgttctgtttttcaatttgcaatgtgtaatctgatagctagaagatcactgnaccagtctgcctggtttt

SEQ ID NO: 2865 - DNA, 578 bp, Triticum aestivum
tcaacagttcactgatttgtttgaaagctgtgatagtgcccatcgtctcaatttctctgatgggaaagtaagaaaaggcctcagttttgaaagcccagatgctaaagggaaacaagatgcaagtgatgacatcatgaatttgcaaaatgaaatttccaaattattagcagagagccaaagtctgaagcaacaagtttcatctgagtctcatcgggcaaacaatgctgagaatgaatgccaagccttaaggacaccatctcatgtttgatttctgagaaggacaaagcccttgtgcagtacagcgaatccaccaaaagattgtctgctttagagactgagctctctaagtcacacaacgaactcaagaaactctctgatcatatggacagggaagttcagaatgtaaacagtgccgagtcatgtaacaacacaatgcaatccgagcttgaaactctgggccagaagatcatgatgcagcagcaagaacttgcacaaaatagaaaagatctggcggattcaaagagtgaattcgagagtgagatccactccctgaggagcactgtctcacaaataaatac

SEQ ID NO: 2866 - DNA, 537 bp, Triticum aestivum
gctatttactgtcaagaggaatggtaccacaccctgatgaaataggttctttatcaagtcgcaaaggtctcaaacagttcactgatttgtttgaaagctgtgatagtgcccatcgtctcaatttctctgatgggaaagtaagaaaaggcctcagttttgaaagcccagatgctaaagtgaaacaagatgcaagtgatgacatcatgaagttgcaaaatgagatttccaaattattagcagagagcccaaaatctaaagcaacaagtttcatctgagtctcagcgggcaaacaatgctgagaatgaatgccaaagccttaaggacaccatctcatgtttgatttctgagaaggacaaagcccttgtgcagtacagcgaatccaccaaaagattgtctgctttagagactgagctctctaaggcacacaacgaactcaagaaactctctgatcatatggacagggaagttcagaatgtaaacagtgctgagtcatgtaacaacacaatgcaatccgagcttgaaactctggccagaaga

SEQ ID NO: 2867 - DNA, 704 bp, Triticum aestivum
aagttgaagcctttgttctgagggctgatgacttgaagtttgtagccacccagtttaggaaactccatagcaaacagctccagcatacctttagattctactcacaacagtggagaacctgggccgcttgttttatacaggcagcttggcacagatattgcagaaagaagctagaggattctttgtttgagaaggagaagaggttacaagcagctattgtaagtgacgactctaccaagctcagtctgggcgcggcactgtacgcctcgcgttttgctggcaacatgatgcggatcttacggagaaatgctacccgaaaggcccgtttgcaggacagggtgcctgcaaggttgttacagaagccggcagaacccaacttttttgccattggagagtaattttgacataccctgctacaagcagaaagtcacaacccaactggtaaagtttgttcttatgccctcatcttctcccagctcggctcagtttatgactggatgctatacatagatagaccgcttgttctgcatccttgtaatttatataatgcaattcaatgtattattgcttttcgttgtctatacatgtgctgtgtttgtatattgaaggtatctatataagcattccacatttattcgtacctgaattggaaaacatgaaactcttgaatgatgttttaggctggaaactctacactgtaactg

SEQ ID NO: 2868 - DNA, 737 bp, Triticum aestivum
atggttcgtttaatgacaaacctgtgatggaatcagctgttggccaattggaaaggatttgtttgagaaagagcagaggatctccttgctgacctgaaagacatacctaagaaggcttgtgatcgccgggtcaatgagtttgtgaagcgtgctagagctgcgaagatccatgcttacataattggccagctgaagaaggaaatgcctgcaatgatggggaaagccaaggctcaacagcgactcattgacaacttacaagatgagtttgcaaaggtccagagggagtaccaccttccggcgggcgacttccctgacttggagcacttcaagcaggtgctggccgggtacagcatcgacaagttcgagaagatgaagcccaagatggtgcaggccgtggacgacatgctcgcgcacgacatcccggacctcctcaagaacttcagcaacccttaccagtgaacttgctgctgacctctcgtcagtcgcaacttattcctcaagtgttgttcgtctgccatgactcatgatggaagtaggcaagcatgagagacccatcgcatgtgcaaggttatgcctgccctttgtgcgggaaaagcgataaacgtgtaacacaacgttcagagacgcgttggctctttccttttgtcttcagtgctgtactgccgtagcctatgcacctttgacaactgttcggaatagatacttggtgggagaattcaagatgaatgggcaatata

SEQ ID NO: 2869 - DNA, 726 bp, Triticum aestivum
ctgtttgtttgtccagacatttacaatgagaaaaatgttaaaccaactgtttttatgtgtatattatgtggcagccgacaacttctgcagaaacgtcagttcttccattctcacagggcacagccaatggcagtggaacaagttttgtcagatcatgacagcgaggatgaagttgacgatgacattgccgacttggaagatagacggatgcttgctgattttcttgatgtcacgaaagatgagaagcttattatgcatatgtggaattcatttattcggaaacaaagggtgctagctgatgggcatataccttgggcctgtgagggcttctcccggcttcatggaccgcagcttgtacaaaaccctcctctgctctggtgctggcgtttcgtcatgattaagctgtggaaccacagcctgctggatgcgcgcgccatgaacacatgcaacaccattcttgagggataccaacccaagaagaagatgttttaattccaaggggggttggttgcttacttttaaacctttccatattccaaggggagcttcattgagggctattctcatttactgaaaatgttgatgttttgccgacctccgccggataatttcctaccaagtcgtttcccctcggatagatttttgagatttttttaaaagtcacttctcgatgcctgtggatgttcagactttgccgttgtcgttccccttttaaattagaaattg

SEQ ID NO: 2870 - DNA, 600 bp, Triticum aestivum
agcgaagtgatcccagaaaccgacaacttctgcagaaacgtcagttcttccattctcacagggcacagccaatggcagtggaacaagttttgtcagatcatgacagcgaggatgaagttgacgatgacattgccgacttggaagatagacggatgcttgctgattttcttgatgtcacgaaagatgagaagcttattatgcatatgtggaattcatttattcggaaacaaagggtgctagctgatgggcatataccttgggcctgtgagggcttctcccggcttcatggaccgcagcttgtacaaaaccctcctctgctctggtgctggcgtttggtgatgattaagctgtggaaccacagcctgctggatgcgcgcgccatgaacacatgcaacaccattcttgagggataccaacccaagaagaagacgttttaattccaagaagaaaatgttgatgtttgccggataattctttcctaccaagtcgtttcccctaagatagatatttgtcttttttttatttaaaaaagtcactctccatacttttgaatgtttagactttgcacttgtcgttccccttttaaattacaaattctcc

SEQ ID NO: 2871 - DNA, 631 bp, Triticum aestivum
gtaatagtgatgaatggcaatacagtggagatagtgatgatgatatggagatcaagagggatgaccgttaccacatcaagaaccggaaggtgaggccgattacagcggcaaatggcaatggaattggacttggggctgtcaatgccaatggcagagggaaaagcgggcttgagaagggaaaggatgcatatccctacctgtgggagactgtcgaggagctgtccaaggagcatccgagtggtgcggcattcaagaaggcatttgaggtgctcgaaggatcaaaagtgcgagccattgaggaaaagctgaggaggtttaggttgatggagatcagacagcagctgcgtaggatggacctgatgaaggagacggtgaggatggtgctcgatgcccttgagagtgctgactgaataatggctgatcgatagtgattggtaaactgttggaagggggaaatcactctttttgtttctagatagactatatgtggttaattacttacttccctggacaaggttgcagttgcctccatcaaaattaggcatagaacatggagtgatggtcttctccttgttattgttcatggatcattgtattttgggattcttaggtgctaacttgtggtttatat

SEQ ID NO: 2872 - DNA, 670 bp, Triticum aestivum
tgatggaggaggcagtgggtatgagaattatggtggtggtgatagtgatgaattgcaatacagcggagatagtgatgatgatatggagagtcagcgggatgaccgctaccacatcaagaaccggaaggtgaggccaattacagcggccaatggcaatgggattgggcttggggctgtcaatgccaatggcagagggaaaagcgggcttgagaaggggaaggatgcatatccctacctgtgggagactgttgaggagctgtccaaggagcatccgagtggtgcggcattcaagaaggcatttgaggtgctcgaaggatcaaaagcgcgggccattgaggaaaagctgaggaggtttaggttgacggagatcagacagcagctgcgtaggatggacctgatgaaggagacggtgaggatggtgctcgatgcccttgagagtgctgactgaataatggctgatcgatagtgattggtaaactgttggaagggggaaatcagtctttttgtttctagatagactatatgtggttaattacttacttccctggacaaggttgcagttgcctccatcaaaattaggcatagaacatggagtgatggtcttctccttgttattgttcatggatcattgtattttgtgattcttaggtgctaacttgtggtttatatg

SEQ ID NO: 2873 - DNA, 641 bp, Triticum aestivum
acattgatgccaatggtatcctgaacgtctctgcggaggacaagacccccggccagaagaacaagatcacaattaccaacgacaaggggcggctgagcaaggaggacatcgagaagatggtgcaggaggccgagaagtacaaggctgaggacgaggagcacaagaagaaggtggactccaagaacgccctggagaactacgcttacaacatgcgtaacaccatcaaggatgataagatcgcctccaagctcccagaggccgacaagaagaagatcgaggatactattgatggtgccatcacctggctcgacaacaaccagcttgccgaggctgaagagtttgatgacaagatgaaagagctggagggcatttgcaaccccatcatcgccaagatgtaccagggtgccggcgctgaaatgcctggtggcatggatgaggatgctccggccagtgccgcaggcggcagcagcggcccagggcccaagattgaggaggtcgactaaatgatagatttagatcgcctactattctgcttgaataatgtgtctctcattgtacggtggattctattatcgttctgcagtttttcgttcgggcatatatacattgccccatcttatgtttaagttgatattgaaaca

SEQ ID NO: 2874 - DNA, 747 bp, Triticum aestivum
acggcgcccaggggtgtcccccagatcaccgtgtgctttgacattgatgccaacggtatcctgaatgtctcggcggaggacaagaccaccggacagaagaacaagatcacaattaccaacgacaaggggcggctgagcaaggaggacatcgagaagatggtgcaggaggccgagaagtacaaggctgaggacgaggagcacaagaagaaggtggactccaagaacgccctggagaactacgcttacaacatgcgtaacaccatcaaggatgacaagatcgcctccaagctcccagaggccgacaagaagaagatcgaggatgctatcgatggtgccatcacctggctcgacaacaaccagctcgccgaggctgaagagtttgatgacaagaggaaagagctggagggcatttgcaaccccatcatcgccaagatgtaccagggtgccggcgctgaaatgcctggtggcatggatgaggatgctccggccagtgccgcaggcggcagcagcggcccagggcccaagattgaggaggtcgactaaatgatagatttagatcgcctactattctgcttgaataatgtgtctttcattgtacggtggattctagtatcgttctgcagtttttcgttcgggcatatatacattgccccatcttatgtttaagttgatattgaaacacgattatttagtactagactagaagacagtatacttggttatctgcagttagttcacatttattta

SEQ ID NO: 2875 - DNA, 759 bp, Triticum aestivum
aggaactggtcgcgcgttctccaaggttctccgggatggcgtcgtcggaggtggtggaggacgaggcgtcggcggcggcgatgctcgccaacggggccgcggacgtccgccggaggagggaccaggccaaggcgatgctgtcgaagcaggccgtcaagatcgccaccaaggcagaggagcacgagcgcttcatcttcaaggtcacacacctgatgggtgttcttggatttgggacattttgctacctcttgggtgctagaccacaggatgtgccgtatgtgtattgcctgttctatgtcatatttgttcctctcaggtggatctactatcgctacaagaagtggcattactatcttctggatttctgctactatgccaacacttttctccttgttatgattctcttttatccaaaggatgaaaagcttttcatggtttgcttctcatttgcagagggtccccttgcttgggcattaattgtatggcgttgcagcttgttgttcagctcatttgataaacttgttagtgttctgatacacctcttgcctggaatagttttgttcactatccgttggtggaacccacaacatttgctgcatgcctccgaaggagagcgcagagtccttggctttgtggcgccatcttcgtggcctggtttgtgtccctacgttcctggtgccgtgttccctgtagggcggcccgggtgggcccgctgcctgggcgggaacgcccctttgtggctggaccggatttcgccgg

SEQ ID NO: 2876 - DNA, 736 bp, Triticum aestivum
aacagagctcagaagcaagaaacagagaaagatttttacagattcctttgcaatttgcgtagcatccagttcacggcgagcaagatggtggccaaggaggcgatcccgctgctgacgccgcacaggatgggccggttcgagctctcccaccgggtggtgctcgcgccgctcacgcgctgccgctcctacgccaacgtcccgcagccgcacgccgcggcctactactcgcagcgggccaccaagggcggcctgctcatcgccgaggccaccggcgtctccgccaccgcgcaggggtacccggagacccccggcatctggacgcagcagcaggtcgacgcctggaagcccatcgtcgacgccgtccaccgcaagggcgctctcttcttctgccagatctggcacgtcggaagggtctccaccaacgatttccagccagatggacaggcgccgatctccagcactgacaagcagataacacctgatgctgagtccggcatggtctactccaagccccgacagcttcaaacggacgagataccgctgatggtcgatgacttcagacgtgctgcccggaatggcgtcgaggcggggttcgacggcgtggagatcccggggcaccgggtccctattgggcggtctggaagcagtctatggtgggcgggggtcggggcgctcgaaacgggcgcttgcggggggatgggctatccaggagggggccctcgccagtgccccgggc

SEQ ID NO: 2877 - DNA, 723 bp, Triticum aestivum
gggagatgagggagatcataagcatccacatcgggcaggcgggcatccaggtggggaattcctgctgggagctctactgcctcgagcatggcatccagcccgacggcctcatgcccagtgatacctcggttggggttgcaaaggatgcattcaacacattcttcagcgaaacgggttcagggaagcatgttccgagggccctgttcgtcgatctggagcccacggtcatcgacgaggtgaggacgggggcataccgccagctcttccatcctgagcagctcatctcccacaatgaagatgctgctaacaactttgcccgcggacactacacagttggaagagaagtggtggacctttgccttgaccggatcagaaaattggcggacaactgcactggcctccaaggtttcttggttttcaatgctgtcggtggcggaactggctcaggacttggttcattgcttctggagcgcctatcggtcgactatggcaggaaatccaagctcggtttcaccatctatccttcaccacagatttcgacggccgttgtggagccatacaacagcgtgctctcgaaccactcgctgatcgagcacaccgacgtggtggtgctcctggacaaagaaggcatctaacgacatctgcacgaggtccctggactcgagcgcccgaactaaccaactgaacgggtgatatcaggtgaatgtcctgacagttatggag

SEQ ID NO: 2878 - DNA, 714 bp, Triticum aestivum
gctcccacgaattacacttgtcattataagatctggccacaaacgacaaactcacagttgcatttagatggtgaggacccccatgataactaaatccaacaccatcaaaagatatgccaaataatggcaccatcattcctccataatcatcaaaggaaacagcagagaacgtttttattacagcatcaataatgatgttatctgaactgctagatataggggggccagcaagcttcagagcgagtcttcttggaggtttacgaaattcacttctaacaagaaatgtaccggcatcctcatccacagtccataaactaaaattttcagatgttttagagccacgtgagtcccatacgctttcctcagaaaattgacctcccgtcaccatatcacttctaatacatcttaacatactgaaatcctctttcgttggtggacctttagatgcaacacatcctaaagcaacaaaaccaggtggagcttgaggataataaaatgatataccatctctacccctgtgcttcttaattggaccaacaatcttataactttctggggctcttaggaaggtatttcaccagtatcacgaacgacacagctgattcggaggtcataccgttaaaacgatgtcccgaataaaaattccttcgaatcatggcgcaaatgaaagtttggggcagagaaggaacctactctggtaaacacaaaacaaca

SEQ ID NO: 2879 - DNA, 704 bp, Triticum aestivum
gaaccttgagcacgagaaggaaaagaacggtgttaaaacaaagcatcttaagatggcaacattggtgcaacagaaggctgatgaaaatgtgctcaagcttgtggaaaaacacaagttagagaaacatgtcgctctagataagattatcaagttggagcatcaactggatgccaagcagaagcttgagttagaaataaaacagttgcagggtaaattggaagtcatgaagcatatgccaggtgaagaagactctgaatcgaagaaaagaatagatgaacttagtgaggagttacaagacaaatatgatgaaatggatgcaatggagtcactctaccatactctgcttatcaaggaacggaaaagcaatgatgaattgcaagatgctcggaagaagctgatagatggtttgcagactattacaactggtcgagcaaatattggcattaaaagaatgggcgaacttgatcttaaatcacttgcaattgcttgcggacgtaaattgtccaaagaagatgcagaagtgactgctggcattctttgtgcgaagtgggaggctgatatcaaaaaaccagaatggcaccctttagggttgcccggttacggggaacacagggagctatctctgagatgtgcgaagctttgaccttaaaaaagttgcgggaaacttttctggggaaaggggtgggtaataaaaacccgggggt

SEQ ID NO: 2880 - DNA, 701 bp, Triticum aestivum
tggggtatgggggtatggacccggatgccgggtctggtcaaggaggaggaggatggagggagcccacgggagaggcgattcgccggcggtcggggcggcgccaaggccgatggaggggctgcacgacgccgggccgccgccgttcctgacgaagacgtacgacatggtcgatgaccccaacaccgacatcatcatgtcgtggagcgccggcaacaatagcttcgtggtgtgggatccgcacgccttcgccacggtgctgctgcccaggcacttcaagcacagcaacttctccagcttcgtcaggcagctcaacacctatggcttcagaacggtggatcctgacagatgggagttcgccaatgagggtttcctacggggacagaggcaccttctgaagaacatcaggcgtcgtaaacctcccgctcatactgcctcacatcagcagctcccttggatcttaccttgaggtggggcacttcggatatgatgcagagatcgcccggctgaccagggacaagcaactgttgatggcagaagtggcgaagctaaggcaggaccagcagaacacgaaggtgcctctgaacaccctggaggataggctacgtgccaccgagcacaagcagcagcagcatgctccttcatggccgtatctgcggaaccggaatctcgagccccgcatgcacgactggataacaagccca

SEQ ID NO: 2881 - DNA, 646 bp, Triticum aestivum
tgtgtaccttggaagggatttcatatttgctttgtgctcttggagatggtcaccttttcagttttctactgaatgcaagcacaggtgaactaaccgatagaaagaaggtttctcttggtacccagccaattagccttcgtacattctcatcaaagggcacaacccatgtgtttgcttcgtctgatagaccaactgttatctacagtagcaataaaaatctgctgtacagcaatgtcaatctgaaagaagttaatcatatgtgtcctttcaatacggctgcttttcctgacagccttgcaattgctaaagaaggtgaactttcaattggaactattgatgatatccagaagcttcatatccgcacgattccgttgaatgaacaagcacggcgcatttgccatcaggaacagtccaggacactggcgttctgcagttttaagtatacccagaatagcatggaggagagcgaggcgcatttcattcgtctgatggatcatcaaacatttgagtttctgtccacacatcctcttgatcaatacgaatgtggttgctccatgattagctgctcattctctgatgataataacttctattactgtgtgggaacagcatatgttctacctgacggagaaggtaccgacaaggg

SEQ ID NO: 2882 - DNA, 684 bp, Triticum aestivum
aagacagcagtctccatggcctccaaggttacagggtaaaacaaacatctacacatttcatcatctttgatttcaatttgtttggctgattggtgccactgatgctggtactaatcaagcaaccaatcccaactactctgcaggtgttcatatccatcgccatgatcctcggggacggcctgtacaacttcgtcaaggtgctcatccgcacgagtgtcgccttcgcggcgatggcgaagaagaacagcaccatcccggtctcggacgtgggcggcgccaaggccaccggcgagcctgtatcgttcgacgagcagcgtcgcaccgagcaattcatgaaggaccagatccccaagtcggtggcgtatgcggggtacgccgccgtcgccgcggtgtcgatcgccaccctaccccagatcttcccggacctcaagtggtactacatcctggtggcgtatgtcttcgcgcccgtgctcgccttctgcaacgcctacgggacaggcctcaccgactggtccctcgcctccacctaaggcaagctcgccatcttcatcttcggcgcgtgggcgggcgcccgcacgggggcgtgctcgtcggcctcccgactgcgggtcatgatgagcatcgtgtcaccgacgcgacctcagcggacttcagagggtactcagctcgggtgcaggcctgtca

SEQ ID NO: 2883 - DNA, 593 bp, Triticum aestivum
  misc_feature (573)..(573): n = any nucleotide
cgctgatggggtcatcggcgccggcaagaccacgctgatggatgtgttggctggcagaaagactggaggctacattgaaggcgacatctcaatctctggctacccgaagaagcaggagacctttgctcgtatctcgggttactgtgagcagaatgacatccactcaccaaatgtgaccgtgtatgagtccctggtctactccgcatggctcagactgccttccgatgtcgagtcggaaacaagaaagatgttcatagagcaagtgatggagctggtagaactgaattcactgagggatgcgcttgttggactacctggagtgaacggcctgtcaacggagcagaggaagaggctgacgatcgccgtcgagcttgtcgctaacccctctataatattcatggatgagcctacctccggccttgatgccagggccgcggctattgtcatgaggacggtgaggaacaccgtcgacacgggcaggacagttgtttgcaccatccatcagcccagcattgacattttcgaagccttcgatgagctgttcctgatgaagagaggaggggaggagatatntagtgggcctatcacgcagg

SEQ ID NO: 2884 - DNA, 865 bp, Triticum aestivum
ctttcttttactgtgggattaagctgtggtcttatccctttgcaaatcataattttgctcgaagggtgctgtaccaagcagaaaaacactcacagcaagctattggatactccacaacaaatccacttaccagagttgatactctttctcatcagctttactaccctcagagaccccttttcaaaacagtttcagctgattgcatcggcagatcagattatacttttggaagaaacgatgactttgctaggcctgaatatttcaatggacaaaatgcgatagttgcagtcaatattcatcagggatttaaccaagaggactcctggttatgaatagagcttctcttgaacgtggtatgtttagaactgagctcatgcggagctataaggcagaagtagagaccaaagggcccaacaaacgactgaaaatgaaggagaaagtaaacttcggcaaaatggaaagcaagagaggacgagttgacaatcttgatgatgatggattaccttttgtgggttcaagtcttcagattggtgacattataattgggaaagtgtcagagtctggtgaagaccatagtattaagctgaagcatacagagaagggaatggtccagagagtgttgctctcagccaatgatgaggggaagcattttgctgttgtatctttaagacaggttcgatcaccttgtgttggagataaattttctagcatgcatggacagaaaggtgttgttggttttctggaatctcaggagaacttcccttttacctgccaaggaatagttccggacatcgtgataaatccacacgcctttcctacccgtcaaactccaggccagctgcttgaagctgctttgggaaaggga

SEQ ID NO: 2885 - DNA, 581 bp, Triticum aestivum
gacgatcggagaaagaacatcacggatactatcaactcatttgcttcagatgctttaaggacattgtgcttagcatttaaggatgtggatgaatttgatgagaatgcagatagccctcctaatggttttaccctgataatcatatttggcatcaaggaccctgtgcgacctggagtgaaggaagcggttcagagctgcataactgctggcatcattgtgagaatggtgactggtgataatatcaatacagctaaagctatagccaaagagtgtggcatattgactgatgatggcatagcaatagaaggaccagattttcgtaacaaaagcccagaagaaatgagggacctgatacctaagattcaggtcatggcccgttcgttaccattgggcaaacatttgcttgtgacaaatttgagaggcatgttccaaagaggtggatcgctgtgaccaagtgatggtaccaaatgaggctcctgcgttacacgaagccgatatttgggctttctatggggatttccagggacagacggttgccaaggggaatgcttaatgtcaaagtaatttacggcaacttccaa

SEQ ID NO: 2886 - DNA, 742 bp, Triticum aestivum
tcatgatgagtcagaaaatgaatcttgtctggttggaagaacaaagtgctcattggaccggatgaggtagaatacctgcttggttttccaagggaccacacaaggggagttgccaaaccagagaggttcaatctcttggcattcgttccaagtagataccgttgcttatcacctgtcagtgctgaaggacatgtatcccaatggtgttaatgtgctatctttattcactggtattggaggaggagaggtagcactgcacaggcttgggatccacatgaggactgtagtttctgttgagataggcgaagttaataggaggattttgaggggttggtgggatcagactcaaactggcacattaattgagattgctgacgtgaaatctcttactgacgatagaattgcaacgtttgttagaagatttggcggctttgacttggtgattgggggcagcccatgtaacaaccttgccggcagcaacaggcaccaccgtgatggcttggagggcgagcatctgctttgttctaccactacttcagaatcgtggatgctgtaaagtcggctatggggcgaatgtagcctaatcattttagttaatgttttatcatttcatgcttatctctaggatccacaacttcatctatgttaaacattgtgttgatgtgaaggatgtttgtttctgagaaacattgcattagtctttagctatatgatttcttgttgctaactaatttagagcctg

SEQ ID NO: 2887 - DNA, 505 bp, Triticum aestivum
cacacaaggggagttggctaaacagagaggttcaaatctctgggcaattcgttccaagtagataccgttgcttatcacctgtcagtgctgaaggacatgtatcccaatggtgttaatgtgctatctttattcactggtattggaggaggagaggtagcactgcacaggcttgggatccacatgaagacagtagtttctgttgagataggcgaagttaataggaggattttgaggggttggtgggatcagactcaaactggcacattaattgagattgctgatgtaaaatctcttactgacgatagaattgcaacgtttgttagaagatttggcggctttgacttggtgattgggggcagcccatgtaacaaccttgccggcagcaacaggcaccatcgtgatggcttggagggcgagcaatctgctttgttctaccattacttcagaatcgtggatgctgtaaagtcggctatggggcggatgtagcctaatcattttagttaat

SEQ ID NO: 2888 - DNA, 710 bp, Triticum aestivum
agaagatggcatggaggagtatatcaaagaggtatccactgatgacgctgctgaacgggcttccaatatgaggtctcagatcaatattctgtggggtatgctgctttatgagcgctcggttgtggagtttaaattaggactgccagcgtgggaggattgtctgatggcagcaattgagaagtttaaacttggaggagcttcagctacaaacattgctgtgttggtgaagaaccactgtgcaaatgaaactgcccaggatggtttgggcttcaatgtcgatgaaattgtgcaagcctggaatgagatgtacgacattaaacggtggctgcgtggtgctccatccttccgtctcgagccattatttaggcggagaactccgcaactgcatatggcactggagcatatatagtatccatgaagttgctccacgcatattaaattctggggcactgttaccaacaccaattttcttttgtaggtcaattgctgattgggatacaatacatggatttgttcggttgcattttttatacatcgaaagagtctgcttcccggttgcgaagctattcattgcggaggggtggagcctgcccgcgatttggatacgttagttgttttttccgtctgtcttgttcttcttcatgcacaggaagctgtgacttgttactgtattagagctgcattcctccgtaagcttagctcatatacat

SEQ ID NO: 2889 - DNA, 574 bp, Triticum aestivum
  misc_feature (562)..(562): n = any nucleotide
gagcagggagtgatgaaacaaaaaaagatgataaatctggagataagaagttattagcaactaggaagttccagtatatggaagggaacagtgagccacatccaatctcggactggaggtctaattccgtttcaagacaggatggcgcctcatctgcgagtagctcacccgtgccatcatggaagagtgaaccatctatctccccaccagaatcatcaactggaaatgcattgcccgacaggctgacacatcgtcaacaaatctcacgctttgggcaatcagcctttcagactggcagtttggcgtttgcaggtttacaggattcagcttcatccaccagtctctcattgaaaggttctctgacaagtaacattttaatgaacttacaaaacaagggcatcttgagcaatacgcagtcttccctcgagacatcatctgccagcctacagacttcagtttcctcatccttcatgtccaagactctgccatcggtgaattctgatttaccaggagcagcaccttccaaatccgcatggaaaccgtcaacttggactgatagatngagcacatcctc

SEQ ID NO: 2890 - DNA, 823 bp, Triticum aestivum
aaaattgtgttaggcatatccatcagtgtcgtcttcctcatggttagcatcttggctctacgggccgagtatcagaaacaggaggatgaagaaagagaaggaaagattctttgatcagaatggtggtcagatattatatcaccaaattatgtcaaaacaagttgatacattgagaatattcacgcaagaagatctgaagaaggctacaaatgattttgacaagagcagagaactgggcaggggtggtcatggcactgtctacaagggcattctcaaggacagcagggtagtggctgtgaagcgctcgaagatcatgaacgtggccgaaactgacgaattcgtacaggagattattatactttcacagaccaaccaccggaatgtggtcaggcttctagggtgctgtctagaggtggaagttccaatgctggtctacgagttcatccctaatggcactctctttgcgttcatccatcgtaactacacaagtccacctccctctctggacacccgtctcagggtcgctcaagaatcagcagaagcactggggtatctgcatctgtccatgagaccggctatagtactgggggtgttcaggctttgaactttcctggggcgagacctcctggcggaagtggccgctggggggtcaagggtccccagggtgtggtcgctttggatctgggccggcccgggggtccccacccggtctccggaggggggacaaaaaagacggtcactcggtgggtgtgggagcacggacgggcccctcgccgaagagaggttcccccgcagggtgtgctcggggagccagtggaggcga

SEQ ID NO: 2891 - DNA, 757 bp, Triticum aestivum
  misc_feature (609)..(609): n = any nucleotide
cagcaatgctgcccgggaggttgaggattcatcagggtgtagtcaatcctcattggccatggtttcttgctcgcaagtgcaggacaccaatctggccttgagctgtgatttacatgtgaatgcggataccagcaagacagaagcacgtgattctcagtcttctatgtgccaggaagactatacttccaccgagggtgttgcatctgctttgtctgaagttcattgccatgcttcttcctccagatttggtccagataaactcttgcagcaggacatttcacaaagaatgaatttgcagatggatattgatgaaacaccaggtaactctatgtttgaaaacaaccagaccatttgtagtacatcgaataatgaaagaccgatgttacagtatgagatagcaccagatatgcctatctctgtgctaacaaatgtttctggagctgagcaaaaactacatttcatgtccgaggctgacttcagcagtcctaattgtttgaaatcagaactttggcaagagatttcgttccagagtcttctttctggagctgatatagttgatgctgattctctttcaagactaaaccaccattcagatacacatttctctgnaggcagaccccattttttggcgggccccaccatcaattatcaatcgcgagtatggggggggtggccgggcccgtgtcggcccctcttttcatggtgtgcgggggggaaaagggaaaagtcgggcggagccccctgtctgggcggcggc

SEQ ID NO: 2892 - DNA, 739 bp, Triticum aestivum
cgggaacgagatcagcaagaccatacggttcctgggtgtgaagtttgcgttcacctcgtagacggtcttgggatactccaccccgggcatgagcatgcagatgaaggactcccaagaccgtctacgaggtgaacgggaacgagatcagcaagaccatacggttcctgggtgtgaagtttgcgtccttcgacctcaccgtggagttcttccggtccgtggtccttgtcgagcagcgccctgcgcccaggcatgcgcccaagagggtcaaatcgactctgaggctggacaagatggataatatcagtcggaaatgggtgaacgccgatgttctgattttcaacaccggccactggtggactcccaccaaattgtttaatacgggttgctattttcaggctggacgtgctctcaaactaggtacaaccattgatgctgctttcaggatggcactgcagacttgggcttcttgggtggccccccgcgttgctctaaaccgaacacttgtgttcttccgcacttattagccctctcattggagtggctgaacccaacggcttgggacgttcagacaagccttacctgtggctacggcactgtccgagtggctgcggcatcctgggcagttggcgcgcctatgttccctcggctaagtcctggggggcccccacgagctgttgggggggatccccccactttggcccggtccggccccgcgctgcacattcctcctgggcgggcg

SEQ ID NO: 2893 - DNA, 727 bp, Triticum aestivum
  misc_feature (567)..(567): n = any nucleotide
caagcttgcagaacaaacagataagctaggtagcaagctgctccaaggctccaggacaccatggccacaaaccccggcctcttcagcgagtggccatggaagatgctcggcagcttcaagtacgtggtgctggcgccatgggtggcgcacggcatccaacaggtggcgaccaaggggtggcgcgaggccgatctggggtacctggtgatcctcccgtcgatgattctccgggggctccacaaccaggcctggatcacggtgtcccgcctccagaacgcgcgcggcaagcggcagatcgtcgaccgcggcatcgagttcgagcagatcgaccgcgagcgcaactgggacgaccagatcatcctgagcgccatcctcttgttcctgggcgcgctgcacctgccgggcgggcagaacctgccgctgtggaggacggacggcgcggtgctgctggcgctgctgcacgccggcccggtggagttcctctactactggttccaccgcgcgctgcaccaccacttcctctacacgcgctaccactcgcaccaccacgcctccatcgtcaccgangccatcacaatcgtgattcatccatttggcgagctcgtggcctacgaaatgctcttctcgataccgatgattgcctgggttctgccgggacggctccatcataagttcgaggtctaatgcctacttggttcgggacactgggcccggacttggtggggcc

SEQ ID NO: 2894 - DNA, 714 bp, Triticum aestivum
gccgagcggctggtggccccgcacgccaccgcgcccgacgccatcgttttcaccagctcggcggaggtcgaggggctgctcaaggggctggacgccgcgggctggagctggccccggctcagggcgcgatggcccgacatggtcgtggccgttcatgggccggtcacggccgacggcgtcaggaggctcggcattgaggtggacgtcgtgagctcgaggtttagcagcttccatggggttcttgatgctctagctgcaacattttgttctcaacaattgaaaattagctccaggtttagtgctggttcacattgaaaattttgatgtaaactttctttcttcgagtcacaagttatcagcctgatggaatgaacaaaaatataagtcagcaaactcaatgctattccacaccaacctgtcacctagatatcttcagaatgtactgtaaatctgcattctaccaacccagctttgtacctgttaataactgtgatcacaaaaatggggtgatgaaccattcttgatcctcctcctctagaatgttctttgacgtgcttatatgagaagctggatttgcctcaaatctcagctacaccacttccagttcagagaatggtgagccaaccagggcaagtgtgtgtaccgggctcaggttctgcctctggtcataaagatctgagggggttccggatacgccgccaacccggatggacg

SEQ ID NO: 2895 - DNA, 711 bp, Triticum aestivum
cttcgccccggttgttaaaccgggcacgatccgcgccgtgctccagttggcggtctcgcgcgcctggcctgtgcaccagttggatgtctccaacgccttcttgcacggccaccttgccgagcaggtgtactgtgagcagcccactggcttcgtcgacgccgagcacccagacttcgtgtgcttactctcccgttctctttacgggttgaagcaggcgcgtcgggcttggtaccagcgtatcgcagccttcctgcagtctttgggcttttggtccactcgctccgatgcctcactattcgtgtatcatcagggagctgacactgcatatctgctgctctacgtcgacgacatcatcctcacggcgtccgcccccgctctccttcagcggctgactgctcgtcttcgtgatgagttcgccctcaaggacttggggcccctgcactacttcctcggcatcgaggtggtccgccggcctaacggcttctttctgcatcagcagaagtacgcccatgagctcctggagcgtgccggtatgcttaactgcaagccggcgcccacacccgtcgacacgaaggcgaaggtctctgctctggaggggtctctcgcgtccgatggagcattttatcgctccattattggtgcttacagtacctgagctgatcgaccgactgcatacctgttaacagtgtgctcaatgaacccggttatccc

SEQ ID NO: 2896 - DNA, 711 bp, Triticum aestivum
  misc_feature (389)..(389): n = any nucleotide
ggcggcacggcggcggagaaaatcgggccaggcggcgaccaaaacagattattggcttgaacaatgtaccccttgctggtgacgaatttgagtctgttgatgaccttgatgttgcacgcgaaagggcaaacgcgcgtgccgatgcaatgagaattgaaaggataaatgcgaaagctggggaaggaaaagtcactctgtcatccattgcagcttccatttcatctgggaatcaagtagggattgatacgcatgggttaaatgtcatacttaaagttgattttcagggttcaattgaggccattaggcaagccattcaagcgctgcctcaagaaaatgtctctttgagattcctacttcaagctccaggagatgtgagcctcagtgatgtngatctggctgttgcttcggaaggaattgtatttggttttaatgtcaaagctccggggccagttaagaaatatgctaagcagaaaagtgtggagattcgattgtacaaagtgatctatgatttgatagatgatttacgcaatgccatggaagggcttcttgaccttgctgaggaggaggtccactcggttcagacaaagtcgagctgtttcagtagtggagtggaaaggagcgggttgctggttatacggaaagtgtggaagtgcatgtcggtcttcgtaagaagagtttgtggtcctgattctgaaggtgagaatggaaggg

SEQ ID NO: 2897 - DNA, 708 bp, Triticum aestivum
gaaacaccatttatactattttccttctttgtcctttaagatcactaggttcttcccttgcttatagtagtaaaagttatttcaaacctagacatcgtaagcttgtgcattggtttcactctctcattttttcttcaggtgtatgttattggtggtgatggtagtcaaaggggtgcaggagtgatttttgaagaggtcagaaagcgtggtctcaaagttgctgttgctggcattcctaagactattgataatgacatcccggtaattgataagtcctttggtttcgacagtgcagtcgaggaagctcaacgtgccataaatgccgctcatgtagaggctggaagtgctgacaatggaataggccttgtaaagctaatgggacgatacagtggtttcatcgcacattatgccaccctagcaagcagagatgtggattgttgcttgattccggagtcacctttctatctggaaggtgaaggtgggctcttcaaatatatagaaaagcgtctgaaggagaatgggcatatggtcattgtcgttgcggagggtgccggacagaaacttttttggcgaaaacatgaaggaaatggggcgaatgcttcgggacggcctggttttgaagttggcctggggggctccaaaataatgggtttctgagaaagggaccttttttggtttatacccaaatatagggagccttaaaatgtg

SEQ ID NO: 2898 - DNA, 698 bp, Triticum aestivum
cagtgagtgagtgaaggactgaagaactcctaggcacgtatcagttccgtcttccttcctcgagatggcggcggcaatggcggcaacgacaatggtgaccaagaacaaccgcgcctcgctcgccatggacaagaagaactggttcttgcggccggtccctgaggtcgccttcccttggagctcgcagcccgagtcaaggagcttggacttcccacgcagggctctgttcgccagcgtaggactcagcctgtcccacggcgccccgccggtggcgcgcgagcatgacgggaaggctcggcccgccgacgacgtcgcacaccagctcgcagccgcgggcgaggcgggcgtccagaaggcccagaaggcgaaaaaggccaagaagcagcagctgggtctgaggaaggtgagggtcaagatcggcaacccgcacctgcggcggctagtcagcggcgccatcgccggcgccgtgtcgaggactttcgtggcgccgctggagacgatcaggacgcacctgatggtgggaagctccggcgccgactccatggcccgggtgttccggtggatcatgcggacggaggggtggcccggctcttcgcgggaacgccgtcacgtcccccgttggccacaagggctcggcctttttttaaccgcagagtattaccccggcggggcgccggtcctcccccccgttcggaggg

SEQ ID NO: 2899 - DNA, 695 bp, Triticum aestivum
tgccctggcgccgtgattgtgtgcgaagaagtcgcgagtgtgttggctggtggacgtgcgagctgcacgagattcgggagggcgtgtcgcaccgcgagcgctttggcattccggggggaaaacttccgaaccggcgccgcaagcagatgcgcgagcagttcatgcgccgcacgcgtctcgtcctcaaggactcggaacatgaaacttggtgcaaaaaatttattgaactgtaccaagaacttagagagaactgggaacggttgtactgggatgaaggtttttcaaaaaagattggcgaagattgcgctaattatgactctgctgaagaagatgatctagacttctcaccatacagcaggagaagggagctccagtgttgagccaaacaaggaccttggttctggggaaagcaaacaggggtgaaaatgggaaagggttactcaaatttgtgacaagtttgagttttacagagaacggggaatgagagagcgagcgtgtgtccccttgaatttgggaacaattttgggcaagagaactggaaaaggcggaagacagaaagagtaggggtttcttgggaaactttaaatactctttgtgccatatgggggtcttaatcaaatggggggggttcacagtacgaagtcttaatataacactgtgtttcacgaatacttttagagttgtttacaatttag

SEQ ID NO: 2900 - DNA, 688 bp, Triticum aestivum
ttgtcgggcaaccgtaactatgagggtcgtgtgcaccctctaactcgagctaactacctcgcctcaccacctcttgttgttgcatatgctcttgctggcaccgttgacattgattttgagaacgaacctattggaattggaaaggatggcaaggaggtttacttcaaggatgtatggcccacaaatgaagaaatcgagcaggttatcaagtccaacgtgttgccgaagatgttcgtggacacgtatggttccatcatggagggcaacgacgcatggaacaatttagtggtcccgaaagagacgctctacccatgggatccaaaatccacctacatccacaagccggcgtacctggaaaatataaccatgacctcgcccggaccgccctcagtgaaggatgcctactgcctactaagcctaggggacagtatacacaccgaccacatcctctccctcagggtccaccaagccaggcaaccctggcgccaagtatccgcggaacgcggcgagaacccgaccactcaccccccatgcgccgacggccaacaacacacgccgcgaaagggcgatcggcacaaaagctgcaaccacctaggccgaacctcggccaaaactcccgaccacggcgaagatacagaacacgcctcacacacccggccaccagcaacgacgcagaagcacaccccaa

SEQ ID NO: 2901 - DNA, 616 bp, Triticum aestivum
gactggctactggctactggtagcagcagctgatcctgatcgagagcgatggggtgggcgatcgcgctgcacggcggcgccggggacatcccgcgcacgctgccgccggagcgccgggagccccgcctcgccacgctccgccgctgcctcgacctcggcgccgccgcgctccgggccggccgctccgccctcgacgtcgtcgagctcgtcgtgagagagctggaggactgcccgcacttcaacgccggcaaggggtcggtgctcaccagcgacggcacggtggagatggaggcctccgtcatggacgccaccggcatgcgctgcggcgccgtctcgggcctctcgaccgtcgtcaaccccatctccctcgccaggctcgtcatggacaagacgccgcacatctacctcgccttcgaaggggccgaggccttcgcaagagaccagggtgtggagaccagggatcaagccacttcataacagaggaaaacattgagaggctcagaaacgccaaagaggccaacagggtgcagatcgactacacccagtacaactacaccgacccatctgcgctcccaacaacgacgacaacagccggaccggcacggtggctgcgtgg

SEQ ID NO: 2902 - DNA, 683 bp, Triticum aestivum
cttagcttcctcgggatctttgacggcgggatcattcaacttctcatctttcacgattgttgcactaccatcatcagtaggttctacgcttgctgtgacaatcacagcctctagggctggctcatttgataccccttggcggacaagctgcagagctatcttccggtaaattttctcaatctgcttttgaaggttccgcactcctgcttctcggcagtaattttcaataagggcaaggagggcagcatctgtaacttcaacctgttcaggtttaatgccacaagcctctctagtattcttctccagatagtcccgagcaatatgcatcttctcatcagttatataaccagctattgaaatgatctccattctatccagcaacggattgggtattgtatcaataacatttgctgtgcaaacaaacagaaccttggataggtccataggaacatcaaggtagtggtcccaaaaattaatattctgctcaggctccagaagttcccgcagtgcactcgctggatcaccagaatgtcctctcccaagcttgtcgatctcctctttccatacccgagggtttggtgtccccctcgtttgggcctggcgccctttccggggttggccacccttgtcccgcaggcccctgtttttgtgcatgggggaccccccccaaaatttttcggggc

SEQ ID NO: 2903 - DNA, 671 bp, Triticum aestivum
ggtgaggttggtgcaccgcgcgagctccgccgggatcgggccggacatcttgttgacgctgagctgcagctcctgcagcgccaagaggttcccgagcgaagccgggattgtgaccggtgatgccgttcatggacaggtcgatgacgttgagccccgtgcacttgcccagctccggcgggatgacgccgacgaggttgttctgccacagcagcaggttcttgaggttgctgaggccgccgagctgcgccgggatggagcccgacagcgcgttctcgtacaggtagatgttctgcaggctggcacatttcccgagctccggcgggatcgggccggagagcagcgccgtgtagattgccagcgtgtcgaggttcttgagctggccgaggctcgcagggaggggccccgagatgctggtctcggcgaggccgagcatggtgaggttggagcagttgccgatctccggcgggagcgcgccctggaggttcttgttgccgccgccgcggagcacctcgagggcggccatcctgccgatagaggccgggatggcgccctccagctggttgtcgtacaagatgagctctcgcagagccataaggtaccgatgggtccggaatggccctcaggtggttgtgtttaagcagaactccagttgtcccggccggataggtccc

SEQ ID NO: 2904 - DNA, 664 bp, Triticum aestivum
ttctagatcgcgagcggcgaggtagcgagcgggggagcgggcgagacgtgagcatggggaggccgccgtgctgcgacaaggagggcgtcaagaagggcccctggacgccggaggaggacctcgtgctcgtctcctacgtccaggagcacggccccggcaactggcgcgccgtccccaccaggaccggcctgatgcggtgtagcaagagctgccggctccggtggaccaactacctgcgcccagggatcaagcgcggcaacttcaccgaccaggaggagaagctcatcgtccacctccaggcgctgctcggcaacaggtgggccgcgatcgcctcctacctccccgagcgcaccgacaacgacatcaagaactactggaacacgcacctcaagcgcaagctgcaggcggggggcgacgccgcggtcaagccggcggcgcagaggcctgcctcctcctccaagggccagtgggagaggcggctgcagacggacatcaacatggcgccgccggcgctgcgcgagggctcaccaggttcgcgaattaagccgagaagcccgaggcgccacgggtcatggggctgccgaaccggccgaagcggcgccgggcgccagttttggccggtcttcccgttttcctcccgggggcggtgttcccccgcgaattt

SEQ ID NO: 2905 - DNA, 817 bp, Triticum aestivum
caagagcaagatatactttgcgatggagtatgtccggggcggcgagctctttgccaggtagccaagggccggctcaaggaagatgctgcaaggaagtactttcaacagttgataggggctgtggacttctgccacagccgtgatgtctatcaccgggacctcaagccggagaacctcctcgtggatgagcatggaaacctcaaggtgtccgacttcgggttgagtgccctcaaggagtgtcagaagcaagacgggctgctgcacacaacgtgcggcacacctgcatatgttgcgccggagataatcaacaagaagggctatgatggagaaaaggcagacatatggtcttgtggcgtcatactttttgttctgcttgctggttacctcccattccaagactcaaatttgatggagatgtaccggaagatcagcaaaggtgatgtcaggtatccacagtggttcagttctgatgcccggaagattctatccaggctgctcgacccaaatccaaacacaaggatcaccatggacaagctcattgagcacccgtggttcaagaaagggtacaaaccagcagtgactctggcaacgccacgtgcctcaaaggatcttaatgatgtccaggctgctttcagcacggaccgcaaggatggtgaaggcaacagggcacaacaaccaaatagcccattgaagccagcgagcttgaatgcgtttgacataatctccctctccaaaggttttgatctctctggcctatttgagaaggaccaagagcagaagtcgactcgcggttcatgacccaaaacccgcatcagca

SEQ ID NO: 2906 - DNA, 660 bp, Triticum aestivum
  misc_feature (446)..(446): n = any nucleotide
gtcaacagtgagaaggaagcattggaagctgcgctgttggcgaacaaaaatgagactgatgggctgaaggaagcaatggcctcagcagctaggcagtttgaaattgaattagcgcatcgtgatcttgaagttgataagtgcaagcaggagcttggagaactttcagcgaagtatctgcatgataaatctgctcttgaggctgagattggaatgctccaaggagttattacaaattttgaaggtgagctagcaaaactgtcacaggagaagttgcagctcgggtctcggattgaagagctagaagaggcagcatgctgcttagattattcagcttccgaggtggtgaagctgcaagaggcaatgaagaatacaaaagcagaactggaggaagttttactggagaaagaagaaaccatcaagaacctagaagcacagctagaaactgnctcacaagagaaatcaatactccaggacagtattaaggagctggagagggtggagggtgaatctgagggaaaactttcctggggaaaattgggcttaagggtggaacttcacatttttagaagccaggggctttcgagaggaagtgggatcccgggaaaggagcttagagagatttgtcggtggggcagagcaatgagcggggaaatttttggg

SEQ ID NO: 2907 - DNA, 585 bp, Triticum aestivum
gtcagggaaagttgagcatttactcctatccttcggttaaagaatgatgttgatttcacttggggggcaaaacagcaagaagcctttgatatgatcaagaattatttgtgcactcctccggtgatgaaagcacccaagcatagagagcctttcaaactttatatcgcagcagaggaaggtgttattggtgctgttttgactcaagataccgaaggaaaagagcatgccattacatatttgagcagacgtttattggacgccgagacaagggtaactatttcagggcttgacagaccagtttttatccggaagaacggcctttagcgtgcgtttggatctgaagaaacaaagcaagatatggctgtcattcctcctaacttggctagttactagtatctccttgatcctttgatgaggtagtcttggcgagtgtttgggcatagagaacataacttggcaatttctgtacaggtttaccgtatccatttattcaggactaggagctgaaattctgaattttatagttcaggagtaactacctcctgatgtaccggtggaatttaatagtttcatcgaatgtgaatc

SEQ ID NO: 2908 - DNA, 648 bp, Triticum aestivum
ggcaacgtgttcttgctttcctcaaggttcgaatgcactatgggcatcctgatgtctttgatcggatatttcatataaccagaggtggtattagcaaggcatcccgggtgatcaatataagtgaagatatatacgctggattcaattcaactctgcgccagggtaatatcacacaccatgaatatatccaggttgggaaaggacgtgatgttggtttaaaccagattgccctgttcgaggggaaagttgctggaggtaacggcgagcaagttcttagtcgagacgtgtaccgtttggggcagctgtttgacttctttaggatgctaaccttcttctacaccactgttggttattatgtctgcacaatgatgactgttctaactgtgtatattttcttgtatgggagggtgtatctggcactctctggactcgaccattcgatatctcgtcaagctaggtttctggggaacactgcccttgatgctgctctgaacgctcaattttgggttcagattggaatctttacagccgtaccaatgataatgggtttcattttggaattagggtaatgaaggctatttcagtttatcacatgcaatgcagtctgcccgaatttcaccttccttggatcaaataggttcatccgag

SEQ ID NO: 2909 - DNA, 647 bp, Triticum aestivum
cagataggaggggggatggatcccgtggaggcggaggagcagcaagacggagccggccggacgacgaggcctacgccgaggcagatcccaccggccgcttcatccgggcacgtgcgcacgctgtcctcttccgagtcctccctcttgcgcgctgccgttcttactttgttgctacaaggccttcgataagctggagggcgatgaggtcgcgtggtgccaaacacggattgatgattctgtcatgggttcctcagagaagatggcacaactgaatacggagatcagtctgttgaagacgctgaggcacaagaacattcagaagttgtttgcctcatggattgatgagaataagaagacagttaacatcatcacagagctctgcacatccggcagtttgaggcagtttcgtaagaagcacaacaaagtcggtatgaaggctatgagaggatgggcaatacagatattgacagggctggaataccttcacagtcaagagccagcgattattcatagggagttgaagtgtgacaacatattcataaatggtcatgatgggcacgtggagattggcgaacttgggctggcgacatttttggctccacggagaatgggaattttaacgggcaattaagattatgggccaaatc

SEQ ID NO: 2910 - DNA, 634 bp, Triticum aestivum
atcctgaatgcagctgcacaggatgtgattgcttcagtccatggtgtcatctctggtatccgtgaaagcataaagttcataaaagcctctgatagtcacgacgaaaagtttgctgagattgctctgcagctggagatccctggtaccaagaccctttgtctggatgttacaacccagtgggacaccacctatctgatgctcttggctgccttggattataggcaggctttcactatactagaaacatgtgatgataactataacgaagcgccttcagccgaggactggaaaaaggttgaggctgccagcaattgtttgaagctgctctatgactcggctcatagcgtcatggcagtagcaaacccaacttcagacatctttttccatgaagcctggaaacttcagctagagctggcaaatgccgcggcacatgaagatccagttgtcggcagcattgctagagatgtgcacgagagtttcgacaagtactggaaagattgcaacctcgtgttagccgtcgctgttgtgatggatccgcgttttaagatgaagcttgtcgagttcagttactcgaagattatggcgtcgaggcagcgaagtatgtcaaggcgggaatgattcaggcatgagctta

SEQ ID NO: 2911 - DNA, 632 bp, Triticum aestivum
cgccacgtgctgcaggaagtcgtcggagtaggtccccttgcgcatgaagcgcgacaggaggtcgtcatgcggcgtggacccgtcgctcttgctggcgagctcgagcttgcgcgtcttgatgacggcggagaggtagcggtcgacgtgcgcgacgctgcgcgccagcgtggtctccatgccaagccccagccacttcttgcaccgccacacgaactccgggaagatgaagcggttgagcgtggcctcggtggcgcggtcgaaggaggtggcgaaggcgttctcggggaggccgcgggcgagcgtctccgggtccttgccgaaggcgaggccgcagatgttgtcgaaggtgaggcggaggaggaggtcctgcaggtcgacgtgcgcgccggaggccgccgcgtcggacaggatggggagcatgcggtggtggatggagcgggagacccagcgggacatggcggtgcggagcgtgcgcgtggtgaactcgagcgcggccgtcttgcgctgcgccacccaggtgtcgccgtcggagttgaagatgccgtcgccgagcaggtcgctgaagacgccgtgccagagggggccttggggtagttgcgaagcggccttgaggacgtgctcaggtcctgggg

SEQ ID NO: 2912 - DNA, 733 bp, Triticum aestivum
  misc_feature (167)..(195): n = any nucleotide
gcgccgcatcatccttccccgcaaagccggcgccaccgtcacctcggtcaaaccgccgccgttgcatccgacgccggtggcctccgctgcacctgcgccggcacctcccacgccacggacgccggttcaggcgcagcccaacgagactacgccaatgagaacacaannnnnnnnnnnnnnnnnnnnnnnnnnnnnacacgcaacgccgacggcgacagagccacagccacagacgccgcagccgcagcaccaacagagcaaggagatcgtcgtccacgccccggagcagccgccggtggacatggccggcggcgcgtcgccgtctcggtggcccaaggcggaggtgcacgcgctgatccagctgcggacggagatgagacgcggtaccaggacacggcgcccaagggcccgctgtgggaggacatctcggtggggatgcggcggctgggctacaaccggagctccaagcggtgcaaggagaagtgggagaacatcaacaagtacttcaagaaggtcaaggagagcagccggaagcgccccgaggactccaagacctgcccctacttccaccagctcgacgcgctctaccgcaccaaggcgctcgcatcctcctccggcgtccatgcgccggcgctggcaccgtcgccgtccccggctcacgcggaggccgcgccggtcaccgtgctctcgccggtgccgctgtcttcccagacgccgccaacagcggcgcagc

SEQ ID NO: 2913 - DNA, 624 bp, Triticum aestivum
ttcgacgagggaacatgctgaaattgggggaccccgacggcagtgacacccccctcgttgtggaaggctagacatttgggcatgaaatgcctgccacggcagtgaaaagcgctgccatggcagcaaattcgcccgcacccaaaagtcctgctacgacagccgaaaacgctgccatggcagggaattcaccatgcacagcctctacagcagaaaaaaaaccctgccatggcagcagaaaacgctgccatggcagtgtcatctccaacatccacgactctcgacgatgtacacttgatgagctctggcaagaggcaatgagcgatgagctcgcgttgatcgaggagaatgacacatggtctcttactgatttgcctgcatgtcaaaaaccgatcggtctcaaatgggtgttcaagctcaaacgcgacgccggcagcaatttggtgaagcacaaggcctgtctagtcacaaaggggtacgtcaagcggccggggatcgactttgatgaagtctttgctccggtggccagtctggactccgttcgactcctgctcgctgtcgccgctcagttcaagtggcaagttcaccaaatggacattaagaacgcggtccacatgacatatttct

SEQ ID NO: 2914 - DNA, 617 bp, Triticum aestivum
cagatgtgccacagaaatggtgtcatccatcgggacctcaaaccggaaaacttcttatatgcaaacaagaaggagagttctcctctgaaggcaattgattttgggctatctgtgttcttcagacctggtgaacggttcagtgaaattgtaggcagtccatactacatggccccagaggttttgaagcgcaattatggccccgaaatcgatgtctggagtgcaggagttatactttacatacttctttgtggtgtgccaccattttgggcagaaactgaacagggagtagcacaggcaattatacgctctgtggtagatttcaaaagagacccatggcccagagtatctgagcctgctaaagaccttgtcaggcggatgttggatccaaatccaatcacacggcttactgcagcacaagtacttgagcatccatgtttacatgattccaaaaagaatcctgacattcaacttggcgatactgtccgagcaagactgcagcaattttctgcaatgaacaaattaaagaagaaagccttaagggtgattgctgagcatttgtctttagaagaagtagctgacataaagaaaatgtttgatagcatggacgttaacaataa

SEQ ID NO: 2915 - DNA, 612 bp, Triticum aestivum
aatgccttcctaaggacatcagccgccacggcgccagctccggccaccttatcttcaaatgcgccggaaacgtccgggaccccaccggcggcctgcttcttggtggcagccaccgaggacgtgatgccaccagcgacgccccttatcgccttcctgtaggccccaagagcgtcgtacgccgacagcctgagcttgtcgtacccttcggtgagcgcgtcctccgcctggaatatctgcttgctgagcttgtcgatgaacctggccacggactcctcgacgccggtggcgtcggccgggaacgtggtgggcatctccgcgtccatcagggcctgctgcgcggcatcgtcggtgaccgcgccgaccacagcgtccgcggccaggtcgacgggcatcagcggcgggtcgaccccggcgcgccagagagggtcgggcagctcggcggcggaggcgaacccccgcacgattgcgtccggcgcggtggcgtagggggagaggatggcggagtcggagaagagcgggcggtcaggcacggcctgcgcgacgagcgggtcggcggcgaagggcctgagcgcgccagcctcgaccctccgcagcgcccgcgaccggcgggca

SEQ ID NO: 2916 - DNA, 603 bp, Triticum aestivum
aaaaatatatcccaggatggcgatgtcgacggcgacgcggatgctggcgcgccgcgccgcccccgccctcctccgctccgccgccagccccggcctcctccgctcccccgccgccggcacaggccccagccccgccctcgcgctgccggcgctgctgcaggcgcaaggccggtggtaccgcgcatcaggaggggacccgtcaccgtcgttctacgagccgccgccgaccccggccaacctgggcctgagcaatcgtcccggagaataaggcgttcgtggtggagcgctttggcaagtacctcaagacactgtcgtcggggatccacctcctgatgcccggcgtggaccgcatcgcctacgtgcactcgctcaaggaggaggcaatccccatcccggacaactcggcaatcacaaaggacaacgtctcgatacagatcggaggagtgctatacgtcaagatcgtcgacccctacaaggcctcgtacggcgtggagaaccccatctatgctgtcatccagctggcgcagacaaccatgaggagtgaacttggcaagattaccctcgacaagacctttgaggagagggacacgctcaacaccaaca

SEQ ID NO: 2917 - DNA, 742 bp, Triticum aestivum
gccggggacgttgacggactccatgtagtcggcgtagagcgcggcgaggaaggagtggcgacggcgtactgcagcgcctggccctggccgtggttgaactgggcgagcccgcccttggtgaagttgaacgcgttgaacttgggaaaatacatgcacatgttcatgctggtgacgttgtggtagcccatgagcgactcctcgtaggaataaccggggttgaggaacatgcgcagccgcgacagcagcagcgtggcgccggggagcttgttgtcccagctgaagacggagaagtcgaggatgttgaagaaggccttggcgttcttgggcagcctggggtcggtggcgaagctgatgtagctgttgttgcccgtggcgtagtacatccaggaggcgctccacatgaactcgtcccagtagctggtggagttgtagaagtactcgatggcagggttgccccgggagtagggggtgcgcttcccgttggcgcgcgcgaacttgtacaccgtcgccgcgcccttcaccagcttcttggagtaggcggcgttgtcgcggaacacgatggaggctgaggccagcgccgccgccacctcgccgccgaggtccggggccgcgctcgcctgctggaccggccgcgggtacgccatgtcctccggccggttccagcagaagtggtcgtccggcgtgctgccgttgatcttggcggtacccacctgactgtagagcttgttgatggtggaggcgg

SEQ ID NO: 2918 - DNA, 596 bp, Triticum aestivum
ggagcatactgtccacagtccaccctcaacaaaaccaccggagtctgcgatccatacaactaccaaccgcctcctgggcagcccaaccatacttgcggcggtgccgacagatggtcggatgtcatgagtactgacgatgttttctgtccagctggttactactgtccaagccctatcctcaagatcgattgcagtagtgggttctattgcaggaaaggatcaactatccagaccaaatgcttatccaagggcagttgtaaaccaaactctacaacccaagacatcacaatatttggtgccatgctagtggttgccctgagtttagtgctgttgatcatttacaacttctctgaccaacttctgaccaaccgagagaagaagcaagcgaaatctagggaggctgctgtaagactcgcgaaagagaccgtacaggcccgtgaaaggtggagatcagctaaagatgtcgcaaagaagcatgccgcaggcctgcagacatctctcacccgcacattctcgcgcaagaagagtctcagcagctcacatgaatcatctaaagggcatccacctgaagagcatggtgcggatactccgctgga

SEQ ID NO: 2919 - DNA, 587 bp, Triticum aestivum
  misc_feature (374)..(374): n = any nucleotide
gcgcctgccgcgttcgacgccgaggccggcggcccggcgatcgtggccgcggcaggcaacggcgcgcacaagcccgtccccggcgccggtgccgacgcgggcgccgcatttgtgctggagtccaaagggacgtggtggcacgcggggttccacctgacgacggcgatcgtggggccgacggtgctgacgctgccgtacgcgctgcgggggatgggctgggctctcggcatcaccacgctctccctcatcgccgccgtcaccttctacgagtactccctcatgtcccgcgtgctcgaccactgcgaggcgcgcgggcgaaggcacatccgcttccgcgagctcgccgccgacgtcctcggctccgggtggatgtnttacttcgtggtgatggtgcagacggcaatcaacacaggcgttagcatcggctccatcttgctggcggccgattgcatcgagatcatgtactcgagccttgctcccaatggtcccctaaaagtgtaccacttcatcatcatcggggctgtggtgctggccttcctctcccaattaccatcgttccattcgctgcggacatcaacttggtcaaa

SEQ ID NO: 2920 - DNA, 587 bp, Triticum aestivum
  misc_feature (462)..(462): n = any nucleotide
atagttctgaagttcagacccacggaaatatgtaaggatctcttgccagtcaggtggatttttgaatcgtcccagattgggcttcagcttgccagctaagactttaagtgctgttgacttcccaattccattggttccaacaagacccaaaacttgaccaggtcttggaacaggcaacctgtgcaatttgaaggtattcggtccatagcgatgggtagtatctttctccaaatcttttggaagattgatgatttcaatggcatcaaatgggcatttcttaacacaaataccacaaccaatacacagctcttcagaaatgaatgcaagtttggccgctggactaacttcaatgcaaagctttccggtcttgacaacggggcaactcttcttgcactcctggcggcacttcttcggcttgcacttgtcctcgctcacgatcgcgatacgggtcaaacggtccgncatctgcggcgactctccgtatacgccgccccgtccaaagagatttccgctggaaggggaagagcgctaccactggcggcgacactagagttaggcgtggaagcggcggcggggaggaggggata

SEQ ID NO: 2921 - DNA, 572 bp, Triticum aestivum
gggggatttcatcatcatgcagctacagctatgtgcagtattctttaccttttcccctcgggacaaaatcacattattttggccgcacaatcctccatggtggtgcaaaatatagagcaactggcagaggctttgttgttcgccatgtaaagttcgctgaaaattacagaatgtatagcaggagtcactttgtgaaaggacttgagctcatgttactacttgtagtgtatgagctctatggtgatgtggctaccgattccactgcctatgttctgctgacatatctatgtggttcttggtaatcacatggttgtttgctcctttcctcttcaacccatccggatttgaatggcaaaaggtggtggatgattgggatgattggaacaaatggataagcagccgtggtgggattggtgtgccggccaataaggcctgggagtcgtggtgggaagaggagcaggaacatctgctgtcaacaggcataatcggccgcatatgggaaatcatattatctctccgattcttcatgtttcagtatggtatcatgtaccatctgaatatctctaatggca

SEQ ID NO: 2922 - DNA, 566 bp, Triticum aestivum
ctccatggtgctcaccaagttcctggtcctcgccgtagacctctctccggaagtactcctgctccccggagctcgccccgggcgcgcgccgtggtggaccggggagcgcaattgcgaggacatcctcatgaacttcgtggccgccgaggcgtccggggaagggccggtgctggtggaggccggcagtatcagggactggggcgacccgaggaacgacgccaacgccggagctggcgtggaggcgatgagggccgtggggctgagctcgagaggcggcgtggggcactgggagaagcgaggggagtgcatcacggagtttcaccggctgctagggaggatgccgctgcggtacagctacgggaaggtggtggaggcggccgtcgccgagcaggggctgtgcagcaaaggcggccgtctcgtccggtgcgaccaggagtagcctcacggcgtagggtggcatttgctacccttcagtgatgtgatcactacacaatctgacggactgtacgatggtgctgtagtataaactgtggtaggataacaatgtgaaaattcagactgtgcta

SEQ ID NO: 2923 - DNA, 565 bp, Triticum aestivum
tcttcgagggcatcgacttctacactaccatcacccgcgcccggttcgaggagctcaacatggacctcttccgcaagtgcatggagcccgttgagaagtgcctccgggacgccaagatggacaagagcaccgtgcacgatgttgtcctcgtcggaggatccacacgtatcccccgtgtgcagcagctcctccaggacttctttaacgggaaggagctctgcaagagcatcaaccctgacgaggccgtcgcgtatggagccgccgttcaggctgccatcctcactggcgagggcaacgagaaggtgcaggacttgctcctgcttgacgtcacaccgctctcgcagggcctggagacggccggaggtgtcatgaccgtgctgatcccaaggaacacgacaatccccaccaagaaggagcaggtcttctccacctactctgacaaccagcccggcgtgctcatccaggtgtatgagggcgagagggcgaggaccaaggacaacaacctgctcggcaagttcgagctctccgggatcccaccggcgcccaggggtgtcccccagatcac

SEQ ID NO: 2924 - DNA, 527 bp, Triticum aestivum
tatatgtggacctcaaaagaaaatgacaccattactgttacactggacaacaattacaacacatatagctttgatggcaaaaagagtttggtgctttctacttcaacttggcttggtggaaagaatgattttcttggtcttgcatatctcactgttggtggactctgcttcttcctggcatttgcattcaccttactctacttgataaaaccaaggttagtggcttataagctctcgtataccgatcatattaagttacatcgctgatctttttttctggtctccatgcagaaaattgggagataacaactacttgtcatggaacagaaactctgcaggccactgatgcactctgaaagttgatttccgcattcaacatcgaacaattggtcttgtggttaacttgtatctttgtacgaaaatagcaatttttgtgtacaagctgttctcaaagtacgtgtatcaagtggacttgtgtgtatgagcaacacgaaagggtgtacattattatactgaaatatacatac

SEQ ID NO: 2925 - DNA, 596 bp, Triticum aestivum
actgagtgacagagaccttattgtttggatgcgaactccgcgcttcctacattcagaaaactgtatggtaggatacgtgttgacctcaaagaaaatgacaccattactgttacgctggacaacaattacaacacatatagctttgatggcaaaaagagtttggtgctttctacttcaacttggcttggtggaaagaatgattttcttggtcttgcatatctcactgttggtggactctgcttcttcctggcatttgcattcaccttactctacttgataaaaccaaggttagtggcttataagctctcgtatgccgatcatattaagttgttacatcgctgatctttttttctggtctccatgcagaaaattgggagataacaactacttgtcatggaacagaaactctgcaggccactgatacactctgaaagttgatttccgcattcaacatcttggtcttatggttaacttgtatctttgtacgaaaatagcaatttttgtgtacgagctgttgtcaaagtacgtgtatcaagtagacttgtgtgtatgagcaacacgaaagggtgtacattattatactgaaatatagatac

SEQ ID NO: 2926 - DNA, 652 bp, Triticum aestivum
cacatatcaatcgacaagacagacatctcttgggaagagtgacagggaccacaaatttggaagtgatgtcttcccaaaaacttccagaaaggtcctcttataggtggaaaaacactcaacgaatctataccgctgagtgagcaagaggaccttattgtttggatgcgaactgccgcgcttcctacattcagaaaactgtatggtaggatacgtgttgacctcaaagaaaatgacaccattactgttacgctggacaacaattacaacacatatagctttgatggcaaaaagagtttggtgctttctacttcaacttggcttggtggaaagaatgattttcttggtcttgcatatctcactgttggtggactctgcttcttcctggcatttgcattcaccttactctacttgataaaaccaagaaaattgggagataacaactacttgtcatggaacagaaactctgcaggccactgatacactctgaaagttgatttccgcattcaacatcttggtcttatggttaacttgtatctttgtacgaaaatagcaatttttgtgtacgagctgttgtcaaagtacgtgtatcaagtagacttgtgtgtatgagcaacacgaaagggtgtacattattatactgaaatatagatac

SEQ ID NO: 2927 - DNA, 608 bp, Triticum aestivum
gtagcagcatcgccatgagcccgccgagtgtgatggggcagttcggggacacgacctacaccaaggtgttcgtgggcgggctggcgtgggagacccagaaggagaccatgaggaagtacttcgagcagttcggggagatcctcgaggccgtcgtcatcaccgacaagaacacgggcagatccaagggctatggatttgttaccttccgggacccggatgcggcgatgaggtcctgcgtcgaccccgcgccggtgatcgacgggaggagggccaactgcaacctggcttcccttggggtgcagagatccaggcctccaaccccacagcacgggggcgctaggagctttcgagtgatgaagtcctttgggcagcagcaggctgcggggatccaaggtgcgctgggcgcagcttttccttcgcaggccaccttccctcattatgccatcccacaaggcctcccttaccatgtctatgggtactctccttattcaccagactacggttatcccgcaaactactacaacatctatggaggaaaccagtacccgttttacggaggagcaggaactggcatggtgacctggaaccagtcccttctatccatattc

SEQ ID NO: 2928 - DNA, 560 bp, Triticum aestivum
aaaaaatttgagataggaatcatgccgcccggggttaatgatactgtcatatgcctcatcccgaagggcaaagatccccaataccttaaggatttccggcctatcagcctatgtaatgttatttacaaagtggtgtcaaagtgcctagtgaaccgcctcaggcctttttttggatgagattgcctctgaaactcaaagcacctttataccaggaaggatgatcacggacaacgctatcatcgcgttcgaatgtttccacaggataaatcactctagaagtaaattcaatacccattgtgcctacaagcttgatttggcaaaggcgtatgatagggttgattggtactacttggaaggagcccttcaaagacttggctttgatcgaatctggataaagtgggtcatgggctgcgtcaagtcggtgtcctattcagtgaagtggaatggtcaactgatggaatattttaccccctctagaggtctcaggcagggtgatcctttaagcccatacttgtttctgctggtggctgatggcctgggtaacattttggaccgagagg

SEQ ID NO: 2929 - DNA, 560 bp, Triticum aestivum
tgcgtacatgagtttgggagaggagcttcagactggtacagcatttgatgaggccgaaggtattgaagttgatggaatcaagtgagcatagatgagctgatgcagtgtccagataaccttgagaggctctacgcggaagttcatctactgaaatctctcaagcatgaaaatgtaatgaagttctacaattattgggtcgatgatcgaaagaagacaatcaatgttattactgaactgtttacatctggcagttttaggcattaccgacgggaacatccacgcgttgatttgaaagcaataaagaattgggcaagacagattcttcatggattagattacttgcacagccaccaacctccggttatccacagagacctgaagtgtgataatatttttgttaatggcaatcatggacaagttaagattggagatcttggactagctacaattatgctaacgcctaaagcaagaagtgttaattggtactcctgaattcatggcacctgagctatatgatgagaattacgatgaactggtggatatttactccttctgaatgt

SEQ ID NO: 2930 - DNA, 560 bp, Triticum aestivum
ttgtcagcagtcttgcaagtttatgagaagacactgatgatcgtgagtgtgagaaaatcaatggtaagagagttaccatatgtatcaaaagcagagagaagtatactgaagaagggtgagaatgcctgtgaatctactagtgatcctcagaaagttgtctaaaagccagatagcccacagcaagaaaagggcaaggataatacaaagccgcgtaatcctaaaacaagtcgtggacagaagggcaagcttaagaagatcaaagagaagtatgcagagcaggatgaagaggaaagagaaatccgtatggctttgcttgcgtcttctggaaaggcttcactaaaggacaatccttcacaggatggagaagataccactgcaaaacaatcaaaaccatcaactggcgaagacgactcattaaaggtttgttataaatgcaaaaagtctggacatctatctcgtgattgccctgaacagtacatcagctgtggatctgactgatgtcaaacgttggtagaagcagagatgggatggatagaagtgctgctcctgttgatgcagca

SEQ ID NO: 2931 - DNA, 635 bp, Triticum aestivum
aaaatcaagacaatggtgataacccagaagatgatgatctgatccgcctacaattagagacactattagctgagaaggcgcggcttgcacatgaaaactcggtgtatgctcgagaaaatagattcctacgtgaaattgtagagtatcaccaacttactatgcaggatgtcatatatgtggatgaaggcatcgaagaggtcactgaggtgtaccctactcaagtactgcctccagcgtctgctcgcactgggtcgggcctaggtcgcgcatcaactccagtgacactcaaacatgttaactcatctccggcctccacatccgcccttccggaaccttgtccggtcgtgccggtttctccgaagatgctttctcgggcttcatctcaaagcaaatagagggagcctggcagcaccagccaccgttcaacaggtaaagatggttggtggtgtgatacgagtaacacatatactgtaacggaggttgcggcgccattgtgcctgtgggatgttgtggcctctgggctgtggtgaatacacgcaggatctgtgatgtgtgtatgatccgtgttgtaacttgtgagatttttctttcacatcaccatgcttgcgaactacgcatgccgggtgcattgtctc

SEQ ID NO: 2932 - DNA, 556 bp, Triticum aestivum
ccggcgggcagaagcagcgggtagccatcgcgagggccgtcgtcaaggaccccaaggtgctcctgctggacgaggcaacgagcgctctagacgcggagtcagagcgtgtggtgcaggaggcactggaccaggtgatggtcgggaggacgactgtggtggtggcgcatcgcctgtcgactgtgagaggcgccgacattatcagcgtggtgaagaacgggacgatagtggagaaaggaaggcatgaagaactgctgcggatcaaggatggagcctacgcttcccttgtcgagcttagctccacttcaagataagatactcatctttctctaccagaaaattccatggaatgaaaggccagcaattcagtgtatttgagtttataggccagttaatgtgggtgtaggatctttcctttcattttagtagatgggtatctgcagacaagcagatgcaatcagacaaactgtatgcaaataattactgattgtcgttcaagcgaggatgccgatgaagcttttccaaaacacggcaataagaagaaattatttgcctgatc

SEQ ID NO: 2933 - DNA, 547 bp, Triticum aestivum
gtcgacagggaaatcataaggtttgaaatggagaagctttcattgaagaatgatactgacaaagcctccaaagaacgactaagcaagcttgaagctgaactagaatccctcaagcagaagcagaaaaacctttcagaacactgggagtatgagaaatcgttgatgactcgtataaaatcaattaaggaagagattgacagagttaacctggagattgaagccgctgagagagaatataatttgaaccgtgctgctgaactcaaatattcaacgcttttgacactacaaaaacagctggatgaggctgaggaaaaccttactgaattccagcagtcaggaaagtcgatgcttcgagaagaggtgactgatgttgatattgctgagatagttagcaagtggactggtattccagtgtcaaatcttcaacaatcggatagggaaaagctactgctactggaggatgtactccacaagagggttattggccaagatattgcagtcaagtcagtagccaatgcaatccgtcgttctagggcaggcctatcgg

SEQ ID NO: 2934 - DNA, 546 bp, Triticum aestivum
gacaaactttgttcttccaatcataatgctacaaactctccagagaaatctaaacgaatttacccttccatggatattcctcaagataagatatctgatgctctggatgatgagttacttagcaaagatggcaaagccacagagcctgtatctaacttggttcaggaattgaatgaacatccaattggtcgtgtcacaccaactgccccaaggacgtcctaccatcggaacaggtttacatccatatcacgcacatttggagatggttcaaaattatggccaggagataacatgtcaactggcagtgctagtggttctaagaaaacacgaacccatgtttcatactcagtttctcctagaagtgatgaactaggatcaaaacacaaagggcatttccggaagatacaacctcacaacatcgccaagactaatggttcaaagaggcttcctggtaatactaggagtgtggagagcagcgcggagtcattggcttgtgttgcaattgtctggttacagttgggtatagagggtgtgagggattatgat

SEQ ID NO: 2935 - DNA, 544 bp, Triticum aestivum
tcgagaatgcatgtattttgtcttgagcatgctgtcgaggttgagaagcaactccaagcaattggtggggcccatgttattcttttatgtcgtccagaatatcttaaaatagaagcagaagcaaggtcgttagctgcagaaatggaagttgagcatggctggaaggacatccatttcagggaagccaacatggaggacaggaagatgatagaagagctcctgcaggatgaggaatcaatacctacaagcagtgattgggctgtaaagctgggaaccaatctttactacagtgcaaatctggccaaatctcctttacataacaaacaaataccatacaacagggtcatctatagggcatttggctgcagttctcctgacaactcaccagtaaaacgggaaaattgcgaggggagtcaagacaggcagaagaaagtagtcttggctggccggtaggtgtgggaaagcatggatgtcaaaccaggtccatccattcctagctcagagaattgaagcagtgaatacgaaggagggctgacaagtctag

SEQ ID NO: 2936 - DNA, 724 bp, Triticum aestivum
gcgtgtggatagagccatgcgaccagctcaccgacgaccagatcgccgagttcaaggaggccttcagcctcttcgacaaggatggagacggctgcatcaccaccaaggaacttggaactgtgatgcgctcgctggggcagaaccccactgaggcagagcttcaggatatgatcaatgaagtggatgctgatggcaatggaacgattgactttcctgagttccttaacctgatggcacgtaagatgaaagacaccgactccgaggaggagcttaaggaggctttccgtgtgtttgacaaggaccagaatggtttcatctcggcagctgaactccgccatgtcatgaccaaccttggtgagaagctgacagacgaggaggtggatgagatgatccgtgaggctgatgtcgatggtgatggccagatcaattacgaagagtttgtgaaggtgatgatggccaagtgagctgccatactaagctagttctatctcgatgttagcagctagtttagccttgaaaactgacagcacttggtactactgttaagtccagtgaatgaacatattgctcgctcttcctttcttctcagggatgttgagaatttcgtttggattttcctgcagttgtattacctttgtacaatgtagctttctttccaaattgagatcatgaatttgctgtagcttatgccttcatggtatcaagttgcatggatgtctgatat

SEQ ID NO: 2937 - DNA, 709 bp, Triticum aestivum
tcgcgcttcgctctcagatccgttctcctccgtctcgcccgcgtgttggggtaggagccatggcggaccagctcaccgacgaccagatcgccgagttcaaggaggccttcagcctcttcgacaaggacggagacggctgcatcaccaccaaggagcttggaactgtgatgcgctcgctggggcagaaccccactgaggcagagcttcaggatatgatcaatgaagtggatgctgatggcaatggaacgattgactttcctgagttcctcaacctgatggcgcgtaagatgaaggacactgattccgaggaggagcttaaggaggctttccgcgtgtttgacaaggaccagaatggtttcatctcggcagctgaactccgccatgtcatgaccaaccttggtgagaagctgacagacgaggaggtggatgagatgatccgtgaggctgatgtcgatggtgacggccagatcaattacgaagagtttgtgaaggtgatgatggccaagtgagctgtcatactaagctagttctatctcgatgttagcagctagtctagccttgaaaactgacagcagttggtactactgttaagtccagtgaatgaacatattgtgcgctcagggatgttgagaatttcgtttggattttctcgcagttgtgtttcctttgtacaatgtagctttctttccaaattgaggtcatgattgct

SEQ ID NO: 2938 - DNA, 542 bp, Triticum aestivum
gagccttgtaaattactgtttgctactcaacttcaggaaaccaacaaagcagcagatgggcaagaggttgatggagattgccagaaaagaaggcattcaagctcaagagaatgcaatggaagagcttgcagaaagagtacatggggatattcgcatggcactcaaccatttgcaatacatgagtctctctcagtctgtggtcaaatatgatgatataaggttgcgtcttaatagtagctcaaaagatgaagatatctctcccttcacggctgtggacaagctattcggtttcaatggtgggagactaaggatggatgagagaatcgacttgagcatgagcgatcctgatttagttccccttattatccaggaaaattatatcaattatcggcctagtgccgttgggaaggatgacagtggagttaaaagaatgaattatcttgcccgtgccgctgagtctatagcggatacgactaatggtaaatgttcaaataagaagatatcgacagtggagtggtccccaaagctggcctgtttggctt

SEQ ID NO: 2939 - DNA, 542 bp, Triticum aestivum
ccggtgctgttcgctcctcctcagatcaaggctgaagtcaagtccgttgagatgcaccacgagtctctgcccgaggctactcctggagacaacgttggattcaacatcaagggtgtctctaacacggatatccgccgtggaaacgtgaccggtgatgctaagaacgacccccccgctggtgtcgacttcttcctcgcccaggttatcgtcctgaaccaccctggtgagatcaagaacggctacgcgccggttgtcgattgccacactgctcacattgcttgcaagttcgaggagatccagtctaagatggatcgccgctccggcaaggttattgaggagaagcccaaggctatcaagtcaggagatgctgccatggtgcagatggttccttccaagcctctgtgcgtggagaccttctccgagtaccctcctctcggacgcttcgccgttcgtgatatgcgccagactgtcgctgtcggtgtcataaggctatccagaggactgctgccggcaagaagccgagggtggcaagccgcttgcaa

SEQ ID NO: 2940 - DNA, 539 bp, Triticum aestivum
cttcaaccagcctggttattctatctgctgccacttgagatatgaaatcatcaaatatgtgcaccactcttgtttcaggaataatggacaaaagtggaatatgctcaaaaattgatttaagggctagaggaaggcatgagacaatgagcaggtacattcactcacctgctgtgcgtcaacttggtccgctttgttcagaactatgcgtatcttgtcatcgtgaccgcgcagcgacccaatcacacgcttgaactcgtcgctgatgtcgagcttatggggatcgaacaggagaaggatgaggtccgacttggccgcaaaccacgatgtgactccggtgaaatcgtagctgcgttgcgttcgctgcttctcccctgataacactccgggagtgtccacgaaggaaatgtgatccagtaacttggcaaacaaaatgaagctcaatactgttagttatttcctacaagctacagaaaatggtgaggtaaatactggcgcgagagagtatatatactggatgagcatctgagatactcaacgtg

SEQ ID NO: 2941 - DNA, 534 bp, Triticum aestivum
  misc_feature (53)..(82): n = any nucleotide
ctcatccatctccggctacctcccagctaccgacgaatcccaaccatctcacnnnnnnnnnnnnnnnnnnnnnnnnnnnnnnccacgagttcatcatctaccgagcgtcgtcatcccgtcttctttgggggtctccgcgagccgcccgcgctcttggaagccgaggaggtcctgggttcgccatcctgcgtgtttgtgttcgctgaaatatggagatacagacttcagggaagcccattgatatgctgatggagaaggttctctgtatgaatattctttcttctgattacttcaaggagctctaccagatgaagacctatcatgaggtcattgacgagatctacaaccaagttgatcatgtggagccttggatgactggcaattgcaggggtccttccactgcattttgtctcctctacaagttcttcacaatgaagcttactgtgaaaagatgcatggttgttgaaccatctgactcccatacattagagctataggattttggtatcttcggtatgtcgcagatccaaagat

SEQ ID NO: 2942 - DNA, 533 bp, Triticum aestivum
  misc_feature (531)..(531): n = any nucleotide
aggacacgggcatcttcgccgcggaggagcaccccatgcacatccacggctaccacttctacgtgctcgccaccggcttcggcaactacaaccccaggcgggacgaggccaagttcaacatggtcgacccgcccagccggaacaccatcggcgtgcctgtcggcgggtgggccgtggtgcgcttcctggcagacaacccgggcgtgtggctggtgcactgccacatcgacgcgcatctcaccggcgggctcgccatggcgttggtggtggaggacggcaagaccgagctccagaccacgatgccgccgccgctcgacctgccgctctgtggcctgtagaggtttcctggtgactttctgtacatggcggggaacgtgagtctgtgtgcgtcttacgtgttgtgaattgtgatgctatctgtttgccattccaatttggtattgtaatttggattttcgatttgaaattgtaaagaaaaggcaaggttttcgttacgggcctcctttttatttatatatgaatattagagtnct

SEQ ID NO: 2943 - DNA, 525 bp, Triticum aestivum
gccttgccgtggaatattgctgttcgggccacctggaactggcaagacaatgctcgctaaggctatagcaaatgtattgtctggcgccagcttcatcaatgtctcaatgtccacaatcacatcgaaatggttcggggaggacgagaagaatgtccgagcattgttcagcttggctgcaaaggtggctcctactatcatttttgtggacgaggtagatagcatgttggggcagcgcgctcgctgcggtgagcatgaggcgatgcggaagatcaagaatgagttcatgagccattgggatggtatcttgtcgaagtccggtgtaagaatcctcgttcttgccgcgacaaatagaccgtttgaccttgatgaagccatcattaggagattcgaacgcagaatcatggttggccttcccactcaagatagtagagagctgattttaaggacagcttttgtcgaaggagaacggtcgataaagacatcgagtacaaggagcttgcgacaatgaccgaaggttacagcggc

SEQ ID NO: 2944 - DNA, 522 bp, Triticum aestivum
gataatgggatggtaaggcatcccaacgtcttgaagcttttcgaggtaatggctagcaagagcaagatttacttgttttggagtatgccaaaggcggcgagcttttcaacaaaataaccaagggaaagttaagcgaggatgctgcaaggaaatacttccatcagctcatcagtgccgtggactactgccatagccgaggtgtttatcatcgcgacttgaagccggagaacctactcctggatgagaatgaaaaccttaaagtctctgatttcggtctaagtgccctggccgagtccacgagacaagatggcctcctccacaccacctgtggaactccagcttatgttgctcctgaagtgcttagcaggagaggctatgatggtgcgaaggctgacatatggtcatgtggagtaattctgtttgtgctggtggctggtttccttcctttccatgacacaaatcttatagagatgtataggaagatctccagggctgaatatagatgccctcgccctttttcag

SEQ ID NO: 2945 - DNA, 522 bp, Triticum aestivum
gcattagcatgccctcaagggtggagaacatagtgagaaatcctgaaagtgaatccctgctcatcggcgagcccacgggtgaattccaggatgtgatcctcttcttcgggatcatcgacatcctgcaagactacgatatcagctagtagctcgagcatgcctacaaatccatgcagtacgatcccaactccatatccgcggtcgacccgaagcagtactgcaagcgattccgagacttcattttcagggctttcgcggaggatgtacagtagcgactccattgacaaacagaaaatttatactcaagagagcagaccttaacagttggctggtgattcttctttgcccaccatccagtattcttttgtaggtaacataatcgattctttcggttgtagacggcagcacgttgatatcacagtgatttcttcttcatgtaatgtgttcatagattttgtacatctaactgaatcttctctgtgcttatgtaattagatgtagggtgacagtaatcatgcgtgt

SEQ ID NO: 2946 - DNA, 515 bp, Triticum aestivum
aaaaatgtatcatgtgtgcatgtgtgcaaatgcccccctttttacgggcatcgagcaactacaacaattttcgcatctacaacagctacttggtctgacagctactgattctgttgaacttggtcacattgtggagcctcctgccattagaactgcgacttctattcttcctcttggatggactggccttcctggtggcaaaagtgctgaaccgctgaaagtagatataattggacacggtctgcatatgtgcactcttttccaggctcagataaatggaagctggtattcaacggccgttgaaaccctaccttcaacgacatcattttcatcggatcaggaggtgcaacctacattgcaaaaaatgcggattttagttggacgtccactaaagcagcctccaaattacactagtgaggactttatggttcctgtggtcacaggtgctatgaatccagattatggagttgagccctttgaagataaaggttgttgcaagggtttgaatgaagtta

SEQ ID NO: 2947 - DNA, 675 bp, Triticum aestivum
aatccgtccatcaaccggtggaacggccggccctactcggcgcgctacctagagatcctcgagaagcgccgcacgctccccgtgtggcagcagaaggacgagttcctccgcgtcctccgcgacaaccagaccctcatccttgtcggagaaaccggaagtggcaagaccactcagatcccccaatttgtgctcgaggctgaaggtctgagcaaccgctctatgttgcctgcacccagccgcggagggttgctgcaatgtcggtctctcggcgtgtcgcggaggatatggatgtcacaatcggggaggaagttggttacagtatccgatttgaagattgcagcagtcacaaaactgttctcaaatatttgacagatggtatgcttctgagagaagcaatggcagacccacttttagagaggtacaaggtgattgttcttgacgaggctcatgagcgcacgttggcaacggatgttctgtttgggcttctgaaggaagttctaaagaacaggcctgacttgaagcttgttgttatgagtgctactcttgaggcagagaagtttcagggttatttcagtggtgcaccattgatgaaggttcctggtagacttcatcctgttgagatcttctatacacaggaaccagaaagggactatctagaagctgctatcaggacag

SEQ ID NO: 2948 - DNA, 503 bp, Triticum aestivum
ggtctgcgaggccctctgcgaaggtaacacgcagaacttcggagcagatttactggagaccttgctaaagatggctcctaccaaggaagaggagatcaagctgagagaattcaaagaagagacatctcctattaagcttggcccttccgaaaagttccttaaggcggttcttgatgtgccttttgctttcaaaagagtagacgcaatgctttatattgctaactttgaatcagaggtcaagtacttgaagaacaactttgagatccttgaggctgcttgcgatgagcttaggaacagcagactatttctgaagctactggaggccattctcaagactggcaacaggatgaatgttggcacaaatcgcggcgatgcgcatgcattcaagcttgacactctgctcaaattggctgatgtcaaaggcaccgatggcaagacaacgcttctgcatttcgtcgtgcaggagatcatccggacagaggggtcccgtctctctgccaaca

SEQ ID NO: 2949 - DNA, 657 bp, Triticum aestivum
cacgtcctccgcatcaacaagatgctctcctgcgccggcgccgaccggctgcagaccggcatgcgcggcgccttcggcaagcccaccgggatgtgcgcgcgggtgcacatcggccaggtgctgctctcggtgcgctgccgcgacgcgcacgcggcccacgcgcaggaggcgctgcgccgggccaagttcaagttccccggacgccagagggtcatcgtcagcggcaaatggggattcaccaagtttaagcgcgaagagtatctcaagctcaagagcgagggccgcatcgtccccgatggtgtcaacgccaagttgctgacttggcacgggtcgctcgagggacgcccgcgaggaaaaggtgtctttccaccctccgtcgccgaatcggcttgaagattacaacctcccgttacgtgtcagccttcgtcgggtccggcctgaatatcgagtctaccatgccatatgttgtgacaggagctgtcatacgcacgtccagctagctttatgtatgcgagtaaacggatataaacatgtggggactatacttgcgatggtaacagtatgatgtctagtgtgtagctcgagttggcagcatgctttaggaacctgtttcgtcgttaaacacgttgtgagcttggttttattcataaataaagg

SEQ ID NO: 2950 - DNA, 495 bp, Triticum aestivum
aaactgggatggagacaatgatgctgatgggagagagcccaaccctgatagttctggtgatgaggatttcttaagagagatgtcagagaaggacaacaagatcaagtccttagtagacatgggctttcctgaagatgaagcaaatatggctattaccagatgtggctgcaggagattgtcattatgggaacttgtctgactatgaggttactggtagctgctttgattctttgggagggagaaagagagcaagattgatggaagggagcaagaaaaagcggaagcggtatggaggtgcagcacaaggaaatcgacggcccttggatggtagccatgaagaaccaatgcctctcccaaatccaatggttggatttaacctgcctaatgataggctacgatcagtgaccagacggcttcctcaacaagctattgggccacctttcttctactatgaaaatgtggcactagctccaaaaggtgtatgggcgaaaattt

SEQ ID NO: 2951 - DNA, 666 bp, Triticum aestivum
cttcgtgggcgcgttcccgaccgtcgtgctcgacctcccgtccctcaggttcctcgacctccgcttcaacgacttcgagggcggcgtgccgtcggagctcttcgaccgcccgttcgacgcccatcttcctcaaccacaatcgcctccgcttccagctccccgacaacttcggcaattcgcccgtgtccgtcatcgtcctcgccacaaccacttcggcggctgcctcccggcgagcctcggcaacatgtccgacacgctcaacgagatcctcctcatcaacaacggcctcagctcgtgcctcccgccggaggtcgggatgctccgggaggtgacggtgttcgacgtcagcttcaacgccctcgcagggccgctgccgccggaggtggccgggatgcaaaaggtggagcagctcgacatcgcgcacaacctgctgtcggggaccgtgccggaggccgtgtgcgacctcccacggctcaagaacttcaccttctcctacaacttcttcaccggcgagccgccgtcctgcgcgcgcgtcgtgcctgccgacggcgaccgccggaactgcctccccaaccgccccgcccagcgcatgccgcagcagtgcgccgctttctctgcccgcccacccgtcgactgcgcagctttccagtgcaagccgtttgtccc

SEQ ID NO: 2952 - DNA, 493 bp, Triticum aestivum
ctggccgccgctaattttgcggctcattcgcctttctctgctggggttctcatgccagggcatgcgcgcaacggcgacttcagcagtggaagagccagaagtggggatgatggaagcagtaggtcgtattcggctgagaaggagccctatatttggagatcagcaagtacgcatgcgtggacagaaacacttatggaggcatctgcctttgctcatatctcagaggaagctgcacaagatgatgtcttacaaggtccacagggagcaactcctgtgatttccagtccaatcataaagaaagatgttgccacacaaatgagtcctgatgacagtataatatcgtcctccccaaaagcaaggcattcctgctccagcttgccgtcaggacatgctattagagaatcaaatagtcatacacctaaggttgaagttagggatgtgacaggtagatgatcaagtaactgttacaacaggtgatcacaagcagacatgt

SEQ ID NO: 2953 - DNA, 489 bp, Triticum aestivum
gcgtgccactgggccgacggctacccgctcaacgtgctcctctacgtctccctcctccagaccgtcttcgaccacagggagcccaccgtggtgctagacgaggtggacgagctgctggagctcatcaagaagacttggccgatcctgggcgtcggccgggcggtgcacaacgtgtgcttcgcctgggtcttcttccagcagtacgtggtgaccgagcaggccgagccagacctcgcgtccgcgactctcgccctgctcgccgacgtggcggccgacgccaagcaggggagccgcgagtccctgtcccgtgacccaggtgtacgcacaaggtgctcctcagcgcgctcggcaagatgcaggagtggtcggagaagcggttgctggactaccacgagaggtacgagagaggcaccggcgggactgccacccgccgggcatggagatattgctgtccttggcgcttgccgcaggcaagatcgtcgccgaccg

SEQ ID NO: 2954 - DNA, 525 bp, Triticum aestivum
  misc_feature (492)..(492): n = any nucleotide
  misc_feature (522)..(522): n = any nucleotide
tggaagtcttcagttgggagatagttaggtatcttgtccttgatgaggctgaccagatgcttgcagttgggtttgaggaagatgtggaaacaatattgcaacagctgccagccgaacgacaaagcatgcttttctctgcgaccatgcctagttgggtgaagaaattgtctaggcggtacttggataatcctttgacaattgatttggttggcgatcaagatgaaaaactagctgaaggaatcaaactctttgctattccactcacaacgacttcaaagcgcaccattcttagtgatctcattacggtatatgcaaagggtgggaaaactattgttttcactcggacaaaacgggatgcagacgaggtatcattggcattgacaaccagtattgcatctgaggcgcttcacggtgatatttcacaacatcagcgtgagaggacattaaatggtttccgccaagggaaatttactgttcttgtggcaactgatngtgcttctcgtggtcttgatataccaatgntga

SEQ ID NO: 2955 - DNA, 475 bp, Triticum aestivum
cagtggtcctcctctgggagaattgtcaatgtctcatcaggcttttcactgctaaggaacttcaccagcgaagaactgaagaaggaattcgacgacattgacaaccttactgaaaagagactagaggagcttctggatctattcctagaagatttcaaggccaacttgatagaggcacatgggtggccgaccggtggctcgtcggcctacaaagtcgccaaagctgccctgaatgcatacacgaggatccttgccaagaggttccccgcgatgcgcatcaactgtttgacgcctggttttgtcaagagcgacatgacgatgcacatgggagtgttgacgcttgaggagggcgctagcaacctggtaaaggtcgctctcttgcccgacgatggcccgatgggtgcttattttgatagggatggcgtggtgtcatttgtgtgactgtacagtgtaatgaactcagtaccaggtatta

SEQ ID NO: 2956 - DNA, 464 bp, Triticum aestivum
accaggagacctgcctcgacggcttcgccaacaccaccaccgacgccgccgccaagatgcgcggcgcgctcaacgcctcccaggagctcaccgaggacatcctcgccgtggtcgaccagttctccgcctcgctcggcagcctcaatatcgggaggaggctgctaggggaggaggacggcatgccttactggatgaaggacggcaagagacggctgctggaggccgagccctccgcgcccgagttcaggcccaacgtcaccgtggccgccgacggcagcggcgacttcaagaccatcaaggaggcgctcgcaaaggtgccgcccaagagcgcctccatgtacgtcatgtacatcaaggccggcacctacaaggagtacgtctccgtcggccgccccgtcaccaacctcgtcatcatcggcgacggcgacgacaagaccatcatcaccggcaacaagacttcaaca

SEQ ID NO: 2957 - DNA, 460 bp, Triticum aestivum
cgccgactctttcgagaagatcgacaagatcggccagggcacgtacagcaatgtgtacaaggcgcgggataccgtgagcggcaagatcgtggcgctcaagaaggtgcgcttcgacaacctcgagcccgagagcgttcgcttcatggcccgcgagatcctcatcctccgccgcctcgaccaccccagcgtcatcaagatcgatggcctcgtcacctctcgcatgtcctgcagcctctacctcgtcttcgagtacatggagcacgacctcgccgggctggtcgccagcccggatattaaattcaccgagccaaagggtttcggagatcccagtgctgctgcttctggtggcccctggacaccgtgcaatgaaatgtgagcctaatcgaggtgtctggctttgctgacctgcaggttaagtgctatatgaaccagctgttgttagggctggagcactgccatg

SEQ ID NO: 2958 - DNA, 452 bp, Triticum aestivum
gcaacagcaagtcagcagaggctatggtgaaaagcgtcagcaaagagtcgttccagtgggggctcgcggccgggatgcactccggcctcacctacggtctcgcggaggtgcgcgggacccacgactggaagaacagcgcggtggcgggcgccgtcaccggcgctgcggtcgcgctgacctcggacaacgcttcgcacgagcgggttgtgcagtgcgccatcaccggcgccgcgctgtccgccgccgccaacgtgctctccgacatagtttagggagttcattcatatgataccacccgatggcggcggaatggacttgtttaggtgacgtgttgttgcgacttgcgagcgcacttgtcctgtgtttcctttcttacgatctcggtgtagccggttcaaataataactgccatatctcctttcatacataaaggtttggcggctattcgctac

SEQ ID NO: 2959 - DNA, 438 bp, Triticum aestivum
  misc_feature (347)..(347): n = any nucleotide
tgccccaccccgatgagcgtgttgagtatgaattctggaccaacagtaacgatgaatgtggtccaaaatgtaatagccagattgatttcgtcaagagctttaaaggagcagcccaggtacttgagaagaagggatacacacagttcactccgcattacattacctggtattgcccggaggcctacactttaagtaagcagtgcaaatcccagtgtatcaaccatgggaggtattgtgcacctgatccggatcaggatttcagcaaagggtatgatgggaaagatgtagtagtacaaacatttacgacaagtctgtgtttataaagttgctaaggagagcaagaaacncttggctggtgggtgggattatgtgactggattttgcagattcggtgcccaatgaaagaaaagaagtacaccaagggaatgtgctgatgga

SEQ ID NO: 2960 - DNA, 931 bp, Triticum aestivum
cttttagttgtcacaggtgtatggggtgtatatggatgcaagtgaacttacagacatggtacagtagaaggacaacaccattttggtacagtgtggggtgtgtgtatcgaggcgcggagaaaccccctcatgtgtatcttgcgctttgcatgatctgtgttactggataaaacacgagccaggccgattggaggccgccgagcatagaagtttgtgactggggctgcggcgattccgcggtgattcagcaggcatctgaagtagtgtagccgagccaggacggtcgtttccaggtcttgggcggatatggcctccaactgactccacatacgctctgctgccgcggctgctcgtggccatattgcatgtggggtgagacggcagacacctctgatgtccaacaaacaatatggccacgagcagccgcggcagcagagcgtatgtggagtcagttggaggccatatccgcccaagacctggaaacgaccgtcctggctcggctacactacttcagatgcctgctgaatcaccgcggaatcgccgcagccccagtcacaaacttctatgctcggcggcctccaatcggccctggctcgtgttttatccagtaacacagatcatgcaaagcgcaagatacacatgagggggtttctccgcgcctcgatacacacaccccacactgtaccaaaatggtgttgtccttctactgtaccatgtctgtaagttcacttgcatccatattacaccccatacacctgtgacaataaaagcccttgatccttccccgtgtatttcaccccgaaactccaataaaaccccagcttttatccgatcctactggggaaaaggtggtcgccgatgtaacagtactattcgcgcgccttttcaacaggcctgtttgttgaacaccagtttccggatcaacatttga

SEQ ID NO: 2961 - DNA, 397 bp, Triticum aestivum
ggcgacgaggtcgaagtgcactacacggggacgctggcggacggcaccaagttcgactccagccgggaccgcggcgccccgttccggttcaccctcggccgaggccaagttataaagggatgggatttgggcatcaaaacaatgaagaggggcgagaatgctattttcaccatcccaccagagcttgcatatggtgaggatggctcccctccagtcatccctccaaatgcgacgctgcagtttgatgttgagcttctctcatgggcaagtgtcaaggacatttgtaaagatggcagcatctttaagaagatactagctgaaggcgagaagtgggagaatcccaaagaccgtgatgaagtttttgttaaatatgaaggcaaaggcattgatggatggg

SEQ ID NO: 2962 - DNA, 393 bp, Triticum aestivum
tggccaatgttttacttccattgtaacttgcacaaaaaagggaggagattctgcaccctgtgttagtgatagccaatatctagataagcccctcccaaacatccttataagattcattaaaggcatgtgtaaactttttaacctatctttccagttgtatggtatacaaaatttctcttcaatgttatttcttgcactaaggaaactgaattctgttacagggacccattcaccatctttggcgtgtgattgagctctgcaggagagtaaaaaatatataccaaaacaaggcaatatgctgacaacaaggatgctttatttatcatagggactatctctggagaagaggcaatgaatcaaccacagtgttggataatatctgatatatatact

SEQ ID NO: 2963 - DNA, 606 bp, Triticum aestivum
gtcgtcaccttcgcccccgctggttgtcaccacctgaagtcaagtccgtcgagatgcaccacgagcagctcgtcgagggtgctccaggtgacaacgtcggattcaacgtcaagaacgtctccgtcaaggagattcgtcgtggcaacgtcgccggtgactccaagaacgacccgccaaagggttgtgactccttcaacgcccaggtcatcgtcctcaaccaccccggtcaggtcggtgctggatacgccccagttctggactgccacaccgcccacatcgcctgcaagttctctgagctcctcgagaagatcgatcgccgtaccggcaagtccatcgaggaccagcccaagttcatcaagtctggtgacgccgccatcgtcaagatgattccgtccaagcctatgtgtgttgaggccttcactgagtacccacctctcggccgcttcgccgtgcgcgacatgcgtcaaaccgtcgccgtcggtgtgatcaagtccgtcgccaaatccgcaaacaccggtggcaaggtgaccaaggcagcagtcaaagctggcgccaagaaatagattctgaaacttgtactcctgtttcagatgcccgagagagatt

SEQ ID NO: 2964 - DNA, 392 bp, Triticum aestivum
ctcgtcagggaccccaagaagcggctcaccgcgcaccaagtcctctgccacccgtggctgcagatgagcggagaggcaccccacaagccgctcgactcggcggttctctcgcgcctgaagcagttctcggcgatgaacaagctcaggaagatggcattgagagtgattgccgagaacttatcagaggaggagattgcagggctcaaggagatgttcaagatgatggacaccgacaatagcgggcagatcaactatgaggagctaaaggctgggctggagagggtgggcgccaacatgaaggagtcggagatatctcagctcaatgcaggctatttggatatggtggaaagatgatattgaagtggaaagcaaacttaggggaaaggcataca

SEQ ID NO: 2965 - DNA, 378 bp, Triticum aestivum
gcggcgtcgcaggtggtgacgcccaggacgggaactccggtcaagctactcggccgcgaggatgctagcattgactggtataacctggagaaatcaaaacgtgtcaaggaatttaggtgtggagagtttgatgcttgtattgagaaggcaatggcttgtcaaggaactcctgtaaagagaagagaaaaatatgctcgtagagaagatgctattcttcatgctcttgaattggaaagaaagcagcttgcattgaagtaccagaaccaaggtttcagggcagatgacagctgcagtatcctctttgctgacacagggagggagtttgacgactttccttcagaatattactcaagaaacaacgtccaggatactcagtgg

SEQ ID NO: 2966 - DNA, 582 bp, Triticum aestivum
gagcccggcgtcgccggcggatcgacaggcgggagcccgacgcggcgccggggatggagggccgcgcgtggggaagccggcgaggagacggtccagggcgtcgcggcgcgcgcccgtgacgctgctcaacacggacaccaccgacgttccgcgccatggtgcagcagttcaccggcatcccggcgccgcccgcgggcgcgttcgcggggcccggcggcgttccggtcatcaacttcggctccgactacggcttcaccggcgccgtccttcccttctccgaccacctccaaccgcgccggccgacgttccaggaccaccaacagctcctccgaccgcagcagcagtacaccggcgcaccgttcggttacggcaacctgcagcaagccggcggcgccggcaccggcgccggcgacatgattcagccacgcgctgagctcggccgaggacaggttgctcctgcagagcctccagacagctcagatgcctacttccgccgctaaccacagcgctaatggttacttcgcctaattaaccaacggttaatcgaagacacatcacaagcaaagaagattcatggaccag

SEQ ID NO: 2967 - DNA, 655 bp, Triticum aestivum
gcgctccgcgacacgccgccatcgcgtcggcgcgcgccgcggagctgtacggcctccaggtcctggcggacggcgtgcaggacgacgccgggaacgtgacccggttcgtgatgctggcgcgggagcccatcatcccgcggacggaccggccgttcaagacgagcatcgtgctggcgcacgaccgggagggcacctccgtgctgttcaaggtgctgtcggcgttcgcgttccgggacatcagcctgaccaagatcgagagccggccgcaccggcaccggcccatccggctggtggacgacgccaacatcggcaccgccaagcacttcgagtacatgttctacatcgacttccaggcgtccatggccgacgtgcgcgcccagaacgcgctcgccgagatccaggagttcacgtccttcctcagggtgctcggcagctaccccatggacatgacgccctgggacgccgcgccgtcgtcctcctcctccgatcaacagcagcgcggctagatgatagctagctccatgttactacattactgtcaattcaatcaatatgcgcaagagattcgttgttaatctatccccccctttgatgctccgctgctcgctacaattttcctctgttaatttgctctcgcagccattgggccaaattc

SEQ ID NO: 2968 - DNA, 627 bp, Triticum aestivum
tgagcgcacggctgatttcggcacaaggctaatacagccctatgacactcatgtgactactgacctagttggcacccttgggttacataccacctgagtacagccagtcactgatcgccaccccgaaaggggacgtctacagcttcggtgtcgtcttgctggagcttctcactggtagacggcccgtggaagtgtcgaaagtcaagggatccagggacttggtctcctgggcactccagatgaaatctgagaacaaggaagagcagattttcgacaggctgatttggagcaaagagcatgagaagcagctgctgtctgttctcgaaacggcatgcaggtgcatcagcactgaccctcggcagcgtccatccatagagcaagtcgttgtttggctcgacagcgtgtcaccgtaatacatcatgttattttcccagttctcttttggtcaatgtctagttctttacatgggtgggtgataaaccgtagcagcagagaaactatctgagaactatcagtctagaagatggagcttatctggtgtaaataaccgtggttttctttcttatagacgtcgaactggcagagaatgactacaagtgctgccatttcttgctgatgctctgcgtt

SEQ ID NO: 2969 - DNA, 314 bp, Triticum aestivum
gcaagccagaaaaaccaacaaaaatgtgcatggcatagcaaaggagctgaggaagctccacagggagggcatcaacaatgcaacaaactctgtcacagttgtggctgtgctcttcgccacagttgcatttgctgcgatattcacggtgccaggcggcaacgacgaccatggtgtagcaattgttgtgcatgcggtatccttcaaggtgttcttcatcttcaatgccatcgcgttgtcacattattacagtagtggtggccagatacacttgttaggtggagaccaacagagagcgagtgtggagtgatacaagt

SEQ ID NO: 2970 - DNA, 704 bp, Triticum aestivum
ttttcgggaagttctgcagaagcaaatacctgtaacttgtgcatcaaaaaaatggaaggctctttcttcggtaacatggatcagagaaactacgtcatgagcggtggccatccaaggacagctttctatcaggcatttctcaagttggcgaagtccatatggttattgcataggctggcatactctttcgatccaaaggtcagggtcttccaagtgaaaaagggaagcgagttctcggagattcacatggaaagtgtggtgaagaacatggtcttggatgaaagtgccgacaggcttaaagtaggtttaatggtgatgcctggtttcttgattgggactagcgtcatacaggcccgagtgtacctttcagatgttaaatatgctgactgaaaatgctgcagttgcttgggaagattcagggcgtattagttcctgtgggctcatttagttgcatctgaaatggcgggggactttgtgtgtctgtgtcgtgtgtgatgctacctgaaaggatgttattcagatgaaatgtggtagtctatagcaacacgtttgtgaaagaccttcatatgcttgtctttttaagactagaatgtttattctctctgttgcgtgatgtaatcctgtccagtgtttggtatatatatattgttggtctgatttggatgttgcagcctatgtggtactgcacaacccttttcatgttg

SEQ ID NO: 2971 - DNA, 276 bp, Triticum aestivum
agatgatattgcagagattgtgagcaggtggacaggcatcccggtttccaagttaaagcaatccgacagagaaaagctgctgtatctcgaggacgaactgcacaagcgtgtagtggggcaggatcctgcagtcaaagcagttgcagaggccatccagagatccagagctggtttgtctgatccaaaccggcccattgccagcttcatgttcatgggacctacaggagtgggcaaaacagaattggcgacacactcgcttcttttatgttcaacatc

SEQ ID NO: 2972 - DNA, 272 bp, Triticum aestivum
cgcgtcttcgacttcctccgcgacgagacctctcgcagcgagtgggacatcctctccaatggcggcatcgtccaagaaatggctcacatcgccaatggccgcgaccatggcaactgcgtctcactcctccgtgtcaatagcaccaactcgaaccaaagcaacatgctgatcctgcaagagagctgcacggacgcgtcgggctcctacgtcatctacgcgccggtggacgtggtggccatgaatgtggtgctcaacggcggcgacccagacta

SEQ ID NO: 2973 - DNA, 272 bp, Triticum aestivum
ggctctggagccgctgtctaccctcttggtggtgatgcaaatgctgagcttgatgatgagatgctccagctgtgggagactgctgagaaggattgcaagaatggaacagccaagtcatcatcatctgaacatgacatacaagaggtggaggaggtgaagagtcagtacacttcctttgaaatagcaagaggaagagacctagggatcaacaggctcgagatatcaacagcaaccctggagcctcagcagtcatggaccaaaatgtcttgaga

SEQ ID NO: 2974 - DNA, 270 bp, Triticum aestivum
cgtgccccgcgcggtcttcgtcgacctcgagcccaccgtgatcgacgaggtccgcacccgcgcctaccgccagctcttccaccccgagccgctcatcagcggcaaggaggacgcggccaataacttcgcccgtggtcactacacaatcggcaaggagattgtggatctctgcctggaccgcatccgcaagctggccgacaactgcactggcctgcagggcttcatggtcttcaacgccgtcggcggtggacccgggtctgggttgggtcc

SEQ ID NO: 2975 - DNA, 261 bp, Triticum aestivum
cttctccacaggctccatgcacttcctgaacagatccatgttcatctcctcaaacctggcacgggtgatggtggagtagaagtcaatgccctcaaacagcgagtcaatctcaatggtggtctgggcagtggaggagagggttctctttgccctctcacaggatgtcctcagcctccgaagagctcttgggttgccactgatgtccttcttgttcttcctcttaaactcctggacaaagtggttgacatcctgttgtcaaag

SEQ ID NO: 2976 - DNA, 259 bp, Triticum aestivum
cgcgagctcggggaggacggcttcgccggcgtcgagatccgggtcacccccatgcgcaccgagatcatcatccgcacgacccgcacccagaacgtcctcggcgagaatggccggaggataagggagctgacgtcggtggtgcagaagcgcttgaactttccggacggcggcgtcgagctgtacgccgagaaggtcctgaaccgcggcttctgcgccgtcggtcaggccgagtccctcggttacaagctgctgggtggct

SEQ ID NO: 2977 - DNA, 254 bp, Triticum aestivum
gcacaaataagcaaaggatatggagaagaaattgtcaagcgtcagttgaaagctgtcgctgaaggtgtggcagcatctgttctgcagtcaccatttcctgaaaaaccaactgaattttctggggatcacaaagatttgcctggagatgtatttgatccaaaaaatgaggatgcgccgagcaaacagtcagacaaaacaagccaaggagttccagttctagatgacatcgataaccttcagataataaagaacag

SEQ ID NO: 2978 - DNA, 251 bp, Triticum aestivum
cgcggacgtcgtcatcaaccaccgctgcgccgaggacaaggacggccgcggcatctactacatcttcaagggcggaggacccgagggcctcctggactggggtcccggcatgatctgcagcgacgacaccaagttctccgacggcacgggcaaccgtgacaccggcgccgacttcgccgccgcgcccgacatcgaccacctcaacccgcgcgtccagaaggagctctccgactggctcaactggctcaagt

SEQ ID NO: 2979 - DNA, 244 bp, Triticum aestivum
attttgcgtcgtggacatataacttacaacgagtacattcaagttggcaaagggcgtgatgttggacttaatcagatatcgaaatttgaagctaaagttgcaaatggcaatagtgaacaaacacttagccgtgatatctatcgtctagcgcggcgattcgattttttcaggatgctttcatgctatttcacaacagtgggattttacttcaacagcctaatatcagttgtaggtgtttatgttt

SEQ ID NO: 2980 - DNA, 244 bp, Triticum aestivum
gctatccgaagcttggcaagccatctctcggagcagatgggaagttcgtagtcgcagcctctattggaacccgcgaggatgacaagcgaaggctagagcagctaattcaggcaggggccaatgctattgtgatcgatagctcgcaggggaactccacctatcagcttgacatgataaagtatgccaagaagacgtttccggaggtggatttgattggaggcaatgtggtgacaattgggcaggc

SEQ ID NO: 2981 - DNA, 600 bp, Triticum aestivum
tatgcttcgcctaggattggcgcaaggtcccccaggaggcactttatcttctaggcaaaatttagctggtgcatccaactacctaggttacaatggagttggaagtccgactggagcagcttctcttcagatgcctatcgatccgttatatgttcaataccttgctgcccaagttgcagccagctatgatgatcctttcatggccagtggacatctaggaagttcatacatggatttacttggtcctcagaagggttgccttagcccactgcttcagtcacagaagaactatggctgctatggaaatcctgggtttggccttggttatggcggtagccctttgacgagtcctgttctgccctcttcacctgttgcatctggtagcccacttaggcacggtgaacgcagcatgcgctttgcatcaggcatgagaaattttgggggttcttttggttcgtggaatccagacctggttggaaagatggaaggaaatctgatgccctcgcttctggaggaattcaagagcaacaaaagcagaacttatgaactctctgaaatagctgggcatgtcgttgagttcagtgctgatcaatatgggac

SEQ ID NO: 2982 - DNA, 723 bp, Triticum aestivum
accgtggtcactttgaaggacatggaaatcagattggcatgcttgcctggacaacaaagttggtttcacagggctttgcgtgccgaaggaacacaggataagtttgtgaaatttgactttaatggaccacctgctgaactgaagcatggcagtgttgttatagcagcgattactagttgcacaacacatcaaccccagtgttatgcttggtgctgcccttgtcgcaaagaaagcttgcgaattgggtctcgaggtcaaccatgggtaaagacaagccttgccctggatctggggttgtcactaaatacttgctaaagagtggccttcaagaatacttcacaagcaaggattccatcttgttggatatgggtgtaccacttgcattggcattctggtgaactccatgaatctgtatcagctgccattacagaaaatgatgttgttgctgctgctgtgttgtcgggcaaccgtaactttgagggacgtgtgcaccctttgactcgggctaattaccttgcttcaccacctctggttgttgcatatgcacttgctggcactgttgacattgattttgagaaggaacccattggagttggaaaggatggcaaggaagttttcttcagggatatatggcccacaactggagaaatcgcagaggttgtacacatccagtgtgctgcctgacatgttcaagagcacatacgaggccatcacaaaaggcaa

SEQ ID NO: 2983 - DNA, 243 bp, Triticum aestivum
gatcgaaccagcacgcaccgttgtggggaatgaggtactgggggcaaaagtggcattcttctcttcgagagggccatcacgtgattaccccgacattatcaagcctgacatagccgcgcctggagccaacatcctggcagcagttaaagattcctacagatttaattccggcacatcgatggctgctccacacgtatcgggcatcgtcgcgctgttgaaagctcagcacccagactggtctcc

SEQ ID NO: 2984 - DNA, 242 bp, Triticum aestivum
gaaccacactgatttcatcattaccagcacattccaggaaattgctggaagcaaggatagcgtgggccaatatgagtctcacattgctttcacccttcctgatctgtaccgggttgtccatgggattgacgtgtttgatcctaagttcaacatcgtctcccctggagcagacatgactgtctacttcccgtacactgagactgacaagaggctcaccgccttccactctgaaattgaggagc

SEQ ID NO: 2985 - DNA, 584 bp, Triticum aestivum
aaagggttatcatctccgtgatttcggcaaagaacgaattgggggagattcccatggaatctcatactggtatgatgaagatccgattctcgggcatcgattatatcgtgatattagacaagtggagtatgtgaaggagcatactagataatctaaacgaaaggggttcttaggtgttccagttgtatcctatcagtgggagactgtcgcgacatactttgttgaatttgaagcagcagcagaaaaactcttttcaagtagtaacaggacagaggtctcacttggaaagaagttgaagctcaattatctcccagagatggaaaagactcacaagaagaaggagaagctgctaaaaaagcaacaaagagaagcccttctccttaatagctacttgacatttgatagattcacctctggccgctcccatcgtgaaagaaagcgtgtcacctatactttcgatgattatgaccgttcaataaatgaggccctaaaagcaataaagaaaagtgagaacccggttcaggtcgttgccactaccaacagaggagtacttgtcgcaacacgagaggcatcaagtaatggta

SEQ ID NO: 2986 - DNA, 240 bp, Triticum aestivum
gggacctgatacctaagattcaggtcatggcccgttcgttaccattggacaaacatttgcttgtgacaaacttgagaggcatgttccaagaggtggttgctgtgacaggtgatggtacaaatgacgctcctgcgttacacgaagcagatattgggcttgctatgggcattgcagggacagaggttgcgaaggagaatgctgatgtcatagtacttgacgacaacttcacaactataataa

SEQ ID NO: 2987 - DNA, 251 bp, Triticum aestivum
gtgaaacatccaaacattgtccaattgtatgaggtgatggccaccaaaaccaagatattttttgtgctagagtatgtgaaggggggcgagctgttcaacaaggttcaacgaggaaggctgaaagaagatgttgctcgcaagtacttccaacagctcaatagtgcggttgacttctgtcacagccgaggcgtctatcaccgtgacctgaagcctgaaaatcttcttcttgatgagaacgcaatttaaagact

SEQ ID NO: 2988 - DNA, 238 bp, Triticum aestivum
accttctgttgttttctaatgagcgggactggtgctccctcactaaaacactactcgatattcttaccaagagaagtatggttagtgacgagttatcacatgagactctggagatgctctccgagattcatcttctgaacagggcagtgaaaaggaagagtagccacatggtgcatttgcttgtgcagtttgttgtaatttgccctgacaattccaaactgtaccctttccttccaaa

SEQ ID NO: 2989 - DNA, 237 bp, Triticum aestivum
ctgttgcctatggtgctgcagtccaggctgccatattgagtggagagggtaacgagaaggtccaggacctcctgctgcttgatgtcacacctctttctcttggtctggagactgctggaggtgtcatgaccgttttgattccaaggaacaccaccagtcccaccaagaaggagcaggtcttctccacctactctgacaaccagcctggtgtccttatccaggtttatgagggtgaga

SEQ ID NO: 2990 - DNA, 236 bp, Triticum aestivum
gctccatgagcttcaagatgaaggagctcttccaggcgcagaccccggcggacaagatcgtcgaggacgccaccgccgagaacctcgaggggcccgactgggccgccaacctcgaaatctgcgacctgatcaacaccgagaaggtgaacagcgtcgacctgatccgcgggatcaagaagcggatcatgctcaaggaggccagggttcagttcctcgccctcttcctcctcgagaca

SEQ ID NO: 2991 - DNA, 623 bp, Triticum aestivum
gggatctttcggggagctgtatcttggcgtgaacattcagagcagcgaggaggtggctatcaagttggaatctgtcaaaatcaaggcatccccagcttcattatgagtcaaaactatatatgcttctgcaaggggggatggggattcctcatcttaaatggtttggagtggacggggagtacaatgtcatggtcattgatcttcttggtccaagtctggaggacttgttcaacttttgcaacagaaaatttacccttaaaacagtacttctgcttgctgatcagatgatcgctagggtagagtacatgcactcgaggggctttcttcatcgtgatataaagccagacaactttcttatgggtttaggccgtaaagcaagccaggtttatgttattgactatggccttgcaaagaagtaccgggacctccaaactcacaagcacataccatacagggagaacaaaaatcttacaggaacagcacgttatgctagtgtaaatacccatcttggagtagaacaagcaggagagatgatttagaatctctcggttatgtgctgatgtacttcataagaggaagccttccttggcaaggtctgaaagctggcacgaacaaacagaagt

SEQ ID NO: 2992 - DNA, 230 bp, Triticum aestivum
ctagaaatgtttgagaccattgacaaaggaaatcttatctacaaaattgacgtgttcttgacatcgagcatttttcgcacctggaaagactcaatcatagttctgcaaagtacgaagtcattgctgccatggtctgagaatttgaaggtaatcaaccactgcattgattctattgcatcgaaggcgtcaattgatccgtcagaggttgagtggtcatacacctacaacag

SEQ ID NO: 2993 - DNA, 567 bp, Triticum aestivum
atcaaacacagcaaaccaatccagattaccatcggctatcaatcagcaggaggaggaaatcgctgctcgattggggaagaatcaagaggctcggcgaagatgcaggcggcgaaggagaaggtgaaggacggcgtgagcgcggtgaaggccaagaccaagatcacgcaggccaaggcgtcggagaaggcggaggcggccacggcgaggtcgcacgcggagcgggagctggcgcacgagcgcggcaaggccaaggtggccgcggccaagatggagctgcaccaggacaaggcgctccaccgggaggaggccatggagcaccgcatccacaagcacggcggcggccacggccgccaccaccacaagcacggcgtcggcatcgtggccgcagcccccgccggcgaccggtgccggggcttaccaccctcctcctgccgccggtggccactactactgatcagctacgcagctggatcgccagctagatgggcacatgcgtcgcgtttgtgtgatgtgttctcgatagctaataagtctgtactttgtgatgtttatgtttgacttacccac

SEQ ID NO: 2994 - DNA, 638 bp, Triticum aestivum
gatctttacagctttatagcttagggatcttgtcacttggtgcttcttggttctgatctgtggtgattggatttggagacaaggagaaaacagagaggggattcaggtgactctcagttgtgtgaagatgaagtatatgaagcttggagcaaagccagatgtctttcagacagaggggaatatcaggtttgtggcaactgaactggcgacggatattgttatcactgttggagatgtcaagttttatcttcacaagttcccacttttgtccaagagttcccgcttgcaaacgttggttgcttccacagacgaggaaggcaatgatgaagtagacatttctgacatccccggtggaccttcagcatttgaaatctgtgcaaagttctgctatggcatgaccgtcacgctgaacgcgtacaacgtcctcgcagcccgctgcgcggccgagtttctcgaaatgttcgagactatcgacaaagggaacctcatctacaagattgatgtgttcctctcctcagcatattccgcacctggaaggactccatcatcgtgctgcaaacaacaaagtcactccttccctggtcagagaacctgaaggtgatcaaccactgcgtggattccattgcggccaaggcttc

SEQ ID NO: 2995 - DNA, 227 bp, Triticum aestivum
gaggaatctgatgaagaagagagctatttctctgttgagctgacaccaagcttgtttacatctactgctgataacgcataccaatcaatacatgagttctcaaagcccttgatcaacatgatgaaagctgcaggttgggatcttgatgctgctgctaacgcaattgaacctgatgtagtttacacaaggagagctcacaagaagtatgcatttgagtcttatatctg

SEQ ID NO: 2996 - DNA, 617 bp, Triticum aestivum
aaggtggagtgcataatggtgaccggggacaactggggaaccgccaaggccatcggcaaagaggttggcatcgaaaacatcatagccgaagcaaagccagagcagaaggctgagaaggtgaaggagcttcagctgtctggaaaaaccgtggcaatggttggcgatgggatcaacgactccccggcgctggtggcggccaacgtcgggatggccatcggcgcgggcaccgacgtggccatcgaggcggcggacatcgtgctcatgaagagcaacctggaggacgtgatcacggccatcgacctgtccaggaaggccttcttccgcatacggatgaactacgtctgggccctcggctacaacatcatcggcataccgatcgccgcgggggtgctgttcccgtccacccggttccggctgccgccgtgggtcgccggcgccgccatggccgcgtcctccgtcagcgtcgtctgctggtccctgctgctgaggtactacaagaggccgttgatcacacagaagcggcagacatagagaagaggaccagcatcgtatagataatactagtatacatacatagaataagctgtagatatctgtaacaaacgtgtggtagaatg

SEQ ID NO: 2997 - DNA, 1268 bp, Triticum aestivum
  misc_feature (195)..(195): n = any nucleotide
ggaccaactgccgctcaaggtggtgagaggaggggggccagtaatggtggtgggttcaggagggatgggagccagtgggtgtcgagaagggagcttgataatcagctgccagagcctctcccgaggccggctcccaaggaagaggatcagagcttggtgaggaggaacaagagaatgctggggaagcttcttgtnggcacgctagagaaatttcagcaagagaacaaaaaactttccaactcagaggcttttatgcgtagatcagaggctcagcagaaggctgatcaaaaggctcgtgaggacagtgaaagattgcggcagcaagagcgggagcaagcagctgagaagcgtaggcgtgatatgacgcttcgtgctcgagtagctgctaaggcagaagaaaagaggttggagctattgtacattcagtggtctgagcatcacaaaaagctgtccagtttcttaaggttatttttattcctggtccaaaagtatccatattgacaattaaattgagggaagatgcgtttctgattgtacgcaaatcttgatgtttgatgtctacaggggtttccatatccactcattatactatatgtttgttccttgtttgattccatttgtatttgcaggacaaaagctgaaccagctatttattacatgccggctaaaccaatagttgatgatccggttattgttgagcaaaacaaggaaaaggtatttgaagaatggaaatctgtgcgcagaacggagctgacccagtttcaaaagcaagttgaggagcagtatctgtctaatgttgagagtcagctcgaaagaattcagaatgcccggaatgctcggagggggaacgtgcctgctaacatgcaggaaatggacaaggagttggacacgcacagggcggagcatggcccaaaggctcggaggatacccgacggtggcaatgacgaggatgatgatgtggatgtggacgacatggccgcggaagacgacctgatggatgaagtgctcggcgttaatgaggcgatcaatgaggacccgaccaagccatctgaagaggctactgatgttgctcctgtaccgcaggaggcacaataggcaaggttatttgcgaggtaggcacttcggcattacgattcttctatatcgttgtagttgccctcttctgctgtgactgtattgttgttgggtttttgtctttgggaatgctgtgagctgtgtttgctgttgaggccatatacatacttttcactattgttattgtcatttgc

SEQ ID NO: 2998 - DNA, 893 bp, Triticum aestivum
cgagtagctgctaagggcagaagaaaagaggttggagctattgtacattcagtggtctgagcatcacaaaaagctgtccagtttcttaaggttatttttattcctggtccaaaagtatccatattgacaattaaattgagggaagatgcgtttctgattgtacgcaaatcttgatgtttgatgtctataggggtttccatatccactcattatactatatatgtttgtttcttgtttgattccatttgtatttgcaggacaaaagctgaaccagctatttattacatgccggctaaaccaatagttgatgatccggttattgttgagcaaaacaaggaaaaggtatttgaagaatggaaatctgtacgcagaacggagctgacccagttccaaaagcaagttgaggagcagtatctgtctaatgttgagaggcagctggaaaggattcagaatgcccggaatgctcggagggggaacgtgcctgctaacatgcaggaaatggacaaggagcttgacacgcacagggcggagcatggcccaaaggctcggcggatccccgacggtggcaatgacgaggatgatgatgtggacgtggacgacatggccgcggaagacgacctgatggatgaagtgctcggcgtcaatgaggcgatcaacgaggacccaggcaagccgtctgaggaggccactgatgttgcgcctgtacccgagcaggcacaataggcaaggttatttgcgaggtaggcactcaggcattacgattctatatcgttgtagttgccctcttctgctgtgactgtattgttgttgggtttttgtctttgggaatgctgtgagctgtgtttgctgttgaggccatatacatacttttcattattgttattgtcatttgt

SEQ ID NO: 2999 - DNA, 636 bp, Triticum aestivum
ccacgtccacaactacgagcgcacatgcccgctctaccagagcccagtgcgtcaacaatgagaagagccactactcgggcaccatgaacgggaccatcttcgtcgttggccggccggcggcggcagccacctgtcggagtacaccaccgcgatccccaagtggagcatattcagggatcacgactacgggttcaccaagctgacggccttcaaccactcatcgcttttgttcgagtacatgaagagcagcgatggcaaggtgtatgactccttcaccatccacagggactaccgcgacgtgctcagctgcgtgcacgacagttgcttccccaccacgctcgctagctgatggtccggccgtcatggagggtcgtgcaataaaattggtaagcagcacaatttatatgtgctaataaacaaatctcgtgggcgtgagtacctggtgtccaaccgtcatggggtgtcaaccaataaaattggtcagctgcactgtttatacgtgctaataaaaagatcttgtgggtatgagttggtgttagatgtgcgcatactaatcatacaagaggcaggtgtatgctaattatgctttgtaactccttgttgttatattatggattagtaaaagcatcacttata

SEQ ID NO: 3000 - DNA, 806 bp, Triticum aestivum
agtacaagttcatcgaggaatgcctctccacggtggaccaagcaccagccgtggctcatcttcacggcgcacagggtgctcggctactcctccaactcgtggtacgccgaccagggctccttcgaggagccagagggccgggagagcctgcagaaactgtggcagaagtaccgcgtcgacattgcctacttcggccacgtccacaactacgagcgtacatgcccactctaccagagccagtgcgtcaacaacgagaagagccactactcgggcaccatgaacgggaccatcttcgtcgtggccggcggcggcggtagccacctgtcggagtacaccacggcgatccccaagtggagcatattcagggatcacgactacgggttcaccaagctgacggccttcaaccactcgtcgcttttgtttgagtacatgaagagcagcgatggcaaggtctacgactccttcaccatccacagggactaccgtgacgtgctcagctgcgtgcacgacagttgcttccccaccacactcgctagctgatggtctggccgttcatggagggtcatgcaataaaattggtaagccgcacaatttatatgtactaataaacaaatctcgtgggcgtgagtacctggtgtccaaccgtcatggagtatcgagcaataaaattggtcagctgcactatttatacgtgctaataaaaagatctcgtgggtatgagttggtgttagatgtgcgcatactaatcatacaagaggcaggtgtatgctaattatgctttgtaactccttgatattatattatgg

SEQ ID NO: 3001 - DNA, 1019 bp, Triticum aestivum
cgccttctgcccatcagtttgatggtagtcgttcagcacactgtttctcccgggtcacagctgcaggattccattctcatcttcctcgctgtgcctggtgcgcctccatggccgatgagtgtgctgggcactgattccatcgcctcggtcaagctgcgcatccagaggttcaagggctttgtggtgacaaagcagcggcttgtgctcgacgggcatgagctggcgcgcaacaactgccctgtcaaggattatgggcttgccgatgggaatgttctgcaccttgttatccgcttggctgacctccgggtgatcaacattgagaccgccagtgggaagaaatttcagtttcaggtggaccagacccgtaatgtcaagtacctcaagagcaagcttgcagtggagggtgatgaggaccttgatagcctggaggatgatgacaagctcgagtacgatggagaggtgcttgaggaccaccagttgattgctgatattagcaacaaggatgatgctgtgattcatttgttcatccgcaaaccagcaaaggtacgaacacagcaagttgataaggatactgtggtcacagttgacaaccctcagaagaaagagaaccttcagaatgaatctgttgtggtgacccctgcaaaaccagctggtggcaagcctgctcctatcgaaccaattgtggttaaccggaaggcgaagctgtcatctgaagtgatgaaaatgattgactcagcaatagctggtcttgagaatggatatacaccagttatgtcagcagaaggttcagggggtgtttacttcatgcaagattcatcaggccagaagaatgttgcagtgtttaagccgattgatgaggaacctatggctgaaaacaacccaaggggtcatccactgtcgactgatggggaaggcctgaagaggggcacacgtgtaggggaaggtgcctaaggggagttgcggattatattctcgaacattcagttggcgatcgtgaatcgggcccggcgttggggttc

SEQ ID NO: 3002 - DNA, 544 bp, Triticum aestivum
atgctcatgacggcgacatcgtccttcgagtacgcgatcctcctcatcatcgctctctgcttccactccatcttcgaggggatcgccatcggcgtttcagcgacgaagggagaggcgtggaggaacctttggacgatcgggctccacaagatcttcgcggcggtggccatgggcatcgcgctcctccggatgatccccaaacgcccattcctcctgacggtgctctactcgctagcgttcgccgtgtcaagcccggtaggggtgggcatcggcatcgccattgatgccacggcggagggctcggattggacatatgctatctccatgggcatcaccacgggggtcttcgtctacattgccatcaaccacctcatggccaaggggtaccgcccgcagcagccaaactacttcgacaagcccatcttcaagttcctgagtgtgctcaccggcatatccgtaatgtgtgtcgtcatgatatgggactgatttatccgtcggttaaatcaagagggtgtttaagtgctttgatttgattgctcgcatg

SEQ ID NO: 3003 - DNA, 1534 bp, Triticum aestivum
  misc_feature (71)..(97): n = any nucleotide
tgaaatccatccatcacgcccttggccttggcagccgcagcagacgactcgcctactctgcgcctgcctgnnnnnnnnnnnnnnnnnnnnnnnnnnngagccgccgacgaattgggaacaaggatcacgccaggtatcgactgactgccggatcactgtaacaagatgagcgacaatctcatggacaaagttaacgccctgggcgagcgcctcaagatcagcggcgcggaagtcagccgcaagatgtccaccggcgtcactagcatgagtttcaagatgaaggagttcttccaaggccagaacatggccgacaagattgttgacgaggccaccttggagaccatggacggccctgattgggctaccaatcttgagatatgcgatatggccaacaccgagagggtcaacagcgtcgagctcatccgcgccatcaagaggcgaatcatgctcaagagcccgagggtgcagtatctggctcttgtcctcctcgagaccattgtcaaaaactgcgagaaggccttctccgagattgctgcggagcgggtccttgatgaaatggtgaagcttattgatgacccacagactatagtcaacaacagaaacaaggcgctcatgcttattgaagcatggggagagtcaggagaggaactccgctaccttcccgtgtatgaagaaacttacaagagcttaagatctaggggaattcgcttccctggccgcgatgatgagagccttgcgccaatatttactcctccccgttcagtacctgcagctgaaccatattctgatgcagcacaggacgggtaccaagaaattccagatgaaagttttgctccagttcgtgctgccccttctgtacaagtcgacgatgcttttgaggtggctcgtaatagcgttgaacttctttccacagtgctatcatcatctccacaaaaagaggctctagaggatgacttgactaccaccctggtccagcaatgccaacagtgtcaatacacaatccagagaatcgtcgagactgcaggtgataacgaggctcaactctttgaggcactgagcatccacgatgaactccagaaagttctgtccaagtacgaagacctcaaggaacccatcgtcgcagagcctgagccagaaccagcaatgattccagtcacggtggagcctgaggaatccccacgcgctgttggcaaagacacccccgcgaggaaatcagctgggtccggtggccgctctagcggcggggatgacttgcttcaggatctcgacgacatgatcttcggtaagaaagccggcacctcctcccagcaggaaagaactccccggaaggagcagaaggacgacttcatcggcttatgatcaacgggtatatatatctgtccggctgaaacttgtcataaaggtgttgcgtgctcagtgcatttccaaactatgatacaggtttgtgcttgcgcgtctatcttctcctgtatcccggggattgctgtacagtggtagatgtctgacgtggcagtgagtttcatgtggcactcct

SEQ ID NO: 3004 - DNA, 1080 bp, Triticum aestivum
cctccgcacgcccgcacggcccccggcccgacctactcccgcgcgacgacttcgtgcgctacctcgacgactacgccgcccgcttcggcgtccgcgtgcggctccgccgcgaggtccgcgaggcccgcttcgacgaggcgcggggcgcgtggctcgtcgaggccgtcgaccacgccacggggctggtggagcgctacgccgcgaggcacctggtgaccgccgccggggagaacgacgagaaggtgctgccggaggtgccggggctggacggctttcccgggaaggtgatgcacgcctgcgagtaccggacgggcaaggggatggaggggaaggcggtgctcgtcgtcgggtccggcaactccggcatggagatcgcctacgacctcgccgaggccggcgccgccacctccatcatcgtccgcagcgagcttcaccttgtgaccaaggagatctggaacgtggcgatgacgctatacaggtacctgccgctgtggctgatcgaccggatcgtgctcttcatgtgcagcgtcgtgttcggggacacctcccgctacggcctccgccggcccgtccattgggcccttctccatgaagatccacaccccagcctaccctgtcgtcgacgtcggcacctacgccaagatcaagaccggcgagatccaggtcctgccggcgatgaaggctgtgcacgggaacgtcgtggagttcgccgacggcaagcggcacccgttcgatgccatcgtcttcgccaccggctaccggagcacaaccaagaagtggctcaagagtgacgatgggctgatcggcgaggacgggatggcgcggcggagcttcccggagcactggaagggggagaacggcctctactgcgcggggatggtgaggaggggcctctacgggagctgcgaggacgccgagtccatagccgaggacatcagcaagaagaagaagaagccacaccaagcctgaccatgatcatcgtcagaagagcaataataccttctggagtcgcacagcgatcgttgggcgagaaacaatgggtgtgttgtgattaatatctcgaaacttaaataatctgga

SEQ ID NO: 3005 - DNA, 1220 bp, Triticum aestivum
gcgcgacgacttcgtgcgctacctcgacgactacgcggcccgcttcggcgtccgcgtccggctccgccgcgaggtccgcgaggcccgcttcgacgaggcgcggggcgcgtgggtcgtcgaggccgtcgaccacgccaccgggctggtggagcgctacgccgcgaggtacctggtggccgccgctggggagaacgacgagaaggtgctgccggaggtgccggggctggacggcttccccgggaatgtgatgcacgcctgcgagtaccggacgggcaaggggatggaggggaaggcggtgctcgtcgtcgggtccggcaactccggcatggagatcgcctacgacctcgccgaggccggcgccgccacctccatcatcatccgcagcgagctccaccttgtgaccaaggagatctggaacgtggcgatgacgctatacaggtacctgccgctgtggctgattgacaggatcgtgctgctcatgtgcagcgtcgtgttcggggacacctcccgctacggcctccgccggcccgccattgggcccttctccatgaagatccacaccccagcctaccctgtcgttgacgtcggcacctatgccaagatcaagaccggcgagatccaggtcctgccggcgatgaaggctgtgcatgggaacgtcgtggagtttgcagacggcaagcggcacccgttcgatgccatcgtcttcgccaccggctaccggagcacaaccaagaagtggctcaagagcgacgatgggctgataggcgaggacgggatggcgcggcggagcttcccggagcactggaagggggagaacggcctctactgcgcggggatggtgaggaggggcctctacgggagctgtgaggacgccgagtccatagccgaggacatcagcaagaagaagaagccagatcaagcctgagcatgatcatcgtgagaagagcaataataccttctggagccgcacagcgatagttgggcgagaaacaatgggtgtgttgtgattatatctcaagacttaaataatctggaaaactagccgtagcttatctgcgattaccggggaaactattatctgttcgttgccttgtctgtgcacagtccggccggccgggaccagaccaggttaataatttccagatgcgatctgcagatcgatccatgcgcgactcgcacttactgtagcactgttattctttttgcgggttgactatgta

SEQ ID NO: 3006 - DNA, 631 bp, Triticum aestivum
ccgccaggtccggagtcacctgctgcttgagattcccaggtcaactcaacgctgacttgagaaagctcgccaccaacttggttcctttcccaagactccacttcttcatggttggtttcgctcctttgacctccagaggatcccagcaatacagagctctgactgtccctgagctcacccaacagatgttcgacgccaagaacatgatgtgcgcttctgacccaagacacggcagatacctcactgcctccgccatgttcagaggaagaatgtccaccaaggaagtcgacgagcagatgctcaacgtccagaacaagaacagctcatacttcgtcgagtggattccaaacaacatcaagagctccatttgtgatatccctccaagaggactgaagatgtctgtcaccttcatcggaaactccactgccatccaggagatgttcaagagagtcgccgagcagttcaccgccatgttcagaagaaaggctttcctccactggtacaccaccgaaggtatggacgagatggagttcaccgaggctgagtccaacatgaacgacttggtgtctgagtaccagcaataccaggaggctacctaccgaggacgagaaacgaggtgccgacgaataag

SEQ ID NO: 3007 - DNA, 878 bp, Triticum aestivum
ggttcagtggcaatgatgacttgatgaagagagagccagtaggaggaacagggaagttcatcacaaatgtgatgtggaggaacatttttgggcaatctctataccaatttgttggtgatgtggtatctccagacgcaaggaaaaaccttttttgggcttggagggctctgatgctgatatagtgctgaatacaattattttcaacctcattcgtcttctgccaggtgttcatgagataaagttcgagggagatggagaagctcaatgtgctcaagggcatgctgaagaactatgtcttcatgtgtgtcctcagcagcaccgttgtcttccagttcatcatggtccaattcctcggcgagtttgccaacacgacgcctctcaccagtctccagtggctagccagcgtgctccttggcctcgtcgggatgccgatcgccgttgtcgtcaagctcattcctgttgggtcctcctgatgaaaagggcaacccaccatgtgaaggaggtgtggcgaaaagaccgattccataatgtgtggacctgaatcctccatgcagggtcttttgggatgcatggagagcaagcctgagaagagctgcactagacaagttttaaagcctacgagtgtggcagatttgcatcatattgttgtgtaagaagcatttgtatctggtgctgtgctagggcttagggcctgctcgtcagcagacctgtaagattgatgtctggctgggattcagacctgaaaggatgtatattctgtggatcgataaacagaaacctgatcatttcgacccctttattccgtatcggcatatgaccgagactttccaggaatggggtgcatgtagtccagacagactagtgccttatgttggatt

SEQ ID NO: 3008 - DNA, 808 bp, Triticum aestivum
gcatcgctcatccctccgtcaagacgcgtcaatctggcgacctcgaccccccatggctgtgtactacagccaactctggctgaccaacttccgatgcgccccaggtgttcgtgatttgctctggaaccgcagtgcgttcgtcgatttcgtggcgccaagcttcatcacgctgatgaggtaacaatcatgattgatgacaaacctcagcagacatgattccatggtggcagtgaatgctgtcccctgtctggccgaaaccgctgctggcttcgataaacacaccatcatcagttattccaacagtctcaataagagactgctttgggggatccttggtgggtataaatacggagctcaatgggttgtctgacatccctttacccacgtgttcgttgtgaagaactatagaaatgttatgcttcttaagttcactccttggtccaatgccgctgatcaacaacagctgggggcttccaattgcgccggcagagacaataatctcactgcctctcttttggctaagaaaggcttgatgctgcccaccattctcatccttgaattgaaccccaatagcactctgtttctgatgtcctgtgcaagagatgaggttactataacaaaatgattgtgcagcaaccagcaagtacctactgtttttgtttgaagtatgtgttttcctagcttccttcttgtggaagtgagtgaattgcaaaaaacatcgacattgaaggctagggttgcaggaaccacagttctacagttttgtgccaaaaatcactaattccgagtctaattttttgcaaaaaac

SEQ ID NO: 3009 - DNA, 1098 bp, Triticum aestivum
ggaggcggcgaaggcaggacgaacggcttgcactggaacgccgcacagttgacgggcgggtgggcatagaaggcggcgcactgctgccgcgtccgctgagcggggcgattcggcaggcagttgtcccggtcgctgccccgaggcacgacgcgcgcgcacgccggcggctccccggtgaagaagttgtatgagaaggtgaaattcttgagccgcggcagagcacacacggcctgtggtatcggcccggagagcaggttgtgcgcgacgttgagctgctccagcttcctcagccccgccacctcctgcgtgagcgggccggcgagctggttgtggctgacatcgagcaccgtgagctcccgcaggcggccgagctccggcggcaggcatgactcgaggccgttgttgatgagcaagatctcgttgagcgtgccggacatgttggcgaggctggcggggaggcatccgccgaaggtgttgtgcgagaggacgaggacggagaccggcgagttgccgatgttgtccggaatctcgaagcggaagcggttgtggttgaagaagatggcgtcgagcggcttgtcgaagaggcggctgggcacgccgccctcgaactcattgaaccggaggtcgaggaaccggagcgccggcatgtcgagcacgacctcggggaagggcccgacgaagcggttgttgctgaggtcgagctcgtggaggaggctgaggcggcggagcgtgcccgggatcatgccgcagaagcggttggagttgaggtgcagcagcgcgaggtcggcgagcaggccgagctccggcgggaggtatcccgcgatgtcgccgtggttgaggtcgacgccggcgacggcgagcacgcgcgggtcggacggcagcggcgcgcagaagacgcccgtgtagttgcagacgtccgggccggcccagtcggcggtgaggttcttcgggtcggagaagatggcgtggcgcttccaggtctgcagcgccacgtaggcatcctcgatgcggcggctcgggaaccgccacgacggatccacctccaccgccgccgccgtgccggccccctcgccccctccgtcgccggagaagcccggc

SEQ ID NO: 3010 - DNA, 788 bp, Triticum aestivum
gtttgagcctccttccagtaaagaaacagacggcagcactactgaggacataggtcataaaaagatggctgatctctcctcccacttcagtcggctgttacaatcctgtggagaacttgagagctattcagcgttcaccgaatacctaaaaggcctatctccgtcatctttagatatggaactacggatgctacagataatagatgacgacgaggtggaagagtctgaggaaccaagacccgagctccagttcatctcattgctgctggactacttcattcatgagctttcctgcaggaacaacttcgagtttgttcaagctgttctgaaattgtttctgaagatacatggtgaaacaatacggcgccactcgacgctacaggagaaagtgaggaaacttctagacgtccagagcaaggtctggcagaagatcgacaaaatgtttcagagctcgcgatgcatggtcacattcctcagcaactcgcagttttagttgcaggtcccgatttctgaaatcatgcatacctgggagtccatgtggctgttgtacccttctgctgtacctcaccgtttcgtcgtcgtggtaaaagctgcaaggcatatatacggtgttgttaacagagatgaccacagattgtgctcctggtgatgatgtaacagttttgttcctgtattcttttgtaacatacagatgtatgagcactgttcagcgagaaatattcgggaatgtcgcagttgccagttaggcgaaacatcccctaaatgtttattcagcattttactttagt

SEQ ID NO: 3011 - DNA, 846 bp, Triticum aestivum
caaagggtggatctgttaggaatttcctgaataggaggcagaacaggtctgttccactgaagctggcagtgaagcaggcactagatgttgcacgtggcatggcttatgttcatggccttgggttcatccacagagatcttaagtcagataacctcttgatttctggtgataaatcgatcaagatcgctgacttcggagttgctaggattgaagtgaagaccgaggggatgacacctgaaacaggaacataccgttggatggctcctgagatgatccagcacagaccatacaatcagaaagttgatgtctacagttttggcattgtcctgtgggagctaataaccgggacccttccttttccaaacatgacagcagtgcaagctgcatttgctgtggtgaacaagggtgtccgcccagccataccccatgactgcctacctgcccttggggagatcatgacaaggtgctgggatgcaaaccccgatgtccgccccccttttaccgatgttgtgagaatgctggagcgtgtggagatggaggtcctgaaaaatgtccgcaaggccagattccgatgttgcatctcccaacccatgaccttagactaaagcaggcagaatccaggagaagagaaagcaatctggagagaagttaaatcccatgtatttatcatattaatacttttggtacagaagcggaaaagcccacctgagcatacgtgtgtgctcgggcttcacatatttatcttagaccataccatagtccctgtcgtcgtcttaaaactgtcattgtactggagacaggtttatccttaacattgtcagaacattgtcatgcggtttcctctgg

SEQ ID NO: 3012 - DNA, 641 bp, Triticum aestivum
ttgctgacttcggagttgctaggattgaagtgaagaccgaggggatgacacctgaaacaggaacataccgttggatggctcctgagatgatccagcacagaccatacaatcagaaagttgatgtctacagttttggcattgtcctgtgggagctaataagtgggacccttccttttccaaacatgacagcagtgcaagctgcatttgctgtggtgaacaagggtgtccgcccagccataccccatgactgcctacctgcccttggggagatcatgacaaggtgctgggatgcaaaccccaatgtccgccccccatttaccgatgttgtgagaatgctggagcgtgtggagatggaggtcctgaacaatgtccgcaaggccagattccggtgttgcatctcccaacccatgaccttagactaaagcaggcagaatccaggagaagagaaagcaatctggagagaagttaaatcccatgtatttatcatattaatacttttgatacagaagcagaaaagcccacctgagcatacgtgtgtgctcgggcttcacatatttatcttagaccataccatagtccctgtcgtcttaaaactgtcattgtactggagaaaggtttatccttaacattgtcagaacatc

SEQ ID NO: 3013 - DNA, 616 bp, Triticum aestivum
tgggcgtattcggattgggcaaagaatcactctggtgacccagagattgatgaagcttttaaagaagggagaagatgctggccttgccttggtgaagaaagcgtatgtgtacattcacaagaatgggtacaagacaaagttgatggccgctgccgtgcgcaacaagcaagacgtgtttagccttctggggatcgactacatcatcgcgcccctgaagatactgcagtccttggatgaatctgtgacctattccgatgaaaagtacggttatgtccagaggctgactccttcgcttgacaagatgtacaacttcagccaagaggagcttgtgaagtgggaccagctgagcctggctgcggcgatggggccagcggcggaggagctgcttgcttctgggctggaggggtacgcaaaccaggcgcggcgcgtggaggagctcttcgccaagatctggccaccccccaatgtttgaacttcaacttgaagccgtttcttctttcttaatatattttcgttccaacaaagggtgttttgtttgttcctgtcaacatgtttacttttgtccttggagtgtcagccggacttgaaatctgaatcgttttgtggaaatatgaat

SEQ ID NO: 3014 - DNA, 763 bp, Triticum aestivum
ggtattcaaatcctgctacatggcaagtatagaagcttcaagattactggaatctgaaggaacctcaacacatgtgaacattcgtttacagttttgcacacagcagcagctgcagcgcaagctggtgcatccgtcgtacaaatatttgtggggcgtattcgggattgggcaaagaatcactctggtgacccagagatcgatgaagctttaaagaagggagaagatgctgggcttgccttggtgaagaaagcgtatgtgtacattcacaagaatgggtacaagacaaagttgatggccgctgccgtgcgcaacaagcaagacgtgtttagccttctggggatcgactacatcatagcgcccctgaagatactgcagtccttggatgaatctgtgaccgattccgatgaaaagtacggttatgtccagaggctgactctttcgcttgacaagatgtacaacttcagccaagaggagcttgtgaagtgggaccagctgagcctggcggcggcgatggggccagcggcggaggagctgcttgcttctgggctggaggggtacgcgaaccaggcgcggcgcgtggaggagctcttcgccaagatctggccaccccccaatgtttgaacttcaatttgaagccgtttcttcttccttaatattttcgttccaagaaagggtgttttgtttgttcctgtcaacatatttacttttgtccttggaatggctgccggacttgaaatctgaatcgttttgtggaaatatgaat

SEQ ID NO: 3015 - DNA, 1353 bp, Triticum aestivum
cttcccccgatcccagctccacccatggcgctctccatttccgcacccacctcgtctcccttcctccccgccccccgccaggccggcaggtggagctcgtcaccaagctcggctaagcccgcggtttttagcctccggaggccggttgtggcggcacgggccgccgccggcaacgcgccctcttcccccgcaggcgcggtcgtaactgagctcgacgtggtctccagcttcagcgagatcgtgccggacacagtcgtgttcgatgattttgagaagtttgcaccaacggcggtcaccgtgagctcttcactgttgcttgggatcgcagggctaccggatacccagttcaagagtgccatagataccgcattggtagatggtgaatgtaacacaatggagaagcccggggaccggatgtcctgttaccttaccaaggccctggcggaatgttggagctgagctggctcatcaagttcctggaagagtgtccacggaaatagatgctcgattggcttacgatacccaaggaatcgtccagagggtgcatgaactgttgcagatatacaatgaacatgatatcccatcagaacgtctgttattcaaaattcctgctacatggcaaggtatagaagcgtcaagattacttgaatctgaaggaactcaaacacatctaacattcgtttacagttttgcacaagcagcagctgcagcgcaagctggtgcatcagtcgtacaaatatttgtggggcgtattcgggattgggcaaagaatcactctggtgacccagagattgatgaagctttaaagaagggagaagatgctgggcttgccttggtgaagaaagcgtatgtgtacattcacaagaatgggtacaagacaaagttgatggccgctgccgtgcgcaacaagcaagacgtgtttagccttctggggatcgactacatcatcgcgcccctgaagatactgcagtccttggatgaatctgtgaccgattccgatgaaaagtacggttatgtccagaggctgactccttcgcttgacaagatgtacaacttcagccaagaggagcttgtgaaatgggaccagctgagcctggcggcggcgatggggccagcggcggaggagctgcttgcttctgggctggaagggtacgcgaaccaggcgcggcgcgtggaggagctcttcgtcaagatctggccaccccccaatgtttgaacttcaatttgaagccgtttcttctttcttggtattttcgttccaacaaagggtgttttgtgtgtcaacatgtttacttttgtccttggaatgtctgccggacttgaaatctgaatcgtttgtggaaatatgaaggc

SEQ ID NO: 3016 - DNA, 469 bp, Triticum aestivum
  misc_feature (15)..(15): n = any nucleotide
caaagttcccagatngtcgcgccaaatgcgagccatgatgacaacagtctggacttacttttagttggcggaagggggagatggaagctgttgagatttttcatactactgcaatttggtcgccatctttctttgccatatgtggaatatgtgaaggtgaaatcagtcaaggttaaacctggtgcaaacacccacaatggctgtgggatagacggcgagctctgccgcgtcaaggggcaggtagtctgctccatgctaccggagcagtgcaggcttattggccggcaatgtaaacagtctatttaagcgccatgaatctgccgagcttcacgagtttttgaggcgctgtatgatctgttgtcacttgtaacagttgatttttgagttgtctatattatcgtttacttgccagtgagggtgcgagtgactggtcggtctgacaatgttgtgacggttctgtatatttgag

SEQ ID NO: 3017 - DNA, 905 bp, Triticum aestivum
caacattgtttcgtaaccagaagaagtcctacgccctcaacagcatcatgcatcatactggccaagaacgaggtccaaaacaaggaccgatagaaattcagttggtgtcacagcttctaatgatacacggttatcttgggcagccccttcaatgcatgataaggaggacatttcctcgacaatatcagatccaggacctatttgggataatgaaccaaagtgggacactgggccaagatgggacacagagccaacttgggagcctgaccatcctatcgaacttcctgaaccaccagaagatatagaaatcggaacatctatggaacttgtgccaaatttggatgagaaatgggttgtcaggaaggggcactttcttggtgtcctagtatgtaaccactcgtgcaaaacagttcaaagttcccagattgtcgcgccaaatgcgagccatgatgacaacagtctggacttacttttagttggcggaagggggagatggaagctgttgagatttttcatactactgcaatttggtcgccatctttctttaccgtatgtggaatatgtgaaggtgaaatctgttaaggttaaacctggtgcaaacacccacaatggctgtgggatagatggtgagctctgccgcgtcaaggggcaggtagtatgttccatgctaccggagcagtgcaggcttattggccggcaatgtaaacagtctatttaagcaccacaagtctgccgagcttcacgagtttttgaggcgctgtatgatctgttgtcacttgtaacagttgattttgagttgtctatattatcgtgtacttgccaatgagggtgggagtgactggtcgatcagacaatgttgtgacgtttctgtatatttgagtgattatagagggacgcctccatcc

SEQ ID NO: 3018 - DNA, 623 bp, Triticum aestivum
tatcgaacttcctgaaccaccagaagatatagaaatcggaacatctatggaacttgtgccgaatttggatgagaaatgggttgtcaggaaggggcactttcttggtgtcctagtatgtaaccactcatgcaaaacagttcaaagttcccagattgtcgcgccaaatgcgagccatgatgacaacagtctggacttacttttagttggcggaagggggagatggaagctgttgagatttttcatactactgcaatttggtcgccacctttctttaccatatgtggaatatgtgaaggtgaaatcagtcaaggttaaacctggtgcaaacacccacaatggctgtgggatagacggggagctctgccgcgtcaaggggcaggtagtctgctccatgctaccggagcagtgcaggcttattggccggcaatgtaaacagcctatttaagcaccacaagtctgctgagcttcacgagtttttgaggcgctgtatgatctgttgtcacttgtaacagttgattttgagttgtctatattatcgtttacttgccaatgagggtgcgggtgactggtcggtcagacaatgttgtgacggttctgtatatttgagtgattatagaggggat

SEQ ID NO: 3019 - DNA, 918 bp, Triticum aestivum
gttctagatcgcggcggcggcaatacattgcagaggatgggagtcggtctacaacaatcctaaaaaaccagcgtttatgggttgttaggtccaacgacactggctcagacaatatggcaacataagcgatggagcgagggtaacttatcaattttcctttccaagtacaacgtgttcttgtttgggcatggaaaaaccaagctacggcatcagatgggctaccatatctatggactatgggcacccaactcactcgctacgctgtattatgttatcatcccttcactggccctcctcaaaggcaccccccttttcccagagattacaagtccatggattgcacccttcgtatatgtcttctgtgtgaagaacatgtacagcctatatgaggcactatcatctggagacacgctgaaaggatggtggaatgggcagaggatgtggttggtcaaaagaataacctcgtacctctttggagtccttgacaatctccggaagttatttggactgtcaaagatgaattttgtggtttcaccgaaggtaagcgatgaagacgagtccaagaggtatgagcaagagattatggaattcgggtcatcagatccagaatatgtgatcatcgggactatcacgttactcaaccttgtttgcctgctgggagggctaagtaaagtcatgaaagttggatggaataatatacacttggatgcacttttcccccagctcattctctgtgggatggtggtgataaccagtatcccattctatgaagcaatgttcctgaggaaggacaaaggcagaataccattcccagttacactagcttctattggctttgtgatgttggctttactgccagcaatagtttaaggtcccacaagaggcatcagtgtgtaattaagtactcaaagttgtatg

SEQ ID NO: 3020 - DNA, 933 bp, Triticum aestivum
attttgggcggcgtatctgggagtcggggaaggcttactattgtgttacgaagggaattccttatccatctttgcccaagaaggaaaaaccgaggcgtgtggaattgtacttctcgagttggcgtattagacctgttcaatcgcccaaaaaagacggccagcaacccatggcatgtgaagtaactctgtttcactacgaggatatgggcatacccaaggatgttgctaaagttggtgtccggcacggcatgtggggtgctgttaaaaagctgcagtccggctttagagcatatcagctaatgagaaaatcagaaaacatcctgtcacgcagtgccatcatggctcgtgtgaccaccaagacatgcattgctagttctgatggctccttggatcaagggcccttcagcacagaacaagccagtacagaggacgacaactctaggtcagtccaacatggttttgactggaagtgggtggtggtcggtggcgcggtggctgccgtctgcgtgcttaacaccggaattgtagggaaggccctcttacttggagctgcaagaaagcaggcaaagaagtgatgagcatctaccagcatccacaaagtgagcttcacggccatcagggcctgtctctgtctagaaagtcgcaatcgagaccgaggataaaggaatgaaatatcatactacaggatgcagataattcgggtgcctaattttggatgtgccttttaagcagtatcgcagatgtgtcttgccataaccgattatgtggtatcaggaatcgttagatgacgatgtatctgaagatatatgagttctgttaacaacatttgctaactaacaagtcccaagtttgcacttttcagctttgtacgttccattgggtttttcccgatgtttgctgacgattacctcgtgtggtgctgaattgaagtgc

SEQ ID NO: 3021 - DNA, 950 bp, Triticum aestivum
ggagtcggggaaggcttactattgtgttacgaagggaattccttatccatctttgcccaagaaggaaaaaccgaggcgtgtggaattgtacttctcgagttggcgtattagacctgttcaatcgcccaaaaaagatggccagcaacacatggcatgtgaagtaacactgtttcactacgaggatatgggcatacccaaggatgttgctaaagttggtgtccgccacggcatgtggggtgctgttaaaaagctgcagtccggctttagagcatatcagctaatgagaaaatcagaaaacatcctgtcacgcagtgccatcatggctcgggtgaccaccaagacatgcattgctggttctgatggctccttggatcaagggcccttcagcacagaacaagccagtacagaggacgacaactccagggcagtccaacatggtttcgactggaagtgggtggtggtcggtggcgcggtggctgccgtttgcgtgcttaacaccggaattgtagggaaggccctcttacttggagctgcaagaaggcaggcaaagaagtgatgagcatctaccagcatccacaaagtgagcttcacgaccatcagggcctgtctctgtctagaaagtcgcaatcgagaccgaggataaaggaatgaaatccataccatactacaggatgcagataattcgggtgcctaattttggattgtgccttttaagcagtatatcgcaaatgtgtcttgctataaccgattatgtggtatcaggaatcgttagatgacgatgtatctcaagatgtgagttctgttaacaacatttgctaacttccaagttccaagagtgcacttttcagctttgtacgttccattgggtttttcctgatgtttgctgacgattatcttgtgcggtgctgaattgaagtgcatattgactgcggaagaacctgtatgaagct

SEQ ID NO: 3022 - DNA, 828 bp, Triticum aestivum
ctaaagccggatatattggcaccaggcctcaacatcctcgccgcgtggccgccaagcacgggctctggaaggggcactttcaacatcatatcaggaacatccatggcgacgccacacgtcagtggtgtcgctgcgcttatcaaaagcatccatcctgactggtcgccagccgccatcaaatctgccatcctaacgacgtcggacatcgttaatagcactggtggctcaatcttggacgagcaacataggaaggccggcgtgtatgacacaggcgccggccatgtgaacccgaccagagccgcagatcctggcttggtgtacgacctcagcgtcaccgactacgccggctacatctgctggctcctcggtgacagcggcctagcaaccatcgtgcgcaactcaagcttgacctgtgcgaagctgcccaaggtccatgctgtgcagcttaactacccgacgataaccgtgtcagcgacatcgacgccattcacagtgaagcggactgtgacgaacgttgggccagcaaactcgacgttcacggcgaaggtggacgcgccaagatcactgacagtgcgtgtctccccggagacgctgggattctccaaaaccggagagaagaagaccttcagcgtgtccgtgagcagccacggcttgggcgaggaactgcacttggagggaagcttgagctgggtatcggagaagcatgtcgtgcggagccccatcgttgctgtctccccaagaggcgatactgctccggacccatcaccatgaatgatgtacgtgccgtgaaatcagtaaatgtttactttgtcaacatcaataataaat

SEQ ID NO: 3023 - DNA, 849 bp, Triticum aestivum
  misc_feature (814)..(814): n = any nucleotide
tctcttcccgtggtccaagcgtcgtcgccctcggcatcctaaagccggatatattggcaccaggcctcaatatcctggccgcgtggccgccaagcacgagctctggaaggggccctttcaacatcatatcaggaacatccatggcgacgccacacgtcagtggtgtcgctgcacttatcgaaagcatccatcctgactggtcgccagccgccatcaagtctgccatcctaacgacgtcggacatcgttaatagcactggtggctcaatcttggacgagcaacataggaaggccggcgtgtacgacacaggcgccggccatgtgaacccgaccagagccgcagatcctggcttggtgtacgacctcagtgtcactgactacgccggctacatctgctggctcctaggtgacagcggcctagcaaccatcgtgcgcaactcaagcttgacctgtgcaaagctgcccaaggtccacgccgtgcagcttaactacccgacgataaccgtgtcagcgacatcgacgccattcacagtaaagcggactgtgacaaacgttgggccagcaaactcgacattcacagtgaaggtggacgcgccaagatcactgacagtgcgtgtctccccggagacgctggcattctccaaaaccggagagaagaagaccttcagcgtgtccgtgagcagccacggcttgagcgaggaactgcacgtggagggaagcttgagctgggtatcggagaagcatgtcgtgcggagccccattgttgctgtctccccaagaggcgatactgctccagacccatcaccatgaatgangtaattagtagatgtttactttgtcaacataataa

SEQ ID NO: 3024 - DNA, 499 bp, Triticum aestivum
gcagaggtactatgtgatagactcagtatttttgttgatggtggtttccaatgcattggaaatccgaaagagctaaaagcaagatatgggggtacctatgtgctcacaatcacaacatctccggaacatgagcaggaggttgaacaactggttcaccgtttatcgccaaatgcaaacaggatatatcacatatctggaacacagaaatttgagctgccaaagcaggaggtgaagatagcaagcgtcttccatgaagttgagagtgcaaaatgccgttttagcatacacgcttgggggctcgctgacaccaccttggaagatgtcttcatcaaggttgcccagggagcacaagcctttagtgtgaatgcttaactagtatatctgattaataggttattgttctttccatttgtgataaatatatggtgtataattcttgtttgaactcgctgtaacttttgtttattataatactgagttgtaaattagtgttgtaaag

SEQ ID NO: 3025 - DNA, 721 bp, Triticum aestivum
  misc_feature (180)..(201): n = any nucleotide
ctcgtcatcgcgctggtctccggggcgatggtcctcatgctgcagcaagacgagcagcggaacagcgcgccgctgccgccgtactacgacgcgcctgtcgccagcggcggcatcgcccccaagccggccgtgacagccgcgcctcgcacctcaggggtggcgatggaaacaggcgggtcnnnnnnnnnnnnnnnnnnnnnncagggctcggcacgtggtggtgccggcggcaagcggatggacgagttcgtcctgatgagcaagtcgagcggcgagttcgggctgcaggacatgatgaaggcttcggcggaggtgctcggcaacggcacactcgggtccgcgtacaaggccgccatgcgaaacggcatcaccgtggccgtgaagcgcatgcgcgacatgaaccgcgtcggccgccaggagttcgagaaccacctccgcgtgctcggagagctccgccaccccaacgtgctggctcccctcggctaccattaccgcaaggaggagaagctcatcgtctctgagctcatgccacgcggcagcctcctctacgtcctccacggtaagaccgtaattacgatccaatatgattactacggccgtcggtgcaggtagtcggtacaccatgcatagtcgtcgtaggagctaactttgtgcctatgtttgatgagcaatcatcgcaacattgtcaaaaccgacaacaaagtagagggagatgaggtgg

SEQ ID NO: 3026 - DNA, 941 bp, Triticum aestivum
gaacaaaaggcctcctcagatatacttcaagaggaagaagactggtgggatttctttcaacagcacagcacctttaactcatattgatgagaagctctgctatcagatactgcatgagtacaaaattcataatgcagaggtattattccgtgaggattctactgtggatgatctgattgatgtgattgaaggaaatcggaagtacatcaagtgtgtttatgtatataataagattgatgttgtgggtattgatgatgtggataatcttgctcggcaaccaaattcacttgttatcagctgcaatttgcagttgaacttggacaggctattagcaagaatgtgggaggaaatgggtctggtgagagtgtatacaaagccgcagggtcagcagcccgatttcggagatccagtggttctttctagtgataggggtggttgcacagttgaagacttctgcaatcacatccacaggagcttactcaaggatgtgaaatatgtgctcgtgtggggaacgagtgctcggcactatccacagcattgtggtcttggccatggtcttgaagacgaggatgtggtccagatagtaaagaagaaggaaaaagaggagggcggacgaggccgtttcaagtcgcacaccaatgcacctgaccgaatctccgacagggtgaagaaagctcctctcaagacatgatcccatcgccgatgtggaactagctgagccggatgctattttgggcgaccatcaagcctggcatctccgcacaatcatatgacaaagtgttgcttttttccagatagtatatgtgctctcattctgtataagatgaggcaggcttgtgtacacgcagtgagtgtttttgccagcaaactttgcaaatgagttagttacagatgccacctcttgttatcgtactgtgtttggaacattaattaattaatgg

SEQ ID NO: 3027 - DNA, 983 bp, Triticum aestivum
gtacaggtaacatcaaattccctcttcgtagtctggaggcgggagattcggaagccatggcggaggagcagttcctggccgcagctgtgggcgccgccaagagcgccggcgagattatccgcaagagcttttacctaagcaagaaagtggagcacaagggccaggtggatttggtgacggagacggacaaggcctgcgaggatctcatcttcaaccacctccggatgctctatccggaccacaagttcatcggcgaggagacgtctgcagccctcggttccaccgatgacctcacctacgaccccacctggatagtcgaccccctcgatggcaccaccaatttcgttcatggctttccttttgtgtgcgtctcgattggcctcaccattggggaagattcccaccgttgcagttgtgtacaaccccatcatgaatgagcttttcacagctgttcgtggaaaaggtgcttttctcaatggttctccaattaaaacatcgcctcaaaatgagttggtgaaggctcttatggtgacagaggtagggaccaaaagagacaagtccactttggatgatacaaccaacagaattaataagttactattcaagattagatctatacgtatgtgtggctctttggctctaaacatgtgtggagttgcttgtggtaggctagatttgtgttatgagatcggttttggtggcccctgggatgtggctgctggagctttgattctaaaggaagctgggggttttgtttttgatccgagcggtgatgagtttgatctgatggcgcaaagaatggcaggatcaaatggccacctcaaggatcagttcatcaaagcattgggagatgcaagctgaataacttatttctcttttcaagtagaatgaaagaatgtaagatggccccaccaataagtaattaagggctaatttttgtgtagttttaagtggacactatatgcatattttgcaaacatggc

SEQ ID NO: 3028 - DNA, 855 bp, Triticum aestivum
acactgcagatacaccaggtggtattgtgacctaatttctatccacagatgtcctccgcaagtttgcaaagtcacagcttgattatattctaggcaagaacccacaaaagatgagctacgtcgttggttttggaaagaagtaccccaagcgcgttcatcacagaggggcatcaatccctcataacggtgtcaagtacggatgcaaaggaggttttaaatggagggagtctaagaaagcaaaccctaatatcctcgtcggagcaatggttgctggccctgacaagcatgatggcttcaaagatatccgcacaaattacaattacacagagcctactcttgcagcaaatgctggcctggttgcagcattgatttctctagctgacatcgatactggaagatactcaattgataagaacaccatcttctcagcagttcccccaatgttcccgacacccccaccaccgccatcagcttggaaaccgtgaagagtcagatccctgaacatttcataagcatcaaatggagggagcaacagatggttgtttggtatatacagcgaaggccacgaacagaaagcagacaacataagcttacagagtttctacttctgtatcggtatgacggatcagtataaatcatctgtcagccttgaactggaagttgtgtgcaatttgtgaaactaaattttgggtccttgttgttatccatattccgagttcgtgtgtgaagttctttttgtagaaatgctaccttagtaagtcattttgttttataggagtgacttattcgtcacagtaaagaatgtgtgacctttatacagcttgttttgacttgtttgacatgcattatacgcgg

SEQ ID NO: 3029 - DNA, 1287 bp, Triticum aestivum
gcttgccaagggagcttaacttcatcgagcataccagtgacatcggatggaaggagtatcagagggcgaagcctgtgatcgtcgacccgggcctatatagcctgcagaagtctgatgttttctggattacggagaaaagaagtgtgccaaccgcatttaagctcttcactggctctgcatggatgatgcttactcaccggtttattgaatactgcatatggggatgggacaatcttccgaggactgtcctgatgtattatgccaatttcctctcttcgccggagggttacttccacacagtcatctgcaatgtcccagagttccgcaacaccacagtcaaccatgatctacatttcatttcctgggataacccaccaaagcaacatcctcattacctcaccctcaatgactttgacggtatgcttaacagcaatgctccctttgcaaggaagtttggaagagaggatcctgtcctagacaagattgatcaggaaatactgggccgtcaacccgatgggtttgtgcccggtggatggttggatctgttgaatacaacagtgaaagggaaagacttcagcgtcgagcgtgtacaagatctccgcccggggcctggtgcggactggataaagaaactcgtcacaggcctgctcaccgaggaaggtttcgacgactagcattgcgtataaaaagtttgatgtttccagggtaggttactttggtcaaaatctgaggtgttgagccactagctagtcattctgctagctgaagaagcggcacatagtgtcgacgatccgcacggatggagtgatctgataggtgttccttattatagacaaccactttgagttgagttaccgtacagcaggagaccacggccgccgtagcatgcagagtttatacaccactaatagctcattaggttatgttagaagattatatcagcccaaccattattaataatatcggaatttttcggtctctcggcgctgctggctgtcgtcgaaggtggtccgttcttcctgtagaaaccacagggcccgagccatcagcgcatgagatttcgttgtattaattgtggattcctccgggcaaacttctacgttttggttgcgtacatgtattctttgatttcttttccttctcccacggctgagtatacaaaattgccttatgcactgtttcctctcttcctttggtaaatatgcatactataagtttttgttggagcttaaatggtactctgtctgttcacaattataagatgttctactccccggctgagtagct

SEQ ID NO: 3030 - DNA, 860 bp, Triticum aestivum
catttgaatcctattgctaccgatctcttattgatgggatggagcacattgcaatgatcaagggtgatgttggggatggccaggatattctagtgagagtccattcagagtgcctaactggagatatatttggatcgtcgaggtgtgattgtgggggccaacttgccctggcgatgaccatgatcgagaaggctggtcggggtgtggtggtttacctacgtggccacgaaggcaggggcattgggctgggtcacaagctccgggcatacaatttacaggatgctggacgggatactgttgaggctaatgaggatcttgggttgcctgccgactcccgggagtacggtataggcgcgcagatactacgtgatcttggcgtccgaaccatgaggctgatgactaacaacccggcgaagtacactggactcaagggctacggtttaagtgtcctgggaagagtgccgctgttgacaccaataactaatgagaatcggcgttacatggaaacaaagaggttgaagatggggcacatctacgaagaccctcctaatggccatacaagtggcatgagtgacgaggagcaatatcaggaggatagtggcagcgaacaagattagaccctagagccttaataaatgtcttcatgtttctcccggcaataaaaataaaaccctcaaatttgttatgagcacttctttctccaattttgattatacatatgtagttactatttgtagatgatgtatattagtctggtctgagcatgtgccatgtgcaaaaatatattctcatgtactccctccaccttggtttgtaaggtttgcatgcatttcagtaaaaactttgatccttttcaataa

SEQ ID NO: 3031 - DNA, 685 bp, Triticum aestivum
tagcagcagcaaagtgtctgagaaggtggacgtgttctctttcgggatagcattatgggaaatcttgaccggtgaggaaccatacgcaaatatgcattgcggcgctatcatagggggtatcgtcaacaactctctccggcctccagtacctgaaacctgtgaccccgaatggcgaatactgatggagcaatgttggtcggccaatcccgatatccgcccctcattcactgaggtcacggataggttacgagccatgtcagcgatgcttcagtcaagggcacaggccccaggaagctgatgaagcttacatgccatcaaccagcaaaagatagctggctgatccccacgggctccttttgtgcatagacgagtatatagcatacctgtatttatggtcacactgtattctgtttgatgtatctatgcttatttttttgactattttatagggtttctgaagtatgtatgtatctgagttaacatgtaccgcaggcttttgtagcgtcggtcacgtttcttgcaattttttgtgtagtttgcgaaacttgtgatggtctaccagaccactcaagcttctatttttggggctttggttgtaaaagtatgagcattgtaattatatagcagatgaactggcaaaaaacatactgccacttttgaacctttataaatttagaaataaagt

SEQ ID NO: 3032 - DNA, 794 bp, Triticum aestivum
gagactttggattatcgagaattaagcgcaacactttggtttctggtggtgtacggggcacccttccgtggatggcaccggagctgttgaacggtagcagcagcaaagtgtccgagaaggtggacgtgttctctttcgggatagcattatgggaaatcttgacgggtgaggaaccatatgcaaatatgcattgcggcgctatcatagggggtatcgtcaacaactctctccggcctccagtacctgaaacctgtgaccccgaatggcgaatactgatggagcaatgttggtcggccaatcccaatatccgcccctcgttcactgaggtcacggataggttacgagccatgtcagtgatgcttcagtcaagggcacaggccccaggaagctgatgaatcttacatgccatcaaccagcaaaaaattgccggctgatccccacgggctcctttttgtgcatagacgagtatatagcatacctgtatttatggtcacactgtattctgtttggtgtatctatgcttattttttgaccattttatagggtttctgaagtatgtatgtatctgagttgacatgtactgcgggcttttgtaggctcggtcacgtttcttgcaatttttttgtgtagtttgtgaaacttgtgatggtctgccaggccactcaagcttctatttttgggcctttggttgtaaaagtatgagcattgtaattatatagcagatgaactggcaaaaaacatactgccacttttgaacctttataaatttagaaataaagtcgaggtttttgctt

SEQ ID NO: 3033 - DNA, 707 bp, Triticum aestivum
catggcagcgcgccgtgagacgcgcgcgaaggccgtggctgttcgcgttcgccggtggcgcgcgggcgcacgacggcagcaacaagaacattaacgccgtcgttcgcgacacgatcatcaaccagtgcgcgcggtcgtcggcggtgcgggctccttctgttcggcggctgtggtccggcgcaacgacttgctacgcgccgagcaacgtcatgcggctgttcaagagcgccgccttctgcctgcagccccagggggactcgtacacgcggcggtcggcgttcgacgccgtgctcgccggctgcgtgccggtgttctttcaccccgggtcggcgtacgtgcagtaccggtggcatctgccggcggatcaccgcaagtactcggtgttcgtgccggaggacggcgtgcggaacggcacagtgagggtggaggacgtgctccggcggatcggcgcgagggaggctggcggccatgagggagcaggtggtcaggatgattcccagcatcgtgtacagggacccaagggtcaaggctggcatccgcttcagggacgccgtggacgtcgccgtggacggcgtgatcgagagggtgaggaggatcaaggcgagggctggaggcctgatgtggggcatcagtgggatggttactttgacaagtagcgaaacacctctcttgctctgattttccgagacagaggagacaccaaaatg

SEQ ID NO: 3034 - DNA, 785 bp, Triticum aestivum
ttcgtgagttctgggctactcaaatggaagagattgagcaggcaactgacttcaagaaccacaccttaccactggcaagggataaaaaagataatgaaggctgacgaggatgtccggatgatctccgcagaagctcctgttgtctttgcaaaggcatgcgaggtgtttatcttagagttgacacttaggtcatggatgcacactgaggagaacaagcgccggaccttgcagaagaatgacattgcggctgccattaccaggactgacatctacgacttcttggtggacatcattcccagggatgacatgaaggaggaaggccttgggcttccgagggtgggcttgccacctgctgctctaggggcaccggctgatgcctatcctccttattactatgtgccagcacagcaggtacccggagtaggaatgatgtatggtggtcagcagggtcacccagtggcatatgcgtggcagcagcctcaagggcaacaggccgaggaggctcctgaagagcagcagcagtctccctcaaactagccaagagattgatgcaatgaagccatgccatgatcctgaacttgatgcctataaactcaggcttgtgttaatttatttccgtcatcgttggccggaacagttactcatggttaggtcttagggggggttcctaatggtagcttcgacgctggtatgctaccggcggtaggaaaaaaaagattgtgatttgttaggtgatttgaaactgatttagtaaacagtaccttcgttttcgccctagtttctat

SEQ ID NO: 3035 - DNA, 1535 bp, Triticum aestivum
tcatcctccgccgcctcgaccacccctacgtcatgaagctctcggcctcgtcacctccgcattccgcagcctctacctcgtcttcgactacatggtccacgacctcgccggcctcgccgccagccccgacatcaagttcacactgccccaggtcaagtgctatgtgcatcagctgctgtcagggttggagcactgccacaaccagggagtgctgcaccgtgacatcaagggctcgaatctgctcttggatgacgacggtgtgctcaagattggggactttggtctggcgtcgttcttcgacccgaaccataagcaaccgatgaccagtcgcgtggtgacactctggtaccggccaccagagctgctgttgggtgctacagattatggagtgggcgtggacttgtggagtgccggatgtatccttgccgagctgctggctgggaagcctattatgccgggacggaccgaggtagaacagttgcataaaatatttaagctatgcggatcccccgctgaagaatattggaaaaaatcaaagctgcctcatgcaaccatatttaagccccagcagccgtacaaaaggcgaatagcagagacattcaaagatttcccgcaatcagcacttcggctgattgaaacactcctatcaattgatcctgccgatcgtttaacagcaactgatgcattaaatagtgatttctttaaaacggaacctcgtgcttgtgatccatcaagtctgccccaatacccaccaagcaaagagatggatgcaaaacgaagagatgaagaagctagacgtttaagagctgctggtagtagacctaatggtgatggagctaggaagacaaggacgcgggatcgaccaagggctgttccagcaccagaggcaaatgccgaacttcaagcaaatatcgacaaaagaaggctaataacgcatgcaaatgcgaagagcaagagtgaaaagttccctccaccacatcaagatggcgcactcggctatccgttgggttgttcgaatcacatggaacctacatttgagcccccagacccgtcttcgttcagtaccgtatttccgtatgacaagaccgccgtgcctacatggtctggaccactggtcgaccctcctgggggcaaccagaaacgaaaacacaagtcgggacgctcttcgaaacaaccatcaactgcccgtgctcggtgatacgttatgtgatatttggtgcataagaaattcttcaatatggacaaattactcggcaacagttcctggaagctggggagatctgattatacgaccaaggcaagcagcgatgaattttttcaagacccatgaattcattccatgtacggattcttttcaaaccgcagtgtatagatgggagagggagctcagttagtcgaattctgtacattaggttatcctttttgatttcttacaagcagctatatgtcatgttagattcgtttgagtgagtaatggaactttttaggtctacttggcatgccactgcaacttactgttaactcttacagcagtg

SEQ ID NO: 3036 - DNA, 653 bp, Triticum aestivum
tcaccgccggtttcttgtccgcagagagctcgatcttttctgcgaaagacttgcaggaacaagtgagaagtggtgagggaagcgctactgaactttttgagcttggagcagtgatgctccggagaaagttttaccctgcagctatcaaatatctacagcaagcaatccaaaaatgggacagagatgagcaagatcttgcacaggtgtacaacgccctcggggtgagctacaagcgggagaacaaactggacaaggcaatcaagcaattcgagaaggccgtggagctccaaccaggctatgtgacggcgtggaacaacctcggcgacgcatatgagcagcagaaggacctcgcgtcggcgctcagggcgttcgaggaggtattgctctttgatccaaacaacaaggtggcaaggccgcgccgagacgacctcaagtcgcgcgtgggcatgtacaagggggtgccagtgaagacgacggacaagcgatagcctagccgccacggatggacggattcgcggtttcctcagttttgaacagcacgtagcatctgttgtagcatctgtaaacatgatgagaagttgtatgtagcatattggtgtgatccatccagagctggctgctgtagaatattttgaatgttagcacaaaagaaa

SEQ ID NO: 3037 - DNA, 1059 bp, Triticum aestivum
cttgatttggaatcagacccctggcctaagatatctgacagtgcaaaggatcttataagaaagatgctttgcaattgcccttcagagcgtttgaaagcccatgaagtgctacggcatccctggatctgccaaaatgggatggccactgatggagttttggatcctagtgttatctctcggctcaagcggttctctgcaatgaacaatctacagaaattggctctgagagtgatagctgagcgtctttcagaagaggagattgctggattaagagaattattcaagacagtggacataaaaaatagaggcgtaatcacttttggtgagcttaggaaaggtctgacaagatatggcaacgaattggtggataccgagatttgtgatataatggaagcggctgatacagacactgatgtaaccataaactatgaagaatttattgctgcaaccatgcctctaaacaagatagagcgggaagaacacttgaaggcagcttttacatattttgacaaagatggcagtggctatatcacagtcgacaagcttcaacgagcctgtgcagaatataacatggaaggcactctccttgaagagattattttagaggccgatcagaacaatgacggtcaaattgattatgccgaatttgtagccatgatgcaaggcaacgctaatggtggcaatattggacttggacgtccaacaatggaaaccagtctgaatgtgaccttgagagatgcagctcaagtacattaatgcacagattttgttctcttctcattgccattatgtccacaacccaaattgggttgtgggcatgtacttccgaagtacgggaagagaacaggtcgattctttcggcggcatttatcgaaaataagctggtctagctagcagtacagtcattgtgagagacagcgtcgtgggttccatatagtaagtagttgtgtcctggttcatatgactgcaagactggctgctatccagcaggtggaagtaagagggcgtgcggcaagttcgtttgttctttgtgtgatcagttgtgtactttgtgtctaa

SEQ ID NO: 3038 - DNA, 1149 bp, Triticum aestivum
acatcagttcagctaggaactactattccattcactcatttatttcaatataaagcatacaaaacatgaaacctgtctttcttttatgcgactacacatgaaaactactctacccaccaatggcgctcgtatgcagtcggccagcctccctcctactcatcgcggctcttctctccgccgcaaccttccttgccgtcccggccgcggccacggggaagaccggccaggtggccgtgttctggggtaggaacaagaacgaggggtccctccgggaggcctgcgacaccggcacctacaccatcgccatcatctccttcctcgacgtcttcggccgcggcaactaccacctcgacctgtctggccacgacgtctccgccgtcggcgccgacatcaagcactgccagtccaagaacatactcgtcttcctctccatcgggggcttcggcaaccagtactccctgcccaccgcccagtccgcggcggacgtcgccaactacctctggaacgcctacatgctcggcacccgcaagggcgtctaccgcccgttcggagacgccttcgtcgacggcatcgacttcttcatcgagaacggcgcgccggccaactacgacgagctggccaagcggctatggaacttcaataaggacttccgcggcaggacgccggtgcagctgacggccacgctgcggtgcggctacccggaccggcacgtggagcgggcgctcgccacggggctcgtcggacgcatcttcgtcaggttctacgacgacgccgactgcgccgccaactggcagcgacagtgggacaagtggacggcggcgtacccttcggcgcagatctacctcgggctgccggcgtcggagcagaaggtcggttacgttcacccaaagaacctctactacagcgtcatacaggtggcgcagaaggcggccaactacggcggcgtcatggtgtgggaacgctacgaggacaagcggaccaactatagcagctacgccatccaatgggcttgagcctccgtcgctcacatccgtcaccgtgtgtgaatttggtgtatccgtctgtctactgcatactctgcatgtgtttgcttaccttacggtaaataagtatcaccagtgtgagaacggcgtttcggtgcccgggtgc

SEQ ID NO: 3039 - DNA, 762 bp, Triticum aestivum
cggatctaccgacagccgtcatcctcctccagcaatccccatgtgctctctgccccgctccgcctgatcccactcccagcgcatcccccttctcgagcgtaccccattcatccacatccgccaccgtcctccatgccctgcctccggtgtacctgacgacccgattcctcgccaacgaactcctcctcagccccccactttcccggatcctcgtcgccccggccgagcagaaaccggagccccgccgcagatccgcagggaggaggaggggggagaatggacgccccgtcggtggcgctctacaaccagctcaaggctgctcaaccattcttcttgttagctgggcccaatgtgattgaatcagaggaacatgtcatgaagatggccaagcacatcaaagccatcacgaccaagcttggggtgcctcttgtgttcaaatcaagctttgataaagcaaaccgtacatcgtcgaaatccttccgcggtcctggtctggaacaaggcctaaagatccttgaaaaggtgaaggccgcatatgatcttccagtggtcaccgacgtgcatgaaagctgccagtgtgaagctgttggcagagttgctgtatttatcgattccggctttctcgtgtgcagatgacctttatggctgggctagctgggacatttcctttccaaggcatctgtgctgctgttggccccttcggaatagcttgggcccatttgtgtggccgccctttggccacgttttgtcccccttggggca

SEQ ID NO: 3040 - DNA, 1426 bp, Triticum aestivum
gacgagaagggaaaagagccagaggaggctttgaaacagatatgtggtatctgcctctcagaggagcagagagctacaatacagggtgtgcttaattgctgctcacactacttctgcttcgcgtgcatcctggagtggtcaaaggtggagtcgaggtgtccactgtgtaaacggcgtttcaacacaattaccaagtcatcagtggcagatctaggattggggttgaggaatgctcccgttagggtagaaaagcgcgatcaggtataccagcccactgaagatgaaatgaggcgttggttagacccatacgaaaatgttgtatgtatagagtgcaatcaaggtggtgatgacaatctcatgttgctatgtgatatatgtgattcctctgcacatactttctgtgttggtctgggaagagaagtacccgaagggaactggtactgtggtgggtgtagatccagtgtggaagggccttctcatgcacaaacacaggatagggtggttcaccgtggagatagtaacatgaacaccgccgatagcagttctggttcgttgggcagatctacaccaagtggagtgtccagagaccaccaccaataaacgttcagccttctttgcaaggatttgatctgaatctctctccaatagaaacccctgaggaagataagcgagccgagtcacatctctcagctgaacctgtatcaactcctactgggaggcatgcaactcttgataggaggcgtgccttgaaccgacgcattcgtattcttctatttagacctaggactgcaactaatgcttggcagaatagcattcagcatgacagaagcgcaccaggaacagaacaaaatcaacggatcacctgcacctctacagatgtgagcccatcatgttccagggctgattttatgcagagccagcagagtagctcacattttgtacagtctgcaagtaatcttaatcaatgcactgatgagggtggaagcaatttccgagaagtagcaaatgccaaggaccagctgattcctattgtcaagaagagcatcaagcacatttgtgcccggtctccattggatcaatcttctttcacgaatgtagcacggcgagcgacacacactatcttagcgttgtctgggattgcacacaacaaggatagggttgtttctacaccttttccttttcctagccattgttgccacgcctgtgatggccgagagccagcgtttctcatgagaaccatctgctcgtcatgcttcaactcattcgttggtgatgtcgtcagtcacatcgctaatatgttttcttgaagtaggtggtctttttaagctggcatttctctctctgctgtcgtcattctttgaatttatagacacttggaaagattatacggatacgaaggtgttaatgaatgttggatagcttgaaa

SEQ ID NO: 3041 - DNA, 1346 bp, Triticum aestivum
caggtataccagcccactgaagatgaaatgaggcgatggttggacccatacgaaaatgttgtatgtatagagtgcaatcaaggcggtgatgacaatctcatgttgctatgtgatatatgtgattcctctgcacatactttctgtgttggtctgggaagagaagtaccagaaggcaactggtactgtggtgggtgtagatccagtgtggaagggccttctcatgcacaaacacaggatagggtggttcaccgtggagatagtaacatgaacaccgccgatagcagttctggttcgttgggcagatctacatcaagtggagtgttccagagaccaccaccaataaacgttcagccttctttgcaaggatttgatctaaatctctctccaatagaaacacctgaggaagataagcgagccgagtcacatctctcagctgaacctgtatcaactcctactgggaggcatgcaactcttgatagaaggcgtgccttgaaccgacgcattcgtattcttctatttagacctaggactgcaactaatgcttggcagaatagcattcagcaagacagaagcgcaccagcaacagaacaaaatcaacggaacgcctgcacctctacagatgtgagcccatcatgttccagggctgattttatgcagagccagcagagtagctcacattttgtacagtctgcaagtaatcttaatcaatgcactgatgagggtggaagcaatttccgagaagttgcaaatgccaaggaccagctgattcctattgtcaagaagagcatcaagcacatttgtgcccggtccccattggatcaatcctctttcacgaatgtagcacggcgggcgacacacactatcttagcgttgtctggtattgcgcacaacaaggatagggttgtttctacaccttttccttttcctagccattgttgccacgcctgtgatggccgagagccagcgtttctcatgagaaccatctgctcgtcatgcttcaactcattcgttggtgatgtcgtcagtcacatcgctaatatgttttcttgaagtaggtggtcttttcaagctggcatttctctctctgctgtcatcattctttgaatttatagacacttggaaagattatacggatacgaaggtgttaatggatgttggatagcttgaaatatagatcatttctaaatgatgcattctcttttggaactaacttcttaattgacttgtcattagccatcctgacaagtttcaaggcttccagcaagctgctacagtcttcaatgatgatgccctccaatgatcttttttattgcgaacctgtgtaacttgcttttcctttctctcag

SEQ ID NO: 3042 - DNA, 609 bp, Triticum aestivum
agcaatatcccgccggcgttcgcaaaggggcttcgccctcagcccctaccgacaaagtagtggtgatcgcactgctcggtatggcagccaatgttcctcttggcatctggagggagcacaccacgaagttttcagtgcaatggtttgcggcggtccatgctgcagtgcctttcatagggatgctgaggaagtccatcctgatgccgaagagtgccatggcccttaccatagctgcctcaatattgggtcagacaattggttcaagagctgaacgtatcagattgaagagggcaaaattagcagcagagggccatggccatgaacatgctacccggattgaagctccggtgagcctgaaaactgggagctcaggtgctgtccagctctgggacccgctcggccttaggctcaaaggcggcgtgtctccagccctggttccgactgttggtgccatgtattgatgagatgatcatgcttcgttgcggcggctgtgataattgtatcaagaggttcagaaattgtttcttgtattcattgttattgtgtcttgtaaaggattactggctacattggattcttctccccacatgagtttgggtgcaatcaata

SEQ ID NO: 3043 - DNA, 712 bp, Triticum aestivum
aattggtggatcgtgcctcttgtcgcaaagctgctgacacccccagctggtatgaaactgacgtgccctcctgcgattgttgctgcccgtgcagcaatatcccgcacggcgtttgcgaaggggcttcgccctcagcccctaccgacaaaagtagtggtgatcgcactgctcggtatggcagcaaatgttcctcttggcatctggagggagcacactacaaagttttcagtgcagtggtttgcggcggtccatgctgcagtgcctttcatagggatgctgaggaagtccatcctgatgccgaagagcgccatggcccttaccatagctgcctcgatattgggtcagacaattggttcaagagctgaacgtatcagattgaagagggcaaaattagcagcagagggccatggccatgaacatgctacccggattgaagctccggtgaacctgaaaactgggagctctggtgctgtccagctctgggacccgcttggcctcagagtcaaaggcgccgtgtccccagcgctggttccgactgtcggtgccatgtattgatgagatgatcgtgcttcattgcggcggttgtgagaattgtatcagagttccagaaattgtttcttgtattcattgttgttgtgtcttgtaaaggattactggctacattggattcttctccccactatcatgagttgggtgcagtcaataaatttca

SEQ ID NO: 3044 - DNA, 627 bp, Triticum aestivum
ctgcccgtgcagcaatatcccgcacggcgtttgcgaaggggcttcgccctcagcccctaccgacaaaagtagtggtgatcgcactgctcggtatggcagcaaatgttcctcttggcatctggagggagcacactacgaagttttcagtgcaatggtttgcggcggtccatgctgcagtgcctttcatagggatgctgaggaagtccatcctgatgccgaagagcgccatggcccttaccatagctgcctctatattgggtcagacaattggttcaagagctgaacgtatcagattgaagagggcaaaattagcagcagagggccatggccatgaacatgctacccggattgaagctccggtgaccctgaaaactgggagctcaggtgctgtccagctctgggatccgcttggcctcagagtcaaaggcgccgtgtccccagccctggttccgactgttggtgccatgtactgatgagatgatcatgcttcactgcggcggctgcgagaattgtatcaagagttccagaaattgtttcttgtattcattgttattgtgtcttgtaaaggattactggctacattggattcttatccccacatgagtttgggtgcaatcaataaatttc

SEQ ID NO: 3045 - DNA, 710 bp, Triticum aestivum
gtgctggatgtaccatgatcacatcaatgttgtcgttagctatgggaaaacctgccaggaaggacttagcaatgactggtgaagtaacattgactggaagaatcctcccaatcggcggggtaaaagagaaggccattgctgccaggcgaagctcgataaagacgatcatatttccagcagcaaacaaaagggatttcgatgagcttgctgctaacgtaaaggagggtctcgaggttcactttgttgacacatacagtgaaatatacaagatagccttccagaacgagacagaaacaagctagcaagcaattcaaacagagtattcagattgcgcgaggtctttggggcaagactgaatactgaacgaagtttgcagctaggccattctttgcaagatcaggagtaactttttgttgtaatgattgttttttcctagtgccccatgtgacaatatgttttaaggaaattttgacgagaatgtccgtagctagatagctgaggagccatgtcaaataagaaaaattagaggtttgttacaaacccaagaatgtacaagttttgccttttctttaatgattttacgattgttttattatggactttgttggtatcttcaaagtctgtttatttctttccttatattctccaatagacaccgcaggtgtacaccttgagatatgctcttgtgcacacacatacatctgcagctg

SEQ ID NO: 3046 - DNA, 627 bp, Triticum aestivum
gatctagaactagtcctgaaaaatttcagctccactgagactttaaatgccgaggacaaattcttctgtgacaatgttgcagtttgcaagaagcacagaagagaatgaagatcaagaaggctccccatatattggtgatccacctaaagcgctttaagtacattgagcagcttgggcggtataagaagctttcgtatcgggttgtcttccccatggagctgaagatcagcagtacatctgatgatgtggatactgaatactctctctttgctgtggtggtccatgttggaagcggccccaatcatggccattatgtaagcctcgtaaaaagccacaaccactggttgttcttcgatgatgaaaacgtggagatggttgaagagtcaaccctgcaaacattcttcggttcttcgcacgaatactcaggcaacacagatcatggatacatcttgttttacgagggccttggtgcgaagagtttaggttgattttccctgttgtttttcttttctctttctttggagcatgcaagtttactgttgtatgtacacagctatttcaccacctccatgggaaattgttaatctcagagattgtgagtatgaacctgaggaaagccagattttt

SEQ ID NO: 3047 - DNA, 1049 bp, Triticum aestivum
  misc_feature (742)..(742): n = any nucleotide
tcatgagttcttaaattttctgttgaatgagcttgttgatattctggagaaagagtccagtgctgcgaaggactcaccccaatcatcatctcctgaaaaagttccaaatgggccagttcaacctttggccaatggagttaaaaaagaaccacctgttaccttggtccataagaatttccagggcatactgaccaatgaaaccaaatgcttaagatgtgagacagtaactgcaagggacgaaacgttttttgatctgagtgttgacattgagcagaatagttccattacaagctgcctgaaaaatttcagctccactgagactttaaatgccgaggacaaattcttctgtgacaaatgttgcagtttgcaagaagcacagaagagaatgaagatcaagaaggctccccatatattggtgatccacctaaagcgctttaagtacattgagcagcttgggcggtataagaaactttcgtatcgggttgtcttccccatggagctgaagatcagcagtacatctgatgatgtggatactgaatactctctctttgctgtggatggtaccatgattggaagcggccccaaccaatggaccaatataatgtaagcctcgtaaaaaaagccacaaaccaactggctgttcttcgatgatgaaaacgtggagatggttgaagagtcgaccctgcaaacgtttttcggcttctttcgcacgaatactcgggcaacacagatgcatggatanatcttgttttacgagggccttggtgggaagagtttaggttgattttccctgttgtttttcttttctttttctttggagcatgcaagtttactgttgtatgtacacagctatttcaccacctccatggaaaattgttaatctcggagattgtgagtatgaacctgaggaaagccagattttttgtggttctagtgtacagcggaaaatggaaccttgctccagtgatgatgaaataaggcggcgcaagtcataaagtacgctcgactatactttccaccgacattctcaccaaggaatgtaacaatgc

SEQ ID NO: 3048 - DNA, 702 bp, Triticum aestivum
tgtgagacagtaactgcaagggacgaaactttttttgatctgagtgttgacattgagcagaatagttccattacaagctgcctgaaaaatttcagctccactgagactttaaatgctgaggacaaattcttctgtgacaaatgttgcagtttgcaagaagcacagaagagaatgaagatcaagaaggctccccatatattggtgatccacctaaaacgctttaagtacattgagcagcttgggcggtataagaagctttcgtatcgggttgtcttccccatggagctgaagatcagcagtacgtctgatgacgtggatactgaatactctctctttgctgtggtggtccatgttggaagcggccccaaccatggccattatgtaagcctcgtaaaaagccacaaccactggttgttcttcgatgatgaaaacgtggagatggttgaagagtcgaccctgcaaacattcttcggttcttcgcacgaatactcgggcaacacagatcatggatacatcttgttttacgagggccttggtgggaagtgtttaggttgattttccctgttgtgtttcttttctttttctttggagcatgcaagtttactgttgtatgtacacagctatttcatcacctccatggaaaattgttaatctcggagattgtgagtatgaacctgaggaaagccgcatctttttgtggtt

SEQ ID NO: 3049 - DNA, 1282 bp, Triticum aestivum
ggcgctcgctcgctacttacgctgaccaaatacagattggactagctggtaatctgagggattatgtactaataactcatactggagaagctaagaagggatcagaaattcacactttcgatggattaccagttggctatacttcgtccccaatagaaataataaattatgtttctgctcatgacaatgagactctgtttgatgttatcagtgtaaagaccccaatgaacctttcagttgatgagagatgcaggataaatcatttggcctccagcatgatggcattatcccagggaataccctttttccatgctggtgacgagatactaagatttaagtccattgatcgagattcgtataactctggtgattggtttaacaagcttgattttacctatgaaacaaacaattggggtgttgggcttcctccaagtgaaaagaatgaagataattggcccctgatgaaaccaagattggaaaatccatctttcaaacctgcaaaaggacacattcttgctgccctagacagttttgttgacatcttgaagatcagatactcatctccgctttttcgtcttagtacagcaagtgacattaagcaaagggttcactttcacaacacagggccctcctcagtcccaggtgttattgtcatgggcattgaagatgcacgagatgagaggcccgagatggctcagttagatgcgaatttctcttatgttgtaaccgtcttcaatgtgtgtccgcacgaagtatccatggatattccagccctcgcttcaatgcgtcttgaattgcatcctgtgcaggtgaattcatcagatgctttggtggggaaatctgtgtacgaggcagcgacgggcaggttcaccgtgcccagaagaaccgtgtcagtctttgtcgaacctcggtgttgatgcctccttggtttcaacgcaagtatctgttctacaaattgtcgaagcgaccgaagatctttctgttttcgtgttgaaggaaataataactgaagaataagagaggagaggcgctgctgcctgcctgccggattacactgctgaaggaacaaacccaagaataagaagcttggcttatgtgtatgtatgtatagtgcccaagttgccaagtcatggctttgttttctgatccattttttattttatatatcaaaaggaaaacatgtatatcgtgttataagtattgtataacatgcatctactattaaataaggaagcataatgatttgtagcggtactgcctttttaactctgtatagagctat

SEQ ID NO: 3050 - DNA, 725 bp, Triticum aestivum
ccgtccaccccgtgacaggcgcatctgcgatcccccgattcgatcctcccggccgcgccccgccgcaccccacccgtcgccgcccgccgcctgcgcccttgggcgagagctccatcacgcagccgcccgcccgcccccgtcaggtcgacgatggacgcagcaggcagagatgccaaccccctggccggctaccggatcggcaaaacccttggcatcgggtcctttggtaaggtgaagatcgccgagcatataattacaggccacaaggtcgcaatcaagatcctcaatcgccgtaagatcaagagcatggagatggaagagaaagtgaaaagagaaatcaagatactgaggttatttatgcatcctcatatcatacggctttatgaggtcatagataccccagcggatatttatgttgttatggagtatgttaaatctggagagttatttgattacattgttgagaagggaagattacaagaggaagacgctcgtcgctttttccagccaattatatctggtgtggaatattgccatagaaatatggcaggtcaccgcgatctgaagccgaaaaaccttcggatgggatcgaacagtaatggtaccatgccaaattggcataaaaaagagaagcgtgacggcactttggaaaaagttggtggcgcaaaatgcaggccaaggaaaaccgaaaggcgcggacaaagaagtaggcaggggaaagaacc

SEQ ID NO: 3051 - DNA, 1119 bp, Triticum aestivum
gtgagccagacccacagccatgtttccggatgttccatgccacacaagctcacactaacttgcagatgaataagcttttaacgacgatggcagaatggtatcgctacgctgataaccgcaaaaaggttgtcaacttttgctcctacattataagggggtccttggcaaagttatatgccgccaagtataagctgcggtcaagggcaaaggtttataagattgcatcaaggaatcttagtcgaccattgaaggataagaaagggcagtcaccagagtacaccaatttgctgagaatgggtcttgtagactcagttgatggactccagtatacaaggatgtcaatggttcctgatcctgactatacaccattaccaagcgggtggcgcccagaccacgagaagtttttgcttgaatatataaagctcacagatcaacaaacactggaagagcagcggagttgcattagagaggaggggcttataacaccacaagaccacatttcaatgcttgtatggagctacaagaaaaatgcagttttactaccttcttcaaaagagagtgatgtccaagattccatagaagaccttggttcagacacagatgaattgaataacaaggaactagggcatggaggcccatcagggttttcccacaacctactgaaatgccttgagtgctcaataatttctgtaaaatcaccaaggcttaattatgataacagttggttgctgccactgaatttacaagagaccaactcaccgatggactaaacagactatgtaaatgtgtactactgtcaagcagattctagcattttgctggctggttcataactgcctagctagatggttacttcctgctcaaggacatgacatattgtgcggctctatccttgaagaccattttcaaatgctcagggcatggtgcaagaacatgaacttcaataattcaactcaggatcattttgcttccaaacagtgcatctgcatcaaggccagcagctgctcatacatcattcatgtcttttagtaagactttatcaagcctatgcattaaaatttatgtaggaaatttattgaacacacattctgtgagagcatatcctgcttgttcaaatgg

SEQ ID NO: 3052 - DNA, 938 bp, Triticum aestivum
gagccacctctcaggaaagaagttgttgagtacatgttggatgtggattctcacatgtggagcatgaggaagagcaaggcaaacttcttcaggattatgaaagtgtcgaccccccttgttggagctgctcaatggtttgataagatttgtgaatggaagaacccgctgaccactgtgttgattcatctcctgttcatcattttggttacgtttccagagctgatccttccgaccgtttccctgtatatgttcttgattggggtctggttctaccggtggaggccaaggcagccacctcacatggacactcgtctttcacatgccgagacctccaaccctgatgagtttgatgaggagtttgatactttccccacatcccgtgcacatgatgtcgttcggatgaggtatgatcgactcaggagcattgcaggcagggtgcagacagttgttggtgacttggcaacacaaggtgagaggctgcagtccctgctcaactggcgggatccaagggccactgctatctttgtgaccttctgcttgatcgctgctgtggttctgtacctggttccgtttcgcatggttgtgctcattgctgggttgtatgtgctgaggcatcccaggttccgctgccacgggcttccatctgctcccctcaacttcttcaggaggctaccggcgaaaacggacagcttgctgtgagaccgtcccgtgccaggtaacatcagagtgttttccagcattggcgacggcattgcatggatggaacctgaaatgcgcagacaatttttcttcaagaattgttatctttcgttgtatgttaatttagacttgagactttgatttgttctggagttggcaccaggttgacctgtttgcctgtgttgtttcgacatggattttctcctgctgtcatcatcgaatttcagttgttatgtgtt

SEQ ID NO: 3053 - DNA, 894 bp, Triticum aestivum
caggacatcatgaacctctacgagggcggcatcaagctgcccatggtgcccgccctcgaggagctgcgcaagcagttcccgctccagctcatcaaggacctgctccccgtgggcggcgactcgctgctgaagctccctgtgccacatatcatccaggcggaccagcaggcgtggaggaccgacgaggagttcgcgcgcgaggtgctcgccggcgtcaacccggtcatgatcacgcgtctcacggagttcccgccaaaaagtagtcttgaccctagcaagtttggtgaccacaccagcaccatcacggcggcacacatccagaagaacctcgagggcctcaccgtgcagcaggcgctggaaagtaacaggctctacatacttgatcaccacgaccggttcatgccgttcctgatcgaagtcaacaacctgcccggcaacttcatctacgccaccaggaccctcttcttcctgcgcggcgacggcaggctcacgccgctcgccatcgagctgagcgagcccgtcatcctgggcggcctcaccaccgccaagagcaaggtgtacacgccgtgccgagcggctccgtcgaaggctgggtgtgggagttcgccaaggcctacgtcgccgtcaacgactccgggtggcaccagctcgtcagccactggctgaacacccacgcggtgatggagccgttcgtgatctcgacgaaccggcagctcagcgtgacgcacccggtgcacaagctgctgagcccgcactaccgcgacaccatgaccatcaacgcgctggcgcggcagacgctcatcaacgccggcggcatctttgagatgacggtgttcccgggcaagttcgcgctggggatgtcgtccgtggtgtacaaggactggaagttcacgg

SEQ ID NO: 3054 - DNA, 627 bp, Triticum aestivum
accaagcaactgggcccagatcaagacatgtatgttttcctgctgttcctactctcacaatgttgcgtcgaagggaaaattcatagcgtttgtgtcaagcacaagcagagagtgacatccagaggcagaactgaagccaggaatcgatcttcttgggccagttgacgagttgtttttcgacacatacgacagatatgaacctactaatgacccttcttcggacaattgttttatatcaacgagttatgatgccacaacacactttgagtctaccgtgatggatgttctttcgctgtatacaaagatcaccggaaagacggttgatctcagtgtggatctaagcgctgcaagtgcccccgaagatgattgacaattctagggcagctataccttgcaatttggaaacgatttatgctttgttttgcagttcattgtaggtccgcctttgccctcgttattttgaaatgtgatagctgagctatagtcagataaagttgtatgatgtatattctaatttcctaaattttctattgggaggtcgatagtatgtttaggcttcgaagacagcttcgcctcggccgctacttttaccttaaattctgataagacacacaagacatagatgat

SEQ ID NO: 3055 - DNA, 592 bp, Triticum aestivum
tatgttttctggttttcctattctcacaatgttgcgtcgaagggaaaattcatagcgtttgtgtcagcacaagcagagagtgacaatccagaggcagaactgaagccaggaatcgatcttcttgggccagttgacgagttgtttttcgacacatacgacagatatgaacctactaatgacccttcttcggacaattgttttatatcaacgagttatgatgccacaacacactttgagtctaccgtgatggatgttctttcgctgtatacaaagatcaccggaaagacggttgatctcagtgtggatctaagtgctgcaagtgccaacgaagatgattgacaactctagggcagctatatcttgattttggaaacgatttatgctttgttttgcagttcatcgtaggtccacctttgccctcgttattttcaaatgtgatagctgagctatagtcagataaagttgtatgatgtatattctaatttcctaaattttctattgggaggtcgatagtatgtttaggcttcgaagacagcttcgcctcggccgctatttttactttaaattctgataagacacacaagacaataga

SEQ ID NO: 3056 - DNA, 686 bp, Triticum aestivum
gactcttccccgctttagtttcctcatcccgagcacctccgacgtcacgcgcaggacgtgcaggcatacatggtgggtgagccggcgacagctcgtgccgatctgtcgagcatcagcgtgggcgggatgccggcgttcaagtcgctgcgagacagccaccggaacttcgacgaggcggcgctggaggggatccggcgcgccgtggtgggcggcgcctacgaggtgatcggcctcaaggggtacacctcttgggccacttggctactctgtcgccagcctcgctgcttccctcctccgcgaccagcgccgcgtgcaccctgtctctgtccttgcctcgggcttccatggcatctcagacggccacgaggtgttcctcagcctgcccgcccgcctcggccgcggcggcatcctcggtgtcgccgagatggacctcaccgaggccgaggccgcgcagctccgccgctcggccaagacgctctgggagaactgccagctcctcgacctctgacggaggaaagccagttgatctacatctacttactgtaaaatcctggagcgtttacaagaactctactgctatatgttgctctgttgctgctgcggccacacgaatgcttgtgtaattttcgagtgtcttcttagggatgttgtagtaatgtaacgcctcttaatttcatgaaataaaa

SEQ ID NO: 3057 - DNA, 726 bp, Triticum aestivum
ccgccaccgcgtcatcggctccggcaccaacctcgactcctcccgcttcaggctcctcatcgccgagcacctcgatgtcaacgcgcaggacgtgcaggcatacatggtgggtgagcacggcgacagctcggtggcgatctggtcgagcatcagcgtgggcgggatgccggcgttcaagtcgctgcgcgacagccaccggaacttcgacgaggcggcgctggaggggatccggcgcgccgtggtgggcggcgcctacgaggtgatcggcctcaaggggtacacctcttgggccattggctactctgtcgccagcctcgctgcttccctcctccgcgaccagcgccgcgtgcaccctgtctctgtccttgcctcgggcttccatggcatctcagacggccacgaggtgttcctcagcctgcccgcccgccttggccgcggcggcatcctcggcgtcgccgagatggacctcaccgaggccgaggccgcgcagctccgccgctccgccaagacgctctgggagaactgccagctcctcgacctctgacggaggaacgccagttgatctacatctacttactgtaaaatcctggagcgtttacaagaactctactgctatatgttgctctgttgctgctgcggccacaagaatgcttgtgtaattttggagtgttttcttagggatgatttagtaatgtaacgcttcttaatttcatgaaataaaatgcg

SEQ ID NO: 3058 - DNA, 596 bp, Triticum aestivum
caagttgatgggatctgaagaaattctgctatacctgtggtgaatctgggcattccctttccaagtgcccgaagcccattgaaaatgcggcacaaactttgcgagctgctttgtctgcaaacagcagggacatttgagcaaggattgccctgaaaatacacacggcatttatcccaagggtggttgctgtaagatatgtggtgaagttacacacttggcaaggcattgcccgaacaaacggcaacagtacttcgaatcctcggtggatgatggtatgaatatggagggagactaccaggaagaccatactctgcatggtggagacgatcttgaagatgatttcattgatgaagaagaggtgaaaaccaccaaaacaattaaagcaagcaacctagcagcggcgagaagagtaccagctcaaagtcaaaaggaaaacagctccaaaagttgtaaaattctttggttaaacaatgccgccatttttgtagtgtacgtcgagaatgatcatcttcctggacaattctttttggaggaatcccagctgtgtaacttacaatgcaatgagaatgtatctgtctacactccgatgttggaaa

SEQ ID NO: 3059 - DNA, 1122 bp, Triticum aestivum
  misc_feature (379)..(379): n = any nucleotide
  misc_feature (514)..(514): n = any nucleotide
ctcgtgtattcatgtgaggttcgaggtttatatgatctccgagatgcccgaatcgatgtggggattcgacagcagtggcaattgtgtactagtgagctactatttcttttctcacaagctgggctttgtagttgctgtttactttgatcccttgttacccttattactgaacacatgagtgcatgggccatgggagtttgaaacattgatatcatgatatgttcctgtgccgggctgagctgctgattcctacttctgataggtttttcgatggattgtttagcttcctgagtagaatgtttgagttatattttcacagctatgaggctgtgtcatcatcatggagtagctttgaggtcatagcatggctgcagcaatntcattcctcagtatgttgtaactagaacagcttttctctctccttctaggttgcttgtcatggcatcaaagcgcatcctcaaggaactcaaggacctgcagaaggacccgcccacatcatgccagtgcaggtccngctggtgaggacatgtttcattggcaagcaacaattatgggaccccctgacagtccctatgccggcggtgttttcttagtgaacattcatttccctccagattaccccttcaagccaccaaaggtatcttttaagacaaaggtcttccatcctaatatcaacagcaatggaagcatatgccttgatattcttaaggagcagtggagccctgctttgacgatctccaaggtcttgctctctatctgttccctgctgaccgatcccaacccggatgatccccttgttcctgagattgcccacatgtacaagacggaccggtcaaagtatgagacgacagcccgcagctggacgcagaagtacgccatgggttgaagacctgcatcgtggacaactgaaatgtcgcttcaagaaaaaaatttatgggccattgtttcttcgatttgttgctggttgtgtgtaatccgatcctcaaggattgtaaattgcattcggcgtcggccctatcatcaattgccactagtatcggcagacatgcatgcctatcagcctattcacctatgcttgttgggttaaccttcatcagtgttggtgttatttggtaaatgttc

SEQ ID NO: 3060 - DNA, 846 bp, Triticum aestivum
gcgtcctccgtccctcgtcctcgccgtcccccacctctcgctgcaaaagcttgcttgtcatggcatcaaagcgcatcctcaaggactcaaggacctgcagaaggacccgcccacatcatgcagtgccaggtcctgcctggtgaggacatgtttcattggcaagcaacaattatgggaccccctgacagtccctatgccggcggtgttttcttagtgaacattcatttccctccggattaccccttcaagccaccaaaggtatcttttaagacaaaggtcttccatcctaatatcaacagcaatggaagcatatgccttgatattcttaaggagcagtggagccctgctttgacgatctccaaggtcttgctctctatctgctccctgctgaccgatcccaacccggatgatccccttgttcctgagattgcccacatgtacaagacggaccggtcaaagtacgagacgacagcccgcagctggacgcagaagtacgccatgggttgaagaagacctgcatcgtggacaactgaaatgtcgcttcaagaaaaatatttatgggccattgtttcttcgatttgttgctggttgtgtgtaatccgatcctcaaggattgtaaattgcattcggcgtcggccctatcatcaattgccactagtatcggcagacatgcatgcctatcagcctattcacctatgcttgttgggttaaccttcatcggtgttggtgttatttggtaaatgttcattaaaaatgtttgcttatgaccttgtccagatttatcttcttttggttctaggtatgtttcgaatgtatgtatgttcagttttgttgttgttcgcagac

SEQ ID NO: 3061 - DNA, 857 bp, Triticum aestivum
gcacgacaccacaccacaaagcgaggggcggacccggagcaaaaaagaccaccaaaggcaggcgtcctccgtccctctgtcctcgccgtccccaacctctcgctgcaaaaaggttgcttgtcatggcatcaaagcgcatcctcaaggaactgaaggacctgcagaaggacccgcccacatcatgcagcgcaggtcctgctggtgaggacatgtttcattggcaagcaacaattatgggaccccctgacagtccctatgccggtggtgttttcttagtgaacattcatttccctccggattaccccttcaagccaccaaaggtatcttttaagacaaaggtcttccatcctaatatcaacagcaatggaagcatatgccttgatattcttaaggagcagtggagccctgctttgacgatctctaaggtcttgctctctatctgttccctgctgaccgatcccaacccggatgatccccttgttcccgagattgcccacatgtacaagacggaccggtcaaagtatgagacgacagcccgcagctggacgcagaagtacgccatgggttgaagacctgcatcgtggacaactgaaatgtcgcttcaagaaaaatatttatgggccattgtttcttcgatttgttgctggttgtgtgtaatccaatcctcaaggattgtaaattgcattcggcgtcggtcctatcatcaattgccactagtatcggcagacatgcatgcctatcagcctattcacctatgcttgttgggttaaccttcatcagtgttggtgttatttggtaaatgttcattaaaacatgtttgcttaatgaccttgtccagatttatcttcttttggttt

SEQ ID NO: 3062 - DNA, 1036 bp, Triticum aestivum
  misc_feature (855)..(855): n = any nucleotide
cagtagtgctcttcaatgcccttatagtatctgttaccatgttttgttacatcaaagctggctggctcggaaatgatcccttaacggttgttattggtgaaagtgatccatacgtccacataagcgggcgggaaataagccatcttcatgttgccacagtgctgatgacagtaataatgatcattgcttttctgtcctcaatagctattgtccggcgtatactgatagccacacctgtcctgaaggttgccgcgaaggtcatcggtgaagttcaggcactgatagttttcccagttgtgccgtactttatcctcgctatcttttatatgttctggttttctgccacactccacctcttcagctctggtcaagttgtccgaaatgactgcagtacagattgttgctcatatgatctgaagttgggcaaagtgaactgtgacaactgttgtgggtacagcatccattacacccctcatatcggcattgccatcctcttccacttatttggatgctactgggctactcaattcttcatggcatgctctgcaactgtggttgctggatcagttgcttcttactactgggcacgtggcgaaatatctcatgatataccgtttttgagcgtcgtctcttcgctcaagcggctgatgcgttacaaccttggatctgctgccataggctcgcttgttgtatcagctgttgagtgggtgcggtttatactagaatggcttcgccggaagctgaagctgatcggttctgctggggagagctgctttgggacagtgtcatcgtcctcgtctcagtgctgccgggctgcatagactggacccctatgcttgtaattgaaatgcctantatgggtgcgctcccgggaagggctttaaggtctgggcccgacgggctttttgtgacacttggcctcgggggaacctcgggggggccttcccggggaaggggggccctttgcgccgtcctctgtggccccaattcggccaatatttgcccccggggcggcggcgaacggaggcagccacta

SEQ ID NO: 3063 - DNA, 606 bp, Triticum aestivum
aggatcctcttggatcaagatgacttggagctctatgggcttcgttgcaatcctcagttgatatccaaattgtcggggatgatttgctttgtcacaatcccttaacgtatagtagaggctattgacaagaaggcctgcaatgctctgttgcttaaggttaatcagatcggtaccgtcacagaatctattcaagctgctctggattcaaaggctgctggttggggcgtgatggtcagccacaggagtggtgaaacagaagacaatttcatcgcggatctagctgttggtttagcgagcgggcagatcaaaaccggagctccctgctagaagcgagagactggccaaatacaaccagcttgtgcggattgaagaggagctaggcaacgtgcggtacgccggcgatagcgttcaggtctccatgagaaaccagaatcacagacgactttgactggagcagtattagtttctacagcggcgtacagtggtgtactgtgtacatccttcgattagaaataaaggcactgaccgtataaattcatgacatctccttgtaggagtgcctcgtgcaccccaaattttgcagcctggagtgtatcgcagatgcac

SEQ ID NO: 3064 - DNA, 548 bp, Triticum aestivum
  misc_feature (10)..(10): n = any nucleotide
cgtgatgaantagcctgttttccacaacctcaagaccctgctcgcgggcgaaatcctcggcgccgtcgaaggcgaggtacgagtggggcgacttgtccatgacgcggcgggccagggacacggggttgcggacggtggacacgccggagacggccccgcagcggcggccgttgccgtccatgatgctggcctccatctcgacggtgccggcgcgagtgagcgcggagcctcgtccggagttgaagcaggggtccgtctccagtcgcgcaccacggcctccaccacgtccagcgcagcggcgccggcccggagcaggtccacgccgatctgcaggcaccgggccagcacccgcttggcctcctcctgcctgtgctccggcaggttggggtccacgcccgcgccgccgtggatggcgatggcccagcgcgccatgtcaaagtatgtatgtgctgggggtggtgtgctgtgctaggtggctgaaggcactgtgttgctgtggctacgtgatgctctgctctttcttgttgagccgtgtgagggttgggaga

SEQ ID NO: 3065 - DNA, 756 bp, Triticum aestivum
tcccagttcatcccatattggtcctgcgaggaggggcggagaaacggaaagcaggaggcggagaggagatcagccagcccttcaagcacagagggcggcgagggaggggcgcgatggcgtccaagaggatacagaaggagctcaaggatctgcagaaggatccccccacctcatgcagtgcaggtcctgtgggtgaagatatgttccactggcaggcaacaataatgggcccatctgacagcccatattctggtggagttttcctagttactatccacttccctcctgattatcctttcaaaccaccaaaggtggcattccgcaccaaggtgttccatccaaacatcaacagcaacgggagcatttgtctggacatcctcaaggaccaatggagccccgctctgactatttccaaggtgctgctgtccatctgctccctgctgtgtgacccaaaccctgatgatcctctggttcctgagatcgcccacatgtacaagacggaccggcacaagtacgagagcaccgccaggacctggacgcagaggtatgccatgtaatgcaagacggcggatgggtcgccggagtccctcttgtaacattctcgatctgtgcgtgtgtgcccgccaggtgtgtgtgtctgtcaaactggcactcgttgctcaactgtgtcacctggcgcagtgacttggaacatggaactggtgttgcatattttggattcagataaatgtcgccacctgccgccaggtcggtgct

SEQ ID NO: 3066 - DNA, 735 bp, Triticum aestivum
catcccatatgggctcttgcgaggaggggggcggagaagcggaagcaggaggcagagaggagatcaggccagaggagggcgagggagggcgcgatggcgtccaagaggatacagaaggagctcaaggatctgcagaaggatccccccacctcatgcagcgcaggccctgtgggtgaagatatgttccattggcaggcaacaataatgggcccatctgacagcccatattccggtggagttttcctagttactatccacttccctcctgattatcctttcaaaccaccaaaggtggcattccgcaccaaggtgttccatccaaacatcaacagcaacgggagcatttgtctggacatcctcaaggaccaatggagccccgctctgaccatttccaaggtgctgctgtccatctgctccctgctgtgtgacccaaaccctgacgatcctctggttcctgagatcgctcacatgtacaagacggaccggcacaagtatgagagcaccgccaggacctggacgcaaaggtatgccatgtaatgtaagacggcgcacggatcgctggagtcagtcttgtttgtaatattctcgatctgttcgtgtgcccgcccggtgtatgtgtctgtcaaactggcactcgttgctcaactgtgtcacttggcgcagtgacttggaacatggaaccggtgttgcatattttggattcagataaatgtcgccacctgccgccaggtcggt

SEQ ID NO: 3067 - DNA, 676 bp, Triticum aestivum
gatcgagccagagggcggcgagcaagggcgcgatggcgtccaagaggatacagaaggagcttaaggatctgcagaaggacccccctacctcatgcagcgcaggtcctgtgggtgaagatatgttccattggcaggcaacaataatgggcccatctgacagcccatattctggtggagttttcctagttactatccacttccctcctgattatcctttcaaaccaccaaaggtggcattccgcaccaaggtgttccatccaaacatcaacagcaacgggagcatttgtctggacatcctcaaggaccaatggagccccgctctgaccatttccaaggtgctgctgtccatctgctccctgctgtgtgacccgaaccctgatgaccctctggtccctgagatcgcccacatgtacaagacggaccggcacaagtacgagagcaccgccaggacctggacgcaaaggtatgccatgtaatgcaagacggcggatgggtcgccggagtcagtcttgtttgtaacattctcgatcagttcgtgtgtgcccgcccagtgtgtcacctgtctgtcaaactggcactcgttgctcaactgtgtcacctggcgcagtgacttggaacatggaaccggtgttgcatattttggattcagataaatgtagccacctgcctgccactt

SEQ ID NO: 3068 - DNA, 769 bp, Triticum aestivum
cctggagctcggttgggggctggccgacagcggctacacgttcatatggaacgttcggccggacctcgtcaggggagagaccgccgtgatgccgccggagttcctagcatcggtccacggccgcgccatgctcacgacgtggtgcccgcaggcggaggtcctcgggcacgaggcggtgggggtgttcctgacgcactccggctggaactccacgctcgagagcatctccgccggcgtgccgatgctgtgctggccgttcgccggggagcagcagaccaactgtcggtacaagtgcaccgagtgggggatcgggatggagatcggcggcgaggtgaagcgggcggaagtggcggcgatgatacgcgaggcgatggtggggggcaaggggcgggagatgaggcggcatgcggcggagtggaaggagaaggcccagcgtgcgtcgctgccaggtggggccgcagaggccaacctagacgaggtgattcgtagcgtgctcctcgccaagtactacaacatttagtagtcgaggaaattcaataacgcgcatgctaaaaatcagtcaactgggatttaactaagtttcagacgaccatgcaacacttttgccatcgtttgcaatattttttcttatcagttgcaatatccgtcttgctggttgtagcatgtcgtccctcatcgattggtagcatgtcatcttaccggttgcaacatccttcattgaaggctatagtatttcagttagaatggttgtcacatttattgttgttgc

SEQ ID NO: 3069 - DNA, 863 bp, Triticum aestivum
  misc_feature (53)..(53): n = any nucleotide
  misc_feature (56)..(56): n = any nucleotide
  misc_feature (63)..(63): n = any nucleotide
aagccccagcgccgcccactataagaaacgcttttcatgcactttaccgtatnatngctgatnaaggtgttctggcactttggaagggcgcaggtccaactgtagcgagagcgatgtcactcaacatgggcatgcttgcctcctatgatcagagtgttgaggtacttagagacaaacttggtgctggagaactttctacaatgcttggggccagtgccatttcaggattctttgcatctgcttgcagtttgcccttcgactatgttaagacacaggttcagaagatgcaacctgatgctactggaaagtatccatacactgggtcttttgactgtgcaatgaaaaccttgaagagtggcggtccgtttaagttctacactggctttccggtctattgcgtcaggattgctccacatgtcatgatgacatggatattcttgaatcagatccagaaggtcgagaagcgcgtcggcctttaaagtgtcgtgctatgctatcctcacctacaaattataatagtgtagctgctttgtacctataaaccagcagttggttctgatatacaaaatctgtacttatttccttggcatatatgctaccatgcttctttgttccttccagaccaaataatcatataatttctgggtaacttttggcagaaaatagtgttgttaggagcagatatgccaccaccggattgaacccatgtcatcaatggagccggacatcaaacaaacttttcattctgtacttgtttaggctttatttttgtcaagtgtcaacatgtactccgtatatatttttggcggggtaatatgtgtggttaattctcgctgttgttgtaatttcttggtatatcaggt

SEQ ID NO: 3070 - DNA, 1157 bp, Triticum aestivum
gtaaatgctcgcacacacatacacttatttctatgaacgcacacacgcacgtcacattcctatgagcacctctgagatactgagccgacacaacatcttggaactgaagaaatcatcacaggcgcctagtaattgatgaaaaccacttctcccaaccaattcccttcttaatgattatacatacaactctgctgcatggtatggaaaaaaaggattttgacgtgcttttgtgcatgcatgtgtacgtgtcaggcgacatccacgggcagttctcggacctgctccggctgttcgactacggcgggctgccgccgagcgccaactacctgttcctgggcgactacgtggaccggggcaagcagagcatcgagaccatctgcctgctgctggcgtacaagatcaagttcccggacaacttcttcctgctgcggggcaaccacgagtgcgcctccatcaaccgcatctacggcttctacgacgagtgcaagcgccgcttcagcgtccgcctctggaagctcttcaccgactgcttcaactgcctgccccgtcgcggcgctcatcgacgagaagatcctctgcatgcacggcggcctctccccggacctcgtacagcctcgtaccggattcgccgagatccagcgccccgtcgacgtgcccgaccagggcctcctctgcgacctcctctggtccgatccccgtaccgcgatgagccgccggctggggcgagatcgagccgcggcgtctccttcaccttctggcgctcgataaggtcgccgagttcttgcatcaagcacgacctcgtacctcatctgccgcgccccaccaggtcgtggaggacgggtacgagttcttcgcggacacggtcagtctggtcaccatcgttctccgcgcccaactagctgcggggagttcaacaacgccggcgcgctgatgaacgtcgactgcctagcctgctctagctccattccagatcctcaagcccttgagagcccaacgtgccaggcaggactaacagagtttttgttactatattgctattagaggctcgattagaatacatggaggtctcatagatttgcatgcacgtatatatttctccttgcagatccatggttctttcgaatcgtttgcttgtaattcattatatatgtgtatgt

SEQ ID NO: 3071 - DNA, 711 bp, Triticum aestivum
agtgttccaacacactcggaaataaggcttgcgaactcgtacttctacgacaaatccacatgcttacttgcctggagattacttttatcagagaaagagttcagcttggaccatcctgctgccaacccctggcccctggcagaggaggaccctccactgaaatgcatgcccccaacacttgacgatcgttgcggaacacgactgtatgagagacagagcaattgcttactccgaggaactccgcaaggtaaatgtggatgcgccagtcctggactacaaagatacagtccatgagttcgcaacactcgatgtgttcctcaagacaccacaggctcaggcctgtgccgaagatattgccatatggatgaagaaatacatatccctgagagggcacgagttctcgtattagctgtagcaaaagatcagcattgtgaaatagagtctttacaggaagcatcggtgcattctttttcacctggtgatgggaggcactgcaagttaaaaggcgaagaacaagttaggcgtaatgtgagtgctgagtacctttcccctttattgatgatccttgtggaagaatgtagtgtgcaaattgtagactgaactcaaagacagatgctcttccgcctcgtagagctcaattctttcattccttttgtaccctttgtgaagtattgaaatgctgggtctcgaaatcaccatttttgagaaaaa

SEQ ID NO: 3072 - DNA, 826 bp, Triticum aestivum
gtcctacttggtgtaagctgtggtgccaacattgctgattttgtcactaggaaagcggtggaagatgcaaagcaatttgacccagtcaaggtcgtagcacaggttctgatgtatcccttcttcacaggaagtgttccaacacactcggaaataaggcttgcgaactcatacttctacgacaaatccacatgcttacttgcctggagactacttttatcagagaaagagttcagcttggaccatcctgctgccaaccccctggcccctggcagaggaggccccccattgaaatgcatgcccccaaccttgacaatcgttgcggaacatgactgtatgagagacagagcaattgcttactccgaggaactccgcaaggtaaatgtggacgcgccagtcctcgactacaaagataccgtccatgagtttgcaacactcgatgtgttccttaagacaccacaggcccaggcctgtgctgaagatattgccatatggatgaagaaatacatatccctgagagggcacgagttctcgtattagctgtagcaaaaggtcagcgttgtgaaatagagtctttacgggaagcatcggtgcattctttttcacctggtgatgggaggcactgcaagttaaaaggcgaggaaccagttaggcgtaatgtgagtgctgagtacctttcccctttattgatgatccttgtggaagaatgtagtgtgcaaattgtagactgaactcaaagacagatgctcttccgcctcatagagctcaattctttcacttccttttgtaccctttgtgaagtattgaattgccgggtctcgaaatcacc

SEQ ID NO: 3073 - DNA, 602 bp, Triticum aestivum
ggacgactacccggcggtgacgttcaactacttctcgcacccgcaggacctccggcgctgcgtcgagggcttgacgctcatcgagcgcgtcatccagtccaaatccttccagaacttcacgtacccctacttctccatggagggagctgctcaacatcacggcggagttccccgtcaacctgctgcctcggcacgacaacgactccaagtctctggagcagttctgcaaggacaccgtcatgaccatctggcactaccacggcggctgccaggtcggcagggtcgtcgacgccgagtaccgggtgctcggcgtcgacgcgctgcgagtcatcgacggctccacgttcaacgcctcgccgggaaccaacccgcaggccaccgtgatgatgctcggcaggtatatgggggttaagatgcgagacgagagggtgcgtgctgaagggttaaggaggagaaaactgtagtccacttgacgaagattggcaggcacattatgtatttgtaactgcagtatgtgaacaattggaatgagttgcgcgtcattattggaagtgtgtgttcatttgtacggttatcaagacgaaatctgtattgtccggaga

SEQ ID NO: 3074 - DNA, 1240 bp, Triticum aestivum
  misc_feature (1232)..(1233): n = any nucleotide
cttcaatgtcggagggcgccgggcacggccggtggcgcacggcgtcgtgttccacgactcaagagggcggatgcacaaggcgtacctcaacaccggccgccgcaacgagatcatcctctcggcgggcgccatgggcagcccgcagctgctgatggtcagcggcgtcggccccgcggaccacctgcgctccttcaacatcaccctcgtgctgaaccagtcggcggtcgggcagggcatggccgacaaccccatgaacgccatcttcgtgccgtcgccttcccccgtcgaggtctccctcatccaggtcgtcggcatcacccagttcggcagctacatcgagggcgccagcggctccaactgggccaacccgcgccaccagggctccggcggcaaccgccggccgccccgcaacttcggcatgttctctccacagactgggcagctggccacggtgcccccgaagcagcgcacgccggaggctatcgcgcgcgcggcggacgcgatgagccagctcgacgactcgggtgttccgtggcggcttcatccgtggagaaggtccttgggaccgggcgtccacgggccacctcgagctgcggaaccttaacccagacgacaacccggcggtgacgttcaactacttctcgcacccggaggacctccggcgctgcgtggaggggttgacgctcatcgagcgcgtcatccagtccaaatccttccagaacttcacgtacccctacttctccttggaggagctgctcaacatcacggcggagttccccgtcaacctgctgcctcggcacgacaacgactccaagtctctggagcagttctgcaaggacaccgtcatgaccatctggcactaccacggcggctgccaggtcggcagggtcgtcgacgccggagtaccgggtgctcggcgtcgacgcgctgcgcgtcatcgacggctccacgttcaacgcctcgccgggaaccaacccgcaggccaccgtgatgatgctcggcaggtatatgggggttaagatgcgagacgagagggtgcgtgctgaaggattaaggaggagaaaactgtaatccactcgatgaagattggcagggcacattatgcatttgttattgcagtatgtgaactattgtcacggactagaattcaattggaatgagttgcgcgtcattattggaagtgcgtgttcgtttgtaccgtaatcaacacaaaatctgtattgtacgaagannaatggaa

SEQ ID NO: 3075 - DNA, 392 bp, Triticum aestivum
ccgaagcgccccccttaccccggaaccaaatcgaacaacccagagaagccatggagcggctgcagcggatcttcggcgccggcgggatgggccagccgccgtcggactcgccgctgctcgactcctccgagcaggtctacatctcctccctcgccctcctcaagatgctcaagcacgggagggccggcgtgccgatggaggtcatgggcctcatgctcggcgagttcgtcgacgactacacggtccgggtggtcgacgtcttcgccatgccgcagagcgggacaggggtcagcgtcgaggccgtcgaccacgtcttccagaccaatatgctcgacatgctcaagcagaccggcaggccagaaatggtggtagggtggtatcactctcatcct

SEQ ID NO: 3076 - DNA, 1110 bp, Triticum aestivum
ccgcaagcgccctccgaaccaaatcgaacaaccgagagaagccatggagcgacttcagcggatcttcggcgccggcgggatgggccagccgccgtcggactcgccgttgctcgactcctccgagcaggtctacatctcctccctcgccctcctcaagatgctcaagcacgggagggccggcgtgccgatggaggtcatgggcctcatgctcggcgagttcgtcgacgactacacggtccgggtggtcgacgtcttcgccatgccgcagagcgggacgggggtcagtgtcgaggccgtcgaccacgtcttccagaccaatatgctcgacatgctcaagcagaccggcaggccagaaatggtggtagggtggtatcactctcatcctggttttggttgctggcttatcgggtgttgatatcaatactcaacagagttttgaagctttgaaccccagggcagttgccgtcgtgattgaccccatccagagtgtcaaggggaaggtggtcatcgatgcatttcgtctcattaaccctcagaccatgatgcttgggcaggagccacgtcagacaacatccaatgttgggcacctgaataagccgtctattcaggctcttattcatgggctcaatagacactactactctattgcaataaattaccgcaaaaatgagctggaggagaagatgctgctcaaccttcacaaaaagaaatggactgatggattaattctgaagaaatttgacgcacattcagaaaccaatgagcagactgttcaggaaatgctgagcctagccatcaagtacaacaaggcagtgcaagaggaggatgagttgtctcctgagaaattagcaatagctaatgtgggacggcaagatgctaagaagcatctagaagagcatgtctcaaatctgatgtcgtccaacatagttcagaccctaggtaccatgcttgacacggttgtcttttagtctaccactagtgttgttccaaagtctatcattcatgttatgtatccaaagcctgccacaacgcagcaaggcacattcgggttctaacagtttgctcgacagactcaattttctgtagtactatattctgcatgtttaacat

SEQ ID NO: 3077 - DNA, 444 bp, Triticum aestivum
acttcacattctacggcatgatggctgttggcttgacacccaactaccacatcgcctcaatcgtctcgtcagcattctacgccatctggaatctctttcttcacggtgttctatcgatctccccgagcccaaaaggttcccaattttggttggaagaatgggtaattgcctggggtatgccccgtagcgtggacactgtacgggctggttgtctcacagttcggcgatgtcacaacgccgatggaggacggcactcccgtgaaagactttatagagggctacttcgacttcaagcacagctggttaggttatgttgctacggtggttgtggcgttcgcggtgctgtttgccttcttgttcggttttgccatcatgaagctcaacttccagaagaggtagatgatgacgatatagaggcatggtctaaaaagaaatgcattagta

SEQ ID NO: 3078 - DNA, 627 bp, Triticum aestivum
accttcactggattgttactgatatacctgggacaacagatgcttcttttggacgggaagtcataagctatgagagcccaaagcccaacataggcatccacaggttcatttttgtgctcttcaagcagaagcgaaggcagactgtaactgtgccttccttcagggatcatttcaacacccgtcagtttgctgcggagaatgacctcggcctccctgtggcagctgtctacttcaactgtcagagagagactgctgccaggaggcgctgaaaatccagctctcgttgtcccagttatgacaaataaaggcctatggagttccaatcttcttttcgaagtggatactcgtctgctacattacttgctcgtgaaccaatgcttccttgccacattacttgctcatggatctacaaataaatcaaatgcattttgcagattgtattagaattagattgttttgtaagcagtaagattgataatcatgttgacaatgccagtgcagcaagtggtccatgtttgtggttccaagtcgtgtattagccagttatcacgaaatccagggtcaagtagacatcctaactggcaaaaggctttatctactgtatgtcgcatgctggttccagttatg

SEQ ID NO: 3079 - DNA, 549 bp, Triticum aestivum
gattggcttgtaaactgcatggattcttgagacaacaagcagcagcgctgaaaatacagaaaaatatacgccgttattttgcacggagaacttattctcagctatgcctgtcagccattacattgcagacagggttaaggaccatggcagctcgcaatgaattcaattctagaaatcaggacaaagcttctatccatatccagtcccgttggcgtcgccacagagataacttaagttatatgaagttaaagagagcagcattgacctaccaatgtgcttggagaggaagggttgccagaagggaactgcggcagctcaaaatggctgcaagagatactcaagctctaaaggtggcaaaggagaaactggaggagcgtgtggaagagctaatgagccgcttgagcttggaaaagaaactaaggactgatctggagaagtccaaagcaacagaaatttctaaactgcagtctgctcttcatgacatggaacagcgagtggaagaagctgccgcaatgaaggaaaacgaatcagctaaaaaagctgtcgaag

SEQ ID NO: 3080 - DNA, 752 bp, Triticum aestivum
ccagtttccgctcgacatgacgccatcaaatccgtcatcttcgacatattggcgccgcagcgagacggcggcgaccacgttggagtgggccatggcagagctgatcaagaacccgagggtcatgcaaaaggcgacgacggaggtgcggcaagccttccatgcccgcggcaccgtggccgagcatgctctaagtgagctcacttacctacacctggtcatccgggagaccctgcggctgcacactcccctaccgttgttgctcccgcgcgagtgccaggaaccatgccaggtgctgggatacgatgtgccgcgtggtacgcaggtgctagtcaacgcctgggcactgggccgcgacgagcgctactggcccgacgcgcccaaggagttccggccggaaaggttcaagggggaggcggcggcggccgacttcggaggtggcgactttgcgttcctgccgtttggtgccggccggaggatgtgccccgggatggcgttcggcctcgccaacgtcgagctggcgctcgcgagcctgctcttccactttgactgggagtggtcggggccagagtcggcggagctcgacatgaccgaggcattcgggatcaccgcgcggcggagggacaagctcgtgttgcgccctgttctccgggtgcctgttcccggagtctagttgatatataactgtaagaattggatgtatattgtaaaaactgtaattatccttgcatagccaactatgtgtagcatataat

SEQ ID NO: 3081 - DNA, 685 bp, Triticum aestivum
caattaccgacaatgagttgtcgctgctgctgtgttgtctgggacaggaatttcgaaggccgtgtacacgcattgacccgagcaaattatctcgcatctcctccattggtttgtggcctatgccctcgctggcacggttaatattgattttgagaaagaaccagtaggcatctcaaaggatgggaaggaggtttacttcagggatatttggcctacctactgatgagattgctgaggttgttaaggcgagtgtgctcccagacatgttcaagggcacatatgaggcaatcaccaaaggaaatcctatgtggaatgagctgccagtatcagcaagcactctctacccatgggatccaaaatcaacatacatccatgagcctccttatttcaaggatatgacaatgacccctcctggcgcacggcctgtgaaggatgcgtactgtcttctcaacttcggtgacagtatcacaactgatcacatatccccagctggaagcatccacccagacagcccagctgccaaatatctaaaggagcgcaatgttgaaaggaaggacttcaactcatatggcagccgacgagggaacgatgagatcatggctaggggaacttttgccaacattcgtattgtgaacaagttcttgaagggagcaggtgggcccccaaaccatccatgtactaaccg

SEQ ID NO: 3082 - DNA, 684 bp, Triticum aestivum
ccaccaagtgcagccgcgcgtccatgcgctcgactacaagactccgcgcgcgtgccggcgtcgaagccggcccggcggccaacggcgtcgggcgccgggccgctgctgcggcggcggacgaggaaggggaggcggtgccgcccgagagagacgccgactctccctacagctccaaggcgacgacaacggaggaggaggagagtgctgggggtggcggggaggtcgattcggcgtcctctgcagccgcaacgctgcggaggccgtcgccgacggcggttgctggcccctcaccacgcgacaccagatggggtgacaccagctcctacggtgctaaaaagaagcatagagttttttgtcagcttccaaatggtgattgggccttatgcaccgtgattactacctctggtgacgagtctgtactaaaggttcctgaaggaaaagttctaagattgaaaacggagagccttcaacctgcaaatcctgaaattcttgatggagtggatgatcttatgcagctgagttatctaagtgagccatctgtgctgtacaacttgcagtacagatattcacaagacatgatttatactaaagcaggtccacttttggtggccgtcaacccttttaagaaggttgcactgtatggtaatgagtatattaaagcatatagcaacaaaacaatgacag

SEQ ID NO: 3083 - DNA, 684 bp, Triticum aestivum
tcacgctgccctaaaatcagcaatgttaccactgcatcaaccaaggacgagcatggcatgccgatgctagcagaagcactaccccggaaggtcgccgacccattcgactatggagggggaaacataaatcctaatgcagctgccgatcccggccttgtttacgacatcaatccgagggactacagcaagttcttcgcttgcacgattcagaaatacgctatctgcaacatctcgacatcgccggcatatcacctaaacctaccttccatagccattcctgagctaaggggtccaattaaggtgcagcgagcagtcacgaacgttggcgaggtcgactcggtttaccgagccgatatacagtcccccccaggagtgaggatcaaagtcgacccaccaaccctagtcttcaacgcgacaaagaaagtgcacgccttcaaggtcagcatgacgcctctgtggaaggtgcaaggggactacacgttcggcagcctgacttggcgcaatgagcaccactcggtgaggatcccactagcagtccggatcacaatccaagatttctacgccgatgttgcatagtaacgaagaatgttgtatgaaaaataaagattggtgatgttacggattttagcatgaatatagacgactatgtggtaattgtaattgtacttatacatcgtgaggtga

SEQ ID NO: 3084 - DNA, 677 bp, Triticum aestivum
cgtccgggggacttttcctcgcagactcaaggacgaggtcatgaagatcaagcccgttcagaagcagacccgtgccggtccagcgcactcgctttaaggctatcgtcgttattggagacagcgctggtcacatcggtttgggcatcaagaccagcaaggaagtcgctaccgccatccgcgctgccatcatcatcgccaagctcagcgttgtgccaattcgtcgcggatactggggcaccaacctcggtgaccctcactccatccccgtcaaggagtctggaaagtgcggttccgttaccgttcgtctcatcccagcgccccgtggtaccggtctcgtcgcctccccagctgtcaagcgtctgctccagttggccggtgtcagcgacatctacaccgctcggccggttcgaccaagaccctcgagaacaccctcaaggccacctttgtcgccatcaccaacacctacggcttcctcactcccaacttgtggaaggagaccaagctcatccgcagcccgctcgaggagtactctgacgttctccgcgagggcaagcgctactagatgtttcgttgacatttccgtattgacgatgatgatctggtggtgatggatgaatgaagatgtgggagaaggaggaaaaaagtactttgcagatacaagttagcttctttcgtct

SEQ ID NO: 3085 - DNA, 724 bp, Triticum aestivum
tctgggtgaaactacattgcttgcatttccgccgacatggctttcttaagttctgtaatgtgaagaaagagagctgtttctttcccatccctcaggcagcaggatgcatcttgcggatcattgagaaagctaatgccccagtaatatatctgtcgactgatgctgctgggagtgagacgaatcttctgcagtcgttggttgttttcaatgaccggcaagtacctcttgtgagaagaccagagcatgaaggttcggagaaatgggatgccttgttgtacagaaaacacatgggtggagatgatcaggtcgaggccatgctcgacaagacaatctgcgctttgtcgaacgttttcatagggtcatcaggctccaccttcacagaggatatcttccggcttaggaggggctgggggtcgatgtcctactgcgacgagtacctctgccagggtgagctacccaactacatagcggagctagagtgagaaattagtaccacatggtagagattcatagcggcattctttttcccttgacgtgctggtgatatacatatatcctgtaaattggcgtgtacaactaagtgtaaaagagttggtgatgtcttctgtatcagcgtcgtccaccgatttgtctgggcggcgttcgttattcttacacggttagagaatacaatgggagcctttgggttgtgcagtgttttattaaccatgtgtggcaagtgaaa

SEQ ID NO: 3086 - DNA, 652 bp, Triticum aestivum
gtccgtagcaggctaagagatcccggtgggcacacgcgtgctcgtcaacgtctgggctatcggccgggacccgactgtgtggggggagacgtccgcggaatttcagccggagcggttccttgggagcaaggtggatgtcaagggccacgacctggaactgctaccttttggtgctggtcgcaggatgtgcccagcccacggcctcgggctcaagatggttcagctggtgctggcaaacttactgcacggctatgcgtggagactccccgatggcgtggcggctgaggagctgagcatggaggagaagtttggcatatccgtgtctcgcatgcaccacctccacgctatccctgagcccaagcttctggatcacctctatttcgggccatgaatgttagtcccttcatttctaaatataagtttttttagacattccactatagaaactacattcaaatgaatatggacgtcttttagagtataggttcactgctgctccgtatgtagtctataatggaatcttttaaaagacttatatttaaaaacagagggagtactagctttaatttgatgtttgctcgagtgcatgtacacgtattggtttactttcacctcggatgtttatgggttgtactatgcattatggttatat

SEQ ID NO: 3087 - DNA, 646 bp, Triticum aestivum
aagatgctgagcagcaacccagcaaagttcttccgcaggagaaggaaagtcagtttcacaactctcttttttgggtcattctcttcgtctcatccgcgccgagagaccgaccatctgctctcaagaggtcttgcggcaacaggtggtccgagttatcctcaggcccatcacaacccactcgtcagggtgacaatcagctgccctgagaaggggaacactgctgggaagctcgtgatcttaccggggtcgatgaaggagcttcttcaactaggtgcgaagaagtttgacatgatgcccactaaggtcctgacaattgagggcgcagaggttgacgaggttgagctcatcagagatggtgatcatcttgttcttgccagtgatgactggataccagatgatacgcaaataggaggtaaaaattaggcatagaattgcgttttccggtttacaataattagggtgaagggggaatgttgaaccatgcttgtaacagaaaagccaatggtgaaaaaataactggaaatcaccaatggctactccacgacacgtctccaccgtgcaaaagatggtgaaatagggttatgtccagcaaggtatgccttgtatagaaattcttgtctgctgggcatgcagaattttcattgta

SEQ ID NO: 3088 - DNA, 645 bp, Triticum aestivum
gtagaggtgtttatcatcgtgactgaagcctgaaaacctgctagtggattgagtatgagaccctttagggtctctgattttggtttaagtgcgcttaaccaagtcaaagtggcgagatggtctgctccacaccgcatgtggaactccggcttatgttgctccggaagtgctcagcaggaaaggctacaacggtgcaagggcagatgtatggtcttgtggagtgattctgtttgttcttgttgccggttatcttcctttccatgaaagaaaccttatggagttgtatagaaagattgccaaggctgagtacagatgccctcgctatttttccactgagctgaaagagctccttaatgggatccttgatccagatcctaatactagaatgtccatcgcaaggataaagagaagcccatggtataggaagccggttgagagaacaccactgagaaaagacaagacttatgcgagcgaagctgctgcgtctggccttgcatgtcgcaacagttccgacggaccggcgagcatgaatgcatttaatatcatttccctcactcctgggttcgatctatctggtttgttcgatgaaagatatagccagagggaggcccggttgcttctcaaagagcggccagcagctgtatt

SEQ ID NO: 3089 - DNA, 640 bp, Triticum aestivum
cacacgcatattacaaccttctctgggaggtaatgcaaggactgcaatcatttgcacaatgagcccagcccgaagctacatggagcaatcaagatataccctactatttgcaagttgtgcaaaggaagtagttacaaatgcgcaggttaatgtagtcatgtctgataaagccctagttaagcatttacaaagagaacttgccaggttggagagtgagctgcgatgtccagcttcctattccagtcttgaagcgttggtgaaggaaaaagataaccacatccggaagatggagaaagaaattaaggaattgaaggtacagcgtgatctggctcaatctaggttgcaggatttgctccaggttgttggagacaaccatgtttcaaagcgtcccctggcttctgggaggaactttaccttcgatgtgccccagccatgtgaagatcggaaatcaacaaccgaatcatcatcagaagtagttgacaatgtccaaaacttcaggttccaaggacgccgcgcagcacaaagggaagttgggtctcaacagtctgaaaataatgtacagtttgctactccattgagttattcagtcagcagccctccattcagtgggatgcccccaaccactagcagagataacgtt

SEQ ID NO: 3090 - DNA, 640 bp, Triticum aestivum
acaggcggaggattggctccaggagcgcgcgcaatgcagcgaccagagggccgtcgactggggcgtgctcaagcaggaccccgggagctgctgcgcaagctggacgagctgagggaccaaatcacgcggtcctgccaggtcgccgagcagccacgggagcaccgtcgggcgggccgccggccgcccttgctccctgaccttcccgagtccggtacctctgcccgggtatcaccgcccacgctatggtgcccggtatgggcctggcttgccgctgagcccatgtgagccgcagcactctgatcatggggagaggtacgcgaggcagtcaagtgggcggtatcgccagtacccagggaggcagtggtgacaacggtgggattggacatgggaattaccatcagtatgcgtgtgctagtccgcattatctgcatggacagagggctgcgccacaagaagagcacataccaatggccagatacttcgctgggcagcatgaatgctaccgatttgaaaggtcaccatctatttcatcagattatgaccaaaggtctgtggcatcatcgctgtactcgcatcgctcggtgtcaaagcaaagggccgagtattttaggaagaaggcagaacatctctgccggccaat

SEQ ID NO: 3091 - DNA, 635 bp, Triticum aestivum
gcgcgtgctggagctacctgtgtacctcccgggcggctgaccataccgacgcgagcgaggagcgctggagcaagccggccgcggtcgccgcggcgaccctttcccctgtcttcctctcttgcctctggagccacgccaccgggagcccgcttctcgtcgtcttcctcggcagcatcgccggcttatccctgggcctcctcgccttcctcagcacggacgctgatgcaccgccgacgaaatttctctcggcctggctcgccggtgggttcgtcatgagcgtggcgtgggagtacgtcatcgcgaacgagctcctctcccttctcgtgtccgccggcctggtgctgggcgtggatccggcgacgctggggatgacggttctggcatggggcaactcgctgggcgacctcatcgcgaacgtggccgtggccatggcggggcgccgcggtggagctcaggtggccgtagctggttgctacggcgggccggtcttcaacgtcctcgtggggctgggcctgtctctgttgctgtcttgctgggtcgggtacccgaagcccgtaacgataccctgggagcccaggctttatcagacgctaggctgggtagcggctgggcttttgtgggccttcgtcatgctc

SEQ ID NO: 3092 - DNA, 633 bp, Triticum aestivum
gagcagatcttgcggactgctgctacacctggcataaaattcacagaggctcaggtcaagtgttacatgcaccagctactgtctggacttggtcactgtcatagtcgtggtgttttgcatcgggatataaagggtgctaatcttctgcttgacaataatggtgccctcaaaatagcagattttggtctagctacattctttaatccgaaccaaaagcagaatttgacaagtcgtgttgtaactttatggtaccgccccccggaacttttgctgggtgctactaactatggtgccactgttgatctctggagtgctggttgcatccttgcggaattgttgtcagggaagcctatcatgccaggacgaactgaggtggaacaattgcacaaaatattcaagctttgtggttcaccatcagaggagttctgggctaatttgaagttatcgcgtgctacaatcttcaaaccacaacatccgtatcgtcgttgtgtgaatgatgtatataaggacttccctccttcagctttggcacttctggaccgtttacttgctgtagaacctgataataggggtactgcggcttctgcccttgaaagtgaaggttgctgatttttgctgctctcctgttagatg

SEQ ID NO: 3093 - DNA, 628 bp, Triticum aestivum
catccccggcgcgtcggtgaccatcacggccacccaacctctgcccgcccaactacgcgctgcccaacgacgacggcggctggtgcaacccgccgcggcagcacttcgacatggccgagccggcatggctcaacatcggcgtctaccgcggcggcatcgtgccggtgctctaccagcgcgtgccctgcgccaagaagggcggcgtcaggttcaccgtcaacggccacgactacttcgagctcgtgctcgtcagcaacgtcggcggcgtgggctccatccggtccgtgtccatcaaggggtccaggaccgggtggatgcccatgtccaggaattggggggtcaactggcagtccaacgcgctgctcaccggccagagcctctcgttccaggtcaccagcaccgacggccagacgctcaccttccccaacgccgcgcccgccggctggggcttcggccagaccttcgccaccaacaagcagttctcttaagagacgatcataagtacgagtggtttattaatttatactccagcctttttgtgggggatgtatgtctttgatcagtgatcggtgtgtcgatcggtgtgaacgttcggtcatcggtgtgtcgatcgcggtgatatcttcgc

SEQ ID NO: 3094 - DNA, 691 bp, Triticum aestivum
agtcggtgaggaagtgcgtcttcacctcgtcgctgctggcctgcgtgtggaggcagagctaccctcaccgccaccggttccccgccaccgtcgatgagagctgctggagcgacgagaccttctgccgtgagaagaagctgtggtttgcgcttggcaagacgatggcagagaaggcggcatggagggcggcgcgtggccgggacctgaagctcgtgacggtgtgcccggcgctggtgaccgggccgggtttccgccggcgcaactccaccccctccattgcctacctcaaaggggcgcacaccatgctggcggagggcctgctggcgacggcggacgtggagcgggtggcggaggcgcacgtgcgcgtgtacgaggcgatgggcggcaccgccggcgggaggtacatctgctacgaccacgtggtgcgccgcgcggaggagttcgcggagctggagcggcagctggggctccggccgagggcgccgccgcccccggccgccgcgccgccgtcgttcgagctctgcaaccggaagctggcgcggctggtgtcctcccggaggcggtgcacccacgacgcctacctccccgtcgcgtacgactgacccggccgggaggaggagtcgccgcgtgggaggagagaaaatggcgtgcgttgtacagagttgtgccccagtgaataataaagctgagc

SEQ ID NO: 3095 - DNA, 711 bp, Triticum aestivum
gtatcattatggcaaccaaggccacctgagggatacgtggctctggatgtgtggctgtttctgctttcgaagagccccctcttgattgcgccttatgcgtgaatgagagatttgcggaggatgcagtgtttgaggatcagatagtatgggcttcctcagatgcttacccatggggatgctacatttaccaagttcagagcagttcgctgcaattcatggcactccgtcttccaaaagagcagtctgagcagaagcctaagaagatcttggaggcgtatctccagcgagcatcagattaatgatcctatgaggcgaagcagacatgccatgcatcggagacatcaggagcggtataatactccctccatcccgacactatgatagtgtaaaaaatgatctcacattttgggacggagggagtatgatatagggaaatgagaaactttgctatgcaaaagagaagactcagcaatcttgcgcaagatagtttgtctttgatatgaaatattttcgtacagttttgggcggcattatgttattgagcatggcatttttgcggggagagataatgtgctagcctggctttgtttttcggctgttgctgggatttgtatctctgcttgatgcttgtcaatagtgtaaactagtaggtgggaatggctgtaagtgtacattttgtaacgcgttgttatagtgctctttctgctgtgg

SEQ ID NO: 3096 - DNA, 588 bp, Triticum aestivum
acaagacaattcctgttcggtacagagtcagaggatttcctgcaggcatgatgggaagctgatggatagggtgctggcatcatgcattctgtgtcatcttctttcttgctgctatgttgctcttcttcgcagtccagggtgattccatgaagctacaggctatatgtactcttgggctgttagtgttctataagttgctgccgtctggaagtgatcgcttccagccgtccttgttagaagggatgcagacagttaatagctttgtagatggtccaacggattatgaagttttttcacaacctgacctggattggaatctgtatcaatcctgaagaaaactcaagccatccttgttcatagagacgcagacagttaaatagctttgtagacagtccaacagattatggagttttttcacaacctgacctggattggaatctgtatcaatcctgaaggaaaaactcaaggtcattttaaagtcgcctagtatcactggagcttcacattgtacagctctcattcttttgtactgttatgtattaactctttttttttctagctggaactgtttgttttgcaaatgacaaa

SEQ ID NO: 3097 - DNA, 645 bp, Triticum aestivum
tacagatctatgaacatggcgaggaaacaaatggtctgatatcgcctctaatgtctgagagagaagacagtgacattctgaatggtttcgaggggcatgatctttccatgtacccaataaaccggagcttccacatgccaaagcagaaattcgactttgcacaatactatgcatttgacatcacaatattcgcgctcacgatgatctactcactgttcgctccgcttgtggttcctgtcggtgcagtatactttggctaccgttaccttgtggacaagtacaacttcctgttcgtgtacagagtcagaggatttcctgcaggcaatgatgggaagctgatggatagggtgctgtgcatcatgcaattctgtgttatcttctttcttgctgctatgttgctcttcttcgcagtccagggtgattccatgaagctgcaggctatatgtactcttgggctgttagtgttctataagttgctgccgtctggaagtgatcgcttccagccgtccttgttagaagggatgcagtcagttaatagctttgtagacggtccaacggattatgaagttttttcacaacctgacctggattggaatctgtatcaatcctgaagaaaactcaaggtcaatacacacttgtttcatt

SEQ ID NO: 3098 - DNA, 783 bp, Triticum aestivum
cttctttagtagttcaatggcctatgttgttgttcgacccacattgggtgggattaacatacagagttgctgctcttgctatcatctatttttactgcctcagaagccccttgaactttgttgaaaaatctggggaaacatcaatgacttctctggcaaacgagattatttctagtgttacctgttgccatacttgatgctaccttcatcatctggatattttcatccctctctagaactctagagaaactgcagctgcggagaagcatggcgaaacttgaattgtatcggaagtttacaaattctctagctatgtcagtggttatctcaattgcttggattggctatgagctatatttcaatgcaaccgatccattgagtgagctttggcgaagggcttgggtcatccctgccttctggaatgtcctctcatatgtccttcttgccatcatatgcaccctttggtcaccatctcgtaatccaacaggatttgcatattcagaggagacaggtgatgaggctgacgaggaaggactctctcttgtaggcagtgctgttaaaggaacaggagatattgtgaacatgcatgtgtttactgaggataaacgtgcatgagaagttattgacttagtgcagctgtactccttgtggaatactatggaatgtaatcttgtgttatccaagcatgcagatagcacttttgactttgagcgccggaggcaactgcctctcaaatatggttggataacaagttagtacatagcatagtgaatttggattaga

SEQ ID NO: 3099 - DNA, 785 bp, Triticum aestivum
ggccagaatctcctctcccatcactcatacagctaaccagggcagagccatctcctttgctcactgttcacttagttgatattctctacagttactgcttcacacttcgcctctacatggtgattggcagtctgatcctttgggtcgcttcaactgttgccttgtctatgtcgaaagtcatgggggacggcgctaaacctgagacagtatctgaagcgctcacaacatgcatagaggagacatgctccccagcttacaggcacaccggaggtttcaggtttgctattggacttgtggatgatatcgtcacaatcctctccttaggaggcaatgcagtggtttgtgcattgtgtgacttccacaggctcatccaagctggtgagagcatcctcaaggaagacaaaatgggcgagacggaaaaggcacagagcttcaaaaagctccatgccgcgggtaggaagctgttcttcatgacatgctgggctcatgagcagccaagtgaggcctggccatcgttggctcgcatcgttgaggtgcagaaagtggcttttgaggagcttgacagtggaagcggactgaggaaggcaggtagaaagaacaacccacagtccaaggttcttatcgaggaggtgtaagcatatcaacgcagtactgctggaataaccgcactttgttttctcgccacccttttggtatctcccagctgtatcatttgatccttgtgcccttcttcatcttcaagtgcagtggcttaaatgtataaactgtcatctttggaagatgtg

SEQ ID NO: 3100 - DNA, 607 bp, Triticum aestivum
ctgaatagcatttggacagatacttcttgaccaatgtcccccttcacccttcttcttctccttcagtctagaactgcgtggttccattgtcccaatggacgggtccctgatgcacattgacagtgcaagttcgtaaagcagttgatagtgcgacagcatgggaggttgattgattgaggctctcctgactgctgcctctttcgctactctcaaccattcaggagtagctatatttgatgcctcaccgcagttgaaaccatggctgaaaccgcagtgatatgatcctgggaaggtgaccacgaactcccctgcattctgcaccaacctgcagcagggcacccccgagccgacgagcaattcaggggacagcagggtcgttttctgccccagcgtcgcgaatgcttctagggcgttcacctccccggcgtagccgtgcacgcgcacgacgtcctcgaaggcgagcgcggcgtcgcgcggcaccccgtaccaggtcttggcggcgccgaggtgcatgtagttgaggctgtggaggtcgtggtcctcgacgtgccaggcgaaccaactgaagagcatgccgacgtagagcatgggcgtgggaccccaggca

SEQ ID NO: 3101 - DNA, 606 bp, Triticum aestivum
tcgtgcgcgcgttcccagatcggacgctgcagctcatgaccacgcacacgccggagttcctcgggctgaggaatggcaccggattttggagcgacgcaggctacgggaaaggagtggtcatcgggctgctcgacaccgggatctatgcaacacatccttcgttcgacgatcatggtgtccaatcacccccgacaaggtggaagagctcgtgcaaggcggtcaggtgcaacaacaagctcatcggtgccaactcatttactggagataacgactcgtacgattacgtggggcacggaacacacacctcatccactgccgccggcaacttcgtcaccgatgcgtcagaccatggcgtgggcacgggcactgcttccggaattgctccaggtgcccacatcgccatgtacaaggtgtgcaccgccgagggctgcgaagaatccgccgtagtggccggcctggatgcggccatcaaggatggggtggacgtgctctcgctatctctcagtagcctcaccggtgtcagcttcaataaggaccccatcgccatcggcgcgttcagtgctatatccaagggcatcattgtggtgtgtgcggctggcaacaaag

SEQ ID NO: 3102 - DNA, 634 bp, Triticum aestivum
cgacgcgtggggcaaagcggacctccgcgcccacgagcgcaacatctgcaccgacgagtcatgcggcaagcgcttccagtcgcacaagtacctgaagcggcaccagtgcgtccaccgggacgagaggccgttcaagtgcccctgggagggctgcgggatgaccttcaagtggctgtgggcccagaccgagcacataagagtccacacgggagagcgcccgtacgagtgctcggttgtagactgcgggcagacgttcaggtacgtctcggactacagtcggcacaggaggaagttcaatcactactgatttggtcgtcgcagcgctgtaggggggcaaaggctcctcctctggctggtgctgctttgtgtgttgaggtacgttcgtccttcgtttgttgtagcaggctagcagctcacgtatttaattaaccgaccggcggctagtgttaatcccgttcgttaacaatgtgccaagtgtagtctaggaagtagagatagattggggggtaaaaggccagatggcccttcattctttttctccgtcaagtccagtcatgtatgtaatccctttataaagttttatcaattcgatgatgccgaaatctccctcagttgagtgatgtatctaaactaa

SEQ ID NO: 3103 - DNA, 599 bp, Triticum aestivum
gggtatgaaatggtatgtcatgcgatatttcaccacgcgcccagtagtatgaagcaactgatccagcaatttacggtcgaagagcatgcgatgaagaattgtgttgcccagtaacagccaaacaggtggaaaagaatcgcaattccaatatgaggggtgtaatggacactgtacccgcaacagctgtcacaatttacttttcccagcttgagatcaaatgagcagcactctgcattgcaatcattttgtagaacttgaccagagctgaaaagatacagtgtcgccgcaaaccagaacatatagatgatagcaagggcgaagtatggtacgaccggaaagatgatgagtgcatggacttcaccaatgacctttgcagccacctttaggacggttgtggatgtcgctatcagtatacgccgaacaatagctattgaagtcaggaaagcaatgatcattaccactgtcatcaatacagcagcagcatgaaggtggtttatttcccgtccacctatgctgacatatggatcacttggaccaatcacaacagttaagggatcattgccaatccagccagcttttatatagaagaacatcgtgac

SEQ ID NO: 3104 - DNA, 594 bp, Triticum aestivum
  misc_feature (98)..(162): n = any nucleotide
tgtcggattcattcttgtacagggagttggagaacggcgtgctctgggaagtagatggacaatgggtcgttcaaggtgcagttgatgtggacattggnnnnnnnnnnnnnnnnnnnnnnnnnnnnnnnnnnnnnnnnnnnnnnnnnnnnnnnnnnnnnnnnnccgtgaaggtgattgacattgttgacaccttccgtcttcaggagctaccagcttttgagaggaaggagttttgcacttacatgaagcgctacatcaagaacctcagtgccaagcttgaagatgaggaacaagaatgtttcaagaacaacattgagtctgccacaaagtttcttcttagcaagctcgcggattttcagttctttgtgggcgagagcatgcatgatgatggcagcctggtgttcgcctactacaaggacggagctgctgacccaactttcctctacttcgcacatgggctgaaaaagatcaactgctaattacgctgtatgctaaaatatatatgcagtcgtcagtactattgctcttgtctatggtcgccagcctactctccaatgttcgtgccgaaactatcacaagtttagtgtattaatg

SEQ ID NO: 3105 - DNA, 591 bp, Triticum aestivum
ggaccagcgtgtcacttagagcaagagttaacggaaatgatccttctgtaaatttagtagttacttggttcaacaagacaccgccaaagttatatgactttgaaagcttcatcaacttcaatgataatccactgagcactctagtcctcagagccagatcatcaaaatcttgtcggaagtggaaagtaacactatcaataataactattctcacatctttatgttctccgaggaatttctccagatagtttatcaccgcaatctgttcagtgtagctgcatattcggaagtagtagattcctgccaggaaactctcgggctgcagattttcttggccagatgacgacttgtcatggtggcatggaaaatactccattatgtcactgatacacccttcagcaatttgatagacgcgttcaaccatgaaactgccctctgtatcaatataaattgctttgccgccaaggccaccatagtccacgggaatttggacgttgattgcatagacatgaatccaccagattgagttttaccaaattcctggaaccccacctatctcagtaacttcatttacaatgaatccctccacca

SEQ ID NO: 3106 - DNA, 577 bp, Triticum aestivum
tgtacgggccctgggggcggccggacatggcctacttctccttcacccggtacatcctccaggggaaagcccatcaccgtgtaccggggcagggaccacgtggacctcgcccgggacttcactctacatcgacgacatcgtgcgggggtgcctggcgtcgctggacacggcggggcggagcacggggacgggcgggaggaagcgcgggccggcgccgtacaggatcttcaacctggggaacacggcgccggtgacggtgccgacgctggtgtcgatcctggagcggtacctccgggtgaacgcgaagcggaacgtggtggagatgcccgggaacggggacgtgcccttcacgcacgccaacatcagcctggcgcgggagcagctcgggtacaagcccaccaccagcctcgagatggggctcaagaagttcgtccggtggtacctctcctactacgggtacaaccggggcacgcaggcattcaacaacttgtgatgactcatggtatattagcattggtgtatagtatgtagtcgtacatttgtatgtatgtttgtacttttcttttttgcgtggttg

SEQ ID NO: 3107 - DNA, 569 bp, Triticum aestivum
gctgaaggagtgccaagtacatcagtcatgagatccaattgatggacaacattcttccctggaaagagtggcctccctgtgagcatttctgcaaagatacaccctacgctccaaatatcaattgcaggtgtgtactttgagaaaaaagagccacacaattctggagcacgataccatctagttgcaacatagtccgtccagaatatggctgatggagccccgtcattaaatgatacacgggcaagcccaaaatcacaaatcttcagcttgcagtcagcattcgctagaatattcttgggcttaagatcccgatggaaaacactcgctgcatggatgtacttcattccccggagcagctgatacaagaagaactggtgatgctctggtgtgagatcatcgttcgcttttattacctgatggagatcggactccatcagctcaaagaccacatatatgtccctgaattccctccttgaaggggggagcataatgtgcttgatctgaactatgtccgggtggcgcagcagccggagcaacttgatctccctaaggatgcgggtggcatcgga

SEQ ID NO: 3108 - DNA, 569 bp, Triticum aestivum
ccagtccatatctcggagataagtttccctccgtcggtgactttgtgcagatctaggccttcgtgtgatttcgcgtcatcctcttcgtagtcctgaacataaatgaagaacttcctagcgcggcgcttttcaaacaggcccattaggttagatttcaaggcttcaacatctgtcgcagggactttgtggatcttcccgttgttgtacacgaagctgccatcgacggccttgaagttcagatactttgtcacgctcgtgcggatcaaaacacggaccaatgcaccgttggccatcatgaacttgggcaccatgtcgacattgtactccttgctgatacccagatgttctggagtggtagtcgctgcctttgaatctcttccagatcttggccagattcagggatgtagattctccaccgtagtagtcattccatgtccatgatgaagaaccttgaggccatcgacaggagaggatgccactgaggatgcacatccattgagccccgtccccagcacagatcacgtcagtacaggcaacaggcagacataatatttttagccagcctccat

SEQ ID NO: 3109 - DNA, 706 bp, Triticum aestivum
agtaagccaagaaccagtactgtttcaatgacacaattcgtgccaacatagcatatggaaagcgaggagaagctactgaagaagagtataatcaccgtggccataggctagccaacgctcatgagttcatatcgagcttgccacagggtatacaacactaacgttggtgagagaggaacacaactatctggtgggcaaagcaacgggtagctattgccagggcgatcttgaaggaccctagaatacttctgctcgacgaagcaacaagcgccctggacgctgaatcagagcatattgttcaagatacactggaccaggtaatggtcagcaggaccaccattgtcgtagcacaccgcctctcgacgatcgaaggggcagatatgatcgcagttatcaaagatggttcagttgccgagaaggggaagcatgaatctctcatgggcatcaaggatggagtctatgcatcactggtcgaactacactcgaaggcggcataaggggagttgcagatatttaaagttcctttcttgtttcccgaactaccaaatgaaaaatgcatgtgtcagtttgtattacataaattttaagggcattcgcctgtaattctacttctctatttgttgggcctaagacatcagaggccagattggcccagcatgtgtttcagactttcagttgttgtggggtactagatatctacgcatta

SEQ ID NO: 3110 - DNA, 553 bp, Triticum aestivum
  misc_feature (459)..(492): n = any nucleotide
gcttgaactacaatctaataatccttggctctcatgtagttcgtccacaacgaacagtgaaatctctagaagctccaagagattcgctttcgcgtggtaaatccttagcatggcgaggcatctccaccgccggtgagaaatccagctagggtttccgcccccgttgacccgatgggcccgggcgcgccgtcgccggaggacgccgcgggcggggagccggaggcgtggtacggcagcatccagtacctcgtcaacatctcggcggtgggcgccgcctcctgcgtgctcctcttcctcctcgtcaagctccgcttcgaccaccgccgcatcccggggccctcagcgctcgccgccaagctgctcgccgtctaccacgccacggcgccgcagatcgcgctccactgcggcgccgacgccgcccagttcctcctcttcgagcgcgcctccttcctcgtcctnnnnnnnnnnnnnnnnnnnnnnnnnnnnnnnnnnctgccgctcaacctgctcgccggggacgccgccataagccgaccagttcgccgccaccaca

SEQ ID NO: 3111 - DNA, 701 bp, Triticum aestivum
atcatcgttaatggagtgtccggtaccacattgatccttaccagggtgacaaggcctctgctctgctagttgagttctttgagaagtgccaggttgaccccatgccactggacgaagatctcacagggcgggcttcagcgtattgaggagaaatacacctggaagctttactctgagaggctgatgaccctaaccggcgtgtatgggttctggaagtacgtctccaacctcgagaggcgcgagacccggcgctacctcgagatgctgtacgccctcaagtaccgcaccatggccagcaccgttccactagctgttgagggagactccgcgagcaagtaatctggccacctcctggccgaaagaagggtgacttggatttctgaaagattgagatttgagaatgatttggtttacgtcctaggcgctgcccctttcaagatttaaggttgagtaattggtgtgctagttttgtttagtagttggagtgagtcgagacagaggaaaatgtggtgtgtgacaatcggttggttggtgcttatcgtttttcttggatgttacccttgaataataggaacggacttggcgccgtttctgaaataataatagtagcatccttcctcgtttccaagaaaatcttttgtcactgctgttgagctctgtaacctctgttacctaatacaattactagatggttcattaca

SEQ ID NO: 3112 - DNA, 546 bp, Triticum aestivum
ccaaatgcatcatataatatcgctgctatcctatccctctgggcccctgttctgttggtctatttgatggatacacagatatggtacgccattttctctacaatatccggcggtatgtctggggcacttggacgacttggggagattcgaacactaggaatgctgagatcacgatttcactctttgcctggagccttcaatacatatttggtgccatcagacaaaggcagaaacagacgtttttcactctcaaagcgcttcgcagaggtttcccccaacaagagaactgaagctgctaagtttgctcaactgtggaatgaagtgatttgcagtttccgtgacgaagattttataagtgataaggagatggacctattggtggttccatactcgtcagacccgagcctaaaattgatgcagtggccgttgttcttgcttgctagcaagatacctatagctttagacatggcagcacaatttagaccgagagacagtgatttgtggaggcgtatatgtgcagacgtgcatatgagagtgcgctgtaat

SEQ ID NO: 3113 - DNA, 544 bp, Triticum aestivum
ggcgcaagagactctgaggaccgactgatggacatcctatcagaggaaggacagatcattaaatgtcacacatgacaataatgcaaaaagtaagtctgtgtatacgagagagatagtacccatcgctttgcagcgcgatcattggcatggtcgtcagcatcacttttcagtaaacagttaagttgagactgaacagtatccttttcttctatcaattccctaagctgtttttccagctgaaaagagaatggagaggtacatggtgcatgaaattgtgcagtcctgcaattaacactgtcacaagggttggaaaatttcagatgcttcagtagtgctttgtcagacatcactacattgacctgtgcatttgtaactacctcctttgcgcaagtcgcaaacagaagtgtgttcctggattgctcaatatgagtgtgtgcaggactcattgtgcagacaatggctgttcttgcattgcctcccaaagaggactgtaatatgcgtgtcagctttgaatctctgtaagggatatggccatttcttccct

SEQ ID NO: 3114 - DNA, 525 bp, Triticum aestivum
gcgccggagcagtcgggcgaccacaagcgcctctcgcaggaggcagacgtgtacagcttcggcgtgctcgtcctagaggcgctgaccggcaaggtgccggcgcagcacctgcagccgctgccggacgcagccggcaacagcgcacagaggaaagacaagcaggcggctgtgagcctcccggagtgggtgcggtcggtagtgcgggaggagtggacagcagaggtgttcgacgcggagctgctccggtacaagaacatcgaggaggagatggtggcgctgctgcacatcgcgctggcgtgcgtggcgcagctgccggggcagaggccctccatggccgacgtcgtgaggatgatcgagagcgttcccgtggaccagtcgccgctcccggaggaggatgtatcaatgtcgccctccattggcatcaccacggacgatggtctcagctactagttttagttcagtatcagctttcctcttccatagctagtagtagcattgaactgaggttgcttcggtcaagtacct

SEQ ID NO: 3115 - DNA, 587 bp, Triticum aestivum
cgcacccattgcccgcctcggcgggtacatcgcgccggagcagtcgggcgaccacaagcgcctctcgcaggaggcagacgtgtacagcttcggcgtgctcgtcctagaggcgctgaccggcaaggtgccggcgcagcacctgcagccgctgccggacgcagccggcaacagcgcacagaggaaagacaagcaggcggctgtgagcctcccggagtgggtgcggtcggtggtgcgggaggagtggacggcggaggtgttcgacgcggagctgctccggtacaagaacatcgaggaggagatggtggcgctgctgcacatcgcgctggcgtgcgtggcgcagctgccggagcagaggccctccatggccgacgtggtgaggatgatcgagagcgtccccgtggaccagtcgccgctcccggaggaggatgtatcgatgtcgccctccattggcatcaccacggacgatggtctcagctactagttttagttcagcatcagctttcctcttccatagctagtagtagcattgaactgaggttgcttcagttaagtacctgtgcttggtgatgttctgggttgaaatgcat

SEQ ID NO: 3116 - DNA, 558 bp, Triticum aestivum
tttttgcgctcgccgaccgggagcggcggtccggcgccgcgggagggcagggtcggtctccggacggccttggagcgcagatccggcccgcccggcaagcggcaatgcagcaggcgcagcggagcaagagttcggcggaggtggacttcttcacggagtacggcgacgccaaccggtacaagatccaggaggtcattggcaaggggagctacggggttgtgtgctctgcccttgatctgcagaccaggcagaaagtggccatcaagaagatacacaatattttcgagcatacctccgacgcagcgcggatcctccgcgagatcaagctcctgaggctcctacggcatcctgacgtcgtcgagatcaagcacattatgttgcctccctccagaaaggacttcaaagacatctacgttgttttcgagctcatggagtctgatctccaccaagttattaaggccaacgatgacttgacaaaagagcattaccagttctttctctaccagctactccgagccctcaagtacattcatactgctagtgtttaccatcgtgacc

SEQ ID NO: 3117 - DNA, 916 bp, Triticum aestivum
gagaaggagaagaagaacagatgacatcggaggagaagaaagcattgcgggaagagaaattgaaacaagaggagaagtatatgtgggctgttgttgatggtgttagagagaaggttggcaatttcagagtagaaccaccaggcttgttcaggggacgaggagagcatcctaagatgggaaaactgaagagacgtattcgtccaagtgatattacaataaacattggaaaaggcactccagtcccagagtgtccaatagagggacaaagctggaaagaagtcaaacatgacaatactgttacatggttggccttttggaatgacccgattagccaaaaagatttcaagtatgttttcttggcagcaagcagctcactaaagggacagagtgacaaggagaaatatgagaagtcccgaaaattgaaggatcacatacacaacattcgtgtaaattacacaaaggatttcaatagcaaagatgtctccaagaagcaaattgcattggcaacatacctcatagataaactagcccttagggctggtaatgagaaggatgatgatgaggctgatactgttggttgttgtacgctgaaggttgataatgttacctgcgtgcctccaaataagcttcagtttgacttccttggtaaagattctataagatatttcaacactgtagaggttgaattacctgtatacaatgcgattgaggaattccgtactggcaaaaaggctggagatgctgtctttgaccagcttgatacaacgaaactaaatcatcacctgaaggacttgatgcctggccttactgcgaaagtgttccgtacatataatgcttcgattaccttggatgctatcttgcacgaagaaacagaagatggaacccttcttgaaaggattgctgtctatcaacgagc

SEQ ID NO: 3118 - DNA, 784 bp, Triticum aestivum
ccccatgtctgtcagtcccagactgcacaagctcctggccgacgatgtcgtcttcgtcaaccctgaaggccagtgcagctatgggtatcttgcccccgagtacgccaacacggccgcttcaccgagaagagcgacgtcttcgcctttgggatagttgttctccaggtcatcacgggcaggagggccgtctcacaagtgaaggtaggcacagcgtccagcgatctcgaaggcctgatagatccataccttggcggcatcttctcgacgactgaagctgccaggcttgcagaggtcgctgtgcattgcacgtccgaagcagcgagccagaggccgaccatggaggctgtggttcagcaactcagcggctgatgccgtggatcggaaccgagctgatgaagatgtctgttgggaggccttttgtagtagtaagctggaggacagtgatgatccagttgccacccaatgaggtctgaggtcttttgtagtaataatctgacctgctaatgtggaacatgtcgccattaactatttagtcactttcctggtgatctcaccatttctaagtatcacaatctcttcacaacttgaatgctgaaagattgtgtatcaatgagattgacttgaacccttggttagctagatcagcatgccaaaatgttgaatgtgtgagccatttggttcagggattttagcatctgtggtgtaaactttgatggctttgtgctactgccatagtgccatagcctgcattcaagtgctctgccatatgtttaaagcatggcaa

SEQ ID NO: 3119 - DNA, 1321 bp, Triticum aestivum
cgcgctggtgcaagggaagatcgaggtggtgaaatgctcgctgctcggctccgtgctctccaacctgcttctcgtccttggcacctcgctcttctgtggcggcatcaagaacctcggggccgaccagccctacgaccggaaacaagcggacgtgagcacgggtctgctcaccctgggcgtgctgtgccagtctctgccgctgctgctgcgttacgccgtcagctccggggagcatgctgtcgccactgacaccacggtgctggagctctcaagggcctgcagtttcatcatgctcctcgcctacttcgcctacctcttcttccagctcaagacgcatcgccagctcttcgagccgcaggagattgagggcggcgatgatgatgaggaagaggcggtcctcggctttgggagcgcgctcttctggctcatcctcatgaccatcataatcgccgtgctctccgagtacgttgtcggcaccatcgagccgacctcgcagtcgtggggtctctcggtgagcttcatcagcatcatcctgctccccatcgttggtaacgcggcggagcacgccggagccgtgatcttcgccctgaagaacaagctggacatcaccctcggtgtcgccttggggtcggctacccagatctccatgttcgtggtgccattgagtgtccttgtcgcttggatcatggggattcagatggatctcgacttcaagctgctagagactggctctctcttcatctcggtgctagtgacggccttcaccctccaggatggaacgtcacattacctcaagggagtcctcctcctcctatgctacattgttatcggcgcctgcttctttgtcacgagacaaccagcacctcacgcgaacaacaacggcacgctgctggatgtcccaacgggtcccatgattgtccaggtcgcataagtactgattgattaagagggctgcctcggcaaactggcatgcgtgcaagacagcgaacgaagtgtttgagcctgaagccaccaaattctgtctatcatatctgggcataactgtgccaaggaagattcaggaagagaattccccgtgtcagagtccccatccaaaaggaatcggttgattagttgttgccagaaaagcatgcaattgtaccagatattttctttattttctcgaatcgtacgtactgctagctatttttattgcttcttgtatattgtctaggctgttcgccgtgcaataagcctagctcatatgcgtctagccatatgtatacatcggcaacagtgggttgttacagttatgcggatcagtatgatatatgtaatgatg

SEQ ID NO: 3120 - DNA, 605 bp, Triticum aestivum
aggagaggacggttgtcttcttcagggtgttcaagaccaacgacaccaattacgtctgtcctcatgtgtaatgacccaacaaggtctgtattatgagtcgcagatctacaggccgacctttgcgggcttcgtcaatgtcgacatagccaagaccaagaagatcgccctcaggacattgattgaccattctgtggtggagagcttcggggccggcggaaagacgtgcatcctgacgagggtttacccgaggaaggccatcggggacgacgcgcacctcttcgtcttcaacaacggcgagtcggacatcaaggtcaccattctgtggtggagagcttcggggccggcggaaagacgtgcatcctgacgagggtttacccgaggaaggccatcggggacgacgcgcacctcttcgtcttcaacaacggcgagtcggacatcaaggtcaccaaactgcacgcgtgggagatgaagacccccacgatgaacaagctgctggagcagtagcagcggcctagaggatcgaggagtagaagtagcctatcctagccatagctagctagcttattagtttcgctgagatggatcaattaggagaggctgaagtt

SEQ ID NO: 3121 - DNA, 653 bp, Triticum aestivum
tctgggagaactagtcgttcatcgttgctcttgtgtactgcgtcacgggcatcggctacaccttcgccatcttcttccagccaggctccgcacaactgtggtctgcactgctcccagtcgttctcaccttgatagcaactcagcagaaggacactatcatagctgatctttgctacacaaagtgggctctggaggcgttcgtgatcgccaatgctcacaactacaccggggtgtggttgataacacggtgcggctctctgcaaagtaacggctacgacatcagcaacaggagtctctgtttatgggtcctcgtggccaacggggtgatcttccgctgcgtagccttcttctgcatggtagtcttccagaagcactgacccctctgtcgatagatccgttcatcgattctttctttctctgcgtaacagaaaaatgtacaattgttagagctttctgtctttcacagcatgcatgaggtgtagataagaacaacagatttacctttttcttgttgtggagatgtaaagagcaggatgttgagtagcagcaggcagctggtcaggaatgccctaatttttatgtagaggcgtatccattttcagattagctgatgatagcacatgtcagaggtacacttcagttgtgcctcagcc

SEQ ID NO: 3122 - DNA, 711 bp, Triticum aestivum
aaggagagcaggccccccagactcaggagaagaagctcatcctgagatcaagaaggtaccaagcaaggacagatgggagctgtgaaagttatggcaaaggaccttattcgcacaaggcatcagatcacgaaattttatgccctgaagtcccagttgcaaggtgtatctcttcgtattcagaccctgaaatcaacacaagccatgtcacagatgaacaggcagatgaatctaccggcactgcagaagataatgcgggactttgagatgcaaaatgagaagatggaaatggtcagcgaggttatgggtgatgccatcgacgacgccttggagggtgatgaggaggaggaagaaacagaagagctagttagccaggtcctcgacgaaatcggcatcgacatcaactctgagcttgtcaaggctccggctaccgcagtcgccatgccggttgcagcgggaaaggcgcctgttcaagctgaagctgcgggcgggatggacggtggaatagacgatgacttgcaggcacggcttgataacctgaggaagatgtgagcattgacggattgtccacgcccgcgcaattctctgtagttttgtaccatataaatgccactccggcaaatctattgacatatcatttgcagtgtgtttggcattgaccatctgtatatagacagatcatcatattttcaataagtcacatactaggcttgg

SEQ ID NO: 3123 - DNA, 702 bp, Triticum aestivum
tcgctgagtcaagaaggtagccaagcaaggacagatgggagctgtgaaagttatggcaaaggaccttattcgcataaggcatcagatcacgaaattttatgccctgaagtcccagttgcaaggtgtatctcttcgtattcagaccctgaaatcaacacaagcaatgggggaagccatgaagggcgtcacaaaagccatgtcacagatgaacaggcagatgaatctaccggcactgcagaagataatgcgggactttgagatgcaaaatgagaagatggaaatggtcagcgaggttatgggtgatgccatcgacgacgccttggagggtgatgaggaggaggaagaaacagaagagctagttagccaggtcctcgacgaaatcggcatcgacatcaactctgagcttgtcaaggctccggctaccgcagtcgccatgccggttgcagcgggaaaggcgcctgttcaagctgaagctgcgggcgggatggacggtggaatagacgatgacttgcaggcacggcttgataacctgaggaagatgtgagcattgacggattgtccacgcccgcgcaattctctgtagttttgtaccatataaatgccactccggcaaatctattgacatatcatttgcagtgtgtttggcattgaccatctgtatatagacagatcatcatattttcaataagtcacatactaggc

SEQ ID NO: 3124 - DNA, 722 bp, Triticum aestivum
caggagaagagctcatcgctgagatcaagaaggtggccaagcaaggacagatgggagctgtaaaagttatggccaaggaccttattcgcacaaggcatcagatcacgaaatttttatgccctgaagtcccagttgcaaggtgtatctcttcgtattcagaccctgaaatcaacacaagcaatgggagaagccatgaagggcgtcacaaaagccatgtcacagatgaacaggcagatgaatctaccagcactccagaagataatgcgggactttgagatgcaaaatgagaagatggaaatggtcagcgaggttatgggtgatgccatcgacgatgccttggagggtgatgaggaggaggaagaaacagaagagctagttagccaggtcctcgatgaaatcggcatcgacatcaactctgagcttgtcaaggccccggctaccgcagtcgccatgccggttgcagcgggaaaagcgcctgttcaagctgaagctgcgggcgggatggacggtggaatagatgatgacttgcaggcacggcttgataacctgaggaagatgtgagcactggactctgacggattgtccacgcccgcaattctctgcctgtagttttgtaccataaatgccactccggcaaatctattgacgtatcatttgcagtgtgtttggcattgaccatctgtatatagacatatcatcatattttcaataaatcacatact

SEQ ID NO: 3125 - DNA, 1017 bp, Triticum aestivum
gacgaatcaaccaacccactataaccaatccgcgtcaacagctcaacacccatctcctctccggcgtatctaatcctccaccatccgacgcgcaacaggaaggggaacagccagatcgatccgtgggactcacagtccagcccaatccaggcagccggccggccggatccgacctccgcccgccgccatgagcttcctcttcggcaagcggaagaccccagctgagctgctgcgggaaaacaagcggatgctagataagtccatcagggagatcgagagggagaggcagggcctgcagactcaggagaagaagctcatcgctgagatcaagaaggtggccaagcaaggacagatgggagctgtaaaagttatggcaaaggaccttattcgcacaaggcatcagatcacgaaattttatgccctgaagtcccagttgcaaggtgtatctctccgtatccagaccctgaaatctacccaagcaatgggggaagccatgaagggcgtcacaaaagccatgtcacagatgaacaggcagatgaatctaccagcactccagaagataatgcgggactttgagatgcaaaacgagaagatggaaatggtcagcgaggttatgggtgatgccatcgacgacgccttggagggtgatgaggaggaggaagaaacagaagagctagttagccaggtccttgacgaaatcggcatcgacatcaactctgagcttgtcaaggccccggctaccgcagtcgccatgccggttgcagcgggaaaggcgcctgttcaagctgaagctgcgggcgggatggacggtggaatagacgatgacttgcaggcacggcttgataacctgaggaagatgtgaacattgacggattgtccacgcccgcgcaattctctgtctgtagtttcgtaccataaatgccactccggcaaatctcttgacgtatcatttgcagtgtgtttggcattgatcatctgtatatagacagatcatcatatttcaataaatcacataag

SEQ ID NO: 3126 - DNA, 867 bp, Triticum aestivum
cgcaggtgaagaccgccgccaccgacggctacgacgccgtgcaggtcgggtaccacggcgtgcgcgaggacaagctcacccgcccggagctgggccacctcggcaaggccagcgcgccgccgctgcggcacctgcaggagttccgcctggtggccgtcgacgccttcgaccccggccaggcgctcgagttcaacgagctcttcaaggagggcgacctcgtcgacgtctccgccaaatccatcggaaagggattccaaggtggaattaagaggcacaacttcaagcgtggtctgatgactcacggttccaagagccacagagccctaggttcgatcggtgcggggacaaccccagggcgggtgtacaaggggaagaagatgcccgggaggatgggcggaaccaagaccaagatcaggaagctcaagattgtcaggatcgacaatgatctcaaagttgtgatgatcaagggagccattcccgggaagcaggggaaccttctccgcatcacgccagcgaagattgtcggcaagaacatccccaagagctagatctgtgctgtgtttcatcttgtaagagttcatttgtttccttttccatgtctggctatgttgtattcctaggtccaggttttgtatacatgttcagttcgctaaagctaatctttggacacaagtgcattctcctccatgttgtcaaccacttcttcaccttcttttggactcgaaacgaagcagattctctctatcaaaaaaaaataataaaaagacaagaagaaggggaggagggggcgggagctacaaaaacagccacggtccgagcgcggggaagcagccacagccacagaggcacacaaaacaggagggcgga

SEQ ID NO: 3127 - DNA, 728 bp, Triticum aestivum
ccggaaaacgggaagcccgtgccggtgacggtggtcggttccgggaggggggcaacgtggtgacgcaggtgaagacggccgccaccgacggctacgacgccgtgcaggtcgggtaccacggcgtgcgcgaggacaagctcacccgccctgagctgggccacctcggcaaggccagcgcgccgccgctgcggcacctgcaggagttccggctggtggccgtcgacgccttcgaccccggccaggcgctcgagttcaacgagctcttcaaggagggcgacctcgtcgacgtctccgccaaatccatcggaaagggattccaaggtggaattaagaggcacaacttcaagcgtggtctgatgactcacggttccaagagccacagagccctaggttcgatcggtgcggggacaaccccagggcgggtgtacaaggggaagaagatgcccgggaggatgggcggaaccaagaccaagatcaggaagctcaagattgtcaggatcgacaatgatctcaaagttgtgatgatcaagggagccattcctgggaagcagggaaaccttctccgcatcacgcccgcgaagattgtcggcaagaacatccccaagagctagatcggtgctgcgtttcaccttgtaagagttcattcgtttctttttccatgactggcactgttgtattcccaggtccaggttttgtatacatgttcagtttgctaaagctaatctttg

SEQ ID NO: 3128 - DNA, 380 bp, Triticum aestivum
tttctattgagatatgcaaagctaataggaagattttgaggagttggtgggatcagacccagacaggaacattgattgagattgatgatgtgaaatccctcaaggatgatgaaattgcatcatatgttcatagatttggcggcttcgacttggtgattgggggcagcccatgtaacaatcttgccggaagcaaccgacaccatcgtgatggcttggagggcgagcactcatctttgttctatgactactttaggatcttgaattccgtcaagtcggctatggcgaacatgtagcctaatcgctgtagtacctatgctatcgtttaatgcttatatctaggaactgtaaccgatctaacgttaaacattgagtgatgtggg

SEQ ID NO: 3129 - DNA, 636 bp, Triticum aestivum
cagtgagctggctatctccacgtagtgatcaagaggctctaagctgcacccgccgggccgctcctgctcccacgggagtgtcgcgaggcatgtcgggtgatgggctacgacgtgcccaagggcacacaaggtgttgtgaacgtgtgggcgatggggagggaccacatgtactggggtgacgcggaggcattcaggccagagagattcgaaaacagcaccatcgacttcaagggagccgacttcgagttcctcccattcggagctggccggaggatgtgccccggcatgtcgctcgcgatggccaacatggagttgtcgctagctagtctccttttccactttgattgggagctgccctgtggcatgaggcccgaagatatggacatgacagagactttcggtatcacagcgagaaggaagttcaagctctcggtgcacgcaaaatcccacgtcccatgtggaaattgatttgtttgttaatggctcaatgcatgtagggatggcgccttaatttggaattatatgtattttctggccaatacattcgcgtagctgcaaggtgtcatcatcgtccttgtacagttgaataccctgtttgaatctcagttgctgttgcatatgtatgtctcatttata

SEQ ID NO: 3130 - DNA, 589 bp, Triticum aestivum
gctatctccaactagtgatcaaggaggctctaaggctgcacccgccggggccgctcctgctcccacgggagtgtcgcgagacatgtcgggtgatgggctacgacgtgcccaagggcaccaaggtggttgtgaacgtgtgggcgatggggagggacgacatgtactggggtgacgcagaggcattcaggccagagagattcgaaaacagcaccgtcgacttcaagggcgccgatttcgagttcctcccgttcggagctggccggaggatgtgccccggcatgtcgctcgcgatggccaacatggagttgtcgctagctagtctccttttccactttgattgggagctgccctgtgacatgaggcccgaagatatggacatgacagagactttcggtatcacagtgagaaggaagttcaagctctcggtgcacgcaaaatcccacgtcccatgtggaaattgatttgtttgttaatggctcaatgcatgtagggatggcgccttaatttggaattatatgtattttctggccaatacatttgcgtagctgcaaggtgtcatcatcgtccttgtacaattgaataccctgtc

SEQ ID NO: 3131 - DNA, 1092 bp, Triticum aestivum
ggagcttactgacctgtacaacgcgaggcagtatgttgagaaaaagatgaaggacgataagtcatctaataacatgaatgaaaccaagtgggatgaggagatcaagaaagcagcagagaagggccagctgagtaacatgaaggagtgtgaggatatcctcgaggacatgctccactgggacaagttgactactgatgagataaagcaaaaggtggaggccaaatttaacgagttgggggacatgtgtgagatgggggagcttgacctgagcaggcttatgagctatttaaagattttgaggataagatggtctcagagtgcacagaactgatggaagcagaaccgctgactgtaaatgaattttctggggcagataataagagcgtcgagttgaatgatccacctggtgagggacctgttctaaggtgggagtcacgcattgtctttgcccctggtggtgatgcatggcatcccaaaaataggaaagttaaactcagtgtaactgtcaaggaactgggactttcacggcatgctttccgtcgattacgtgaggttgttggaaagaggtataattcaggaaaagatgagctcacaataatcagtgaaaggtttgatcatcgagaagagaacagaaaagattgcttgagaacactgtatgctctagtggaagatgcgatgaaagccgatgtgttggccaatgctgctagagatgcttatgttaaggggaggctccaggctaactctcagttcatggaccggctgaagatgaagacacaaaaattaaggcaagctgcataagctgcagaatggagcttccggttggaatatttcatctcccttgttatcaattatggggaccgtcatgctcaatatttgtacggctatcagcaatacatggataaggagaaagatgtgtccttctgcacttcattttgctgcccttctttgcactattttgtaggtttactgtatattttgctccttccgaaggaaactatattttatattccgaacataccatgcccgtgcaaccactttgcacaagcgattagtgaagaaactattaattgttcctgaataagaaagctacgc

SEQ ID NO: 3132 - DNA, 1596 bp, Triticum aestivum
ttttgactgctgctgtcacttgctgaccagagactggggaaagaaggctttgaggctggtgccatgtgttctttctgatcgtggcttgtctcatttgatgaatttgataagatgaatgatcaagaccgagttgctatacatgaagttatggaacagcaaactgtgaccattgccaggcaggaatacatgcatcgctaaatgcaagatgtagtgtaattgctgcagcaaatccagtatatggatcttatgatcgttcaataacaccacaaagaacattgggcttccagattcactgctctctcgttttgatttgctttttattgttctggatcaaatggatgctgagatcgatcgccagatttcagaacatgttgcacggatgcatagatactgtgctgatgatggaggagcaaggtcttttgataaagcaggatatgctgaagaagaagatggtgatgccaatgcagccatatttgttaaatatgatagaatgctccatgggcaggatagaaggcggggcaagaaggccaaacaggacaggctgactatcaaattcctgaagaaatatatacattatgcaaagaaccttattcagcctaggctcactgatgaggcatctgaccacattgcaactagatatgctgagctcagagatggcagtgcaaatgcaaaggctggtggaggtacccttccaattactgcaaggacactggaaacaataattcgtctatctactgcccatgcgaagatgaaactgagacatgaggttcttaaaactgatgttgaggctgcactgcaagttctgaattttgcaatattccataaggaattgactgacatggaagaccgtgagcagagggagactgagaaacaacaagctgagcaagatgcaggtgcaggtggtgataatgtagatgggcctggaggtgcaagcggtggcaatgcagacgtgcatggaagctctggcaacgacccaatggatgtggatggaggctcaggcaatgcatcaaatgatcaggatgtttcttcacagagaatggaagcatttgaggcgattcttggacagcatgtgctggcaaaccatgttgatcaaatgtccattgatgaagttgagcaaacagtcaacagagatgcagctgttgcttacaccagaggccaagtagagttcatcctggagaggatgcaagatgcgaacaggataatgataagggacggcattgttcgcatcatctagtcagaacatggattgacgttggacaagctgattgtggcatgcgctgtcctgatctgttctccgctttgtctgaaatcctggagaggctttgctgaaactctgcatgtgtggctgagctgtctgttgattactttgtatcttgatttttatcagtgaggtttaaattgatggtactatttattcatgtaatgtactgtctgacctagtgctatttagtccctgattatgtctggtttgcatggttaaatgcatctaaactagttgcaccgggcatatatgacagccattgtcacaagaaatggcttgatctgttggtgcccaaatttaccctaccaatagtgctataatactttggctttcgc

SEQ ID NO: 3133 - DNA, 688 bp, Triticum aestivum
gcttgcgtgtaaatccaacctttatgtggatgggaaggtttgtttaagcctcttaaatacttggactggcagagggaatgaagtatgggatccatcctcatctagtattctccaagtactagtctcacttcagggactagttctcaatgaaaagccctatttcaatgaagctggatatgagaagcaagtcggtactgttgaaggggagaagaatgcactgccatacaacgaaaacacatatctgctaagcgtgaaatccatgttgtatatcttgaggcggcctcctatgaatttcgaggattttgtgaaaagtcacttctgcaagcgcggcgactacattctcaaagcttgtgaggcctacttgcaaggagctgtggtcggcacgctgaatgacgatgcctgccccactgatactaacaaggagtactcttgctccatgggcttcaaacttgcattgggcaaaatcttgccaaggttgatcacagccttgaaggacataggagcagactgcagccagtatgagcacctcgggaagaccgagaccgctcaagaaagctgaacaccgagctgaggattgtattcaaatcttttcttggcttgagaaaacatgataaaacttcacctcccgctgtttccgtataaatgtacatccaacatttgttgttttattatctcaacatgaacattt

SEQ ID NO: 3134 - DNA, 1342 bp, Triticum aestivum
tgatcctgcaaatgttgatctgcaaaatgcagtccagaatagcattgaaatggaaaatgggtcattcaattcccaagatgaaacttctgttggaagtggtccactctctgttgcttttggctttgttacgcgactggcgagtgagatcttcgcccgagaatctggtgatgacattgataaaaacgaggatgagaaccgcatggcagcatcggagagcaccactgtggcaacaaatgactctaatgctgagaagtccgtagatgtagttatggctgacgagcctgcagattctgattgcttgaaacactttgatgttctgcagtgccctccggaccatcactaccttgaaaacatagcacatggtaccggtggacgaaagtgggtcaaaaaagttcagcaagaatggggcatacttgagaagaatctaccagattatatttatgtcagggtatttgaagatcgtatggatctcatgagagctgtgattattggagcaagtggcacaccataccaagatggtctgttcttctttgatttctaccttccacctgagtttccacaagctcctccgtcggcatactatcattctggcggcttgcgtgtaaatccaaacctttatgtggatgggaaggtttgtttaagcctcttaaatacgtggactggcagagggaatgaagtatgggatccatcctcatctagcattctccaagtactagtctcactccaggggctggttctcaatgagaagccctatttcaacgaagctggatatgagaagcaagtcggtactgttgaaggggagaagaatgcactgccatacaacgaaaacacatatctgctaagcgtgaaatccatgttgtatatcttgaggcggcctcctatgaatttcgaggattttgtgaaaagtcacttctgcaagcgcggccactacattctcaaagcttgtgaggcctacttgcaaggagctgtggtcggcacgctgaacgatgatgcctgccccaccgatactaacaaggagtactcttgctccatgggcttcaaacttgcattgggcaaaatcttgccaaggttgatcacagccctgaaggacataggagcagactgcagccagtacgagcacctcgggaaaaccgaaaccgctcaagaaagctgaaaatcgagccgagggttgtattcaaatcttcccctggcttgagaaaacatgataaaacttgacccccctgctgtttccgtataaatgtacattcaacatttgttgttttattatctgaacatttgggaaacgtggttccaaatgaatccatcatctcttccaaactgggaattgaggtgtgtcctgcac

SEQ ID NO: 3135 - DNA, 728 bp, Triticum aestivum
ggcgggcgggtgtgggcgcgcacggggtgcagcttcgacggcgccggcaacgggcggtgccagacgggcgactgcggcggcaagctgcagtgcacgcagtacgggcaggcgcccaacacgctggccgagttcgggctcaacaagtacatgaacctcgacttcttcgacatctccctcatcgacgggtacaacgtgcccatgtcgttcctgccggcccccggctcccccgggtgccccaagggcgggcctcagtgccccagggtgatcacgccgcagtgccccaacgagctgcgggccgccggagggtgcaacaacgcgtgcacggtgttcaaggaggaccggtactgctgcaccgggtcggcggccaacaactgcgggccgaccgactactcgaggttcttcaagggccagtgctccgacgcctacagctaccccaaggacgacgccaccagcacctacacctgccccggcggcaccaactaccaggtcatcttctgcccatgatcgagctaaaactaggcagccattgaagcggtctcgatcgagcacacagacaagaaggagtctatctgatcttatataaaaataagcgtgattggatgcatacgttcatatgtacaatcacatgtaagcgggaaatggatgtattcgacaaggaaattgctaaaaagatttgagagggctatttactatattttccaagtccaccgaatatacatcacatttca

SEQ ID NO: 3136 - DNA, 1020 bp, Triticum aestivum
acttaagctccactacaacaagggagaggagagaacacgatggccacttcatcagtcctcctccctgtgctcctcctggtggccgtcgccggcgcggaggcggcgaccttcacggtgatcaacaagtgccagtacacggtgtgggcggcggcggtgccggccggcgggggcaggaagctggacgcggggcagacgtggagcatagacgtgccggcgggcacgacgagcgggcgggtgtgggcgcgcacggggtgcagcttcgacggcgccggcaacgggcggtgccagacgggggactgcggcgggaagctgcagtgcacgcagtacgggcaggcgcccaacacgctggcggagttcgggctgaacaagtacatgggccaggacttcttcgacatctccctcatcgacgggttcaacgtgcccatgtcgttcgtgccagcacccggcacctccgggtgccccaagggcgggccgcggtgcccgagggtgatcacgccgcagtgccccagcgagctgcgggccgccggagggtgcaacaacgcgtgcacggtgttcaaggaggaccggtactgctgcacagggtcggcggccaacaactgcgggccgacggactactcgaggttcttcaaggggcagtgctccgacgcctacagctaccccaaggacgacgccaccagcatcttcacctgccccggcggcaccaactaccaggtcatcttctgcccatgagtggccatgaaagggtctcgagcacatagacaagaataagtctatgtctatccgttcttatatatcaaaataagtgcaactggatgcatacattcgtacgcacatgtaagccggaaatggatgtattcgatcgacgtgcgtaataaagtcgtgcatgaataaaatgctcttgcgtaataaatacatgcgtgcatgttcttgtagtagatatgattgagtgttcttgtagtactactactagataagatatctataggtgactacattgcctaagagcatggttaataataa

SEQ ID NO: 3137 - DNA, 641 bp, Triticum aestivum
cagcgatacaagtctctcggcaactcatttcaagttgatacagttgcttaccacttgtcagtgctgaggcgcatgtttcccaatggtgttcgtgtgctgtccttattcaccggtattggaggaggagaggtagctctgcacaagcttgggatccacatgagggtagtggtttcggtagagataggtgaagctagtaagaagattttcaaaagttggtgggatcagacccagacaggcacattgattgagattgatgatgtgaaatctctcacaaatgatagagttgcatcatttattagtcaatttggtggctttgacttggtgattgggggcagcccatgtaacaatcttgccggaagcaaccgacaccaccgtgatggcttggagggcaagcactcagctttgttttatgactatgtcagaatcttgaatttcgtcaagtcggccatgggaggacgtaggatgtagcctaatcattgtacactacctatgctatcgtttaatgcttatatctaggaactgtgacttatctgtgtttaaacgttgaattgacatggaggatttattttggagaaagctcacattaacatttaggcatatggtttattgttgctaattaatttagagcctgttcatcttta

SEQ ID NO: 3138 - DNA, 887 bp, Triticum aestivum
acaatttgccaattgagaacagatcgcctcttcttcctctgcccccaaagacaatatttgaggcattccctcattacaagaagtggtggccttcctgggacacgagaacacatcttaattgcttacaaacatgtgtagcaagtgcaaagctgacagaccggatccagcgtgctcttgtaagctcaagcaatccaccgccaaaaagtgtccagaaagatgtcatggacgagtgcaaaaaatggaatcttatctgggttgggaaaaacaaggttgcgcccttggagcctcatgagatggaattactacttggtttcccaagggaccacacaaggggagttggcaagacacagcgatacaagtctctcggcaactcatttcaagttgatacagttgcttaccacttgtcagtgctgaggcgtatgtttcccaatggtgttagggtgctgtccttattcaccggtattggaggaggtgaggtagctttgcacaagcttgggatccacatgagggtagtggtttctgttgagataggtgaagctagtaagaagattttcagaagttggtgggatcagacccagacaggcacattgattgagattgatgatgtgaaatctctcacaaatgatagagttgcatcatttattagtcaatttggtggctttgacttggtgattgggggcagcccatgtaacaatcttgccggaagcaaccgacaccaccgtgatggcttggagggcaagcactcagctttgttttatgactatgtcagaatcttgaatttcgtcaagtcgacgatggcaggacgtaggatgtagcctaaccattgtactacctatgttatcgtttaatgcttatatctaggaactgcgacttatctttgtttaaat

SEQ ID NO: 3139 - DNA, 686 bp, Triticum aestivum
gctcgcgtggcaccgccatgggctgtatcatcgggccactaacattcatgctgttctacaaggcatttgacataggcaacccagaagggccctggaaggcaccgtatgctctaatctaccgaaacatggcgattcttggtgtggagggtttctctgctctaccccagcattgcttgcagctgtgctatgggttctttggctttgcagtggtggccaaccttatgagggacctcttgccgccgaagtatggcaggtgtgttcccctaccgatggcaatgggggttcctttcctcgtcggcgcgagctttgccatcgacatgtgcgtgggaagcttagtagtcttcgtctggaacatgatggacagaagtaaggctgcactgatggtgccggcagttgcatctggtttgatatgtggagatgggctttggatcttcccttcggccttgcttgcactggccaagatcagcccaccattctgcatggcatttaggcctacacactagggacagtaacaaactactctatgtacagttagaagacatacatcctggcaagaatgcagtaaataggttttgcatagccgggcgagattgtagcatgcacatgcattttttcttcttgtattgatatgttgctgtatatagttttggcaacaagtcacacaaggtgtaatactgtaagatgtg

SEQ ID NO: 3140 - DNA, 868 bp, Triticum aestivum
tgggaaggttgccctcttcattcttgcagcctgggctggaaaggactctggtgtagttgctggcttagtaggctgcggtctggtgaagtcgctggtgtcaatatctgctgatctgatgcatgatttcaagactgggcatctcacactaacatctcccagatcaatgcttattgctcaggctattggcaccgccatgggctgtatcatcgggccactaacattcatgctgttctacaaggcatttgacataggcaacccagaagggccctggaaggcaccgtatgctctgatctaccgaaacatggcaattcttggtgtggagggtttctctgctctaacccagcattgcttgcagctgtgctatgggttctttggctttggagtggtggccaaccttatgagggacctcttatcgccgaagtatggtaggtgggttcccctaccgatggcaatgggggttcctttccttgtcggcgcgagctttgccatcgacatgtgtgtgggaagcttagtagtctttgtctggaacatgatggacagaaataaggctgcactgatggtgccggtagttgcatctggtttgatatgtggagacgggctttggatcttcccttcggcattgcttgcactggccaagatcagtccaccattctgcatggcatttaggcctacacactaggacagtaacaggctaggtctatgtacagttaggaaacatacatcctggcaagaatgcagtaaataggttttgcatagctgggcgagattgtagcatgcacatgcatttttttcttcttctattgatatgttgctgtatagttttggcaacaagtcacacaaggtgtaatactgtaacatgtgggaataa

SEQ ID NO: 3141 - DNA, 652 bp, Triticum aestivum
ggagccctccgctcatttcccttggagaagatacactatggcgagagagagcggcgggcatgagctcccttgcatacttcatgtccaaggacacgatcgatcacttcaacacgatcgtgaagccgatcgtctacctctccatgttctacttcttcaacaacccgaggtcgtccatctgggagaactacgtcgttcttgtcgcggtcgtctactgcgtcacggggatcggctacacctttgccatcttcttccagcccggttcagcacagctgtggtcagcgttgcttccggttgtcctgaccctcttctcgaatgagcagaaggacagcgtctttgctaacctatgctacacaaagtgggcgctcgaggcgttcgtgattgcaaatgcgcagaggtactctggtgtttggctcatcacgcggtgcggttcgctggtgaagatggggtacgacatcgaccacaagatcacgtgtatacttgtccttgctgcgaacgggatagtgttccggtgtatagccttcttctgcatggtcatcttccaaaagcactgatgatttctttcgttttttcttcatcagcatatgtatcccatgtatgtatgctatgtatgtttgtaactgacagactgatcgagtagtagtagaacaagaag

SEQ ID NO: 3142 - DNA, 563 bp, Triticum aestivum
tcaacgtgtgggcgatggggagggacgacagtatctggggcgacgcggaggcattcaggccggagaggttcgagaacagcaccgtcgacttcaagggcgccgacttcgagttcctccccttcggagccggccggaggatgtgccccggcatgtcgctcgggatggccaacatggagctggcgctggctagcctccttttccacttcgactgggagctgccctgtggcgtcggggccgaagacatggacatgacggagaccttcggcatcacggtgagaaggaagtccaagctctgggtgcacgcgaaaccccacgttccatgtgagaattgatttgtttgttaggaaaaatatgtactccctcagatcggaggtagtagctgattggtacccgtggccaatagattcgtgttgcggccttgcacgattgaataccctgtgtaaatctcggtaggctgttgtactcatttgtttctttgttcaaagagttttggttgtatcgatggagaactgtagatgccaaatgcatccaattcggtagctatgaacaacaatggagggacg

SEQ ID NO: 3143 - DNA, 749 bp, Triticum aestivum
acgtatccatttcagctttcgtcgtatgcccctgttatctctgcggagaaggcttaccatgagcagctctctgtgcctgaaatcaccaacgctgtgtttgagccctcaagcatgatggccaagtgtgaccctaggcatggcaaatatatggcctgctgcttgatgtaccgtggtgatgttgttcccaaggacgtcaatgctgcggtagcaaccatcaaaaccaagagaactgtccagttcgtcgactggtgccctaccgggttcaagtgtggcatcaactaccagccaccatccgttgtccccggaggcgacctggcaaaggttcagcgggccgtgtgtatgatcagcaacaacactgccgtcgccgaagtgttctcgcgcatcgaccacaagttcgacttgatgtacgccaagcgcgcgttcgtgcactggtacgtcggcgagggcatggaggaaggtgagttctcagaagcccgtgaggacttggccgctctggagaaggactacgaggaggttggcgccgaaggcgcggacgacgagggcgatgagggggatgactattaagtagctggttaataagtagttggctggttaatgattggctttgatctgtatactcagtaagtatggttccattgcgttacatattgattgctgttatgcgtgtttcctttcctgtaatgtactgaagatgttgttagggtggccatgattgttcccattttggctttcgatgctactcgtcccaa

SEQ ID NO: 3144 - DNA, 733 bp, Triticum aestivum
catttcatgctttcgtcgtatgcccctgttatctctgcggagaaggcttaccatgagcagctctctgtgcctgaaatcaccaatgctgtctttgagccttcaagcatgatggccaagtgtgaccctaggcatggcaaatatatggcctgctgcttgatgtaccgtggtgatgttgttcccaaggacgtcaatgccgcagtcgcaaccatcaaaaccaagagaactgtccagttcgtcgactggtgccctaccgggttcaagtgtggcatcaactaccagccaccttccgtcgtccccggaggcgacctggcaaaggttcagcgtgccgtgtgcatgatcagcaacaacaccgccgtcgccgaagtgttctcgcgcatcgaccacaagttcgacttgatgtacgccaagcgcgcgttcgtgcactggtacgtcggcgagggcatggaggaaggtgagttctcagaagcccgtgaggacttggctgctctggagaaggactacgaggaggttggcgccgaaggcgcagacgatgagggcgacgagggggatgactattaagtagctggttaataagtagttggctggttaatgattggctttgatctgtatactcagtaagttttccgttgcgttacatattgattgctgttatgcgtgtttcctttcctgtaatgtactgaagatgttgttagggtggccatgattgttgataccccatttccccattttggct

SEQ ID NO: 3145 - DNA, 727 bp, Triticum aestivum
acccaatggctgtctttggagcccctcaagcatgatggccaagtgtggaccctaggctatggcaaatatatggcctgctgcttgatgtacccgtggtgatgttgttcccaagggacgtcaactgccgcagtcgctaaccatcaaaaccaagagaactgtccagttcgtcgactggtgccctaccgggttcaagtgtggcatcaactaccagccaccctccgttgtccccggcggcgacctggcaaaggttcagcgggccgtgtgcatgatcagcaacaacactgccgttgccgaagtgttctcgcgcatcgaccacaagttcgacttgatgtacgccaagcgcgcgttcgtgcactggtacgtcggcgagggcatggaggaaggtgagttctcggaggcccgtgaggacttggccgctctcgagaaggactacgaggaggttggcgccgaaggcgcagacgatgagggcgacgagggggatgactactaagtagctggttaataagtagttggctggttaatgattggctttgatctgtatactcagtaagtatggttccattgcgttacatattgattgctgttatgcgtgtttccttttcttgtaatgtactgaagttgttgttagggtggccatgattgttgataccccatttcctcattttggctttcgatgctactcgtcccatgtttggtgtgtgtgcatcattctgagcacgtactgcaa

SEQ ID NO: 3146 - DNA, 600 bp, Triticum aestivum
attctgaggatccaatgccctaacggagagtggttcatcagttaatgggcgcacaaattctggtttttctcgtggttcttctgaggctggtttagatgaagatcaatcctcaactggtaagagtggggattcatcattttttgctggtttcttgaagaaggggttcaaggacctttctttatttaaccagtccatggatagtgttaaaatttcaatcgatggccatccaatctcggaaagagctcttaagaaggcagaaaagaaagctggtcctgttgaacctggctcatactggtatgactgccgtgctggaaataagctacgcagtcttggcaaacttgctcccacaattgagaagctgaagcgtggttttggtatgcacgtccctgaagggtttaggtagctggatataatgccgggttcctgcatttctaataatcagtttaatcacctccctccagctacctattggagggcaagtttgtgatttctactgaacctgacatggacgctttttaagtagtacttgggagtgctggtgtgcagcatagatgtagtactcaagaagctatgatcacatgatcttgtggttttactatt

SEQ ID NO: 3147 - DNA, 808 bp, Triticum aestivum
gaaagctggtcctgtttgaacctggctcatactggtatgactgccgtgctggattttggggcatcatgggtagagaatgtattggcattattcctccatatataagagaattcaattatccaatgcccagaaattgtgctggtggagacactgatgtcattgtcaatggcagagaacttcatcagagagatttagatttgcttgtaggaagaggacttccacgtatctctggcaaatcatattccattgagatttctggaaatattaccgatgatgctggaaataagctacgcagtcttggcaaacttgctcccacaattgagaagctgaagcgtggttttggtatgcacgttcctgaagggtttaggtagctggatataatgccgggttcctgcatttttaataatcagtttaatcacctccctcgcagctacctattggagggcaagtttgtgatttctactgaacctgacatggacgctttttaagtagtacttgggagtgctggtgtgcagcagatgtagtactcaagaagctatgatcacatgatcttgtggttttactattgatgaccttggtcctactaattcagtttatttgctgaaagcaatgtttgaaaatgatgcaatctgccaggcagcgctaatttctctgcagctttttcttacgagtgttattgtcttgtgtattttctcaccacgggaagcattaggtatatgtgcaattatcggcttgtaatatgttcctagcgctataccttctctaatatatttatgtgtaaatatgttactatttgatcacctcttcc

SEQ ID NO: 3148 - DNA, 1270 bp, Triticum aestivum
  misc_feature (47)..(47): n = any nucleotide
aaagtgaaggtacatccagagatatgaccacacagcaagaagatganacaaccgtctgaaagttgagaacacaagtaatgagtttgacaagaagaacacagcggacagcaacagtgccctcgaacatgcgaacactgccattgaatttgaaggtacaagcacaagtgagagatatgaagaaaacctaatggaacaagataatggaaaattgcatgagccatgtgctgaggatgccaatgccctaacggagagtgggtcatcagttaatgggcgcacaaattctggtttttctcgtggttcttctgaggctggtttagatgaagatcaatcctcaactggtaagagtggggattcatcattttttgctggtttcttgaagaaggggttcaaggacctttctttatttaaccagtccatggatagtgttaaggtttcaatcaatggccatccaatctctgaaagagctcttaagaaggcagaaaagaaagctggtcctgttgaacctggctcatactggtatgactgccgtgctggattttggggcatcatgggtagagaatgtattggcattattcctccatatataagagaattcaattatccaatgcccagaaattgtgctggtggagacactgatgtcattgtcaatggcagagaacttcatcagagagatttagatttgcttgtaggaagaggacttccacgtatctctggcaaatcatattccattgagatttctggaaatattaccgatgatgctggaaataagctacgcagtcttggcaaacttgcccccacaattgagaagctgaagcgtggttttggtatgcacgtccctgaagggtttaggtagctggatataatgctgggttcctgcatttttaataatcagtttaatcacctccctcacagctacctattggagggcaagtttgtgatttctactgaacctgacatggacgctttttaagtagtacttgggagtgctggtgtgcagcagatgtagtactcaagaagctatgatcacatgatcttgtggttttactattgatgaccttggtcctactaattcagtttatttgctgaaagcaatgtttgaaaatgatgcaatctgctaggcagcgctaatttctctgcagctttttcttatgagtgttattgtctttatgtattttctcaccacgggaagcattaggtatatgtgcaattatcggcttgtaatatgttcctagcgctataccttctctaatatatttatatatgtaaatat

SEQ ID NO: 3149 - DNA, 610 bp, Triticum aestivum
catccgggagtaattggttcagaatcatcccatcttcgagccaggtgcttctgccaggaaatgtgggaaatgacaatcttgtagagcagcagaaagcaaaccctgtcgccctgctcctgtcgtccgctatgatgttgaggcatttgcagttcccgtcgttcgctgaccgtctggaaactgcggtgaagcgggtcattgcagagggcaagtacaggacaaaggatctgggcggcaccagcaccacccaggaagttactgatgcagtgatcgctaatctggattagatacctgatgcacgcctgaagaatcgattcttttggaggactggtttacaggtcccaacttttgagtgctattttttccgtacagcgttagatcggcaattatatatttcagaaataattgagaaacccacgaggattattcttcccatgatactttgtagcaaggcaaaacaccttgtgttgcagagggggtagctggctaccttcaatttaaacggcatgcattgaaagtttattctcagttcttattcgtggttatcactcccatgtaaccggaatccggtcctcttttctttggaaagggaatctggtcttctgaattgcta

SEQ ID NO: 3150 - DNA, 861 bp, Triticum aestivum
atggttgttctggagtctgccggagatgccgctaatatccaagtattgagtgataatgaaatcattgttgacaactgctgcatgcaacttgtttcaaggcctgagcagtttgatgttatggttacacctaacctttacggcaatttggttgccaacacagctgcaggtcttgttggaggaacaggtgtcatgccaggaggtaatgtgggtcaggatcatgccatcttcgagcaaggtgcttctgcaggaaatgtgggaaatgacaatcttgtagagcagcagaaagcaaaccctgtcgccctgctcctgtcgtccgcgatgatgttgaggcatttgcagttcccgtcgttcgctgaccgtctggaaactgcggtgaagcgggtcattgcagacggcaagtacagaacaaaggatctgggcggcaccagcaccacccaggaagttactgatgcagtgatcgctaatctggattagatacctgatgcacgcctgcagaatcgattcttttggaggactggtttacaggtcccaacttttgagtgctattttttccgtacagcgttagatcggcaattatatatttcagaaataattgagaaacccacgaggattattcttcccacgatactttgtagcaaggcaaaacaccttgtgttgcagaggggatagctgtctaccttaaatttaaacggcatgcattgaaagtttattctcagttcttattcgtggttgtcactcccatgtaaccggaatcgggtcctcttttctttggaaagggaatctggtcttctgaattgctatgcatgtcactgtcagattttgtatggtactcgagctatagctcccaaatcctgtccccct

SEQ ID NO: 3151 - DNA, 755 bp, Triticum aestivum
ttgctgctaaatatccaagtattgagtataatgaaatcattgtttgacaactgctgcatgcacttgtttcaaggcctgagcattttgatgttatggttacgcctaacctttacggcaatttggttgccaacacagctgcaggtcttgttggaggaacaggtgtcatgccaggaggtaatgtaggtcaggatcatgccatcttcgagcaaggtgcttctgcaggaaatgtgggaaatgacaatcttgtagagcagcagaaagcaaaccctgtcgccctgctcctgtcgtctgctatgatgttgaggcatttgcagttcccgtcgttcgctgaccgtctggaaactgcggtgaagcgggtcattgcagatggcaagtacaggacaaaggatctgggcggcaccagcaccacccaggaagttactgatgcagtgatcgctaatctggattaggtacctgatgcacgcctgaagaatcgattcttttggaggactggtttaaaggtcccaactcctgagtgctattttttccgtacagcattagatcggcaattatgtttgagaaataattgaggaacccacgaggattattcttcccactatactttgtagcaaggcaaaacaccttgtgttgcagaggggatagctggctaccttaaatttaaacggcatgtattgaaagtttattctcagttcttattcgtggttatcactcccatggaaccggaaatctggtcctctttttcaggaaaagggaat

SEQ ID NO: 3152 - DNA, 1181 bp, Triticum aestivum
agaggaggaggagacgagcgccctccagttcgacgacatcgacgaggactacgaggatggatacggcgggcgcgccccgcgttcacggcccccacccgcccgcgcaccggcaaggccgctctcccgctcaagcgcgaccgcaccaggtccaagagatacctggagatacagaagctgagggagagcaagaaggagtacgacgtgcccatggccatctcgctcatgaagcaggtcgccaacacccgcttcgtcgagtccgcggaggcgcatttccgcatgaacctcgaccccaagtacaacgaccagcagctccgggccacggtcaatttgcccaaggggacgggacagaccgtgaaaattgcagttctcacccaaggtgagaagatagatgaggcagggctgcaggcgctgatattgttggctcagatgacttgattgaacaaataaaaggaggattcatggagtttgacaaattgattgcgtcacctgatatgatgcctaaggttgccagcttgggtaagattctaggaccaagaggattgatgcccaaccccaaagctggtactgtttctccaaacattactcaggctatcgatgagttcaagaaaggtaaagttgaattcagagttgataagacagggattgcgcacattcctttcggcaaggttaacttccctgaagaagaccttattgcaaacttcatggctgttgttcgctccattgagaggaacaagccatctggtgcaaaggggatatactggaaaacggcatatgtatgctcatcaatgggaccttcaatcaagctgaacattaaagaaatgctcgactatggcgcagattcgtctaactagatgtcaccacgaccaattaagtcatcaggcatttgctgccaacttcacaggcttgaccatccatcccttgtgataaatacacactgagaaacacgactgtgggggaacactgggaggtgcttaggtacagtttttttttagtttcacggacatccgacgtcggcagttaaacagtgccctgatcaacaaacaagcggtattgttggtcgtttgtatttatgagcgaattatgcatgcacttacacatgtatttttgtctgatgtttgttgtaatgttcatcattttgtcaatagtcatccttgagcttcagccaatatcatgtcctcacc

SEQ ID NO: 3153 - DNA, 597 bp, Triticum aestivum
tcggtcggctgtgcacgacggactgcaagatcaagttctcggacctgaaggcgagacgaagcttcaggttcatcgtgttcaagatcgacgagaagtcgaggaaatcaaggtggagaggctcggtgagaccagttacggctacgaagaattcacaaacatcctcccagctgacgagtgtcgctatgctgtctatgacctcgacttcgtaaccgacgagaactgccagaagagcaagatcttcttcttctcctggtctcctgacacggcaagaacaaggagcaagatgctttatgcgagctccaaggacaggttcaggagggagatggacggcatccagtgcgagatccaagcgaccgaccccagtgaaatgagcctcgacatcataaaaagccgagctcactaatgaagcacaagtacatatactccagctccacaacgtacaatgaatatatccatatgaaacccttccgcaatcgacggctcacgccatgcccatggattaatgggcatgggatacctctcgcttacaactatcgtttaaatcatttgttccatatgctatctttcagtcttggggataagctctgtcgacaatga

SEQ ID NO: 3154 - DNA, 749 bp, Triticum aestivum
ctggtgacaccaagggagcatttgtgcagccctgcattctatgaagcatttggtctgactgtcattgaggccatgacatgtggtttgccgacaattgcgacatgccacggtggccctgctgaaatcattgtgaacggggtgtctggcctgcacattgatccttaccacagcgacaaggccgcagatatcctggtcaacttctttgagaagtgcagcgaggatccaagctactgggacaaaatgtctgaaggaggcctgaagagaatttatgagaagtacacctggaagctgtactcagagaggctgatgaccctgaccggcgtgtatgggttctggaagtacgtgagcaacctggagaggcgcgagactcgccgttacctggagatgttctacgctctgaagtaccgcagcctggctgctgcagttccattggcagttgacggcgagagctccgacaactagcgcggtgcaatggggcatgaagaggcgcattcagcgggagggtgaagtgtcggctgcgttatgatttgtctgtctaccgtagtttccatttggtctggtcgtggggtgtgttaatttgttgtcccggcacatttgtgaggtcctgggcagtgctcgctggttcatgccagccgcatttgttgcgtggaataaacgcctgcccatattgttcatctttcatcagagttcaatgcaatgtttcgttgtctgtctcacttctcctctctgccattggacattggatgatc

SEQ ID NO: 3155 - DNA, 802 bp, Triticum aestivum
gaacgtgttcgcaatggtgagctgtaccgcacaatctgtgacaccaagggagccaatttgtgcagcctgcattctatgaagcttttggccttactgtcattgaggccatgacatgtggtctgccgacaattgcgacatgccacggtggccctgctgaaatcattgtgaatggggtgtctggtctgcacattgatccttaccacagtgacaaggccgcagatatcttggtcaacttctttgagaagtgcagcgaggatccaagctactgggacaaaatgtctgaaggaggcctgaagagaatttatgagaagtacacctggaagctgtactcagagaggctgatgaccctgaccggtgtgtatggattctggaagtacgtgagcaacctagagaggcgtgagactcgccgttaccttgagatgttctacgccctgaagtaccgcagcctggctgctgcagttccattggcggttgacggcgagaactccgacaactagcccggtgcaatggggcatgaagaggcgcattcagcgggagggtgaagtgtcggctgcgttatgatttgtctgccgtagttttcatttggtctggtcgtggagtgtgttaatttgttgtctcggcacatttgtgaggtcctgggcagtgctcgctggttcatgccagccgcatttgttgcctggaataaacgcctgcccatggtgttccatctttcatcagagttcaatgcaatgtttcgttgtctgtctcatttctctgtctttcaaaattatttgatcaccccttttgtcatgaatgaacctgg

SEQ ID NO: 3156 - DNA, 701 bp, Triticum aestivum
gacaccaaagggtgcatttgtgcagcctgcattctatgaagccgtttggcctgactgtcattggaggccatgacatgtggtttgccgacgattgcgacatgccacggtggccctgctgaaatcattgtgaacggggtgtctggtctgcacattgatccttaccacagcgacaaggccgcagatatcttggtcaacttctttgagaagtgcagcgaggatccaagctactgggacaaaatgtctgaaggaggcctgaagagaatttatgagaagtacacctggaagctgtactccgagaggctgatgaccctgaccggcgtgtatgggttctggaagtatgtgagcaacttggagaggcgtgagactcgccgttaccttgagatgttctacgccctgaagtaccgcagcctggctgctgcagttccattggcagttgacggcgagagctccgacaactagcgcggtgcaatggggcatgaagaggcgcattcagcgggagggtgaagtgtcggctgcgttatgatttgtctgtctaccgtagttttcatttggtctggtcgtggagtgtgtgcaatttgatgtctccggcacatttgtgaggtcctgggcagtgcttgctggttcttgccagcggcatttgttgttgcctctgaataaacgcctgcccatattgttcatctttcatcagagttcaatgcaat

SEQ ID NO: 3157 - DNA, 724 bp, Triticum aestivum
ttctgggtaacccgctcccgccccctttccccgcccgtctggggtcagattcatgccagacaagcccaattgaaatgaggcttaagcggtgggaacggaagaagtgtaagccaaacagtcttcctatgctgcacaagatgcatgttagggtcggcgacacagtgcaggtcatcgcaggccgtgagaaaggtaaagttggagaagttgtacggctttacaagcacaacagcactgtgatagtgaaggatctgaacttgaagtcaaagcacaagaaaggcacagaggatgaaccgggtgaaattgtcatgattgaaggccccattcatagctcgaacatgatgctctactcaaaggagaagaacgtgacgagtagggttgggcacaaaatcctcgaggatggcaccaaggtccgctacctgaagaagaccggtgaagtgatcgacagcgttgataactgggtgaaggtgttcaaggaaggagattctgagtcatcatcgtagtatggaaacgctgcacatgctctcaaccttggctgcgcttattgctgcccaaacgcttactcggctggtgctgctgcttgtaagatcagttttcttctagcttcagagcctcttttgtaaattactactactactacaaagttgtcaccatttttgcaatgcttggtccagcgagaaggccttttttttttttacatttctgtcattttgatgaatagtaatga

SEQ ID NO: 3158 - DNA, 832 bp, Triticum aestivum
ctgcgagttagcgagtgacgaaagatgacggcgactatggccggcattgcggcgctgcatggcgccatgtgggcgctctccgtctcggccgcgagcaccagcgcattctggggcaacccgctcgccgccaccttctccgccgcgccgtctggggtcagattcatggtccaagacaagcccaattgaaatgaggcttaagcgatgggaacggaatgaagtgtaagccaaacagtcttcctatgctgcacaagatgcatgttagggtcggcgacacggtgcaggtcatcgcaggccgtgagaaaggtaaagttggggaagtcgtacggctttataagcacaacagcactgtgatagtgaaggatctgaacttgaagtcaaagcacaagaaaggcactgaggatgaaccgggtgaaattgtcatgattgaaggccccattcatagctcgaacatgatgctctactcaaaggagaagaacgtgacgagtagggttgggcacaaaatcctcgaggatggcaccaaggtccgctacctgaagaagaccggtgaagtaatcgacagcgttgacaactgggtgaaggtgttcaaggaaggagattctgagtcatcatcgtagtatggaaatgctgcgcatgctctcaaccttagctgcgcttattgctgcccaaacgcttactcggctggtgccactgcttgtactgtcagtttttttctagcttcagagcctcttttgtaaattactactactactacaaagttgtcaccatttttgcaacgcttggtccaacaagaaggccttcgacttacatgtctgtcatttcgatgaatcgtaag

SEQ ID NO: 3159 - DNA, 817 bp, Triticum aestivum
tgctgcttctctgcgagtgagcgagtgaggaaagaggacggcgacgatggccggcatggcggcgctgcagggcgccatgggggcgctctccgtctcggccgcgagcaccagcgcctttctggggcaacccgctcgccgcccaccttctccgcccgcgccgtctggggtcagattcatggccaagacagcccaattgaaatgaggcttaagcgatgggaacggaagaagtgtaagccaaacagtcttcctatgctgcacaagatgcatgttagggtcggcgacacagtgcaagtcatcgcaggccgtgagaaaggtaaagttggagaagtcgtacggctttacaagcacaacagcactgtgatagtgaaggatctgaacttgaagtcaaagcacaagaaaggcacagaggatgaaccgggtgaaattgtcatgattgaaggccccattcatagctcgaacatgatgctctactcaaaggagaagaacgtgacgagcagggttgggcacaaaatcctcgaggatggcaccaaggtccgctacctgaagaagaccggtgaagtaatcgacagcgttgataactgggtgaaggtgttcaaggaaggagattccgagtcatcatcgtagtatggaaacgctgcacatgctctcaaccttggctgcgcttattgctgcccaaacgcttactcggctggtgccgctgcttgtactatcagttttttttctagcttcagagcctcttttgtaaattactactgctactacaaagtgtcaccatttttgcaacgcttggtccagcgagaaggccttcgttttacat

SEQ ID NO: 3160 - DNA, 674 bp, Triticum aestivum
cgaggccagttcgacggtaccagacacgctcacacgcacacgagccggcagtactaccgagactgcaccgtgagcggcaccatcgacttcatcttcggcaacgcgcaggtggtgttccagaactgcatcctccaggtgcgcaagtgcatggagaaccagcagaacatcatcacggcgcaggggcgcaaggagaggcactcggccggcggcatcgtcatccacaactgcaccatcgagccgcacgcggagttcaaagaccacatgggcaggctccggacgttcctggggcggccgtggaaggagcactcccgcaccctctacatccagtcggagatcggcgacctgatcgacccgcaggggtggctgccgtggctcggcgacttcgcgctcagcacctgctactacgccgaggtggacaaccgggggccgggggccgacatgagcaaccgcgtcacgtggaagggcgtcaagcacgtgacctaccggcaggcggaagagaagtacaccgtggagaggttcatccaggggaagctctggatctccaagtacggcgtgcccttcatcccggggttgctgccgcaggagcaggccggccacactgatgacactgagcgaagctagcgttcgtccggggtcgacgaagatggattgttaattttatggatggatggatg

SEQ ID NO: 3161 - DNA, 809 bp, Triticum aestivum
gtaccaggacacgctgtacacgcacaccagccggcagtactaccgcgactgcaccgtgagcggcaccatcgacttcatcttcggcaacgcgcaggtggtgttccagaactgcgtcctccaggtgcgcaagtgcatggagaaccagcagaacatcatcacggcgcaggggcgcaaggagaggcactccgccggcggcatcgtcatccacaactgcaccatcgagccgcacccggagttcaaggaccacatcggcaggctccggacgttcctggggcggccgtggaaggagcactcccgcaccctctacatccagtcggagatcggcgacctcatcgacccgcaggggtggctgccgtggctcggcgacttcgcgctcagcacctgctactacgccgaggtggacaaccgggggccgggggccgacatgagcaatcgcgtcacgtggaagggcgtcaagcacgtcacctaccggcaggcgcaagagaagtacaacgtcgagaggttcatccaggggaatctctggatctccaagtacggcgtgcccttcatcccggggttgctgccgcaggagcaggccgcccacactgacactgagccaagctagcgttctttcggggtcgaggatgaagatggattgtggacaagggttgttaattttatggatagaggatcggttgtacgtacactgttgttgatgtatatcatctgtgtatcgtcgtacagtatatgtgagatgcatgtcaatgtagaatgtagaatgtatgtgcgtgtacactgctctttcgaccacccatgctcacaattgacaa

SEQ ID NO: 3162 - DNA, 726 bp, Triticum aestivum
tgctttcagcatgtggaaacacctgcttgaaaggtgtttttttgtggctttgggggttttcgttcatctgaacttctaaagctccttgtaaatcagctcgagcctctaacagagcagcagttgatggggttatccagcctcgagcaatcctcacaccaggccgaggatgcactatcacaaggaatggaggcattgcagcaatctttggctgaaacgttggctggttcccttggtccatcaggatcttcaggaaacgtggcaaactacatgggtcaaatggctatggctatgggaaaacttggaacccttgagaatttccttcgccaggctgacaatctacggcaacaaactttgcatcaaatgcaaagaattctgacaatacggcaagctgctcgagctctccttgcaatacacgactatttctcacgtttgcgtgccctcagttctctctggcttgcgaggccacgggagtaaaacatgtgtgccatcttttggcgcttcatgagctgatcctagaaatgtggacaaattgcgacgcatttgcagaagattgatggttcagttccctctgaaaaatatattgacgccttgtgttctcatattgtacttcgatgttgtacaagtagccaggtaggggtaaggcttgtaactgtaagttaccatgaatttatgattgacatattgtacaattgtattagcaataagataagcgtagattaaaggtgc

SEQ ID NO: 3163 - DNA, 741 bp, Triticum aestivum
atcgtcatggggaggtatgagctggggagattgttagggaaaggagcatttggcaaggtgcactacgccaagaaccttgagtcaaaccgaggtgtcgccataaagattttggacaaggagaaggtgctcaaggtcgggctcgcggagcaggtcaggcgtgagatcacaaccatgcggttggtagtgcacaaaagcattgttcagctccatgaggtcatggcgacacgaagcaagatctacttcgtcatggagtacatgaaaggcggtgagctctttgacaaggtctccaagggtggcaagctcaccgagggtgctgcacataagtacttccagcagctcatcagtgcagtggattactgccacagccgtggcgtgtatcaccgggacttgaagcctgagaacctactgcttgatgagaatgaaaatctgaaggtttctgattttgggctgagtgcactttcagaatcgaagagacaagatggcttgctccacaccacctgtggatcacctgcttatgtggctccagaggtgatcagcaagggaggctatgatggtgcaaaatcagatatctggtcttgcggggtcatcctgtttgtcttgtagctggttacctcctttcagggtcaaaatgatagaatgtccggaagatggaaggggatcagtgccgtgtgggtccaaaattggagggtgtcagactgcccgtcgaaaggttatccagaaaggcccggtcaagcgggaaaa

SEQ ID NO: 3164 - DNA, 598 bp, Triticum aestivum
tggagctaacttctttagaactagggacatgatagtggcaaatttgggtgcaaaacctttggtgatacagttgccgattggttcagaggacaatttccaaggagttgttgatctaataagaatgaaggctattgtatggacaggggaggaactcggtgcacaattttcataccaagacatacctgctgatcttgaagagttggctcaagactatagacttcagatgatcgaaactattgttgaattggatgatgaagctatggagggctatctagaaggaaaggaaccggatgaggcgactgtgaagagattaatcagaaaaggaacaataggtgccagctttgtccccattttatgtggttcagccttcaaaaacaagggtgtccagccattgcttgatgctgttgttgattacttgccatcaccacttgacctgccaccaatgaagggtactgacccagatgacccggaattgattcttgaaagacgtccaagtgatgatgaaccattttctgggttagctttcaagatcatgactgatccatatgtggggtcactaacgtttgtccgcatatactcagggaagctgatcgctggt

SEQ ID NO: 3165 - DNA, 1171 bp, Triticum aestivum
gagcccacagatgcaagtctatgtcattcgttgcactcatgaatactggcacctgagatcataaagggtgaggggcatgggagtgctgtggactggtggacttttggcatattcttgtatgaacttcttttcggcaagactccattcaaaggttcagggaacagggcaacgctattcaatgttgttggccagcccctcaggttcccagaatcacctgttgtgggttttgctgcaagggatctcataagggggttgctgatcaaggagccacagcatcgattggcgtacaaacgtggagccacagaaataaagcagcacccattctttgaaggtgttaactgggcattgataaggtgcgctactcctccagatatccccaagccagttgaaatccctcggccaggagcctcgacaagtcagaaggcaacaccgtcagccgagaaaggtccagacaattatcttgaatttgatttcttttagtggattcttccaagaccatttcatgtgcaagctgtaaagttcttttttcctagacattttctgcattctaataacttgatatgtagatggcatatgttcctagtgttgttggtaagctccgttcgcagttcatttcacctccattgatcacattggatgggagcctctatcaggagtaagctgtaatccctcatcaattattgagaagtagggtctcttgaataacaaataaatgtttccgttctgtctgcaaccgctgttttgaaagctaaatttggtggtgtaccggaagctgatcacacctttgatgtggtaaataaatgtcagctggagcagctgcatttatgcccttcaaatcggcaaggaactcgtcctgccgtctgaaaaacagggggaaacctaagatgttacaatgctaatgctcagtagaggaccgatcttcagactgggtggttcagtagaggaccagcatgcctgctatgcataaatgttgtttatgctgcattgctatgagttgctgcttgctgaattgttgccactgatgatactttagtggatttgcctctgcatcacgggaaagatagtttccgagttggcacgtgaattacagttctgagatgtgcctttttttgtgtgtgcactagttctgacttttcttcgccaaccactcactaatcagcaataaaataac

SEQ ID NO: 3166 - DNA, 753 bp, Triticum aestivum
gcttagagctgtcatagttgggcctgcaggcactccttaccatgacgggttgttcttttttgatgtctatttcccttcccagtatccatgtaaacctcctcaagtgaattaccgctctggaggtctgcggcttaatccaaatctgtatgcctgtgggaaagtctgccttagcctcttaaacacatggactggtagtgggtgtgagatgtggaacccatccacttcaactatgttgcaggtcctggtctccattcaagccttggtgctgaatgctaaaccttatttcaatgaacctggtcattcgatgtatgctaacacaccccttggggagaagcagtccctggcttataatgaagagacttttctgctatcctgtagaaccatgctgtattctcttcgcaatccaccaaagcattttgagcacttcattggtggacatttccggaagtatgggcgtgacatcctcgtaggatgcaaagcttacatgggcggtgcccaagttggatgccttgctggagacggagtgcaagatgtcgacgagggtgacaaaagctgctcacaaaatttcaagtgctcgctagagatattatttaagggtctcattaacgaattcactgatttaggagtagcttgtcatgaattccaggcccagattgtgaactctggagctgcagcagacaccacattaaggctataagttataggtgatcccaaggatcatgttgaccaaattttgttttgaaataaacatat

SEQ ID NO: 3167 - DNA, 686 bp, Triticum aestivum
tccccccgccgccgcccgcgcagagccccgaatctccctacccgcggcagccatgagcgacggcaaggacaccctcgacctctccgccctcggcgccgccgtccccaacgccgcagagctcagcgccgaggacaaggccaacctcgtggagtcgattaagaacacgctgcagggattggcggcgcggcacacggacgtgctcgagagcctggagcccaaggtcaggaagcgcgtcgaggcgctcagggagatccagagccaacatgatgaatttgaggcaaagttttttgaggagagagctgcacttgaagctaaatatcagaagatgtatgaaccactgtactcaaagcgtcatgatgttgtcaatggtgtggttgaggcagaaggcgtaaccaaagattcaggtgaagctgctccagatgagaaagaggaaaagggtgtgccagatttctggttgaatgcaatgaagaaccatgaaatccttgctgaggagattcaagagagggatgaggaagctctcaagtacctcaaggatatcaagtggtacagaattactgagccaaagggtttcaagcttgagttccacttcaatactaatccattcttcaagaatgaagtgctttcaaaaacgtaccacatgatcgatgaagatgaaccaatcctagagaaggtatgactgaattgat

SEQ ID NO: 3168 - DNA, 624 bp, Triticum aestivum
gaaggtcctagccagaaaccctcgatttgtcaaagagaagtatcttatgcaaaccatatatcagagcttgatctctcaaattgtcagcgatgcactccaagttaccggcttctacctaaaaattacccaacgcctccggcaggcaacaagactgatcttggtgccacggttcttaatgatcactgggtgtcagtgacatcagggagtgaagactattcgtttaagcacatgcgcaagaatcagtatgaagaaagtttatttagatgcgaagatgacaggttcgagttggatatgctgttggagtcagttaatgcagcaactaagcgcgtcgaggagttgatagaaaaaatgcaagataactcagtaaaaccagaaagcccaatacgcatcgatgagcacttaactcctttgaatctaaggtgcattgaacggttatatggtgaccatggtctggatgtgatggacgttcttcgaagaaatgctagtgttgcgctgccagttatcttatctaggctaaaacaaaagcaggaggaatggtcaaggtgtcgatcagatttcaaacaggtttgggctgacatttatgccaaaaattaccacaagtcacttgatcatcgcagttaacta

SEQ ID NO: 3169 - DNA, 682 bp, Triticum aestivum
agttgatagaaaaaatgcaagataactcagtaaaaccagaaagcccaatacgcatcgatgagcacttaacttctttgaatttaaggtgcattgaacggttatatggtgaccatggtctggatgtgatggacgttcttcgaagaaatgctagtgttgcactgcctgttatcttatccaggctaaaacaaaagcaggaggaatggtcaaggtgtcgatcagatttcaacaaggtctgggctgatatttatgccaaaaactatcacaagtcacttgatcatcgcagtttctatttcaagcagcaagactcgaagaatctcagcacaaaatctctagtgactgagattaaagaaattaatgagaagaaaagaaaggaagacgatgttctcattgctattgctgctggaaataggcggcctatagttcccaatatgtcatttgagtatgtagatgcaaatatccatgacgatctttataagatcgtcaagtactcatgcggagaagtctgtggctcggaccaactggacaaagtgatgaagattcggacaactttttctggagcctatatagggcattccgtctcgatcccacggcgccgtggatgcagacctacataaacccaagtttgcattcacaaattggtttgcaatgtgcggacgcatatactcttagatgagtggcgcaa

SEQ ID NO: 3170 - DNA, 785 bp, Triticum aestivum
aggagatgttcaaagtgatggatactgataatgacggtatagtctcatatgaagagttgaagagcgggattgcaaaatttggttctcaccttgcagaatctgaagtgcaaatgttaatagaagctgtggatacaaatggtagaggagcactagattatggtgaatttttggctgtctcacttcatctacaaaggatggcaaatgatgagcaccttcggcgggccttcctgtttttcgataaggatggcgatggttttattgagcctgaggagcttcaggaggccctggcggaggatggggcggtagatatcacggaagtggtgaaggacatattgcaagaagttgacaccgacaaggatggcaaaattagctttgaagagtttgtagcaatgatgaaaaccggcacggactggcgaaaggcttcacggcattattcgagaggacgtttcaatagcctaagcataaggcttatcaaggatggatctgtaaagatgggaaatgagtgaaatcacaggcttgcagctggcgctcttgtcccggtcacgtaagtccggccgttggcccactaagcatagaccctctttccttctctgatgattattttggcggaaatttaattagataggctccccccctgattggcttactcgtgtaagtagctttcccggtatcgctgaggtgaggagcacgcaccgaatgatgcaccaactgctcctgcctgatgatatctccttttgctgtacctgatgctaagtgttgtacaatattttgttgtttccccctca

SEQ ID NO: 3171 - DNA, 779 bp, Triticum aestivum
gagaatgtctctagcgaggctcttgaggctgcccgtattgcttgcaacaagtacatgacgaagaatgctggaaaggatgcgttccacctgagggtcagggtccatccataccatgtccttcgtatcaacaagatgctttcatgtgccggggctgataggctccagactggaatgaggggtgcttttgggaagcctctgggtacctgtgctcgtgtggacattggccaagtactcctatctgtgcgctgcaaggagagcaatgctgttcatgctgatgaagccctccgccgtgccaagttcaagttccctggccgtcaaaagatcattcgcagcaggaagtggggctttaccaagttcaacaaggctgattacatcaagtacaagagtgagggaagaatcgtgcctgatggtgtcaatgctaagctgcttggtgtccatggccccattgctaaacgcgcccctgggcaggcgatcctggcttgaggcagttgaagcatgcacagaccatttccttcgctagatggaactcatgagttttgtttttgctttagccagtatatttccccatgcttgaacgagtgttaagtaaagatggcagctggctgcagtataatctacttctgtagttctttactgtagaccgtttctcatggtggaggttgacatatctgcagttgtcctgttttagcactttcttgagattgttatctacaagtgctgaaattttctggatcatctatgaatgatgtataacttttgcctatgcaaaatcacctttc

SEQ ID NO: 3172 - DNA, 745 bp, Triticum aestivum
agctgcccgtatgcttgcaacaagtacatgaccaagaatgctggaaaggatgcgtttcacctgagggtcagggtccatccataccatgtccttcgtatcaacaagatgctttcatgtgctggggctgataggctccagactggaatgaggggtgcttttgggaagcctctgggtacctgtgctcgtgtggacattggccaagtgctcctatctgtgcgctgcaaggagagcaatgctgttcatgctgatgaagccctccgccgtgctaagttcaagttccctggccgtcaaaagatcattcgcagcaggaagtggggctttaccaagttcaacaaggccgattacatcaagtacaagagtgagggaagaatcgtgcctgatggtgtcaatgctaagctgcttggtgtccatggccccattgctaaacgcgcacctgggcaggcgatcctggcttgaggcagttgaagcatgcacagaccatttccttcgctagatggaactcatgagtttttatccgctttagctagtatattccccatgcttgaaccagtgttaagtaaagctggctgctggctgcagtataatctacttctgtggttctttactgttggccgtgtcctggtggagttttacatatctgcagttgtactgttttagcgctttctggagattgttatctacaagtgctacagattttctggatcatctaggaattatgtataacgtttgcgtttgctcaatctat

SEQ ID NO: 3173 - DNA, 707 bp, Triticum aestivum
gagaaggagagggagcagccgcagccatgggtcgcgtccgcaccaagaccgtgaagaagacctcccgccaggtcatcgagaagtactactctcggatgaccctcgacttccacaccaacaagaaggtgctagaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagatccgcgtcgacaaggagaccatggacatgctggcgttcctcggcatggctgacctccccggcgtcgagcgcgcccccgaaaccacctctgccgccgccccctaccgccagcccttcaacggaccccgcggtggcaaccgcgcctaggttcctccgcatcgtcatcgtacccctatattatgctttatgtcttttagatctgttacttgtggcaagtaatgttttgaactcaaggcttaagttcgaggtgttttgatctgcgtatggtggacatgatctgtttatctcaccgtttatctgaagtgattcgatatattactgttgatctttgaagtttatgctcgttgctcgatgatcgattgatttatgagctatctacctattgttaattatata

SEQ ID NO: 3174 - DNA, 676 bp, Triticum aestivum
gcccaagccgccgccggagaaggagacggagcagccgcagccatgggtcgcgtccgcaccaagaccgtgaagaagacctcccgccaggtcatcgagaagtactactctcggatgaccctcgacttccacaccaacaagaaggtgctcgaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagatccgcgtcgacaaggagaccatggacatgctggcgttcctcggcatggccgacctccccggcgttgagcgcgcccccgaggccacctctgccgctgcgccctaccgccagcccttcaacggaccccgcggtggcaatcgcgcctaggttcctccgcatcgtcgtcgtcgtacccctatcatctttacatgttttattattagatctgttacttgtggcaagtgatgttttgaactcagagcttaagttcgaggtattttgatctgcgtatggtgaacatgatctgtttatctcatcgtttatctgaagtgattcgatatattactgctgagctttgaagtttaagctc

SEQ ID NO: 3175 - DNA, 620 bp, Triticum aestivum
gagaaggagaggaagcagccgcagccatgggtcgcgtccgcaccaagaccgtgaagaagacctcccgccaggtcatcgagaagtactattctcggatgaccctcgacttccacaccaacaagaaggtgctcgaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagatccgcgtcgacaaggagaccatggacatgctggcgttcctcggcatggccgacctccctggcgtcgagcgcgcccccgaggtcacctcctccgccgccccctaccgtcagccgttcaacgggccccgtggtggcaaccgcgcctaggttcctccgcatcgtcgtcgtacccctatattatgctttatgtcatttagatctgttacttgtggcaagtaatgttttgaactcagagcttaagttcgaggtgttttgatctgcgtatggtggacatgatctgtttatcgcaccgtttatctgaagtgattc

SEQ ID NO: 3176 - DNA, 638 bp, Triticum aestivum
ctcctctcgcattcacccccaggccactcaggcttccgccgaggcagaacattacaccggaggtagaggggaaacgcgcaacagccatggcctcgcatccgatcctttcagtgatcgctgtggtcgccatctttgccctcgccggcaccgccgtcgccaatgacctccccgactacattgttcagggacgggtctactgcgacacgtgccgtgccgggttcgagacaaatgtgaccgagtacatcaagggtgccaaggtgaggctggagtgcaagcgcttcggcactgagaaagttgagcgctcgatcgacggcgtaaccgacgagactggcacttacaaaatcgagctcaaggacagccatccggaggatatctgcgagatggttcttgtccagagccccctcccaaactgcaacgagattcaggaactcagggaccgcgccgagatagtcctcagcaggaacgttggcatcagcgacaacatccgcatggccaacccgctcggctacctcaaggacaagccgctgcccgtctgccctgacctgctcaagacgttcaaccttactactgatgatgatcactgagcagagcaggcagaccgccaacatggtaccactggagaggctgctgcaccacac

SEQ ID NO: 3177 - DNA, 752 bp, Triticum aestivum
tcaccccagtcatcagctccgccgagcagacaatcaccggagtagagggaaacgcgcaacagccatggcctcgctccgcatcctttcagtgatcgccgtggtcgccatctttgccctcgccggcaccgccgtcgccaatgacctccccgactacattgttcagggacgggtctactgcgacacgtgccgtgccgggttcgagacaaatgtcaccgagtacatcaagggtgccaaggtgaggctggagtgcaagcgcttcggcactgagaaagttgagcgctccatcgacggcgtaaccgacgagaagggcacttacaaaatcgagctcaaggacagccatccggaggatatctgcgagatggttcttgtccagagccccctcccaaactgcaacgaggttcaggctctcagggaccgcgccgagatagtcctcagcaggaacgttggcatcagcgacaacatccgcatggccaacccgctcggctacctcaaggacaagccactgcccgcctgccctgacctgctcaaaacgttcaaccttactactgatgatgatcactgagcagagcaggcagaccgccaacatggtaccactggagaggctgctgcaccacaccaataaatctgttatctggcatgcaaatagcatggttgtatcagcagagtacagcatcaatgcgtagctgtctctaatgctacttacagccttgtgatgtaccagatcttgccatcgattcttcttctgcaagctg

SEQ ID NO: 3178 - DNA, 905 bp, Triticum aestivum
ctcctctctgcattcacccctagatcattcagcctccgccgagccagaacacacaccggaggtagaggggaaacgcgcaacagccatggcctcgctccgcatcctttcagtgatcgccgtggtcgccatctttgccctcgccggcaccgccgtcgccaatgacctccccgactacattgttcagggacgggtctactgcgacacgtgccgtgccgggttcgagacaaatgtcaccgagtacatcaagggtgccaaggtgaggctggagtgcaagcgcttcggcactgagaaagttgagcgctcgatcgacggtgtaaccgacgagactggcacttacaaaatcgagctcaaggacagccatccggaggatatctgcgagatggttcttgtccagagccccctcgcaaactgcaacgagatccaggatctcagggaccgcgccgagatagtcctcagcaggaacgttggcatcagcgacaacatccgcatggccaacccactcggctacctcaaggacaagccgctgcccgtctgccctgacctgctcaaaacgttcaaccctaccactgatgatgatcactgagcaggcagaccgccaacatggtaccactggagaggctgctgcaccacaacaataaatctgttatctggcatgcaaatagcatggttgtatcagcagagtacagcatcaatgcatagctgtatctaatgctacttacagccttgtgatgtaccagatcttgccatcgattcttcttctgcaagctgtaacaaatcttttcaacaaaagtcaccatccatctaacctgataggaacaatgccatttcatttctttctaaattaccaacttcagaaatcgctcatgttagataacgccttgactgtaatttacacccatggcact

SEQ ID NO: 3179 - DNA, 720 bp, Triticum aestivum
  misc_feature (4)..(4): n = any nucleotide
cacnggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccaacacgctcacgatcgtcgacagcggcattggcatgaccaagtcggacctcgtcaacaacctcgggaccatcgccaggtcggggaccaaggagttcatggaggccctcagccgccaggcgccgacgtgtccatgattgggcagtttggtgtcggtttctactccgcctacctcgtcgccgagagggttgtcgtcaccaccaagcacaagcgacgacgagcagtagcgtgctgggagtcccaggccggtggctccttcaccgtcactcgtgatacgtctggggagcagctcggcaggggtaccaagatggtcctctacctcaaggacgaccagatggaataccttgaggagcgccgcatcaaggatctagttaagaagcactctgagtttatcagctaccccatctccctgtggactgagaagaccactgagaaggaaatttctgatgatgaagatgacggaggagaagaaggatactgaggagggtcagctgaggg

SEQ ID NO: 3180 - DNA, 484 bp, Triticum aestivum
tcgtcctgcaggacaccagcatcgtcacgccggagaaccaccccatccacctccacggctacgacttctacatcctcgccgagggcttcggcaactacgacgccgagaaggacgccgcgaagttcaacctcgagaacccaccgcagaggaacaccgtggcggtgccggtgaacggctgggcggtcatccggttccgcgccgacaacccgggggtgtggctcatgcattgccatctcgatgtgcacatcacctggggcctggcaatggcgtttctggtcgaggacgggtatggcgagctacagtcaactggaggcgcctccagttgatcttccaatgtgctaatgaccggcaaagatacaaacaccagggatattgaaggctgcccacacgttctattctcagttcctgccatttggggggtatttgtgatctttattttgtacttctaactaggggttttgattctccaccatgatttgtaaca

SEQ ID NO: 3181 - DNA, 279 bp, Triticum aestivum
ccacatgatctgccgcgacgaccggccctacgccgacggcaccggcaacccggacaccggcgccgacttcggggccgcccccgacatcgaccacctcaacccgcgtgtgcagaaggagctcgtcgagtggctcaactggctcaggaccaacgtcggcttcgacggctggcgcttcgacttcgccaagggctactccgcggacgtcgccaagatctacatcgaccgctccggggccagcttcgccgtggccgagatatggacgtcgctggcgtacggtgg

SEQ ID NO: 3182 - DNA, 496 bp, Triticum aestivum
  misc_feature (142)..(142): n = any nucleotide
ccggccgccgcggccgggaccccgcggcgccgcaagtccggatcgactacgcccgtgcaccagacgcccggggtcgcctggcccagcccctaccccgcggggggcaccagcccgctgccggccggggtgtcgccctcgccgngccaggtccacagcccaggcggttcttacaagcggccccttccgcgccgccctcgccggccaagcacatcaaggccacgctcgctaagaggctgggcggagggaagcccaaggaggggccgataccggaggaaggcgcggttgcggccggagccggcgctggagccgtcgcggatggggcggaagcggaaaggccattggacaagacgttcggattcgggaaaaacttcggggccaaatacgagctcgggaaggaggtggggaggggccatttcgggcacacctgctcggccgtcgtgaagaagggcgagtacaagggccagaccgtcgccgtcaagatcatctccaaagctaa

SEQ ID NO: 3183 - DNA, 862 bp, Triticum aestivum
ttccttaggatatttcttcatcgtttgattgccatagctctgttcacatcattggcggtgtcgtggttcaaataacagttgtcaggggagaaaccaagtccgagcgaaagttgttgaggtgatcacaagcttatgtggctggcatcagtttgcacaaccatttctttcattgcctcatgctatattgtgctagccgccatttccaatgggcagcaatactggttagtttaataggtggtgttacaatgactggtgttcttggaacaatgacgtactttgtggtgaaatcaaagcgcatgaggaagattagaaaaaaagagaagatgtcaagaagaagcggctcaagctcctgggttgataatactgaaatctcagagactgagcttaatcaagtgtatgccttgtaaagagacagggtgtttgaactcagccttgcctctgcaattgagaatgtacatgcttaatcaagtgtatgccttgtaagacacagggtgtttgaactcagcctcatatctggaatcgagaatgtacatgaaaattccagatgcgcgcattaacaaatagattactcacattattccttgattgtacaattcctttctgtaatgacaaacatgcatacctaaaagggaggcccattgtctaaggctcatgcagttgaagaatccatctgtgcacaatctgttgtaaagtcggttgcacttattctatatgttacattttccagccatcaaaaaagtgcacaatctgttgtaacatgtgaaggtgcacattataaaaaccacttacatttttccagacaatcaataattcaacgagacattatgttctggatatggtggtaagtatgcatctacattac

SEQ ID NO: 3184 - DNA, 708 bp, Triticum aestivum
ctttttgctactgttgctttcgcagctatattcactgtacctggtggaaatgaaaacaatggagttgcgattgttgtccagactgcttcctttaggatattcttcatctttaatgccatagctctgttcacatcattggcggtggtcgtggttcaaataacagttgtcaggggagaaaccaagtctgagcgaaaggttgttgaggtgatcaacaagcttatgtggctggcatcagtttgcacaaccatttctttcattgcctcatgctatattgtgctaggccgccatttccaatgggcagcaatactggttagtttgataggtggtgttacaatgactggtgttcttggaacaatgacgtactttgtggtgaaatcaaagcgcatgaggaagattagaaaaaaagagaagatgtcaagaagaagcggctcaagctcctgggttgataatacggaaatctcagagactgagcttaatcaagtgtatgccttgtaaagaggcagggtctttgaactcagcctcgcctctgcaattgagaatgtacatgcttaatcaagtgtatgccttgtaagacacagggtgtttgaactcagcctcatatctggaatcgagaatgtacatgaaaattccagatgcgtgcattaacaaatagattactcacattattccttcattgtacaattcctttctgcaatgacaaacgatgca

SEQ ID NO: 3185 - DNA, 810 bp, Triticum aestivum
catttcaagatgttgagggggagatgaagaaagaagacgtgctaggttagaacgtcatcagaggacccgtgagcgagcggcaaaagctttggctgagaagaatgaacgagatatgcaggttcagagggaacaagcagaaagagatagaattggtgactcattagactttgaaattaagaggtgggctgctggaaaagagggcaacttgcgtgctttactatcaactctgcaatatatactttggccagagtgtggatggcaagctgtatccttgaccgatttgattactggtgctgctgttaaaaagcagtacagaaaggcaacgttatgcatccatcctgataaggtgcaacagaagggtgcgactcttcaacagaaatatattgctgagaaggtctttgacatgctcaaggaggcatggaacaaattcaattctgaagagctgttttaagccatccctgtgaatgtacagccagcttttaactaagtgtacccatgtgaagccctggagcattaagatgcagccgatcttctttttggtgcagctccatcaaagttatcagtgtattataggttctgttcaaatgcagacttctgttctttgaggattactggccggttgctttgggatgattcttttttatattatataccttggagggccaaagattacatgtatttcttcaacaccatttgtctatggtcagaccacagaaagtcgaaaccacagtttatgctttacttaagatcttacaagaaacagatgtacaagtatgctttgccctttgattattctcactcttgtactcc

SEQ ID NO: 3186 - DNA, 882 bp, Triticum aestivum
atttgaatttgaaagtacccgatcatcatctgacgcatttcaagatgtggagggggagagtgaagaaagaagacgtgctaggttagaacgtcatcagaggacccgggagcgagcggcaaaagctttggctgagaagaatgaacgagatatgcaggttcagagggaacaagcagaaagagatagaattggtggctcattagactttgaaattaagaggtgggctgctggaaaagagggcaacttgcgtgctttactatcaactctgcaatatatactttggccagagtgtggatggcaagctgtatccttgactgatttgattactggtgctgctgttaaaaagcagtacagaaaggcaacgttatgcatccatcctgataaggtgcaacagaagggtgcgactcttcaacagaaatatattgctgagaaggtctttgacatgctcaaggaggcatggaacaaattcaattctgaagagctgttttaagccatccctgtgaatgtacagccagtttttaactaagtgtacccacgtgaagccctggagcattaagatgcagccgatcttctttttggtgcagctccatcaaagttatcagtgtataataggttctgttcaaatgcagacttctgttctttgaggattactggccggttgctttgggatgattcttttttatattatataccttggagggccaagattacatgtatttcttccacaccatttgtctatagtcagaccacagacaagtcgaaaccacagtttatgctttacttgagatcttacaagaaacagatgtacaattatgctttgccctttgattattctcacgcttgtactccacagtgtgcagtttgactattaattctcaacatgat

SEQ ID NO: 3187 - DNA, 717 bp, Triticum aestivum
gagcaagcagaaagagatagaattggtgactcattagactttgaaattaaaaggtgggctgctggaaaagagggcaacttgcgtgctttactatcaactctgcaatatatactttggccagagtgtggatggcaagctgtatccttgaccgatttgattactggtgctgctgttaaaaagcagtacagaaaggcaacgttatgcatccatcctgataaggtgcaacagaagggtgcgactcttcgacagaaatatattgctgagaaggtctttgacatgctcaaggaggcatggaacaaattcaattcagaagagctgttttaagccatccctgtgaatgtacagcagcttttaactataagtgtacccacgtgaagccctggagtattaagatgcagccgatcttctttttggtgcagctccatcaaagttatcagtgtataataggttctgttcaaatgcagacttctgttctttgaggattactggccgtttgctttgggatgatacttttttatattatataccttggagggccaaagattacatgtatttcttcaacaccatttgtctatagtcagaccatagaaagtcgaaaccacagtttatgctttacttaagatcttacaagaaacagatgtacaattatgctttgccctttgattattctctcttgtactccacagtgtgcagtttgactattaattctcaacatga

SEQ ID NO: 3188 - DNA, 712 bp, Triticum aestivum
caaatcgtacttgttgaaaccctagcgccatctcgccgccggcgatgtccgcttgacggacgcgccaccgagaaagcaccaaactcctccgagccctcccctctctctgatccgtcgcccgcccgcgggatccggatcgtcttcagccatgtcaaaggccagggtctacgccgacgttaacgtggtgcgccccaaggagtactgggattatgaggccctcgccgtccagtggggtgagcaggatgactatgaagttgtgcggaaagttggaaggggcaaatacagtgaagtctttgaaggtatcaacgtcaacaataatgagaaatgtgttattaagatcctgaagcctgtgaagaagaagaagatcaaaagagagatcaaaatactacagaatctctgtggaggtccaaatattgtgaagctgcttgatattgtcagggatcagcattcaaaaacaccaagcttgatctttgaatacatcaataacacagatttcaaagtgctatatccgacattgacagattatgacattcgctactatatctatgagttactgaaggcttgggattactggcattcacaaggcattatgcaccgagatgtgaagcctcacaatgttatgatagatcccgagcttcgaaaactccggttatagactggggcctgctgaatttacctcccgggaagggataacggcgggtggcccaaggca

SEQ ID NO: 3189 - DNA, 1364 bp, Triticum aestivum
ggtctgaccaacgctgttccgggcaatgctcgccgtttttatttcggtggcccttccccccatcttgctaatgaacagtctgttgcaatatactttaatcaagtcatggctgctattggaggaaacactgctggtccaggtgatgctgttcttaatgtgtacataaaccatgacaagaaattcgcttttgtggagatgaggtctgtggaggaagcaagcaatgcaatggcactggatggcattttgtttgaaggtgcaccagtgaaggttagaagaccaacagactataacccttctctggcagctgccctgggcccaagccagccaagctccaatttgaatcttgctgcggttggcctaacaccaggttcagccggagggttagaaggcccggaccgtatttttgtgggtggtctcccctattacttcacagaggctcaagttcgggagctgcttgaatcatttgggcctcttcgaggatttgatcttgtgaaagatagggaaactggtaactcaaagggctatgcgttctgtgtctaccaggacctcaatgtcactgacatagcctgcgctgctctaaatggtatcaagatgggagacaaaactcttacggtcagacgagcaaaccagggctcagcccaacctagaccagagcaggaaaatatcctgttgcaggcacagcagcaggtgcagttacagaaacttgtgtatcaagttggagcgctccctacaaaggttgtatgcctgacccaggtagttactgctgatgaattaaaagatgatgaagaatatgaggacattatggaggacatgaggttggaagctgggaaatatggtaacttggtgaaagttgtcatcccgcgccctcatccgagtggagagccagtttctggagttggaaaggtgttcttagagtatgcagatgttgatggttccaccaaagcaaagacggcgatgcatggaaggaaattcggtggaaacccagttgttgcggtcttctaccccgagaacaagtttgctgatgaggactatgacgcggcagcataaattatctctcttttccaatgacaatagtgctttgtgtagtttgttcgatttacagcaacgttttcccttctagtcgagctttcctgtagcctggatttatgcagaaccgccagttattaatattggaagatagattgcctaaagatgatctattggtcttgtcccttaatcttgactggcgtttagaggtcccagggtatcgccattctcttcgtttagcgcccttgaaagattattagcaagtaactttacctttagctttaccctgcaaatggctcaaaagagtcatcttgaacaacttggcatggtaaataaga

SEQ ID NO: 3190 - DNA, 1156 bp, Triticum aestivum
  misc_feature (1110)..(1110): n = any nucleotide
actcccatgaactacatgatgaagataatgatatggattgctggcatgacatacatggccgagataatgccacaatgggaaacttggataacagtccagtacaaagacttgaggctgcggaagtgaaatctggtggtaaattgcattgttgtaagagaaaatccagcaagggcaaggcaaaggatgattactcatatggagatgagaaattgcaaatgctgaacatagaatcaatctctaggaagcaaaagagtgatagccagtttgatgaaggttgcgacagagataacgctttggactctttgcttaatgatgtggatgaagccgcacgagagaactgttatgaagttcgggaagaagaaatggatggcatggaagtgaagcctagagggaagatgcaaactggtaagagaaaaaccagcagatgtcaagcgggtgataaagcagctaaatttccttgtgatatagaagggtgtgacatgagcttcagctcacagcaggatttgttgttgcacaagcgtgatatttgtcctgttaaaggatgccagaaaaagttcttctgccataaatacctgctccagcaccgcaaagtgcacatggataaaggccactcaattgtgaatggaagggctgcaagaagacattcaagtggccatgggctaggacagaacacatgagggtccatacgggggtgcgaccttacgaatgcatggtacctggctgtggtcagacattcagatttgtgtcggatttcagccgccacaagagaaagactggccattccagtggtaagaaaaataaggagagtacataacttctaatccctgtgcagtagtacaggttctttctctgaagggtatgctgattgaataactgcatcagattccatttgtcgttggattaacctgcattaggagtctaattcattccattgtttactgactccgcataatgagtcaatttttccagtgccttgggtccaactggcctgttgttgactggggttattccaagtcaattgtatgtgctttagtttatcgccaacgcttggggaagttccttttgtcttcatggttaaattgacatacttatcttgctgtctggtggcantctgttagttgttcgttgttattttcctatttattattacggattg

SEQ ID NO: 3191 - DNA, 650 bp, Triticum aestivum
ggccgtgtcgtcgaacgacatgtccactggcaggcgacgatcaggggccgagcgacagcccctactcgggcggcgtgttcctggtgaccatccacttcccgccggactacccgttcaagccccccaaggtggccttcaagaccaaggtgttccaccccaacatcaacagcaacggcaacatctgcctcgacatcctcaaggaccagtggagccccgccctcaccatttccaaggttctgctgtcgatatgctcgctgctgacggaccccaacccggacgacccgctggtgccggagatcgcgcacatgtgcaaggccgaccggaccaggtacgagtccacggccaggggctggacgcacaagtacgccatgggatagataatgaagagcttcagctcgatcgagcttgaagatgtggaaaccatgtaccgatgaataataatcaatcaaccttttgcttcaaattatactagctgatgctgagtatgaacttaatcaccgtcagtcctctcccgtgcgaagggttgttcgcacaagtgacacgcagagagcatacactcacccctataaatttagaaaaatacgagcaccagtgtcaagtctaggacattaactctgttggcctagggatacaattgtcattctaaccag

SEQ ID NO: 3192 - DNA, 689 bp, Triticum aestivum
  misc_feature (249)..(249): n = any nucleotide
  misc_feature (258)..(258): n = any nucleotide
aaaacaagcagtagtgtgagatcaccttgagattaggatacaagttccacatccatctgcccaagaacaggttaagacattagcgtctttcctggaaattttggtggttcctagaggaaatggcgctgaggaggatcgtcaaggagctcaaggacctgcagagggacccgccgacctcctgtagcgcagggccggtgtcgtcgaacgaccatgttccactggcaggcgacgatcatggggccgagcganagcccctantcgggcggcgtgttcctggtgaccatccacttcccgccggactacccgttcaagccccccaaggtggccttcaagaccaaggtgttccaccccaacatcaacagcaacggcaacatctgcctcgacatcctcaaggaccagtggagccccgccctcaccatttccaaggttctgctgtcgatatgctcgctgctgacggaccccaacccggacgacccgctggtgccggagatcgcgcacatgtgcaaggccgaccggaccaggtacgagtccacggccaggggctggacgcacaagtacgccatgggatgagatagataactaaacaagagcttgagctcgatcgatcgaactcaaagatgtggaaaccatgtaccgatgaataatactcaatcaaccttttgcttcaaattatactagctgatgctgag

SEQ ID NO: 3193 - DNA, 644 bp, Triticum aestivum
ccccacgctgtgctctccacagttagcgtcattgtctacttctgctgctttgtcatgggctttggcccgatccccaacattctatgtgcagagattttccccaccagagtccgtggtgtctgcatcgctatttgcgccctcacattctggatatgtgacattattgttacctacagcctgcctgtgatgctgaatgctattggtctagcaggtgtctttggtatatatgcagtcgtttgctgcatcgcctttgtgttcgtctacctaaaggtcccagagacaaagggcatgcccctcgaggtcatcaccgagttctttgcggttggtgcgaagcaagcgcaggccaccattgcctgattcatcatggagctttgttttcagtttgcacactgcactgaaaattgcaaattggacgggtcctcatgaggaacggaaaaccttttgagttgtaaatgagatagctacccaaagagttcatcacgaggaacgggaagctgtaaaagtaggaggatttcatgcccccatttcatcgtctattcttgcttattagtactgtactgtaatcgtcattagttgttgtggggaagttcaacttgctaatctgattctgaactactatgctgatgtctgaaataaagaaaaag

SEQ ID NO: 3194 - DNA, 1028 bp, Triticum aestivum
gagcgcgagatcaccaaggacatcgtcatgcccaatatttctacggcaacgctggaaagaaagcatagcatctctgagtgcggaagcgctagacacccagcagaagacaagagctcatcatatgctgatgactggatggtgcagttcgctcgtctattcaagaaccatgttggttttgattctgatgcattagtggatctccgtgacctcggtacgcggctgtgcatcgaggcaatggaagacaccatcacaagcgaagaagcccaggagatatttcatgcggcagaggcaaaatttcaggaaatggcagctttagcgttgtttaactggggcaacatacacatgtctcgcgcaaagaaacgactatctttatcagaggatgcttcaaaggagtctgtactttcccaggtcaaaaccgcatacgaactggcatgcgctgaatacgtcaaagctggaaagaagtttgaagatactgtggatgtaaagccagacttttatgaaggccttattgcgcttggaaatcaacagtttgagcaagcaaagctgtcttggcgttatggagatgcttgtaaggtagacatgcgaactgaagtactagagctattcaatcgtgctgaggataacatggaaaaaggaatggagatgtgggaggggatagaatacttgcgactaaaaggattgtctaaatcaaaaaaggagaaaatcctactggataagttgggattggatgggcaccaaaaagatttaacagcagatgaagcgtttgagcaagcttcaaatatgcgatcacagctaaacatttcatgggctaccattctttatgagcgatcagtagtagaattccagttaggtcttgctagctgggaggagagtctcaccgaagcaattgagaaatttaagaccggtggagcttcgctggcagatatcagtgtaatgataaagaaccattgtgcgaatgagaaaactcaagaaggtatgatgtaatcgtgtgacctttttctgtaattttttgttcctctgttgctaaa

SEQ ID NO: 3195 - DNA, 1020 bp, Triticum aestivum
ggaaagaaagcatagcatctctgagtgcggaagcgctagacacccagcagaagacaagagctcatcatatgctgatgactggatggtgcagttcgctcgtctattcaagaaccatgttggttttgattctgatgcattagtggatctccgtgaccttggtacgcggctgtgcattgaggcaatggaagacaccatcacaagcgaagaagcccaggagatatttcatgccgcagaggcaaaatttcaggaaatggcagctttagcattgtttaactggggcaacatacacatgtctcgtgcaaagaaacgactatctttatcagaggatgcttcaaaggactctgtactttcccaggtcaaaaccgcatacgaactggcatgcgctgaatacgtcaaagctggaaagaagtttgaagataccgtggatgtaaagccagacttttatgaaggccttattgcgcttggaaatcaacagtttgagcaagcaaaactttcttggcgttatgcagatgcttgtaaggtagacatgcgaactgaagtactagagctattcaatcgtgctgaggataatatggaaaaaggaatggagatgtgggagggaatagaatacttgcgactaaaagggttatctaaatcaaaaaaggagaaaatcctactggataagttgggattggatgggcaccaaaaagatttaacagcagatgaggcgtttgagcaagcttcaaatatgcgatcacagctaaatatttcatgggctaccattctttatgagcgatcagtagtagaattccagttaggtcttgctagctgggaggagagtctcaccgaagcaattgagaaatttaagaccggtggagcttcgctggcagatatcagtgtaatgataaagaaccattgtgcgaatgagaaaactcaagaaggtatgatgtaatcgtgtgacctttttctgtaattttttgttcctctgttgctaaatcatcaataccaaaacttgtatatgtacacaatgtatgttaataa

SEQ ID NO: 3196 - DNA, 701 bp, Triticum aestivum
ttgctgacacaacagaaccccagatctcgacttcgcctcgccagctctttcggcgagaccagacgcaggccgtcaccagccgcgtcgtcggaacatatgggtacatggcgccggagtacgtgatgcgcgggaactactccgtgaagtcggacgcgttcagcttcggggtcatggtgctggagatcgtgacgggcaggaagaacaacgactgctacaactcccagcagtctgaagatgtcttgactacgatatgggagcactggacggccggaacagtgctggctacggtggacccgagcatcggcagcagcttctcagagagcgacgtccgaaggtgcgtccacgtcgggcttctgtgcgttcaggggaacccggcggatcggccggtgatgtcgtcggtggtcatgatgctcggaggcgaaacagtctctctcagcgccccgtccaagccggcgttctacgcgaggaacgccggtgccgatcactcggtcatctcgtccactgtgtccgtgcaggatggtcctggagtgtctatttaacaagttcagttgcagattaattcatgcctcacgcctgagggcatgtgtaaagaaatctatttttttaaagaggtcaccctgcataagtgatgcacattctgtaagatggtttcactgcaagatggagagatgtcattcaaggcaaggttgttgtactgtaac

SEQ ID NO: 3197 - DNA, 606 bp, Triticum aestivum
gcgagggatagaattgctgtaatcacatggaatatcccgatcagataactcagaccataactcatgagttaatacatgcttatgatgactgtgttggcaagaacatggactggacgaactgcgctcaccatgcttgctctgagattcgagctaatcatcttagtggcaattgccattacaaacgggaactgatgaaaggcttcctgaagataagggggcatgagcctgaatgtgttaaaagacgttcgctggaatctgtcaagaacaacccttactgttcagagacagctgcaaaggatgcaattgaggctgtgtggaatatatgctacaacgacacacgcccgtttgatagggctccatgaagtgcaagctgttgagagagttttgtgtcctttcagatgagctctgtgaagttcaagcctgtgggacaggttagtttcccttgagatgggctccatggagtacaagcctgtagggacagtttagtatcgcttcagattgtacttcagcagagcatcacaacaaaatccggaaatttggcgctgaaccaaaactttgaatgtatattagtccaaacaatgtaacagattattccatgcaattgaa

SEQ ID NO: 3198 - DNA, 689 bp, Triticum aestivum
ggatagaagtttgctgtaatcacatggaatatcccgatcagataagtcagaccataactcatgagttaatacatgcttatgatgactgtgttggcaagaacatggactggacgaactgcgctcaccatgcttgctctgagattcgagctaatcatcttagtggcaattgccattacaaacgtgaactgatgaaaggcttcctgaagataagggggcatgagccagaatgtgttaaaagacgttcgctggaatctgtcaagaacaacccttactgttcagagacagctgcaaaagatgcaattgaggctgtgtggaatatatgctacaacgacacacgcccgtttgatagggctccatgaagtgcaagctgttgagagatttttgtgtcctttcagatgagctctacgaagttcaagcctgtgggacaggttagtttcccttgagatgggctccatgaagtacaagcctgtcgggacagtttaggttcgcttcagattgtacttctgcagagcgttgcaacaaaatctggaaatttggcgctgaaccaaaactttgaatgtatattagtccaaacaatgtagcaacagattattccatgcaattgaattcttttgcatggcacattgtgacagagttcactgagctcaaaataagactgggcgtaactgattaattctttcccaggtaaa

SEQ ID NO: 3199 - DNA, 661 bp, Triticum aestivum
cagggggacctcatcgagagcgtccgcgtcctgccgcgcaaggtgcacttgcacgcaggcactgatgaacctctgaatgtgacattcatgagagcaccttcttcggcgctgctcaaaatagatgttcctttaatgtacattggagaggacgcctcacctggcctcaggaaaggagcttacttcaacaccataaaacgaactgtcaagtttctctgccctgctgacatagtcccaccatacattgaagtggacctaagcgagttggacgtcgggcagaaactgctgatgcgcgatctgatagtccacccggcgctgaaattgcttcagtcgccagatcaacccatctgtagcattatagggtcaagagcccccgaccagaagaaagagaaatcaaaataactctctccactgtattaactatttccaacagaataaacttgttttgctatctatgctcgagttattcagttcttgattatcccacctagaacgaatactactaggatgattttgtagcaagagaccactgttttacctgaggaatggaagccagatgctacagataagaatacggcaggaatgtctaaatatgtttatgtgattttgttcacagaaacttcactgtgatgtattttatcagaaaagcgtttatctcttgaca

SEQ ID NO: 3200 - DNA, 727 bp, Triticum aestivum
agctcgtcgaccacctcgggacggtccttcttcctctcccgcctcttccgtctccaggtttggtccgagcaggccgggcagggggacctcatcgagagcgtccgcgtcctgccgcgcaaggtgcacttgcacgcaggcactgatgaacctctgaatgtgacattcattagagcaccttcttcggcactgctcaaaatagatgttcctttaatgtacattggggaggacgcctcacctggcctcaggaaaggagcttacttcaacaccataaaacgaactgtcaagtttctctgccctgctgacatagtcccgccatacattgaagtggacctaagcgagttggacgtcgggcagaaactgctgatgcgcgatctgatagtccacccggcgctgaaattgcttcagtcgccagatcaacccatctgtagcattatagggtcaagagcccccgatcagaagaaagagaaagagaaatcaaaataactcgctccgctgtgttaactatttgcaacagaataaacttgttttgctatctatgctcgagttattcagttcttgattatccttcctagaacgaatactaccagtatgattttgtagcaagggaccactgttttacctgaggaatggaagccagatgctacagataagaatacggcaggaatgtccaaatatgtttatgtgattttgttcacagaaacttcactgtgatgtattttatcggaaa

SEQ ID NO: 3201 - DNA, 743 bp, Triticum aestivum
cggtgccgtccaagcagatccgcaagctcgtcgaccacctcggacggtccttcttcctctcccgcctcttccgtctccaggtttggtccgagcaggccgggcagggggacctcatcgagagcgtccgcgtcctgccgcgcaaggtgcacttgcacgcaggcactgatgaacctctcaatgtgacattcatgagagcaccttcttcggcactgctcaaaatagatgttcctttaatgtacattggggaggacgcctcacctggcctcaggaaaggagcttacttcaacaccataaaacgaactgtcaagtttctctgccctgctgacatagtcccgccatacattgaagtggacctaagcgagttggatgtcgggcagaaactgctgatgcgcgatctgatagtccacccggcgctgaaattgcttcagtcgccagatcaacccatctgtagcattatagggtcaagagcccccgaccagaagaaagagaaatcaaaataactcgctccgctgtgttaactatttgcaacagaataaacttgttttgctatctatgcgagttattcagttcttgattatcccacctagaacgaatactactaggatgattttgtagcaaaagaccactgttttacctgaggaatggaagccagatgctacagataagaatacggcaggaatgtccaaatatgtttatgtgattttgttcacagaaacttcactgtgatgtattttatcagaaaa

SEQ ID NO: 3202 - DNA, 713 bp, Triticum aestivum
gtcatccacagaggcgcagcttaagcaacttcatgccgaaaaggcagaagcatctgctgagagtgagaagctgatctctggattgaagcaagatattgccaatcttaagacagagctcgagttagtgtcctcacagaaagctgcagttgataataaggtgtctggtttgctgagtgatctcacaacttgtgatgaaaagatgaaggagatggatagccacttgcatcagctgcacctggagcatgtgcaagtgattgcagaggcagatgctgcacggaagtccgtggcagaactgcgtgcacgggtgcgtgagctcgaggaagaggttgagaaacagaagctcatggccttcgacagcgcagaggggaagcgggaggcgatcaggcagctgtgcttctcgctcgagcactaccgcgacgggtatcagcagctccggcaagttcttcagggccacaagaggccgatggtgatggcaacgtgatcagccagccagcagcttgctggatcctcttctctctggatgcctaaagtcagtatgtcaatgtaatgtaaacatccctttccccttcccctttcttcatgtagcttcggtctactccttagtagtcttggtaaagcttgtgctttgtagttgcttcagctactggtactgtctattgtgtgtgatgtaatatattatggaccattatggcattccttttcaaaatcatctg

SEQ ID NO: 3203 - DNA, 663 bp, Triticum aestivum
cgcagcttaagcaacttcatgccgaaaaggcagaagcatctgctgagagtgagaagctgatctctggattgaagcaagatattgccaatcttaagacagagctcgagttactgtcctcacagaaagctgcagttgataataaggtgtctggtttgctgagtgatctcgcgacttgtgatgaaaagatgaaggagatggatagccacttgcatcagctgcacctggagcatgtgcaagtgattgcagaggcagatgccgcacggaagtccgtggcagacctgcgtgcacgggtctgtgagctcgaggaagaggttgagaagcagaagctcatggcctttgacagtgcagaggggaagcgggaggcaatcaggcagctgtgcttctcgctcgagcactaccgcgacgggtatcagcacctccggcaagttctgcagggccacaagaggccgatggtgatggcaacgtgatcagccagccagcagcttgctggatcctcttctctctggatgcctaaagtcagtatgtcaatgtaatgtaaacatccctttccccttcccctttcttcatgtagcttcggtctactccttaggagtcttggtaaagcttgtgctctgtagttgcttcagctactggtaccgtctaattgtgtgtgatgtaatatat

SEQ ID NO: 3204 - DNA, 680 bp, Triticum aestivum
gccgaaaaggcagaagcatctgttgagagtgagaactgatctctggattgaagcaagatattgccaatcttaagacagagctcgagttactgtcctcacagaaagctgcagttgataataaggtgtctggtttgctgagtgatctcgcgaacttgtgatgaaaagatgaaggagatggatagccacttgcatcagctacacctggagcatgtgcaagtgatagcagaggcagatgccgcacggaagtccgtggcagaactgcgtgcacgggtgcgtgagctcgaggaagaggttgagaggcagaagctcatggcgttcgacagcgcagaggggaagcgggaggcaatcaggcagctgtgcttctcgctcgagcactaccgtgacgggtatcagcagctccggcaagttctgcagggccaccaagaggccgatggtgatggcgacgtgatcagccaaccagcagcttgctggatccttctctctggatgcctaaaatcagtatgtccatgtaatgtaaacatccctttccctttcccctttcttcatgtagcttcggtctactccttagtagtcctggtaaaagcttgtgctctgtagttgcttcagctactggtaccctatgatgtgtgtggtgtaatatattatggatcattgtggcattcctttttcatcatctgcct

SEQ ID NO: 3205 - DNA, 1328 bp, Triticum aestivum
aaagcatgccaggtttgactgctgacaaatgacactaaaccttctaagggcacccacctacacatgataaaagaagacacatcatccacagtttcagatcctgggacctgcgtgggatacaggacccaggtgggatctgagcctaaatgggataatcaacctaattgggaacctgaaactcctatcgagctacatggtccatcagatgacattgagcttggtctcactaaggaactagtcccaagcttagatgaaagatgggtcattaggaaagggcgctatcttggtgtattggtatgcaaccattcgtgcaagactgtgcagagtttaagttcccagattgttgctcccaaggctgaatatgacgacaactgtctggacctgctgctggttggtggaagtgggaggctaaggttattaaggtttttggtgcttttgcagtttggaaaacacatttctcttccgaacgtggaatatgtaaaggtacgatccgtgagacttaaggcaggtccgaatacacatgatgggtgtggtattgatggggagctcctccatgtcaaggggcaggtccggtgcagtttgctacctcagcaaagtcgtttgatcggtaggccagccaaaaaccctgtacagtaactgtaaatacataaccctgcagcactatatctgcctggaaattcacacctacaaccggcaactttcttgttctttttacctctgcatccagaacagcctcgctgacagacaggcacatataactccagcgatgtacattcgcgcttgatggccgaaagtgccatacggtgacatttatccaagagttgtaaagcctatctggtctgcagcctgttgcgcttctcttcgtttagccttttctttggctggtatcggaagtgttatagagcaatctatctgatcagtgtatttgcggggacggtttggttcggaagagcatggtgcccacccctggtatgtgcggttgtttggagtcccctggtgccggccacttgatgcttgtcaccccccattagagggacaaacaaaacactcccaatgctatgtccctgatcagctcgttacaaaagtgcgaacagatttctatcgtgtcatgttcccggtatagtataggatttggatgaaccaaaaaaggagagaagatatttgtggtgctgctggcttttccacctatagtttttttgtgtgtgatgtattgagttgtaatttgtcccagctgtctgtcataacgtgttggatcataaatctttgtcaagataaacctgcaggtacatatgtggtactatgtgttgttctctgctggggaataaaca

SEQ ID NO: 3206 - DNA, 631 bp, Triticum aestivum
atagtgattttagcaataaaatgaccatctcctgagagcaattctgcagaagcaaagacaacaacacatgattgatgaatttgggggttactatccagaacacttatactggcaacagaatgatgaaccccggaatgaagatcaggaaatggaggtcagggtaagaagcgaaatggcccagattcatcatgaaatatatgaactacgtaagttggcggaaacttgtattgcatcccaagtaaagatgcagcattccattaaagaagaggtgtgcagcgcacttcgcgaagctgggttgatgccaagcaagcctgacataacagcaaaaaagggcacgtgctgcatctgccatgagatgcaagttgactctttactttacaggtgtggccatatgtgcacctgcttcaactgtgctgatcagctgaaatcgagcagcgggagttgcccaatctgtcaatctcctatcgacgatgttgttcgggctcacctgaatttttgagacttaggatttaggaagatgaaagaaaaaaagccgacactcccagctttagaagtggagttcgtgaagcctggttttgaggaggcttcttgccttttgttaaccactaaaaactataggagctaggttttc

SEQ ID NO: 3207 - DNA, 735 bp, Triticum aestivum
ccagaacacctaataactggcaacagaagaggaaccccggaatgaagatcaggtggcatctgcaccgggttcattagcacctgtctgcccatgtcacagcccaccacccaagagaattggcagcactcatcaatttgaacatcaacaacatgaaaatcaaaatttgcttgaaatggaggtcagggtaagaagcgaaatggcccagattcatcatgaaatatatgaactacgtaagttggcggaaacttgtattgcatcccaagtaaagatgcagcattccattaaagaagaggtgtgcagcgcacttcgcgaagctgggttgatgccaagcaagcctgacataacagcaaaaaagggcacgtgctgcatctgccatgagatgcaagttgactctttactttacaggtgtggccatatgtgcacctgcttcaactgtgctgatcagctgaaatcgagcagcgggagttgcccaatctgtcaatctcctatcgacgatgttgttcgggctcacctgaatttttgagacttaggatttaggaagatgaaagaaaaaaagccgacactcccagctttagaagtggagttcgtgaagaccctggttttgaggaggcttcttgccttttgttaaccactaaaaactataggagactaggttttctcgagaaaatgtatatatgttattgtgcaactgcgacacgtgttgactgggaggcaaaacatagatctaatcaaaat

SEQ ID NO: 3208 - DNA, 1018 bp, Triticum aestivum
cagaaggtacactcgatgctgtttgtgcaccatgcctgtcgtcaaccatagcactggttccttgcgggatatgggtcatgtaccactcccatatcggtagtgcaacggtggttcatctatgacatacaacagtcgatgtatggcatcgtaggaagtccttggttccatggatccatccgcatacaatgcgacacgccacttgtggccttggatgaaatctcatggaggctggatttgcacattgtgcactcagggcgcgggagagctgcgagtgggtggggttcatcgacatcgatgagttcctgcacttaccctgggaaccataaccctacaagatgtcctccggaattactcaagcaggccaaggattggtgagctcaggactgcgtgccacagctttggtccatcaggtcggactaagattccgaaaaaaggcgtcacgacaggctacacctgccggctggctgcgccggagcggcacaagtcaattgtcaggccagatgcactgaatccatcactgatcaacgtggtgcaccacttccatctgaaggaagggatgaagtatgcgaatattggccagggagtgatgctgatcaatcactacaaataccaagtctgggaggtgttcaaagaaaagtttgctggccgcgtggcgacctatgttgccgattggcaggacgaggagaatgttggatccagggacagggcgccaggtctagggaccaaaccggtggaaccggaggattggccaagtcggttctgtgaagtatatgacactggtttgaaagattttgtacacaaagaattcacagatccacagactggaagtcttccatggtagatgggtaaggacggcatttgatccgcacagcacacggtacatgatatggagagaaaaacagataacgaaagaagaaacacgaaattaagttaggtggtagagtgggttttgcacttcggtatatttttagaccttgttgttaggtttgctgtccttaatttagaagcatcatttttt

SEQ ID NO: 3209 - DNA, 639 bp, Triticum aestivum
acgtgcaagacttgtaaactgagatggagggagtagatgacaaaggtagggactaaattaaggggtgacttcttgtaagaataagtccatttcaacacctcaactcttgcccgactctggaataaaccctcaacccataaaccaggtacttcagactcatttctgccaaaacaagatccaaagtagggacttgttttgaaggtttaagggtgtcaagtgtacggttctaccgctttaaaacatgtatttcccgcactgaacattaacacagttgccatgtcatttggagaaggtatggagagaggctaccttgtgtggatatcttcgtatgcaccgcagatccacactcagagccaccaagtcttgtcatctccaccgtcctatcgctcatggcatacaattacccagctgaaaaaattagtgtgtacctttctgacgacggaggttcgattctcactttctatgctctgtgggaggcctccttatttgcaaagcattggataccattctgcaagagatataacattgagccaaggtcaccagccgcttacttctcagagtcagatgggcatcaagatttgtgcagcccaaaggaatggtcacttatcagggagatgtatgaagatatgactgagcgaa

SEQ ID NO: 3210 - DNA, 630 bp, Triticum aestivum
aatttttacctgacaaagcagctgtatcaattcgctcagtcatatcgttcatacatctcctgcccagaagaatgaaaaagaagtcagttgtcatgccaaatgctgagcactacgggtaggctgcacttaacattaagcatcttatctaatcacatgtgtgtgccatgccattccctgttcaatagccatttgattacatgtgttaaagaaaatatgtttggaaaatctgcttaccctgataagtgaccactccttcggggtgcacaaatcttgatgcccatctgactctgagaagtaagtggctggtgaccttggctcaatgttatatctcttgcagaatggtatccaatgctttgcaaacaaggaggcctcccacagagcatagaaagtgagaatcgaacctccgtcgtcagaaaggtacacactaattttttcggctgggtaattgtatgccatgagcgataggacggtggagatgacaagactcggtggctctgagtgtggatctgcggtgcatacaaagatatccacacaaggtagcctctctccataccttctccaaatgacatagtaactgtgttaatgctcagtgcgggaaatacatgttttaaagcagtagaaccttacact

SEQ ID NO: 3211 - DNA, 458 bp, Triticum aestivum
ctagattgtatcccctgacgaagaagcgtgcgaagcctgcagtgccactgggtgccaactacaggcttattgatattcctgtcagtaattgtctgaacagcaacatatcaaagatctatgtgctcacgcagttcaactcagcttctcttaatcgtcatctctcacgagcctatgggagcaacattggaggttacaagaatgaaggatttgttgaagtccttgctgcacagcagagcccagataaccctgactggtttcagggtactgcagatgctgtaaggcagtacttgtggctattcgaggagcataatgttatggagtatctaattcttgccggagatcacctgtaccgaatggactatgaaaagtttattcaggcacacagagaaacagatgctgatattactgttgctgccttgcccatggatgaggaacgtgcaactgcattgggccttatg

SEQ ID NO: 3212 - DNA, 744 bp, Triticum aestivum
tagcatatctttaactcgatacaagtagaatggcatcaaattcatagttcatgcactcgtgttgtttacctctgcttaatttgttggttttgcatgttaaaaataaattaagcccatgtaaccgatgaacgtggcatgccgataatggcggaaggaatatcgcggaagatcgccgacccattcgactacggaggcgggaccatcaatccttgcggggcggctcatcccggcctcatatatgacatcgatccaagtgattacagcaaattcttcaaatgcaccatcagcaacaagaggacacccgtggattgcaacaccaccaccatgcaaccagcgtattacttgaacctgccatccatatcggttcccgatctcaggcatcccatcaccgtttccaggactgtgaccaatgtcggcgaggtcaattctgtgtaccatgccgcagtccagagcccagcaggagtcaagatggaggtcgtcccgcccgttcttgtgttcgacgctaccaacaaagttcagacgtatcaggtgaagctatcacctatgtggaagttgcacgggtactacacatttggtagccttacctggcataacgaccaaaagacagtgaggattccaattgtgacacgacttacaattgaagaattctactgagttgttgcataataaaataaaaatatcatttccacacttaacaataaaaagcagacatgcatggcagtgatgaggaaaacatgccacctg

SEQ ID NO: 3213 - DNA, 611 bp, Triticum aestivum
  misc_feature (604)..(604): n = any nucleotide
tcacctcaggcagtagaagggtcgaggaaacagattcagaggtgtttcactttagaagaagctactgatacaattctcctgtgtagttccatcgttcatgatctggcatacaaggcagcaacaattgcactggagcacgagcaagaatcagaacgccctcgaccaactgttaccattgtagggaaatccattcgagacgaggatggtttccttaagctgccccacagaagaaccccaaatcgtaaggttaaaaggaaaagattggaaggtgaaacaacaaccatcacagaaaccgctgaaaaagaatccatcgtcgaagatccttcacctgtaccttctgcttcaggaatcacaagggcatctgataatatgaaacctccaaagttggaatccaagtgcaactgtgtaattatgtaagttacttcaggcaaccatccagtatgccaaagagacatgggatacacacgcacgcaaaaccactactttgcgccagcctgcttcaaatcgctatcagcaacggatagagttccacacgtgtctctagattatttttcgacgatagtgcattttctgttttttaggcaacaggaattgcactgcgagnattcttt

SEQ ID NO: 3214 - DNA, 593 bp, Triticum aestivum
tgagggtctacggagcactgctgtggtcgcctgggggaaggtcctcaacacgccggagggccatgcgtgtctacaattgggtcgttcaacgacatagccaatccgggagacgcgcggcggggccgtctggggtcggtagctgttcgtgagggagcaggaggacctgctgtcggacctcaacgacatcccgaagaaggcttgcgaccggcggatcaacgagttcgtgaagcgggcgcggtcggccaaggtgcacgcgcacatcgtggggcacctcaagaaccagatgccggcgctgatggggaaggccaaggcgcagcagaagctgctggagacgctggacgagcagttcgccaaggtgcagaaggagatgcacctgccgccgggcgacttccccagcgtcgacgagtaccgggacacgctcagcgcctacaacttcgaccgcttcgagcggctccataccaagatggtcaaggacgtcgacgacatgctcgcctacgacatcccggacctcctcaagcagttcaggaacccctacgaatgaactgaaggacaaatggacaatgtagattccaaaggcagaacacccgaatttc

SEQ ID NO: 3215 - DNA, 757 bp, Triticum aestivum
agatcaccactcttgtgttcgagccttcgaagcgtcatggtccaagtgcgactccctgggcacggcaagtacatggcctgctgccttcatgtactcgtggtcgacgtcgtgcccaaggacgtcaactctcgccgtccactccatcaagaccaagaggaccgtgcagttcgtcgactggtgtccgactgggttcaagtgcgggataaactaccagccgccgacggtggttccgggaggggacctggccaaggtgcggcgagcggtgtgcatgatcagcaacaacacggccgtggccgaggtcttctcgcgcatcgaccgcaagttcgacctcatgtacgccaagcgcgcgttcgtgcactggtacgtcggggaagggatggaggagggggaattctcggaggccagggaggatctggccgcgctggagaaagactacgaggaggtcggagctgagtgtgaagacgacgaggacagaaggcgatgagtactgagttgatcaagcatgggtacgtgcttaattgggtggcagtgttgtgcacttcatgccgtatgttgttcttctctgtccctgtttgcttgccgttgcatctgtgatgttcggtggttagcagagtacaaaaattgtcagattggttcgggtgcactgacggctcggtgccacatagtctgtgaggaggtggtatcgatacatcataataatgaacgaagattttttgtactgcaagttgcaggggtatgtcttcctttacttcgttgt

SEQ ID NO: 3216 - DNA, 834 bp, Triticum aestivum
gaagcacccaagccccagtcagttctaagaccgagagaggcgagaggaagccaggggatgctgctgcgaagggagatggccgggaagggaggcaaggggctgcttgcggcgaagacgacggcggccaagggcgccgccgacaaggacaaggacaagaagaaggcgcctgtgtcccgctcgtcccgtgccgggattcagttcccggtgggccgtatacacaggcagctcaagcagagggtctcggctaatggccgtgtgggtgccactgccgctgtgtactctgcagcaatccttgagtacctcactgccgaggtccttgagctggccggcaacgccagcaaggatctcaaggtgaagcgtatcacccctcgccacctgcagctcgcgatccgtggagacgaggagctggacaccctcatcaagggcaccatcgctggtggtggtgtcatccctcacatccacaagtccctcatcaacaagacctccaaggagtgaatgaaacgcaataacgggtagttgtgctttgtatcttcgtgatcccttgttatgttgtgctatctgtgatgtgttgctattatcacaacctgaataggttgtctgaatttgtgatggggctagctttcggtaacttgttattagggaaagacttggcaaatgtaatcgtgatatggaaccacttatatttggtttcctgaagaccagacaatccttactattcgtcttcatggatatccaggtttaactttcttttatttttgttggtttcgctcaagatcactgcaactggagtgcctgccggctggacgctttgttagattatgtttatgtatagtt

SEQ ID NO: 3217 - DNA, 695 bp, Triticum aestivum
agctcctccacagagagaggcgagaggaagccaggtaggaggctctgctgcaaagggagatggccgggaaaggaggcaaggggctgcttgcggcgaagacgacggcggccaagggcgccgccgacaaggacaaggacaagaagaaggcgcccgtgtcccgctcctcccgcgccgggattcagttcccggtgggacgtatacacaggcagctcaagcagagggtctcggctaatggccgtgtgggtgccactgctgctgtgtactctgcagcaatccttgagtaccttactgccgaggtccttgagctggccggcaacgctagcaaggatctcaaggtgaagcgtatcacccctcgccacctgcagcttgcgatccgtggagatgaggagctggacaccctcatcaagggcaccatcgctggtggtggtgtcatccctcacatccacaagtcactcatcaacaagacctccaaggagtgaatgaaatgcaataacgggtagttgttgtgtgttgtatcttcgtgatcccttgttatgttgtgctatctgttacgtgttgctattatcacaacctgaataggttgtctgaatttgtgattgggctagctttcggtaacttgttattaggtaaagacttggcaaatgtaatcgtgatatggaactgctcatatttggtttcctgaagactagacaccc

SEQ ID NO: 3218 - DNA, 730 bp, Triticum aestivum
acccaagcccaagtcagttctaagccttgtagctgctcgacctagagaggagagaggaagtcaggtaggaggctctgctgcgaagggagatggccgggaagggaggcaaggggctgcttgcggcgaagacgacggcggccaagggcgccgccgacaaggacaaggacaagaagaaggcgcctgtgtcccgctcctcccgcgccgggattcagttcccggtgggccgtatacacaggcagctcaagcagagggtctcggctaatggccgtgtgggtgccactgccgctgtgtactctgcagcaatccttgagtaccttactgctgaggtccttgagctggccggcaacgccagcaaggatctcaaggtgaagcgtatcacccctcgccacctgcagcttgcgatccgtggagatgaggagctggacaccctcatcaagggcaccatcgctggtggtggtgtcatccctcacatccacaagtccctcatcaacaagacctccaaggagtgaatgaaatgcaataacgggtagttgttgtgcgttgtatcttcgtgatcccctgttatgttgtgctatctgttatgtgttgctattatcacaacctgaataggttgtctgaatttgtgatggggctagctttcggtaacttgttattaggtaaagacttggcaaatgtaatcgtgatatggaactgctcatatttggtttcttgaagactagacaatccttac

SEQ ID NO: 3219 - DNA, 524 bp, Triticum aestivum
gccgccgctcggagcaagcgccgcaggggacgccgccatgtcgaagcgcgggaggggaggatcggcggggaacaagttccggatgtcctgggtctgccggtggcagcgacggtgaactgcgccgacaacacgggcgccaagaacctgtacatcatctccgtgaagggcatcaagggaaggctcaaccgcctgccgtcggcctgcgtcggcgacatggtcatggccaccgtcaagaaggggaagcccgacctcaggaagaaggtcatgccggcggtcatcgtgcgccagcgcaagccatggcgccgaaaggacggtgtcttcatgtacttcgaagataatgctggggtgattgtgaatccgaagggtgagatgaaaggatctgctatcacaggacccattggtaaggagtgtgctgatctctggcctaggatcgctagcgcagcaaatgccattgtctgaggagcttgttggggataatgatatgtttccttagtttcagagtggtactggatgatgaatgtact

SEQ ID NO: 3220 - DNA, 1196 bp, Triticum aestivum
ggcagctcaacacctatggcttcagaaaggtggatcctgagaggtgggaatttgcaaatgagggattcttgcgagggcagaggcacctcctcagaaatattaagcgccggaaacctacacatgggtctcagaatcagcaatctcttggctcttaccttgaggtggggaactttggacatgacgtggagatagatcatttcaaaagggacaagcagctcttgatggctgaagtggtgaagctcagacaggagtaacagaacacaaggtcagatctgcaagccatggaaaagaggctgcaaggaaccgagcagaagcaacagcagatgatgtcattcttggcgcgagtcatgcagaatcccatgttcatacgccagctgatctcccagagtgagatgaggaaggagcttgaagatgccatctcaaataaaagacggcgccgcatcgaccaaggacctgaagctgtcgatggcatgggcactggctctaccctggaacaagggtcacaggtaatgtttgagaagcaggagccagtggactcgctcgtgaacggtgtcatatccgatcttgaaagctcgtccgtcgacacaaagggagctgaggtgcagcagagtgtcgcttccagccgttcggagcaactgagaggcaggcccagtggagagctaaatgatgatttctgggaggacctgctgcatgaaggggggctcggcgaggaggccagcaaccttgtggttccagatgacatgaacttgttggctcagaagatggactagctccacttgaagaacacaaagtctggacagtaatccatcgccgagcagccccgagaatccttaccagcaagcctgttgttatatatgtgtatatatatgtccatgtcggccatgatcagtcagtcgagtagatcactgccgcctttggtgatgatgctaccatattatcttggtgtcggtcttattttcgtcattgccgtgtttagttcagctttcgggaggattctatttggtatcagttatttctgctagctactgtcggtctaacgaactgcagtgtttctgctagctcgtgtgtattggcattgtcagtatcagtatgagaaataaatagaagagtacccagtatatagcacgtatatctgcagtgactgtatctggatgaccactcgatgtacagtatacttccttgtgtgtatgtataat

SEQ ID NO: 3221 - DNA, 647 bp, Triticum aestivum
cctcgcgcggcccagggacaacgccggcgtcctgctgctcttcagggacaagccctacctccaccccgagaaggtggtggacctggtgagaagagcggtgccactggccctcgaggtagaggacgacccaaggagagaagagctgaggcagctccaggagaagaaggacggcatcgacaagctggcgcacaagcaggtccggcgcatcctctggtccggcctggggttgatcatgtcccagatcggcctcttcttccgcctcaccttctgggagctctcgtgggacgtgatggagcccatcgccttcttcaccaccgcatccgggctgctcgtcagctacacctacttcctcgtcacctccagggacccgacgtaccaggacttcatggagaggctcttcctgtccaggaggaggaagctctgcgccacgcacaggttcgacatggagaggtacctggagctgcacaggcattgcaagtgccctctcgaaggtcactatcctcctcatggtcccaagcttcacaacttgtaacacctgaagtgaaatctcccagctggactctctggtttgggcaataggcaaatatgtagcttccgaagtgttcgctacatctttgcagaagtcaccagttacctgctagatcaat

SEQ ID NO: 3222 - DNA, 1057 bp, Triticum aestivum
ccgacaaccaattctggtaatctcttttccctaaatggaggcaatcatagcccggaatttgaacgtaagccggcgaagaggggtcggacagaacatccggagaagaacaattctgccatgtctgggggcagcccaacgatgcaccagagagtccttggggcactggcttgggcgctgagggagacggaggaggcatttttcaaggcagcagaggagggtgcggccgacaacccggagattgggctgatggggtcatgcgtactagtgatgctgatgaagggcgagaacgtgtatgtgatgaatgtcgggaacagtcgtgccgtgttggcgagaaggccggagcccaatcttgataacatcctcggcaaggcgacagagaaggatctgcagcagttgaaggccgagatcatggatggcctacagtccgtgcagctcaacgctgaacacagtacctccgttgaggaggaggtaaagaggatcaaggccgaacatattgatcgcaacgccatcatccacggcagagtgaaggggaaactcaacatcaccagagcattcggggctggctacctgaaggagccaaagtggaacagtatgttgttagcgtgcttcaagattgattacatcggcaaggacccctacatcaattgcatcccatcactgcaccaccaccgtatcggtccaaacgacaagttcctggtgttgtcgtccgatgggctctatcagtatttcaccaacaaagaggtggttgatgaggtagagatgttcacagctgcgtatcccaagggcaatccttctgagcatctcatccgagaagtgttacttcgggctgcaaggaaggccggtatggactaccatgaactgctcaacatatcctatgacgaaaggaggaggtaccatgatgacgtttccatcatcgtgatctcattcaaagcacatgcaccatgaacaacaaccttgttaggtctttgttttccttctcttgagaataatgttcctttatcgccgaaagcccgaaactgatatgcatagttctagtagtatgcttatgtaataagtt

SEQ ID NO: 3223 - DNA, 509 bp, Triticum aestivum
atcgagagaaagaaagggaccaaagaagagaggaagggaagatgagcaacgcagctagcacaacccccctcctcgcccactacaagatggggaaatttgatctttctcacagggtggttcttgcgccgctcacaagggagcggtcgttcggaaacgttcctcagccccatgccatactgtattatcagcagagagcaaccaaaggaggccttttgattgctgaggccaccggagtttcagacactgctcaagggtacaaagatactcctggcatctggaccaagaagcaggtagaagcatggaagccgatcgtcgatggggttcatgccaaaggaggaatatttttctgtcagatttggcatgtaggaagagtctccaatcatacttttcagcctaatgggcaggctccaatttcaagcaccggttaagcaatcaaacctgcaacgagagccgatggcattggattggctaaagtctcaactcctagggcgactaacggctgattgaat

SEQ ID NO: 3224 - DNA, 538 bp, Triticum aestivum
gttttttgaaaagtcttctttccccacagtagagagcagtacgccggggcaaggagcagacgaaggaagatgagcaacactgccagcagcgccgccctcctcaccccctacaagatgggaaggttcgatctttcccacagggtagttctcgcaccactgacaagggagcgatccttcggaaatgttcctcagcctcatgccatactgtattatcaacagagaacaaccaaaggaggccttttgattgctgaggccactggagtttcagacactgctcaagggtacaaagacactcctggcatttggacaaaggagcaagtagaagcatggaaaccgatcgtgaatggggttcatgcagaaggaggaatatttttctgtcagatttggcatgtaggaagagtctccaatcacacttttcagcctaatgggcaggctccaatttcgagcactgattagccactcaaacctgtagttagagccaacggcatagatgtacctacaatctcaactcctaggcggctacagactaatgagattc

SEQ ID NO: 3225 - DNA, 557 bp, Triticum aestivum
ttctctgttccgctgtaaaggcggagcagcctggaacagggttgttggatctgaccggctatctctgagccgaggagactcgccgccagatgctgcccaccggcaggagcaggcctcagcccaggcccgcgcccagatcttggtcccttctcagacatggacttctctgatccgaagcgcaactccaggtacctcagcaagatcatcatggtcgcgctcctcacggccatgtgcgtcgtcatgctcacccagccgccctgccataggaaggctcccagcgtgttctccatccatgaactcggagtaacacatgtgttggtgacgggtggcgctggctacataggatcgcatgcggctcttcgattgctcaaagactccttcagagtcaccattgtggataatctctcaagaggaaatatcggggcggtcaaggttcttcagaacttgtttcctgatcctgggcgattgcaattcatacatgctgatttaggcgatccaaaagctgtcaacagaatattcgcagagaatgcatttgatgccgtcatgcacttcgctga

SEQ ID NO: 3226 - DNA, 726 bp, Triticum aestivum
tactttgtgatcttctttggtccgatccttcgaatgaagcacaagggtgggctatgaatgatcgaggtgtctcatatacatttggacctgataaagtggctgaatttcttgagaagcatgatttagacctcatctgccgagcccaccaggtcgttgaggatggctacgagttctttgctgatcgtcagctagtaacaatattttcggcacctaattactgtggagaattcgataatgctggtgccatgatgagtgtagacgagacgctgatgtgctccttccaaatactcaaacctgcaaggaaaatgttgcctggttcaactaataacaagtctggcttcaagtcaatgagaggatggtgacggtggcacggcgattggtgagcaagctgtggtctcatttgcgggcaggcacgtgcctaccacgagcggctgcgactaaccggcgttttcgccgatgcctcgagcccggaccggaacaagaacgcagattgtacaactctctcgtcgatggactgtacatcgttcatgtcggattaacacttgttgtaatgtattattgtttttctaccgtgcggatctctttatcgtacgagaggacgatgtgaatgaaactgctgctcctcctccccctctaaattcaaggattcaggcaggcatatacgccaataaaaactggtaagagtcttgggtgctggcgtgggatcttgacacagggacaaaaatt

SEQ ID NO: 3227 - DNA, 1481 bp, Triticum aestivum
tttggttcggacctcccggcgggacagtgatcatcaggagccggcggcgcttcaaatcaaatcccccaaaagagcaaagcagagcgagatttgctcgatctgtgcttgattcctttcctttttgttgctgttgcggggatagccttgttttcttcttctttaactgtcgccgctctgtgcgttgttgagaagctcttgattgatggagaaggggatggatccggcgctgctggacaacatcatcgccaggctgctggaggtgaatcagcctcaagcccgggaagaacgcgcactgtccgagtcggagatcaagcagctctgcgccgcctccaaggagatcttcctcgcgcagcccaacctcctggagctcgaggcccccatcaaatctgcggtgatgtccatgccagtattctgatctcctgaggctctttgaatatggtggatatcctcctcagtccaactatcttttcttgggcgattacgtggaccgaggaaagcagagccttgagacgatatgccttcttttggcttataaggtcaagtaccccgagaacttctttcttctaaggggaaaccatgaatgtgcatcagtaaaccgcatctatgggttctatgatgagtgcaagcgcagattcagtgtgaaactctggaaaacatttacagactgttttaactgcttaccggtatcagcattgatagatgaaaagattctatgcatgcatggaggtctttctccagagttgaacaagctggatcaaatactcaacctcaatcgccccacagatgtgcctgataccgggttactctgtgatcttctttggtccgatccttcgaatgaagcacaaggatgggctatgaatgatcgaggtgtctcatatacatttggacctgataaagtggctgaatttcttgagaagcatgatttagacctcatctgccgagcccatcaggttgttgaggatggctacgagttctttgctgatcgtcagctggtaacaatattttcggcgcctaattactgtggagaattcgataatgctggtgccatgatgagtgtagacgagacgctgatgtgctccttccaaatactcaaacctgcaaggaaaatgttgcctggttcaactaataacaagtctggcttcaagtcaatgagaggatggtgacggtggcacggcgattggtgagcaagctgtggtctcatctgcagtcaggcgcatgcctaccacgagcggctgcgactaaccggcgttttcgctgatgcctcgagcccggaccggaacaagaacgcagattgtacaactctctcgtcgatggactgtacatcgttcatgtcggattaacacttgttgtaatgtattattgtttttctaccgtgcggatatctttatcgtgcgagaggatgatgtgaatgaaactgttgctcctccttcccccctctaaattcaaaggattcaggcaggcatacgccaataaacactggt

SEQ ID NO: 3228 - DNA, 735 bp, Triticum aestivum
ctatttctgggccagtactccgtgagtcccgacaaaggacatggaccgagcatcattggctcgccgatcatctcaaggaatagttgacctggttcacgatgtccggctttggcttctccttcttggactttgacttggacttggatttcgagaagaatcgaggaccacaagcatgttgttggaacaacacaggatggctgaatgcaagcaggctggaccagtacgctgcattattcctctgcagcgcgtctaagccaggatttgcacccctgatcacggttgggctcactgaacaacgaagagagaggtcaaaatcagtcagcatgatgtgcccatcctcccgaactaggacattttctggcttgagatcacggtatataatcccaagcatatgcaggtactccaatgcaaggagcacctctgctacatagaactttgctgcttgctctgaaaaatgttttccaggctgcctttgtcgaagggtgtgcaagtccccgccagggcagaactccataaccagacacgaaaacttgtccgtctcaaaatgagtatatagggttggcagaaatggatgatccagggactgcagtatctcccgctcggtctgcgcccggagcagcttcttccgactagccagagatgttttatccatcaccttcattgcaagtgactctttgtaccactcattcagagagatacacacttccgatatcaccagaacccagtttcttaagc

SEQ ID NO: 3229 - DNA, 734 bp, Triticum aestivum
atctagtcttggcagcagcactgcagcatatgtgcttacattgcaccgcagctgcttggatctggtattcctgaagttaaagcatatcttaatggagttgatgcttattctatacttgctcctagcacactctttgtaaagatatttggttcaatacttggagtttcagctggatttgtacttggaaaggaaggtccaatggtacatacgggggcgtgcattgcaaacttacttggtcagggagggtcacgcaagtaccatcttacatgcaattggctaagatatttcaagaacgacagggataggcgggatttgattacgtgtgggtgcgcggctggagtggccgctgccttccgcgcacctgttggtggcgtcctgtttgctcttgaggaagcagcatcatggtggcgaagtgctcttttatggagagcattctttacaactgctgttgttgctgtcgtgttgaggactctgattgagttctgtcgcagtggaaagtgtggtctctttgggcaaggtggattgattatgtttgatctaagttcaacagttgcaacctatagtagtccggatctacttgcaataattctccttggaataattggtggtatattcggaggcctctttaactttctcttggataaaattcttcgtatttacagtattatcaatgagtaagtaccgaggatgaattgtaataaatgtgattgcataatttttctattttcgatacc

SEQ ID NO: 3230 - DNA, 732 bp, Triticum aestivum
gcgctgccttactatgatgcgttcgagaggccacgtgaggagatgcctaggattggcgggcgcttgtgaagaacagggagggagaccaagtagaagattctcgacaattacttgggcagcagggatggctcctgctcttgttaaatgggacagccactcacttcttatagcctgaccacatggaaagattgaaatgcctctgcaaagtttttaacaggaacatattgaaagcttgacagaacataacaatgaaactcacctcctgcaagaagtctgccacgccttttctctcaggacatctgaaacccgctgattcaaagaactcgagcacttgttcacgggggccattgtagacaacctgaccgtctgagaggagaattatatcgtcaaacagttcatatgtctcaggtgctggttgcagcaaggaaataactgctgttccaccaagagtgtgaatagtttgccggatggagttcacaatctggaaggtagtcgaactgtcaagtccagttgatatctcgtccatgaaaagggctcgtcctggcgtgacgagcatctccgctgcagatgggatgggtgcgttagatacttggatcgtacaggacacatggtattttacttactcccttgatgaatcacctgtggtcactctctttttttgccctcctgatattcctctcaacatgttatttcctacgattgtgtcggcacacatatccaatcccaggatct

SEQ ID NO: 3231 - DNA, 711 bp, Triticum aestivum
cgccgcgccgttgttgttgccatcctgctcctccgcaagtgcaccgccgacggcgcgtgccctgcgggcctcccgcgcgattggcgcgggttcgagctctggatcgccggattcgggcggactggattctgctggctggttgcgccgggtttgctgccttgttcctgcccaattttggcggatcttgcggccgttccgtgctgaaaggatggcgaggtgagtggtgacgcgctcgatcttgggagtagtttctgctgagttcgtagctctcccattgcctgcaacgagtggtatcgtcagggccgccgaacccaatggggcctgggcagccaggaggcggtgcctcacttctccggacaagttctagcctgctcagtggtggccaacagggaatgggtgggggtggcggcatgctgcagtcgcagtccccgttctcatctcttgtctccccaaggtctcagtttggtggaaatggcttgctgggagcaacctctaatgtctcctccctgctcaaccggtcatcgtttggaaacgggagccctgttccaagtccaggacaaatgccaaacggtgggcttccgatgaatacccttcagcagagaggggggcttgatggcgctggtgattttactggcactggaggatccgatcctatgtcgtttccatcctcctcctcgcaggttagtttgggcaatcacctaggttcagata

SEQ ID NO: 3232 - DNA, 706 bp, Triticum aestivum
aatgggttggactaactatgcctctgcccacagagatcgccgtgaccatggctaccccttggcatagaacaaagccccaagaaagccctgcgtaccgtaccaccatggaccctctcggaccgtggtggcgagaacatgggcctacgttgggttcttccctcgggcaaacggggagcccctcttcacacggccactttgtcgttggttggagcttcgcgctggacaggcttagctccgatgttgaatatcttgtcgttgcatgccttggccgccgatcggacccaagtcacggtccaaagtgttgcagatcgtgctacccatagcatcctccacaacggttttatccatgggcatcattgtttacattttggttcgaaggcatctcaggtacgcggaggtccatgaggactgggagaaagcatttggccgcaccgattctcttacaaggatttatttcaagcgaccaaggggttcagccagaagaacctactcggagctggaggctttggaagcgtctacaagggcgtgcttcgcaagtctcacatggaggtcgccgtgaagaggctgtcgcatgagtcaaggcaagggatgaaggagtttatcacggaggttgcaagcatgcgaagcctgcgccaccgcaatctggtgccgttgctcggttattcccgacgaaagggagaatttctcttggtctatgtttacatgc

SEQ ID NO: 3233 - DNA, 701 bp, Triticum aestivum
catatgacaccattttttgggtttgatggggataaccgaatccccctgaaaagagaggctgctgtagtcgtggaaggactgaagaagatgggcattcatccagtgatgctcacaggcgacaactggaggactgcacaagctgttgcgaaagaggttggcattgaggatgtgagagcagaggtcatgcccgcgggcaaagccgacgtggtccggtcgctccagaaggacgggagcatagtggccatggtcggggacggcatcaacgactccccggccctcgcggcggcggacgtcgggatggccatcgggggcggcacggacatcgccatcgaggcggcggactacgtgctggtgaggaacaacctggaggacgtgatcacggcgatcgacctctcgaggaagaccttcaaccggatccgctggaactacttcttcgccatggcgtacaacgtggtcgccataccggtggccgccggcgcgctgttcccggtgacggggctccagatgccgccgtggctggccggcgcctgcatggccttctcgtccgtgagcgtggtgtgctcctcgctgctgctgcggagatacagaaaacccaggctcaccaccgtgctgcagataactgtagagtagagcgatagcttcttttgtgaatactgtaagtcccgttcaccatttttacagaagtgaaatgaaaagaaaga

SEQ ID NO: 3234 - DNA, 697 bp, Triticum aestivum
  misc_feature (252)..(252): n = any nucleotide
ggtactgggtacgccaaagacaatcactgtggatttattttggcagattgtggtcttgatgtttggtttccaacacccgtggaactaattccagccggaaccatacctcggctcaccccagatgatccggaggtactgggaattggacgtgggaccacttggctgcctaatgaatcttcctgccgtgcttcagcatgtctatgatcacacaggaggccagaaagttcactatatcggtcactcctgggaacncttgagtattctgcagccttctctgagcacaggttacttcatttagttcgatcgactgtgttgctctgcccattgcttatctgtataagacaaatcgaaactcacccggcttgctactcaaatcctccttgcagaggcatttcactttctaggatatcgtgagttcaatcctgttgggccagtttcacatgaaattctgctcataatatgcggtgaccctgaaatcgactgctacgacctatttacggctgttatgggaccggactgctgcctcaatgcttcaactgtatgtaacttcctgcagcatgctacacagtccacctctatcaagaaccttattcacatgtcgcagatgatcaggtacgaaggggtcagaaggtatgactatggcaacgccaaggaaaacatgaagcattacaaccagccacgccccccgctgtacaac

SEQ ID NO: 3235 - DNA, 684 bp, Triticum aestivum
catctccttgcagagaagtcatcatatcctcaccaagaccgcaaacaataatagtggaactgattcgtgggaatggtagcaggtttacaccagcttttgatgcagcatccaaatggatttatgccacatcaaatgccgccaccccatcaacaaaatggaatgctcccaattcaacactctccaccccagttctcacaactacatgcccagatgcttggtgcccaacattctccgccacaaaatctgccgatgtttggtcctcggcatccttcaccacaaatgatgggtagatttgatccaaattttgtcatgcctgacttgagtgatcccagagccagatcgatgttacaccatggaaggcatggcccacgctatcctccccaaggttttgagcctggcatatgagaatggataataggtggcagcggttcagatccaagtacatgtccactgaagaaattgagaacatcgcaaggatgcagaaagctgccactcagatcaccgatccatatattgatgattactatcatcaagcttgtttggccagaaaatcagcaggagcacaactgaagcactacttctgtccaaccttgatcagagatacatcttctcgtgcacgcagtaaggatgagccacatgcgtatcttcaggttgatgctcttgggcggctcccattttcttcca

SEQ ID NO: 3236 - DNA, 683 bp, Triticum aestivum
cagatggtgattccatgtacatctgattgctgcacctcatgcactggcaaaattatacaactactccaattgaaatgtccctaggagagtgccaagatccaagccacctagataaagatctgataagggggaagatactggtctgcagctattccataagatttgtacttggcctctcttctgtgaagcaagctttagatacagcaaagaatgtcagtgctgcaggaattatattttacttggacccttttgtccttggtttccagctgaacccaactccaatggatatacctggacttataataccatcatctgatgactctaagatattcctaagttattacaacgattcgcttgtacgagatgggccgtcagacagagttgtcaagtttggtgcagttgcaaaaatactaggaggtctgaagccaaattatggtagttcggcaccaaaagtgatgttttattctgctagggggcctgaccctgaggataatacattggccaatgccgatatcttgaaaccaaatgtggtagcacctggcagttccatttggggtgcttggagttcgcgtggattggattctgctgaatttaccggtgaaagttttgcgatgctctccggtacaagtatggctgcaccacacattgctggccttgctgctctaatcaagcagaagtttcct

SEQ ID NO: 3237 - DNA, 681 bp, Triticum aestivum
  misc_feature (134)..(134): n = any nucleotide
tttaatcaccgtgatctgaagcctgaaaatctacctcctggattgagaatgaaaaacctagaaagtctcagattttggtttgagtgcccctgctgattgcgcgaggcaggatggtcttcctggcgacaccacantgtggaactccagcttatgttgcccctgaagtgcttagcaggaaaggctatgatggtgcaaaagcagatgtatggtccagtggagtaattctgtttgtgcttgtggctggttaccttccttttcatgaggcaaatctgatagagatgtacagaaggatttccaaagcggacttcaaatgccctcggtatttttccgctgagctgaaggagctattacataaaatccttgatccagatcccagtactaggattacaatctctaggataaagagaagtgcttggtacagaagaccagttgaggtaaatgcaaagaaaaccgagcctgaagcaagcacaacaccttttcagctgaagctgcgtcgccaggctcgacaggatgcagcacttctgagggaaatcaagggtcattaagcctcccaaacctgaatgcatttgacatcatctctctgtcaacagggttcaatctatctgggttttttgaggatgagtatggtcgcagggaagaacggtttaccactaggcagcctgtaacaatagtacttacaaa

SEQ ID NO: 3238 - DNA, 675 bp, Triticum aestivum
aatgatctacttggtttcccaaggaccacacaaggggggtcgcaagaccgagagatataaatctcttgcaactcattccatggtgataactgttgcttaccacttgtcggtgctgagggacatgtttcctaatggtggttagtgtgctgtccttgttcaccggtattggaggaggagaggtagctttgcacaggcttgggattcacatgaggacagtggtttctgttgagataggtgaagctaataggaggattttgaggggttggtgggatcagacccagacaggcacgctgattgaggttgctgacgtgaaatctctcacccctgatataattgcatcatacgttggtagatttggcggcttcgacttggtgattgggggcagcccatgtaacaatcttgccgggagcaaccgacaccaccgtgatggcttggagggcgagcaatcttctttgttctaccactacttcagaatcttggatgtcgtcaagtcggctatggcgaggatgtaggctatggcaaggatgtagcctaagcattgtagtaccctatcttatcacgtagtgtttaaccgcaacttcttttgttctacatagagtaagaggcttcttttgtttagttgcttcatgtccttttctttgcttgcacttacaactatgtatcaagcacttaaat

SEQ ID NO: 3239 - DNA, 674 bp, Triticum aestivum
tacttctggaaaagttcccagaggttaccaatggggttctcctcttgcagacatggatgtattatgagcagggagatttgcgaaaatcatagacagttctgcgggtgatgatatggatattgaacaagcctgcaggttcctgaaagttggacttctctgtacacaagatgtcacaagacatcgacccactatgtcaactgtcgtcagcatgctaacaggcgaaaaggatgttgactcggagaagatcagcaagcccgctacaattagcgactttatggaccttaagatcaggagcatgaggagagaaaataacattgcattcgcttcatcctccacgttgctatccactatcatggcacactcttctcctttgttgtcgcaagagacgacacaagcctccatcacattcaccgcaatatcagagcgtgagtgacctgaagttggttgcaaatatgaagaccatgtagagaagtagcatagccagataccctttttcttcagaagttttcttcgtagtgtatagattcactttgtttatagtgtacacagcattgctgggacaaagaagtttcatgagttttactttgtgcgtacaatactagattggtggcgcatgccattgtatatgtgtgcatgtacatcctgtccgttgtttgtttggtggaaagaaaata

SEQ ID NO: 3240 - DNA, 674 bp, Triticum aestivum
cttggtagctttgcctgctgtactggagtctcccaactgtggttcatgaatgtttgttccgttcattgcgagatactttctactttaggtgtaatctatgagcgaggattaataggaatgtatcacgactggtgtgaagggttttctacttacccaaggacatatgacctcatccatgctaacggtgtcttcagtttgtaccaaaacaagtgtaaatttgaagatatactgctggaaatggaccggatcttacgcccagagggcgcagttataatccgtgacacagttgacgctcttgtaaaggtggagaaaatagccaatgccatgaggtgggagacaacactggccgaccatgagggcggccctcgtgtgcctgagaagatcctctttgcagttaagcaatactggactgccgacagcaagagccgccgctaacatgtctggattattgttctcgcttctcttcaggataacttttgtccctggcggcgttcgttgcaagtacacattagacggcgtgtagagaactgaagaaccaagccagtgacaactagaggagagtaaaatatgtcttctatttatcgttggtgttgtatttttctttatttttgttcgtgctgtattcttgtttatttttgttcgtgttgtatcttagaaattcatgaagtggagag

SEQ ID NO: 3241 - DNA, 658 bp, Triticum aestivum
cctgctgatgggctcttcatttctgggtttttctcttttgattaatgagtccagcctaaccggcgagagtgaacctgttgttgtaaatgaagaaaacccttgttcttttgtcgggtaccaaggtccaagatgggtcctgcaagatgcttgttacaacagttggtatgcgaacccagtggggaaaactaatggctactctcagcgaaggcggggacgatgaaaccccactgcaggtcaaacttaatggagtggcaactatcattggtcagatcggactatttttcgctgtcataactttcatcgtcttgtctcaagggttaatcagcaaaaagtatcacgatggtctgctcttaagctggtcaggggatgatgcactggcaatgttggagcattttgctattgcagttaccattgttgtggttgctgttcctgagggattgcccttagcagtcacactgagtctggcatttgcaatgaagaaaatgatgaatgacaaggcgctggttcgcaacttagctgcatgtgaaactatgggctcagctactaccatctgcagtgacaagacagggacactaacaactaatcatatgactgttgtcaagacctgcatttgtggaaatatcagagaggttaacagtcctcagaatgcgtctaagtt

SEQ ID NO: 3242 - DNA, 652 bp, Triticum aestivum
agatccgcaggacggactgagcgagagtacaaggatcggaggaagagagcggtggtctttcttggcgctgctgcttgcgttgctgcggaagtcgtttctcggttgcagggaggagggcccccaaggcgaaggttgtgcgatggagatcgggtggccgacggaggtgcagcacgtggcgcatgtcacctttgataggttccatggattcctggggctgcccgtcgagctcgaacccgaggtgccccgccgcgctcccagtgccagtgcaagtgtctttggagtttcaacagaatcaatgcagtgttcgtatgattccagaggaaacagtgttccgacaattctcttgatgatgcagagacgtctttatgaacaaggtggtcttcgggcagaaggtatttttcgtataaatccagagaatagccaggaggagcttgtgagagaccggctaaacagcggaatcgtgccgtatggtattgatgtccactgtttgtcaggtctaataaaagcatggtttagagaactgccgagcggggtgctggaccctattccacctgaacaggtgatgcaatgccaatctgaagaggattgtgctcgggttgcgaaatgcctcccactagctgaagcggccttacttgactgggccgttaatttg

SEQ ID NO: 3243 - DNA, 637 bp, Triticum aestivum
cgttatgtcaaatcagaaactagttttgtgacattaggacagcgtgttctttctaatccactgaaagtgagaatgcattatggtcaccagacgtgtttgatagaatatttcatattacgagggtggcataagtaaggcgtcccgtatcatcaatatcagcgaggatatatttcagggtttaactctactctacttcaagggaacataactcaccatgagtatatccaggttggtaaaggaagagatgttgggcttaatcagatcgcactatttgaaggaaaagttgcgggaggaaacggcgaacaagttcttagcagagatatatacagacttggccagctttttgattttttcaggatgttatccttctatgtgactactgttgggttttacttctgtactatgctaactgtactgacagtgtacatatttctctatggtaaaacttatctggctttatctggtgttggagaatcaattcaaaatagggcggatatacagggaaataaagcattgagcgtggctctgaacacccagtttcttttccagattggtgtgtttactgcattcctatgattctaggtttcatcctggaagaaggtgtcctgacggcttttgttagcttcattactatgca

SEQ ID NO: 3244 - DNA, 636 bp, Triticum aestivum
ggagcttgtactagagtcaaatgtcaaatagagaccccaagtacatacccataagcgtgagcgcgcgctcggattgcccgtgcaaatgagctatgacgtgccgcttctcggggcgcaagaggccacgcgccggggaaggcgccgcacggcggggggcaagacgacggcaatgccagcttcgtgcgaacttgcctcaacggcaccaacggcttggcaggtgttgggctgctgtcgatgccgtacgcgctcgcggagggtggatggctgagcctggcgctgctcgccgccgtggccgccacctgctggtacacgggcctcctcctcgggcgttgcatggccgctgaccaggcaatccggacgtacccggacatcggcgagcgcgccttcggccgccggggacgcctggtcgtgtccgccttcatgtacgccgagctctacctcgtcgccatcggcttcctcatcctcgacggcgacaacctcgacagcttttccccggcgccagcgttcacctggggcccgtgtcgcttgcggggaagcagctgttcgtcgtgctggtggcgctcatggtcgcgcccacgacgtggctgcgcagtctgggcgtgctcgcctacgtctccgctgcaggcgtgttcgcgt

SEQ ID NO: 3245 - DNA, 631 bp, Triticum aestivum
cgtaagttactaaaacatgggcatgattgtgctctagccttgctggtgcttaatgaagatgatacatcaatgatgatgcattcgaggtatgtgctctattgatagtgtcattttggccacttacagattccagccagcagttgtgcgggtcatgctagcattaaatgagcttagcgagcctgctgcatataatgaaagcgtggatggccaaaaaacattgaagcctctctaagaatcttctatgggatggtgcttggacaaggaatactctatgccgtggcctgcatgtttgagttcttttctttcatccctcgaagatccctcatccgcggtggtggatttaaaggtcagtggggaatgagatctgtcaatatgtattacgcatatgcatcagagaaatgcatgcaagggggtgtgcttgctccaaagaagatcaacctcagcacctttgccatgaattctgtgaactcggattcatccaagaatcagctcgccgggatacgaatgatgcacaactttctgcaaagtcaaccaaccaaggcacactcctttcaaaactcgccacttctaccaagacgatggccagaataatcagaatgttggattggacaagtccaaaggatacagctat

SEQ ID NO: 3246 - DNA, 631 bp, Triticum aestivum
ctgcatctggttctgcaacaaatggaacgttcatcatgacaataaagatacaaaaaatagtctctctatgatgaccagctatgctctgtttggttacctgtagcgcctgctgcctatgttgccttgggttgtgtagtttcagctggaactgctgaaccacctttgtctgcagttttttgtttaactgcttccttgatttcttcatgtggtctaagggattgtattgcactgaggggtaatactaatacgtcattttggcgcgttgataatgcttttggtacctttttaccgggggatcctgctaatgtcagtgtgcatccaaatgcttacgatcttcgccacatgctattcaatagtgcggattcatcttcgaagaatagctctaaagggaaagatagtcggaatgacgatgcctctcagatagagagatcagcgttgacttcaggtcggctgtttgaagcagtagcaagcttcaaacttgtttggtcaaacgatggaatgtctgcgccaaaaaagctctcagtatggcgtccaatgatgtcggaaggaatgttttactttggggacatcgctcttaacgggtatgaacctccgaattcagctgttgtccttcgtgatactggtgaagata

SEQ ID NO: 3247 - DNA, 629 bp, Triticum aestivum
cagacataccagggcgtgggattcgttgtgtaccatgcaagtttgcaagacatgttaccgcatgtactcccgcaccactttgttaaaggattcgaactgttgatacttctggttgtgtatctgacttacggaagttcgctacaagagctcgaatttgtacctatttgtcactttctcgatatggttcctggttgcatcctggctctttgcaccatttatttttgatccatcatgttttgagtggcagaagacggttgatgactggagagattggaggaagtggatggggaaccgagggggtattggcatgtctgtggaacaaagctgggaggcttggtggataggtgagcaggagcaccttaggaaaagtaacattcgtgctcttctctttgagataatcctttcacttcgcttcttgatctaccaatattgtattgtgtaccatctgaacatagcacacctcaacagaaccattcaggtatacacattgtcatggctggttgcgcccgttgttctaatagttttacagctgctttcaataggacaacagaagtttgggttcgacttgcagtgtttgttccgcatcctcaagggccttctcttccttggcattctcactgtgatggtcg

SEQ ID NO: 3248 - DNA, 628 bp, Triticum aestivum
cccatcgccttcgatcgttctgaccggcattctgttgaagtagaccggagccgagatggagcgacgccggaagctgttcatcgtggcatctcgtggacaccaacgaggaccgcctccgggagtactttgagaagtacggggaggtggtggaggctgtcatcatgcgcgaccgagccacgggccgcgcccggggcttcgggttcatcgtgttcaccgacccagcagttgcagagcgtgtaataatggagaagcatatgatcgacggccggatggtggaggccaagaaagctgtccctagagacgatcagcaagctcttagcaagagtggtggcagtgctcatggatcaccagggcccagtcgcaccaagaagattttcgttggtggtcttgcatccaccgtgacagaggcagacttcaggatgtattttgagcagtttggcacgatcactgatgttgtggtgatgtatgatcacaacacacagcgtcctagagggtttgggttcataacgtacgattctgaagacgctgtggacaaggcattgttcaagacattccatgaacttaatggtaagatggttgaagtcaagagggctgttcctaaggagctatcacctggacctagcatgcg

SEQ ID NO: 3249 - DNA, 628 bp, Triticum aestivum
gagcattcgtctcactgttgtggagaccatgacatgtggactccctactttggccacagtccatggtggacctgccgagattatagagcacgggatctcagggttccacatagatccttatcatccggatcaagctgcaaaatctgatagctgacttcttcgaacaatgtaaacaagaccccaaccattgggttgaagtttctaatagaggcctacaacgtatatatgagaaatatacatggaagatctactctgagaggttgatgacattggctggggtttatggcttctggaagtatgtctcgaagcttgagaggcgggagaccaggcgctatcttgagatgttctacatattgaagttccgtgaactggcgaagactgtacctcttgcagtagatgaggcacactgactgtaggtcctcgacgtgatgagatctgagggaaatcttcctgctgtcagtgggaatggtataggcaataatgtgcagcagatggccgcttggccgataataaaatggaatgtaacttgtgtgttcagcaagtgacgaacttgggagttgggactctgtaaaactagatttgtcaaacatcttgtctatgtacattaaaatagtttgatactcagtgc

SEQ ID NO: 3250 - DNA, 626 bp, Triticum aestivum
agcttctgggagtttgtattgggacgccctgcaaagatactaccctgataatcccttgctgcatgtgcttttgtctcctttgactggtcggcatcgccaccgaaggctgggccgaacggctcccatgatggcatcggaatcttcgcgagtatcatcctggttgtttctgttaccgcgacgagtgactaccagcagtctttgcaattcagggacctggacaaagagaagaggaaaattcttgttcaggttacaagggacgggttcaggcaaaggatattgatagatgatcttcttcccggtgatgttgtccatctagctgttggagatcaggttcctgcagatggcgtctttgtttctgggttttctctgttgctggatgagtccagtctaactggagagagtgagcctgtcgatgtaaatgaagacaagccttttctttcatcagggaccaagtcctagatgggtctggccaatgctggttacatcggtcgggatgcggacacaatggggaaagctaatggctgctctcactgaaggtgggaatgatgaaactccgcttcaggttaaacttagtggagttgcaaatattatcggtaaaatcggcctgttttttgctgtgttaactt

SEQ ID NO: 3251 - DNA, 612 bp, Triticum aestivum
ctgacaaagaatgaatccaagatatcagattttggaattgcgagactattggcgcaagaccagacccatggaattaacgaaacatgtcgtcggcacatacggatatatggcgccggagtacgtgatgcgtgggaactactccgtgaaatctgattcattcagcttcggcgtcatggttcttgagattgtgacgggaaggaagaacaatgactactgtaattctgagaaatctcaagatcttctgaatgtgatatgggagcgttggatggccacaacggtgttgggcatgatggatccgtgcatgaacaccagcttctcagagagcggcgtactaagatgcatccatatagcgcttctgtgtgttcaagaaaacccggctgatcgaccgcttatgtcgtctgtggtcatgatgctcggaagcgataccgtgcctctctctgccccatctaagccggcgttctacgtccagaaggctagcgacaactttggcatcgcgtcaacttagcacaattaacatgttcttgagttgaaaattaaagaggtcggctctctgagcagttttaacacgggccctcgtaccttctcttttactaaaagtgtataatagaccag

SEQ ID NO: 3252 - DNA, 607 bp, Triticum aestivum
gtcaaagagaattctagccccatgcaaaggggaatgtggctccatttctcccgctttcactcacgtttgacacatcagatactctgttgacatgccaccggaaatgaaagcacaaggcgtagttgaagaccgattggagctcctcaaaggtgttagtggatctttcaggccaggggtactgactgccctgatgggtgtcagtggtgctggcaagactactctgatggatgtgttggcagggagaaagacaggtgggtacattcaaggaaacatcagcatttcaggatacccgaagaaacaagagacctttgcacgcgtatcaggatactgcgaacagaatgatatccactctccgcaggtgacagtctatgagtcgctgcttttctcagcgtggctccgtctccccgaggatgttgattcaacaaagaagggtgttcatcgaggaggtgatggagcttgtggagctcaagcctctgaaagatgcattggttggtctaccgggagtgaatggtctgtcaactgaacagaggaagaggctgaccattgctgtagagctcgttgctaatccttctatcattttcatggatgagccaacctccggacttga

SEQ ID NO: 3253 - DNA, 606 bp, Triticum aestivum
  misc_feature (437)..(455): n = any nucleotide
gtcacgtcgcgcagatcaatcgggctcaacaccatgggcatctccctcgtccgcattgactatgcgccaaatggcctcaaccctccgtcacacccacccgcgctccaccgagatcttgaccgtgctagagggttgcctccacgtcggcttcgtgacctcgaaccctgagaacagacacttcaccaaggttctcgccaagggagatgtgtttgtgttccccaagggcctcgtccattaccagttcaataatgggaatactcatgcggtggccatcgcggcgctgagcagccagaaccctggagtgatcacggtagccaacgcagtgtttggatcggagcctgccatctcagatgatgttattaccaaggccttccaggtggagaagaacacggtagattggatccaagcacagttctaaaaagtcttgtgttgcggcnnnnnnnnnnnnnnnnnnngaagtactattttatctttagcttcatttggattgcattgcatgttcttcataagtattgtaagttgaggatttttaatcctcatgtgtatgttctttacctatgtaacattgatgtattgtggtacacacctctatttgtttattgcaaa

SEQ ID NO: 3254 - DNA, 606 bp, Triticum aestivum
  misc_feature (102)..(102): n = any nucleotide
cataaggcaaacgtatttattgactgacaacggcgagccagacatattttgagaatataagtaatgggttgttctcctttcttctgctataaaagtggggcnacacgccagcaaatttctactcatactgaagacctccctggtgatattaatacaataagatacacttatagggagctagcaagggcaacagaaaattttaacccatccaacaagattggtgagggtggttttggatcggtatataaggggcggctaaggaatggaaaacttattgctgtcaaggtgttatctgtagaatcaagacaaggactaaaggagtttctgaatgaactgatgtcaatttccaacatatctcatggcaatcttgtcagcctttatggctattgtgtggaaggaaaccagaggatccttgtctacaattaccttgagaataatagccttgcacaaacacttctaggttctggccgcagcaatatccagttcaattggagaagtagagtaaatatttgccttggtatcgcccgaggattagcatacctccatgatgatgtcaatccccacattgttcatcgggatatcaaagcaagcaatatacttcttgat

SEQ ID NO: 3255 - DNA, 604 bp, Triticum aestivum
ttcgacgtggagcgactgacggcatggtgtaccgcacgcggcgctgtgcgagtgcctgaggctgtacccgtccgtgcccttcgagcacaaggcggcggtggccgacgacgtgctccccagcgggcacgagatgaaggccggggacaagatactcatcttctcctactgcatggcgaggatggagggcgtgtggggcaaggactgcatggagttcagaccggagaggtgggtcaccgccgacgggaagctgaggtacgagccgtcctacaagttcatctccttcaacgccgggccaaggacctgcctcggcaaggagatggcgttcgtgcagatgaagaccgccgcggccgccgtgctgtggaacttcgcagtcgaggccgtgccgggacacgttgtcgagccgaagctgtccatcattctccacatgaagaacgggctcgccgtcacagtcaagaggaggaacgtcgcgggcgtgcatggctagctagtggtatacgtacctacgtgcctactgcctacacgtctcggccacaaagtatacggggcgtatgtaacgtagcggacacgtacgtacatgtacgcgtattatatgtatgcaagagtg

SEQ ID NO: 3256 - DNA, 603 bp, Triticum aestivum
ttctgattttggactatgcaagctcattgacagggatatgagtgaagtggttactagaatgagaggcacaccaggctatttggctcctgaatggttgacatcgcagatcacggaaaaggccgatgtctacagctttggcgttgtggtcatggaaataatcagtggaagaaagaacctcgacacctctcaacctgaagagagcatccatcttatcaccctattggaagaaaaggtgaagagtgatcagttagcagatctagtcgacaagcagagtgatgacatgcaagtgaacaagcaagaggtgattcggatgatgaggatggcaatgtggtgtttgcagattgattgcaaaaagaggccgaaaatgtcagaggttgtcaagtcttggaaggcaccataaacacgggaaacaacatagattataagtttgttgcaacaactacagtgaactttggcgtggcaggagatgcatgctcctcagctccacctttggcttcagatgtatcaggccccagatgaaacgggactatcctgagaagataggcaaccagattatgtataggagatctgtgagtccacaaaaaaaacatgttttgttgtatt

SEQ ID NO: 3257 - DNA, 603 bp, Triticum aestivum
tgtttatctgtataagttggaaatgtactagctggatcccctggatgtgctgcatgatggtgatgaccaaggagggtgctcattttagcccccctctgcggactgcctttctggaagccccagaaagtttagaacctctggtccgctgtatcagtgttgggcttccccctattcaagacaagtccattcaaattctcgcaaggctatgtcaggaccaatcttctctgcttagtgagcagataaacagaagtcaaggctgcattgattctcttgtcagtagagttatggaatcgacaaacatggaaataagaatctccagtgcaatcaccctcatatctgcgttgaaggacaacagagaagattcaattgaagttcttgaagcatcaggacatctgaagagtctaatatctgcactcattgatatgttgaagcaacattccacttcaacatccctagacattgaagtctggaaaccttacacagagaagagtttgttcaattgtgagcaggatgttttggatgtgcctgaatcgggaaaggttctggaagaaactgttgcacgtttgctctcactaatttgttcttctcatcccaggagtaaag

SEQ ID NO: 3258 - DNA, 598 bp, Triticum aestivum
gggtgctcgcagcgtgcgccgcacccgtacagcgtgtccaaggcgcggtctggggctcgtgcgcgccgtggcaggggagatggcgcgctccggggtgtgcgtgaacgccatctcgcccagctacatcccgacgccgccggtgatgcgcaccctggaggagtggtacccgaaggcgaccgccgaggagcgtcggcggatcgtggagcaggacgtcaacgagatggaagggacggtgctggaggccgaggacgtggccagggcggcactgtacctggcgtccgacgaggccaagtacatcaacgggcacaacctcgtcgtcgacggcgggtacacggtggggaaggcgaccaacatgccggcgccggtgcagtaagggcctattcggagtcattctgcttccggagcagatggagatgcagtgtaaaaccaacaatgctacacatacacgtttttacgtttacatggttgattttacgtgacggttttttattgggtgttagttgggaaggggccccacctccaagaaaatcaggggggcgatgtttatgaagtttggaaggagcttgtaaactcctgtaaagccatgtagatatagcat

SEQ ID NO: 3259 - DNA, 598 bp, Triticum aestivum
cgtcttcagtcgagctctttgtcggtatgaaggaggccaacaccgcaggtccgtgcgcatagatgaaatggagcagaggtgttcaaggcgttgctctggtttgtgtataccgactccttacaggtgacagaagaggaagatgaagatgtcatgtgccagcatctgcttgttgcggcggacaggtatggcatggagcggctgaagagtatttgcgaggaaaagctatgcaagttcgtcaacgcagccacaatagcgaccatcctgacgttagctgagcagcaccactgtgatggcctaaagaaggcgtgctcaaggtttcttggctccccggccaatcttagggctttgttggacagtgacggcttcgatcatctcagcaggagctgtcctttggttgctaaaaatctgattgccatgtcggcccttgtttagtgggattgttgctttagcaattatagttccacggtctgaaatggttttcttgtaccagcaatggtccttagctccctagtttggtttcaagacttattatctggtatttatcgtggattcttattgtatgactatcagactacctatctaacatttgaagaaacag

SEQ ID NO: 3260 - DNA, 598 bp, Triticum aestivum
cgtgctgtcatctctgtcccgtttgacatgcccgacggcgacgtcaggctcttcattggggactggtacaagaagaaccacacggacctcaggaagatgctcgatgatgggaaggagctcgggatgcccgacggcgttctcatgaatggcaagggccgtatcggtacaatgactccctcgtcccggctggcatcgagtacgagaccatcaatgtcgagccaggcaaaacataccgcttcagagtccacaacgtgggcgtctccacgagcttgaacctgaggatccagggacacaacatggccatggtcgagacggagggctcctacacgatgaagcagaacttcaccaacctcgacatccacgtggggcagtcctactcctttctggtcaccatggaccagaatgcaagcagcgactattacatcgtggccagcgctcggttcgtgaacgagtcgctctggaccagggttaccggtgttgcaattctgcactactctaattcaaagggcaaggcgtctggtctgctccctgacccgccgaatgatgagtacgacaaatctttctccatgaaccaggcacggtcaatcacggatgaacg

SEQ ID NO: 3261 - DNA, 598 bp, Triticum aestivum
ccatcagtgcattgatgatacccaagggaaatgttgggggcatgttcgacaaagacagttttgtggagacatttgaaggatgggcgaagtcagttgttactggcagagcgaaactcggagggattccggtgggtgttatagctgtggagacacagactatgatgcagctcatccctgctgatccaggccagcttgattcccatgagcgatctgttcctcgtgctgggcaagtctggtttccagattcagctactaagacagcgcaggcaatgctggacttcaaccgtgaaggattacctctgttcatccttgctaactggagaggcttctctggtggacaaagagatctttttgaaggaatccttcaggctgggtcaacaattgttgagaaccttaggacatacaatcagcctgcctttgtatatatccccaaggctgcagagctacgtggaggggcttgggtcgtgattgatagcaagataaatccagatcgcattgagttctatgctgagaggactgcaaagggcaatgttctcgaacctcaagggttgatcgagatcaagttcaggtcagaggaactccaagagtgcatgggtag

SEQ ID NO: 3262 - DNA, 595 bp, Triticum aestivum
cgcgccggagctccagcccggagagcaacaccagcggcgcggcggtggcgccgacgagcggaagaggaagaggatgctgtcgaaacagggagtcggcgaggcggtccagggcgaggaagcagcagaggctggaggagctgatcgccgagcggcgcgcctccaggccgagaacgcgcgcgtcgaggcgcagatcggggcctacgcgggggagctgagcaaggtcgacggcgagaacgcggtgctccgcgcccgccacggcgagctcgccgggcgcctccaggcgctcggcagcgtcctggagatcctccaggtggccggcgcgcccgtcgacatcccggagatccccgacgacccgctgctccgcccatggcagccgccgttcgcggcccagcccatcgtcgccaccgccatggccgacgccttccagttctgagccaccatggagagctcgcacgccatggccattggcatcaatggcatggttgcagctgcattacaactagtagtactagcctctgtggttgtgtctgatgatgcttattatgtttaattatggtttgcttcatgttgttttcattaatctagaccattaata

SEQ ID NO: 3263 - DNA, 595 bp, Triticum aestivum
agataaacgggagatcgccacaatgaagctaatacgacatccaatgtggtccagctgcatgaggtgatggctagcaaatcaaagatatacatggttcttgagtttgttgagggaggcgagctttttgataagatcgtcaattctgggaagctaggagaagatgaagcaagacgatacttccaccaacttataaatgcggttgattattgtcatagtcgtggagtgtaccatagagatctcaagccagaaaatctgctccttgattcatatggagctctcaaagtttcggatttcggtctcagcgcattttctccgcaaacaaaagaggatggacttctgcatactgcttgtggaactcccaattatgttgcacctgaggtgcttgctgataaaggttatgatggtatggctgctgatgtgtggtcctgtggcataatcttatttgtccttatggctggatatttgccctttgatgaccccaacttaatgactctgtataaattgatctccagagctaatgtttcttgtccaccatggttttctaccggtgcgagaaatcttattaagcgcattctcgatcccaatcctcacacta

SEQ ID NO: 3264 - DNA, 592 bp, Triticum aestivum
acaactcgtttgaaggacttcactggggggtttggacaataatggaatggatttcgtgagacccttccctgggctttctggcctacagaagtggaaaattgaatttttccaagtggtttcactcgcaatgaacaaagtggacaagggaaaggactttcaaagaaggcccgctgagggttcaccctctgctttgcctgtgcctgatggaagagccagcagtggacctcagaaggggcagttgtccaatgggaggacaacgggtccagcaaggcgctcgaccaagggaaattggaccctcgaagaggacgatatacttcggaaggctgttgaaatccacaatgggaaaaattggaaaaagatagctgagtgttttcctgataggaccgacgttcaatgcttgcataggtggcagaaggttttgaatcctgagctagtcaaagggccatggtctaaagaagaagatgacatcattattcagatggtaaagaaatatggacccacgaaatggtcaaccatcgcccaagctttgtcagaacgcattgggaagcaatgtcgcgaaaggtggcacaatcaccttaatcctggtataaac

SEQ ID NO: 3265 - DNA, 590 bp, Triticum aestivum
  misc_feature (578)..(578): n = any nucleotide
aagtgcgtgacacacaagtcgtgaggaaagtcacatggaaaccttgaagaatgtgtgtttgacatttggatgaagatcagattcttcaggatgaccatgaaaaggaaccaataaagatatctcagcccaaatccgggagtggtcaaagggaaaagaaggaaatattcggtcattgctttctacactgcaatatgttctctggcctgagagtggatggaaaccagttccattggttaacataattgaaggagcagcggttaagaaagcttatcagaaggcattgttatgtcttcatccagataagttgcaacagcgaggagctgccatgcatcaaaagtatatagcagaaaaggtttttgagattctacaggaggcatggaaggaattccattcagtcacttttggatagtctttcgtagcttcttttgttcagcatgtctacctgtttgcggtggtgccccaatggacgtgaataatcttatcccgataatgtgtagacatggtacaaagccatcttttaagccggcgaactgcgccgtttgaacttgttttggtgtaaatgcaagtgaaccgaccantgctaccctttg

SEQ ID NO: 3266 - DNA, 585 bp, Triticum aestivum
  misc_feature (49)..(49): n = any nucleotide
gaggacttgcccctatgtgcacttcccacagccaaaggttacagcaggncggaatgctcgtgtaatcctgtgcggttctttgtgatcgtgtcgatgcaagatcgggaagtggatggtttgagacactgctaaacagccaccctaacatcagctcgaacggcgaaatattcaacagagtggatagaagacaaaatatatcgtctatcgtacaaacactcgacaaactgtatgacctggactggctcacaagtgcagcaaagaatgagtgcacggctgcatttggattcaagtggatgctaaatcagggttttatggaccatcatgatgatatacttagttatttgaacaagaagggtgtctctgtgatatttctcttcaggagaaatacactacgcaggcttatctctgtgttggccaacaactatgacagagatgcaagcagctgaatggaacccacaaatctcacgtccactcggaagaagaggccgagatactcgcaaaattcaaaccagaactggacgtgtcaaccctggtttcaaacatcagggatgtcgagaagtacatgggagactgcttggacagctt

SEQ ID NO: 3267 - DNA, 583 bp, Triticum aestivum
  misc_feature (510)..(510): n = any nucleotide
tgctcgcaaagaattcagattcagaaaggaaaccaaagcagctgtcccatatccaagctcgatggcggctgccacagagactattcacattacaagaatatgcagcgagcagttcttacttaccagtgtgcgtggagacaaaggcttgcaagaagagagctcagaaatctcaagatggccgcaagagaaactggagccctcaaagaggccaaagataagcttgagaagcgcgttgaagagttaacatggcgcttaggactggagaagcgattaaggactgaccttgaggaagcaaaagctcaggaaattgctaagctgcaagaaacattgcatgacctacagcttcaagttgaagaagcaaagaccatggccactaaggaaagagaagcagcgagaaaggcaattgaagaagcacctccagtaatcaaagagactcctgtattggtcgaagacactgaaaaagttaactcgctaacagctgaagttgatcaactgaaggctttgctgcanactgaaaggcagccacagagactgcaaagaaagaacatgctgaagctgaacggagaaatgaagaactaatgaa

SEQ ID NO: 3268 - DNA, 581 bp, Triticum aestivum
cagtacagtacacagcagcaagcctgttgcgagatatgtgcgtgcaagctcggcctgttctgagcaactcagacctgaagaatatctcttacatcttgcgagaggtgttggaaggaataatggatgcagaaggagcagagctagagatccttcttggccttagttcacaaatatgtaatgttgttcctgaagactttgcccgagaactagattgtggtgagattaaggaaagatttataaagaggcttgtcgatgtgcttaactcaaatatggtacccactgctcattgtcctggaatcaggagggcagtagttcaacatgcagtatacatgatggagaacaagcctagctacgcaaactatttcaacagatgctggatgatggaagcactggtaatggtagaaagtacaccttcaaaggctgaaaattatagactcttctggggtgatgcaggactcatggagcacagcatacctctctctgctctcgtggccagagcgaaaagatgtctgtgagtggctacaaggtatcagcagcgtcacctgaacatgtattttgatgatattggacttctgctagta

SEQ ID NO: 3269 - DNA, 580 bp, Triticum aestivum
gcgaccaggtggagatggaggaggccgccaggttccgccacgcccactccttcatcatcaagctccccgacggctacgacacgcaggtgggggagcgcgcctgcagctctccggcggccagaggcagcggatcgccattgcccgtgcgatgctcaagaacccggccatcctcctcctggacgaggccaccagcgcgctggactccgagtcggagaagctcgtgcaggaggcgctggaccgcttcatgatcggccgcaccaccctcgtcatcgcgcacaggctctccaccatccgcaaggccgacctcgtcgccgtcctgcaggctggcgccgtctccgagatgggcgcgcacgacgacctcatggccagaggggacagcggcgcgtacgccaagctcatccgcatgcaggagcaggcgcacgaggcggccctcgtcagcgccaggaggagcagcgcaaggccctccagcgcccgcaactccgtcagctcacccatcatgatgcgcaactcctcctacggccgctcgccctactcccgccgcctctccgacttctccaccgccgacttcagcctgtccgtc

SEQ ID NO: 3270 - DNA, 579 bp, Triticum aestivum
tccttaccctgcattgcaatcgttcacgggaaataaattatgggactcctacttctttaaccaattagaataagtgatttgaagaaagtgaatccaatcagagcatgtgaatatttcaacagttgcttcaaggatccatcagcttttaccgttgtagtagttggaaacatagacccagccatctcaatcccactgattttggagtacctgggtgggataccgaaggtacaggatacagttcagccacttagtcgtgaggatctaaagggattgccctttcaagtttccggaaaccataattagagaagttgtccgcagccctatggttgaagctcagtgcttcgtccaactagggtttccagtggttctaaagagcacaatgatgacggaggatattcactatgtcggatttctaagtaaacttctcgaaacaaaaatcatgcaagtactccgcttcaaatatggacaggtctactcagttaatgtaggtgtcttcttaggtggcaacaaaccttctagaagtggagatgttcgtggagacataagtgtgaatttctcatgcgatccagacatgtcatc

SEQ ID NO: 3271 - DNA, 575 bp, Triticum aestivum
gcacatgacttcatcagcaacctcaaggatggatatgacacatggtgtggcgagagaggtgttcagctgtcaggagggcagaagcagcgcattgcaattgcccgtgccatcctgaagaacccggccatcttgctactagatgaggctaccagtgcactggacagccagtccgaaaaggtggtacaggaggcactggagagagtgatggttggcaggacaagtgtggtggtggcacacaggctcagcacaatccaaaactgtgacctgatcactgtgctcgacaaaggaattgttgtggagaagggcacacactcatccctcatgtcaaagggtccctctggaacatattatagcttggttagtttgcaacaaggaggcaaccagaactaaagtatttccatgacaatagagcactcgtatttgaattagaactgtaagcaaggatggcgatcagatcatttaaactttcggcgacaatgggctatttttcctcctgttgcactatcagtatatagaagtgtgccaagcttgtagtttattcatataactgctggatatgtattgcagtgatgcaa

SEQ ID NO: 3272 - DNA, 575 bp, Triticum aestivum
cccgtcgagagccacaagaagaacataatggagaaagaattcttcacagagtatggagaggcaagccagtaccaaatccaagaagttgttggcaaggggagttatggagtagttgctgctgcaatagatacccgcaccggcgagcgggttgcgattaagaagatcaacgatgtgtttgagcacgtctcggatgccacgcgcatcctccgcgaggtcaagctccttcggctgctacgtcatccagacgtggtggagatcaagcacataatgctccctccttctcggagggagttccaagatatatatgttgttttcgagctcatggagtcggatctccatcaggtcatcagagctaatgatgacctcacggcggagcattaccagtttttcctttaccagcttctccgcgctctcaagtacatccatggagctaatgtatttcatcgcgatctgaagcccaagaatatactggccaacgcagactgcaaactgaaaatttgtgactttggacttgcgcgtgtatcatttaatgatgctccttcagctatattttggacggactatgtagcacaagg

SEQ ID NO: 3273 - DNA, 573 bp, Triticum aestivum
gtcgacgctctccgggacctgcgcaagcgcccatcatacgcccactcctaaccctacccactccgacgaggacaacggcacgaacgaggatggcaaaaagaggaagaagaggaagaagaagtgggccaagtccatctccgacttcgcgggagtcctccgcgtcctcgacgtctacaggatggccaccgtcaggttcaagggcgacctcgacctctggttccgctacctcgagttctgtcgccagaagggccacggccggatgaagcaggttatggcgcaagccattcgttaccatcccaaggttcctgggctttggatgtatgcagcagcgtgggaatttgatcagaacttgaatgttgctgcagcacgtgcacttatgcagagtggtctcagatcttgtccagaatctgaagatatgtggattgaatatcttcgcatggagcttacctaccttaacaagcttaaggctcgaaaggtagctcttggggaggatgtgaagacactgcaaaaaagtactgatgattcgggtcagtggaaagaggagaacaagaattgttcatgtcacttgatgaa

SEQ ID NO: 3274 - DNA, 573 bp, Triticum aestivum
tctactcccgcctccccatgcagggccagagcaacaccgtcacgtcgcaggccgcaccaacccggaggcagaacaccggcacctccatccagggctgcaccctcctcccgtccccggagctcgcggccaacgccgcctttgacacgcgcaccttcctcggccggccgtggaagaactactcgcgcaccgtggtcatggagtcgtacatcggcgggctcgtcgacgccaccgggtggatgccgtggtccggggacttcgcgctcgacacgctctactacgccgagtacataactctggtccgggtgccgacaccggccgtcgggtcagctggccgggctaccacgtgctaggcgacggcgccgatgccggcaactttaccgtcgacaacatggtgctcgggggcaactggctgccgcagaccggcgtgccgttcaccagcggattgaagtattgatccgtcaacttatcatatatgctttgaacggtagacatatatttaccgtaggtaaatcacctactgtttgtcctaaaaaactatacatacatattgatgatgtggtctgactacttcgg

SEQ ID NO: 3275 - DNA, 570 bp, Triticum aestivum
acagagagatcaattcttctcttagatatgaggtttgcatgctgcagaagcacttgatattcgtagtgaggaaaggaagtgtaacctcaaatctgctgatgcttcacacaagcaacatcttgaaaatgtaaggaagattactaagctagaagaagaatgcaagagattgcgctcaatggtacgtaaaaggctaccaggaccagctgctgttgctagaatgagaagtgaagttgaaacactgggcagcagtacaacacacataaggacaggaaagttgaattctacgccatccttcagttcatatgatcagatacagaactcttccatgcatcacatgtgagtccttcattgcttgcaaggctacatgtgacggaagatgaaaataaggccatgaaggaatctctttctagaaaggatggtgaacttcagctttcccgtaccatgcttgctcgcacaacctctaaactttcccaagttgaagctcaactcgaagacttatcaggtgatcgagctaccacagaactggcaaaaagaagtcctacagtggttgaaaatcttctttcatctatc

SEQ ID NO: 3276 - DNA, 570 bp, Triticum aestivum
  misc_feature (159)..(181): n = any nucleotide
cctcaaggccaccgccccaccccgacaccgtctacgtccagtccggggaccgcgggtcaaggaccacgcgtgctgggagcgcacggaggacatggacacgccgcgcaccgtgtacaaggtcgaccccagcacccccggctccgacgtcgccgccgagannnnnnnnnnnnnnnnnnnnnnntccctcgtcttccgcaagtccgacccggcctactccagccgcctcgtcgccagggccaagagggtgttcgagttcgctgacaagcacaggggcgtgtacagcgccaagctctcgtcctacgtctgcccctactactgctcctactccggataccaggacgagctgctatggggcgccgcatggctacaccgggccaccaagagccccgtctacctcagctacatcaaggtgaacgggcagctgctcggcgccgacgagcaggacaacaccttcgggtgggacacaagcacgccggcgcccggatcctcctctccaagtccttcctggtgcagaagctgggcgcgctgcaggagtacaaggcccacgccgacagcttcatctgctccatg

SEQ ID NO: 3277 - DNA, 569 bp, Triticum aestivum
catttgaaagcttttggctagattttgggcatgtccagcttgctaagattctgatagataatggcttttcctgggacaacctaacgatgttaagattctactattcagtagagcacccagtgactgcggatgtgatgtcccgtgtattttctgaggcattcgccgagcttgaagaaggtggtgttggttcctgcacacctgatggggttcctattttcaaacatcgtgccagtgtcggcatctggttgcttcacatcgttaagcgacattatatcatgcgagctattagcttcgaaagtttaagacaagaacttggcttgcgcatgtacgtgcatgatttgtttggtactcgctgaaatgcagttcgtttctttggccttttgggaggttggagccttagcatctccagtctaagccagaacttggcttgcacatgcattaggtaaacaattgcgatagagttagcagcgacatttttctgtgggttttatcatatgatactacactatatgatagtacatactataaacattgggcctgattagcggtcctgaagcttgcattgacaa

SEQ ID NO: 3278 - DNA, 568 bp, Triticum aestivum
gctttgctgatctgcaaaaccacagatggagctggatggaaaggcgtgcgctgctgttggtcagagtgggctgatggcactctatgacatgttgtttacccaacttgatgtgtcatcatcacaacttcttgtgacagatagtgacttcgacattcaaatttccgggagcgactccgcgaaactgtcgagtcattattagagcttagagttattccaatatttaatgaaaatgatgccatcagtacgaggaaggctccatacgaggattcatctggtatattctgggataatgacagtttggcaggtctactggcattggaactgaaagctgatctccttgttctgcttagtgatgtggatggcctctacagcggtccaccaagtgaaccttcatcaaagttaatacatacttatatcaaggaaaaacattatcatgaaattacttttggagacaagtcccgtgttggtagaggtggcatgacagctaaagtccaagctgctgtgtgggcttcaacgggtggtgtacctgttgttattacaagtggatgtgcatctcagagccttgtta

SEQ ID NO: 3279 - DNA, 566 bp, Triticum aestivum
cactgttgaagggcgttccaaacccaaaggccatccactcgtccaaggctgtaggagagccgccgttcttccttgcttcctccgtcttgtttgcgataaaagacgcgatcacagcggccagggcagaggagggtcatctcgactggttcccccttgacaacccggcaacacctgaaagaataaggatggcgtgtgttgactccattaccaagaaatttgccagtgtatattaccgtcccaagcttagtgtatagtggcaacacctagaagggggaaaccagccaacttctgacaagctacacctacttacctcagacaacaaaatgtaactgagataagatcatgctagactcaagatgcatcgatctgaagcaaagttaagtacacaggactgcggtgatatatattaaagagatctacattgaacagagtgagctagacgtgggaactgcaaaattcatcgacaacttgtcatgctgagaatttagatgcatatatgtttttaagttttttttaaaattacagatgctatgtggttgaacctagctcaacggtaccacatctaa

SEQ ID NO: 3280 - DNA, 564 bp, Triticum aestivum
cttcagacctgtcagagatatggacgaagttacacttctgttcgacaactctgaaattttcttgcaagacctctttgctaaataaaaatggcaatcagataacctctattgatcagaaggcatgtggggacggatcttcattgtatcaacaaaatcatggctcacatcttggttacactgggcaggtgttgtttaatgttgacctgaaggtacaggctaactatcaaggtgagcatgtcccattggtttctttgatgagcagactggatggcaaagctattgttggacaccctatccaagttggaattcttgaagaaggttcaatggacaggcttattttgggcagtgatcttgttctggaaaatagcacagcagcaccacctgcttggccgacaggcagaaggactgttatgccaagagtcccacgtttgaatccatcacgagcaaccttagatggcaatgccaccgatgagcagggggtcaagcatgcaaagaaaagcaccaccagtgtccggaggccattttcgcagaaatctcaaagaagccctctggcttcaagaaagc

SEQ ID NO: 3281 - DNA, 561 bp, Triticum aestivum
ccggaagatgtggcttcttcttgataaacactgctggcttaaatgcacaatggttggagactatttgggtgaaagagacgagtttcctctcaaagtcatgcatgcctatgtggatgcactaaactttaaagggttggatttcggtgaggcaattagattctttctgcgaggtttcaggttaccaggggaagcacagaaaattgacaggatcatggaaaaatttgctgaacgcttctgtaaatgcaacccaaatgtttttaccagtgcagataccgcttatattcttgcttattctgtgatcttgctaaacactgatgctcacagtgtcatggtgaaggataagatgtctaaggctgattttatgcgcaataacaggggaattgatgatgggaaggatttacctgaagcttacttaagtacattgtacgaccaaattgttagcaatgagatcaaaatgagtgctgattcttcagctgcacaaaccaagcaaaccaacagcgtaagtaagcttctaggcttagacaacattatgaaccttgtcaattggggactgacagaaga

SEQ ID NO: 3282 - DNA, 561 bp, Triticum aestivum
gtgacatcaagggtgcctatctccttggtgtataacgaaggagttctaaaaatagctgattttgtctggctaattactttgacccaagtaaaaaccatcctctgacagccgggttgttacactgtggtaccgaccgcctgaactattgctagggtcaactcactatgattcagctgttgatttgtggagtgttgggtgtgtatttgctgagttgttacgtggaagacctatcttacagggaagaaccgaggtagaacaattgcataagatctttaagttatgtggctcccctgctgatgactattggaagaagtcaaggttgcctcatgcaacaatatttaaacctcactgtccttatctaagtacccttcgagatgtttttaaagaggtgccggaacatgcattcagtttactagaaactcttctgtcggtggagccatacaagcgtggtactgcatcatgcgcccttacatccgagtttttcaagacaaaaccttatgcatgcgaacctataagcttgcctcagtatgcacccaacaaggagatggatgcaaagttacg

SEQ ID NO: 3283 - DNA, 561 bp, Triticum aestivum
tcccaagttcctcaaggaaggggagcgcgtgctcgtgggcttcaccggcccgttcggcttccacagggtcacgcccagggacctcatgtcctccttcatcggcaccatggtctgcgtcgagggcatcgtcaccaaatgctcactggtgaggccgaaggttgttaagagtgtgcactactgccctgccactgcggcttttatgtctcgtgaatacagggacattacatcttttgtaggcttacctactggttcagtttatccaacaagggatgaaaatggcaatttgttggtcaccgagtatgggatgtgtcaatacaaggatcaccagacattgtccatgcaagaggttcctgaaaatgctgcccctggacagctcccaagaactgtggatgttattgtagaagatgatcttgtagattgttgcaagccaggtgaccgtgtctcaattgttggtctatacaaggctcttccagggaaaagcaagggcagtgttagtggtgtcttcaggactgtccttattgctaataatgtttcacttctgaacaaagaggcaaatgcgcc

SEQ ID NO: 3284 - DNA, 551 bp, Triticum aestivum
cagtgtcttcatctgtgtacaaaacatccagatggcttcatgggatgtggaaagcaagtcgtcttgaagctactgtcacaaaggtggaaactgctgctgtcatagtctattggattgcatctgcacactgtggtacaaatcaagattctgtcccccctgaggagcagaacccaaaggatctgactcttctgtcttgcttttcatatgcaagctggcattggctgaatggtgtcatcctcaaccacacacatcatcatgtgccaatgacgctttaatggagtgttcaaaaatgaaagagctcaattctgagcaggctgatgttcctgaatctgccgttgatgttcaggctgaacaggctcaaaatactaaaacagatgtaaatcccctggagaaacatggtgattctcttgcagatcgatcaaatatgtcagatggagataatacatgcgtagccaaagattcagaatctggcactagtgtatcaacccttccaaaggagggagtgcatgaccatgctacttacagaaagaagatcagaaaagtttttgtca

SEQ ID NO: 3285 - DNA, 550 bp, Triticum aestivum
cctttcgagacctgatgttgaacagccgcgagccgatgcaggtgtgggtggactacgatggccaggccaggcaactcaacgtgacactggctcctgcgcacgagcccaaacccaggtatcctctcctctctgaagccattgacctctcctctgtcctcacggagacaatgtatgttggcttctcgtcgtcatccggcgtggtgtcaacgcaccactatgtgcttggatggagcttcagcttggacgggcctgccccgcctcttgatttctctaagcttccagcactgccacgtgtgggttcgaagcatcggtccatggtcttggctctcgtgctaccactagcaaccgtattgatcatcgccgcggtgctagctgccgcctccttctttgtgtggcgtcggcgtcgatttgctgaggtgcgcgaagattgggaggatgagttcggcccacaccggttcgcatataaagatctatttcgtgccactgatggattcaagaatggaaatttactcggctactacggcgatgacggtgccacctttcgagacct

SEQ ID NO: 3286 - DNA, 549 bp, Triticum aestivum
ccactccgtgttcgaagacatcgccattggagttgccgagacggaagccgacgcgtggaaggcgctgtggaccatcagcctgcacaagatcttggccgcgatcgccatgggcatcgcgctgctccggatgctccccgaccggcccctcctctcctgcttcggctacgccttcgccttcgccgtctccagccccattggcgtcgccgtcggcatactcgtcgacgccaccacggagggccgggtggccgactggatctatgccatctccatgggcctcgccacgggcatctttgtctacgtctccatcaaccacctcgtcgccaaggggtacaggccccagaggcccgttgccgccgacacgcccgtcggccggtggctcgccgttgcgcttggcgtcggtgtcatcgcggtcgtcatgatatgggacgcctgaatgtggttcatgataactagaaccatttacctatggatgtaagcctattgtcctgctaagctagttggacaccagatttgcagtaccagctgaccaaatgaagcagctaatgacag

SEQ ID NO: 3287 - DNA, 546 bp, Triticum aestivum
atcttctcctactgcatggcgaggatggagggcgtgtggggcaaggactgcatggagttcaggccggagaggtgggtcaccgccgacgggaagctgaggtacgagccgtcctacaagttcatctccttcaacgccgggcccagaacctgcctcggcaaggagatggcgttcgtgcagatgaagaccgccgccgccgccgtgctgtggaacctcgcagtcgagaccgtgccgggccacgtcgtcgagccgaagctgtccatcattctccacatgaagaacgggctcgccgtcacggtcaagcggaggaacatcactggagtgcatggctagctagtacgtacgtgcgtgcctagtgcctacacgtctcggccgcaaggtatacggggcgtacgtagctacgcgtagcggccacgtaagtacatgtatacgtattttatgtgtgcaagagtgccatgtgtgcttactactagatgtgcgttgtgacatgtgtgtaagctgtatgtatgtgtgccctaaatagaaaatggacgtattgggcaccagctt

SEQ ID NO: 3288 - DNA, 544 bp, Triticum aestivum
tcatagtcgtcatatgtcgtgcccgtgatattataggttccagtctctgtgattgataaccgaggcatactgtaagatagctgattttggattagcaagtgttctgtgatcctgtactaaggcaccctttgactaccgtgtggtcacactttggtatagaccaccagaacttctgcttggtgccacaattatggtgttgctgtagatctgtggagtactggctgcattcttgctgagctatatgctggcaagcctatcatgcctggtagtacagaggttgagctattgcataaaatatttaaactctgtggttcgccatcagaggactattggaggaagtctaaacttccccatgcaaccatttttaagccacagcatccatatgcaaggcgtgttacagacacatttaaagacttcccttcacctgctctagcattagtagatgttcttctttcagtagacccagccgatcgacggacagcgtcttctgcgttgcaagtgagttttttacaacaaaaccatatgcttgcaatccttcagtttg

SEQ ID NO: 3289 - DNA, 539 bp, Triticum aestivum
ccgatgcccgaaccgttgctcttgaggcttcatgttttggtgatggaatttataggaaaaggagttggctgctcctcgtcttaaggatgctgctttgtcggatgacaagttgcgtgaaacttactttgagattgttacaacgatgcggacactttacctaaagtgcaagcttgtccatggtgatttgagtgaatacaacattctttattttgagggacacttgtacatcattgatgtttcacagtctgtcgaccttgaccatccttcagctttggatttcctgaaggaagattgcttgcatgttaatgatttctttgaaaaacgaggcattcctgtcatgacagtaacagagctatttaattttgttgtggatcaaaatatcgctgatgaagatgttgatgattacttggagaaggttcaacaaagattttggaaaatggagatacagctgcagatgatgatgaaattgctccgacagtcttggtgcaggtaggaatatgaatattgtactatgcatttgtgcagctttgccagaaata

SEQ ID NO: 3290 - DNA, 537 bp, Triticum aestivum
gaggtgacttcgaagaaagatcaaagcaatatctgggtgcggggtgatgagtcctaccggttcgtgtccggttaaggactttgtgcgtgcattccagtcattccacaccgggagagctataagaaaggagctcgctgtgccattcgacaagagcaagagccatccagcagcattgacaactacgaggtatggtgtgagtggcacggagctgctaaaggcaaacattggcagggagatcctcctcatgaaaaggaactctttcgtctacatgtttagaaccttccagctgatcctcatgtcatttattgcaatgacgctcttcttccgtacaaagatgaagcgcgactcggtgacaaatgggggcatctacatgggggcactcttctttggtgtgctcatgatcatgttcaatggcttctctgagcttgcactcaccgtctttaagctacccgtgttcttcaagcagagggacctccttttctacccagcatgggcttacacaataccctcatggatcctcaagatcccaataacatt

SEQ ID NO: 3291 - DNA, 530 bp, Triticum aestivum
tcggcaccccacgcccaacctgcgcgacctctacgcgctgggccggaagctcgggcagggccagttcggcaccacctacctctgcaccgagctggccacgggggccgactacgcctgcaagtccatctccaagcgcaagctcatcaccaaggaggacatcgacgacgtgcgccgcgagatccagatcatgcaccacctctccggccaccgcaacgtcgtcgccatcaagggcgcctacgaggaccagctctacgtgcacatcgtcatggagctctgcgccgggggcgagctcttcgaccgcatcatacagcgcggccactacagcgagcgcaaggccgccgagctcaccaggatcatcgtacaggggtcgtcgaggcctgccactcgctcggggtcatgcaccgggacctaaagcccgagaacttcctgctcgccaacaaggacgacgacctctcgcttaaggccatcgatttcggcctctccgtcttcttcaagcctggccaaattttcaccgatgttgttggaagccc

SEQ ID NO: 3292 - DNA, 529 bp, Triticum aestivum
cagtctttagcgctctcagaaattgatgccatgctgactttcaaagtcgatctccccttgaagaatagcatcaatattcccttctcagtttcagcccagaatggaggaacaccgctgagaagaatgtacagaataacacctgcactccaaacatctatctctttaccatagtttctcctaaggacttcaggagcaacataataagcacttccaacgatgtccctatacatttttccttcttcaatgaagaccgaaagcccgaaatcagtggccttgagcacagcattctcatccttggtcgcgagcaagaagttctctggcttcagatcgcggtgcatcactcccatgaaatggcaaacattgacaacattcacaactcctctgcagattgtagcagctgcacgctctgagtagtgccccttggcaataatccgatcaaacagctccccgcctgcacagagctccatcacaacatgcacgctgcccttgtcctcatatgctccacagaactccactatgttcggctgcc

SEQ ID NO: 3293 - DNA, 527 bp, Triticum aestivum
ttcatggtatgtaaatgagggactacgagaaatcctcactacggggatatctaactgaaggactagctgttggctgatacaccatgcaacttcttttggttttgatcgtggatggttttcatgtggttgctgatacaccatatgctgaagtggtggaagtcatgaaaatgtgcatgccactgttactaccggcctctggtgtcattcactttgtcatgtctgagggtcaggccatgcaggcgagtggcctcatagcaaggtgggatcttgttggcccatcttctggtaggagcgctgaaccatttcatggcacttttccaaaacttgaacctccaactgctatttctggcaaagttcatcaaaagtttgctgcaagtgtgaattctgcgcacatgatccttgcaggatatgaacgtagtatcaatcacgtaagaaatacaattttttcagtgtatagttattcttccacttttgtttccctttgtctatctcgttgccactttcctcgtctacagagtgaaactaac

SEQ ID NO: 3294 - DNA, 510 bp, Triticum aestivum
tttgagacatcagcaggcatttggttattccagtgaagatgtgcaaatggtaattgaaacaatggcttcacaagggaaggagccaacattttgcatgggtgatgacattccattagccgtgttgtcacaaaagccacacatgctctttgattatttcaagcagcgatttgcacaggttacaaatcctgcaattgatccactcagagaaggtttagtcatgtctcttgaagttaacattggtaaacgaggcaacatcttggaggttggccctgaaaatgctgaccaggttaccctgtcaagtcctgtgctgaatgaaggtgaactagaatcactattgaaggacccaaaattgaagcccaaagtactctcgacatacttcaatatccgtaaaggtctagatggttcccttgagaatgcaattaaggctctttgtgaagaagctgatgctgctgtgagaagtggttctcaacttcttgtgctttccgatcgttctgaagcacttgaaccaac

SEQ ID NO: 3295 - DNA, 505 bp, Triticum aestivum
  misc_feature (79)..(79): n = any nucleotide
  misc_feature (272)..(272): n = any nucleotide
tctggcaagactgttgcccttgttggagagagtggtagcggcaagtcaacgttaattggactgttggagcgattctacnatcctgattcaggcaccatctcattggatggagcggaaatcaagagcttaaacatcaattggttgagggaccaaacgggacttgtgagccaagagcctgtactcttcaatgatacaatccgtgccaacatagcctatggtaaggatggggaagttactgaggaggagctaattgcagctgcaaaggcatccantgcgcatgagttcatatcaagccttccccaaggatatgacaccacagttggggagagggggatacagctgtcgggtggccagaagcagcgggtggcaattgcaagggccatactgaaggaccccaagatactactacttgatgaggcgactagtgccttggatgccgagtccgagcgaattgtgcaggatgcattagacatgtgatggtcggcaggaccacggcttgttgtgg

SEQ ID NO: 3296 - DNA, 503 bp, Triticum aestivum
gactacaaattaacttacccaagcggaacagcaaccgccgtgcttataaatggatttcatgcgcctaagggagatgatgtggcaaagatgcaagtgaatggattcacaaaatactttgcaattagcttcttctggagcttcttccagtggttttattctggtggagatcattgtggcttttcgcaattccccactcttggactacgagcttggaaacattcgttcttctttgatttcaatctcacatatgttggggcagggatgatttgcccccaccttgtgaatatctctctccttcttggctctattctctcgtggggcgtaatgtggccactgattgctgatttgaaagggaactggtatccggcagatttaccagaaagcagcatgagaagtctgcaaggttacaaggccttcatttgcatagctctcatcctaggagacggcatatacaattttacaaagattattcttaagaccgtcgcgagtatgcttgacaaatc

SEQ ID NO: 3297 - DNA, 498 bp, Triticum aestivum
acgtcgttgtgcgcgccgaggaggtgctggcgttcgccaagacccaggcggactacatcctgggcacgaacccgatggagacgagctacctggtcgggtacagcgacaagtacccgcggcgggtgcaccaccgggcggcgtcgacggcgtcgttcgcggacgagaaggggttcatcgggtgcgcgcaggggttcgactcgtggtacagcgctggggaggagaacccgcacgacctcgtcggcgccgtcgtcggcgggcccgacggcgaggaccggttcaacgaccagcgcggcgcgtacatgcagaccgaggcctgcacgtacaacaccgcgcccatggtcggcgtcttctccaggctcatggagctcgacgcggaggagcggctgcgggagcaacgagacctgtgaagaagcggctcgtcgccggccggtgaatatgttcagctgtaggaatgttaattgaataactgagaaaaaaatgtggaaaaagaaagagtgg

SEQ ID NO: 3298 - DNA, 498 bp, Triticum aestivum
ggcatccccgaagaaatgatccgggaggcgctcaaagtcatccttgacgtaagaaaccatccggtgctcatccactgcaagagaggcaagcaccgtaccggctgcgtggtgggctgcctgaggaagctgcagaagtggcgcctgtcctccgtcttggacgagtacctgcacttcgcggcggccaaggccaggaaaaccgaccagaggttcatggagctcttcgacacgtcaagcttggtgcatctgctggcctcgcagtgttgatgaaagcgagcgagcgtttttcgtttctcttttggcctgtcccgatcgtgccaccatgcggctgcgacgacctgtcttttcccgcggcgatttacagagaataatgttactagaacaatcatgggccatatctgtgagagatacaaggggaccaatgagagatgtactccttgaatgctcaaaaataacaattcaaagtgtatggcacagtatcattattcccgcaaaaaaaat

SEQ ID NO: 3299 - DNA, 483 bp, Triticum aestivum
ttgcacggcggtgctttccatgctgggatgagcctgcatttaaggccaagttcaagataacattggaggttccagctgaactggtagcattgtccaacatgccagtagttaaggagacagtctgcgggcctctgaagactgtctattatgaggaatctccacttatgtcaacatatctagtcgcaatagttgttggtttgtttgattacatagagagctcaacgttagaaggcaccaaagttcgtgtgtatacccaagttggcaagactagtcaaggaaagttcgcattagatgttggggtgaagtcactggatctattcaaggattacttcgccactccttacccactacctaagttggatatgattgctatccctgattttgctgctggagctatggagaactatgggttggtcacttaccgagaatcagctttgctttatgatgagcaattatcgtcagcatccaacaaacaacaggtag

SEQ ID NO: 3300 - DNA, 482 bp, Triticum aestivum
tggagagcttcggcacgccggacttcacgatatacaacgccggcaagttcccctgcaaccgctacacgcactacatgacgtcgtcgacgagcgtggacatcaacctggggcggcgggagatggtcatcctgggcacgcagtacgccggggagatgaagaagggcctcttcggcgtcatgcactacctcatgcccaagaggcgcatcctctccctccactccggctgcaacatgggccgagacggcgacgtcgccctcttctttgggctctcaggtactacgttcgttaacggaacgtaacagatccatcatccatccatggattggatggatccgtccggccgcaagaaccgtcacctgcccaaccgcatgcacctgactgacgccttcgccttgctcagcggcccgtctagtctagtttcaataaatattagcattatcgtgtgatgtcaccttttcagttttccaataatatgaaacaca

SEQ ID NO: 3301 - DNA, 482 bp, Triticum aestivum
tgaaggatgaatcgcctgacacatcggagccaccgccgtcacggctgaagaaggctgtggagctggagccccactccgctcagaacagagacgagcagttcgtctggccctggatgggagtgttggtcaatgtgcctactgagtggaaaggagggcgccaggtcggggaaagtgggaaccgcctgaaggagcagctcttggccttttgcccgcacaaggtcattcctttgtggaactatagaggccacaccgggaacgccatcgttgagtttggaaaagactatgcttctttctgcaatgccttcaagtttgagaaccactttgaggcagaaggacatggcaagcgggactgggagcagcgcaagtatcaagggcgcgagatgtttggatgggttgcaagggctgatgatcagagagccccgggaccgatcggggagcatctgcagaaaaatggtgatctgaaaaccgttgcagaacttgag

SEQ ID NO: 3302 - DNA, 479 bp, Triticum aestivum
gaggaggaggtgaaggtggaggtggaggaaggcaacgtgctggtgatcagcgggcagcgcagcaaggagaaggaggacaagaacgacaagtggcaccgcgtggagcgcagcagcgggcagttcatgcggcggttcaggctgccggagaacgcgaaggtggaccaggtgaaggccggactggagaacggcgtgctcaccgtcaccgtgcccaaggccgaggtcaagaagcctgaggtgaaggccattgagatctccggttaagctcctgaagatgtgatcggtgagggaagaagtcatgtttggtgtcagtaattcagtatttcagtgtgtgtttgtttggtcgtgcaagtatggtctgctgctggtgtgtcgtacgcgttgggagtccgagtggctgagtcggccggtttcatgtattcctttgtgagtacttgagtaatcgccttcttagttcttgctcgttgaggaataaataaaga

SEQ ID NO: 3303 - DNA, 467 bp, Triticum aestivum
gcgccatcccaagctcgcacagatcatcccacccgtagcgacgacagcgttcatctttgccgcgggcaccctcatcgtcctcctaatacgacggcggctcaagtacagcgagctccgggaagattgggaggtcgagttcgggccgcaccggttctcctacaaggatctgttcagcgccaccggcgggttcaaggagaagaatctgctcggtgtgggagggttcgggagggtatacaaaggggtgctaccggcgcccaaactggagatcgccgtcaagaaggtgtcacatgactcaaaacaaggcatgaaagagttcatcgccgaggttgtgagcattgggcgactacaacatcgcaatctcgctcagttacatggttattgcaggcgtaaaggtgaactgctcttggtatacgagtacatgtcaaatgggagccttgataggcacttgtatggcgatgatgagaagc

SEQ ID NO: 3304 - DNA, 455 bp, Triticum aestivum
  misc_feature (38)..(38): n = any nucleotide
ctttcgaaaggggatgttgaactatgttttgcgtccantacatgcgataaagttatagaaggagaagttcaagtcggagttcaagagcacttctacatggaacctcaatgcactcttgtctggccagttgattctggaaatgaaattcatatgatctcatctactcaagctccccatacacatcagaagtatgttgctaatgttcttggtcttccactatcaaaagttgtttgcaagactaagcgtattggtggcggatttggtggaaaagaaaccagatcagtaatatttgctgcggcagcttccgtagcttcctattgtctaagaaggccagtaaagattgttttggatagggatgttgacatgatgacaactggacaaggcacagtttcttggggaaatataaggttggatttaccaatgatgggaagatactggccttagacctcgaaatt

SEQ ID NO: 3305 - DNA, 433 bp, Triticum aestivum
gggaattggggatggcgtcaaagaggatacagaaggagctcaaggatctgcagaaggatccccctacatcatgcagtgcaggtcctgttggtgaagacatgttccactggcaggcaacgataatgggtccatctgatagcccatatgctggtggagttttcctagttaccatccacttccctcctgattatcccttcaaaccacccaaggtggcgtttcgcaccaaggttttccatccaaacatcaacagcaacgggagcatttgccttgacatccttaaggaccaatggagcccagcactaaccatttccaaggtgttgctgtcaatctgttccctgctgactgatccgaaccctgatgatcctctggtccctgagatcgcccacatgtacaagacagataggcacaagtacgagaacacagcaaggacctg

SEQ ID NO: 3306 - DNA, 432 bp, Triticum aestivum
tggaaaccgaactgggtgataaagttggatatgctatccgatttgaggacgtcacttgttctagcactataataaagtatatgacagatggagtgcttcttcgtgaaaccttgaaagatgccgaccttgataaatatcgtgttatcgtcatggatgaagcacacgaaagatccctcaatactgatgttttgtttggcatattgaagaaggttgttgcacgccggcgggattttaagctaattgtcacatctgcaaccctaaatgcagacaaattctcaaagttctttggaggtgtgcctgtatttaacattccaggcaggacatttccagttaatatcttgtttagcaaaacaccatgtgaagattatgtggaagcggcagtgaagcaggccatgacaattcacataacgagtggccctggcgacatcctca

SEQ ID NO: 3307 - DNA, 409 bp, Triticum aestivum
tgatgcctgcactttccctatgtgtatggatgcattttttctacaaaacgtgttttgttcttaccactattctctctcccatcttcattcttcaataaccgagcttatttcacagcatgttatggaacacggcaaaccccatgagcgatctgctatcattgagaagttgattgggcagattgtacaaatgagccagcaaaagtttgcctcaaacgtcattgagaagtgtttatcctttgggaatcctgtagaacgccaaatcttaattggtgaaatgcttggttccacggaggaaagtgaacatcttgaggtgatgatgaaagatcagtttgcaaactacgtggtacagaaggtgttggagacctgcgacgaccagcagagggaggcgatcctcacgaggatcaaagct

SEQ ID NO: 3308 - DNA, 402 bp, Triticum aestivum
tctcaagagcttgaagttcctggacatctccaacaaccggttctcgggtccaatccctgatgatattggcagtctccggagcctgcagaacatgtcgcttgccgggaacaacttctcaggtccattgcctgactccattgacgggctcgcgtcgcttcagtcgctggatgtgagcggcaatgctctctctggcccattgccggcagctctgaaaggtcttcggagcatggttgctctgaacctctcatataacgccttcacaaagggcattcctgctgggcttggcctccttgtgaacctccagtctgtggatctgagctggaatcaattggatggtggtgtcgattggaaattcttgatcgagtcaactgttactcatgttgacttcagtggaaacttgct

SEQ ID NO: 3309 - DNA, 401 bp, Triticum aestivum
ggtgccaccgacggatgcgcataagacgagtcccccgcctgaaggtcccgggccaactggtgggaaggagcaggaaggaggagcgggtggggagaagaagaatccgacagaagaaattaagaaggtgttgagttgtgaggatgcagcggagaaatgttctgttccaggagaaattaccgcttgccttcaggtttttaaggatggtaaagccactaattaccttggaaacttcactatgttcaattaattgagtttctgtttgctaaaatttataagggtagacatatttttatcaactgtatctgttgagtaaaaaaaatgttcttctgaattagtaccttttgcaagtccatttgagccatgcttgcatagttgcattcagtttgagccagttttattgc

SEQ ID NO: 3310 - DNA, 308 bp, Triticum aestivum
tccataccatccacaatatatatgagaaaattggatgtggtatcgactacatcacgctagggttgcatccagaattcgagaactcaaggtgtttgttcatagttaggacggacggcgagcaggtcgatttttctttctggaagtgcatcaagggtctcataagacaaaagtaccccgtgtacgcggacagtttcattctcagacatttccgcaggaggcaagactactgaactagtgatccgtacggttgttttcgtgtaatatttctgtgattttgatcttgtccacgcgcctttaatatcatgtga

SEQ ID NO: 3311 - DNA, 663 bp, Triticum aestivum
cccacggctggtgacctcatcttggtggggaggactttgacaaccgtatggtgaaccactttgtccaagagttcaagaggaagcacaagaaggatatcagtggaaaccccaggtctttgagaaggctcaggacttcttgtgagagggcgaagaggaccctttcttccactgcccaaaccaccattgagatcgattcactctttgagggagttgatttctattccaccatcaccagggccaggtttgaggagctcaacatggacctcttcaggaagtgcatggagccagtggagaagtgcctgagggatgccaagatggacaagagcactatccatgatgtcgtgcttgttggtggttccaccaggatccccagagttcagcagctgctgcaggacttcttcaacgggaaggagctctgcaagagcatcaaccctgatgaagctgttgcctacggtgctgccgtgcaggctgcaatcctcagcggtgaggggaacgagaaggtgcaggaccttctcctcctcgatgtgaccccactgtctcttggtcttgagactgctggaggagtcatgactgtgctcatcaccaggaacaccaccatccccaccaagaaggagcaggtcttctccacctactccgacaaccagcctggtgtgctcatccagg

SEQ ID NO: 3312 - DNA, 638 bp, Triticum aestivum
ctggaacaaggtggactacgggatgttccggttcctgcgtggcggactcggagcacgactggcgggaggggactccgcagtacaagttcatcgaggagtgcctctccacggtggaccggaagcaccagccgtggctcatcttcgcggcgcaccgggtgctgggttactcctccaactcgtggtacgccgaccagggctcgttcgaggagcccgagggccgggagagcctgcagaagctgtggctagcggcaccgcgtcgacattgccttcttcggccacgtccacaactacgagcgtacttgcccgctctatcagagccagtgcgtcaccagcgagcggagcaactactcgggcaccatgaacgggaccatctttgtcgtggcaggacggcggcggcagccacctctcgggctacaccagcgcgacccccaagtggagtgtgattcagggataaagactacgggttcaccaagctcactgccttcaaccactcgtcgcttttgttcgagtacaagaagagcagcgacggcaaggtgatatgactccttcaccatccatagggaactaaccgcgacgtgctcggatgcgtgcatgacagattgcttccccaccacacttgctacctaccatcgagctac

SEQ ID NO: 3313 - DNA, 671 bp, Triticum aestivum
cgggaggggactccgcagtacaagttcatcgaggagtgcctctccacggtggaccgcaagcaccagccgtggctcatcttcacggcgcaccgggtgctcggctactcctccaacgcgtggtacgccgccgagggctccttcgaggagcccgagggccgggagagcctgcagaagctgtggcagcggtaccgcgtcgacatggccttcttcggccacgtccacaactacgagcgcacatgcccgctctaccagagccagtgcgtcaccggcgagcggagccactactcgggcaccatgaacggcaccatcttcgtcgtggcgggcggcggcggcagccacctctccagctacaccacggccatccccagatggagcgtcttcagggatcaagactatggcttcgtcaagctcacggccttcaaccactcgtcgcttttgttcgagtacaagaagagcagcgacggcaacgtctacgattccttcaccgtcgatagggactaccgcgacgtgctcagctgtgtgcacgacagctgcttccccaccacactcgctctctgaccgtctagcggcccatcatggcaacgttgctagccggagagtggctaacaaggttggtcctcatgagcttaatctgtggaataaaactggccagctgcaccattaattagttt

SEQ ID NO: 3314 - DNA, 1596 bp, Triticum aestivum
cttcatttggtgtgctgctccaatttctggaccagtatctatctgcttctcgatccaactactctggctctatttcaccagccggttcctggcactggagattctgcaagggcaaatctaattctggaccgctcaataagcatggagaaccaacaaagagatcctctggcccccagtcaggaggagtgaccccaatggctcgccagaattctggccatctaccgcctattcttccgacaactgggctcatcacatcaggacctatctcctctggacagttgaactcatctggtgctctacgaaaagtatcaggcactcttgattctactgtttcgatgaagatgcgtgccacctcttctgcttacaacccggctgttacaaatcttaatgagcaaaatagctactcaattaaggccagtttgccaaagccgatactatgggcggctattctgctctttgcgatggggttcatagcaggtggcttcattctagctgctgttcataattcgattttgctggtagttgttgtggtgatatttggatttgttgctgcgctcttggtttggaacatttgctggggaacaagaggcatgactaggtttgtcagtcgctatcctgatgctgatcttagaattgcgaaagatggagagtatgtgaaggtcacaggggttgttacttgtggaaatttcccccttgagtcctcatttcaaagggttccaagatgtgtatacacttcgtcctgcttgtatgagtataggggttgggactcaaaagctgccaacactcagcatcgccgatttacttggggattacgttcaattgaacggcatgcggtcgatttctacatctctgatttccaatctgggttgcgagcattggtcaaaataggatatggtgcacggctaatcccatatgtcgatgaagctgttgttattgacataaatccagaaaacaaggacatgtcccctgaatttttgagatggatacgggaaaggaacctctcaagtgatgatcgtataatgcgcctaaaagaaggatacattaaggagggaaacactgttagtgtcatcggtgttgttcaaaggaacgataatgtgctgatgattgttccaccacctgaacccttcaacactggttgccagtggggcaagtgcctcctcccaactagccttgatggactagtcttaagatgtgaagacacgtcgaacggtgatgtaattccagtatagctatctagcctcgttctggcagttcacctggggaaaagggaaaccaatatttgactttgggtttattttatggattgaaaaatgtgcaaatgcaaggtgtgattatggtttagtacaatattgatagtcagttgctcacggcttgattgtgtagtattttttgcattttgctcttttttggttgggcaatgaatacctgtaagattgatggcttcagtactaccatggagctctttggagatagagtggaaccatgttcatatgttcttttttattttggtttgtagcattacagcatcataaaccattctccagttccccactctgtatctatacttcttcatacataactccagctctcatggta

SEQ ID NO: 3315 - DNA, 742 bp, Triticum aestivum
tgatcgtaagccacttggtatgaatatcaactcagcaaaagtggcttctaataatagcacaaataagacctttttgttgaagactgcaccacctaagactctgcaacctgatgatgattcagatgatgatcataagccacttgttcagaggttcaacccagcaaaaggggcttctaataatagcacaagtaagcccgttttattgaagcctgcacctaagattgtgcaatctgatgatgattcagaggatgagaaaccacttgccagcaggttacccactaatgctgctccaaaaagtagaggtagtacctctgattcagaggatgagaagccactgtctgcccgattttcaagaggtactgcaggtacatctgcgagtatctcaaattccaaggacaagctcccgtctaacaacaaggggccaaccaataattcgagtgctccccggaattcagttaaaaggccaggtgataacaataatcaaacaagttcagctcttaagaagaccaaatcttctgatgcttctgcctcaggaagtgtcaaaagagaatccaaggatgatgacagtaacagtgtacccgtcgaaagaaaactgacaccgggggagtcttcaaaaagcaagccacctgtaaagaatattgtaaagaagagtcctttatccgttaagaaggataataagaaattcaaaacaaaacaagaaaacatgaaaagttcccagttctcaaatcactgagggtgcctc

SEQ ID NO: 3316 - DNA, 1285 bp, Triticum aestivum
tgagggttttctctggccgtatatatccacaaaagctggggaatggtaccatctggcctcggaagcaatgatttcaaagggctctatggatacaatgtttttatctctgtatctatgatacttggtgatggtatctataacctcatcaagatcatttatgctactatcaaggaaataatgaatgcacgatcaaagcaaggaaggcttccccttgtccgggctcaggatgatgatgaaagttctgaattatcttctgaagagaagcttctgaatgacgtatttgtaaaggacagtatccctccctggttagcaggatctggttatgtggggcttgcagcaatctcaactgcaactgtaccaatgatgttcccacagctcaagtggtaccttgtcctttctgcctatgttgttgcacccctactcgccttctgcaactcatacggcactggcctaacagactggaaccttgcatccatatacggaaagattggccttttcatttttgcctcatgggttggccagcatggtggtgtgatcgccggcttagcagcttgcggtgtcatgatgtccatagtatccacagctgctgatctcatgcaggacttcaagactggttactttaccctctcttcaccaaggtccatgtttgtgtcacaattgattgggactgctcttggctgtgtcattgctcctctcaccttttggctttactggtcggcctttgatgttggcaatcctgatggcatgttcaaagctccatacgctgtcatcttccgtgagatggcaattttgggagtcgaaggattctcggccctcccccaacactgcctagcaatctgctctttcttcttctttgcagccatagcgatcaacctcctgagggacgtcactccagacagcgtgtccaaattcatcccactcccaatggccatggctgttcccttctacattggagcgtattttgcgattgacatgtttgttgggacggtcatcctgtttgtctgggagaagattaaccgcaaggagtcggaggactttgcaggcgcggttgcttcgggtttgatctgtggtgacggcatctggagcgtcccttctgcaatactctctatcatgaggattgacccgccgatgtgcatgtacttcaagccatctcttgcctagggcgtaaataggctgtagctagaatgtttgttttattgggatgccacaaatagaagagaaccacatcgtgtacatatttatttcacacacgtgtaaatcaatactgcggcaaaaatcgcagcag

SEQ ID NO: 3317 - DNA, 1218 bp, Triticum aestivum
  misc_feature (6)..(6): n = any nucleotide
  misc_feature (9)..(9): n = any nucleotide
  misc_feature (37)..(37): n = any nucleotide
ctgccntgntcccaccattgcagctcttagcaatccngaagtggaaatggccttcttctgaaaggaggaaaagaagctatgagatcaaacacaatattacataaggtcataaccagtgtgattccagatgctgttggtaaaaagcttattggccttgtgaaaagcaaagatgaaattgctgatcttctaaagcttgacgatgtgattgatcttgttattccaagaggcagtaacaggcttgtttctcaaatcaaagcacaaaccaagattcccgttctgggtcatgctgatggtatctgccatgtttatattgataaatcagctgacatggacatggcaaaacgtatagtattggatgcaaaggttgattatcctgcagcgtgtaatgctatggaaacactgcttgttcataaagatctgaacaagacagagggtcttgatgatttattgatggaacttgcgaaagaaggagttgttatttatggtgggcctgtcgcacatgacacattgaaagtaccgaaggtagattcatttcatcatgagtatagctcaatggcatgcaccctcgaatttgttgatgatgtgcagtcagcgattgaccatataaatcgttatggaagtgcacacacagattgtattatcacaactgataagaagtcagcggatacttttctacaacaagttgacagtgctgctgtgttccataatgcaagcacaaggttctgtgatgggactcgctttggtctaggtgcagaggttggcataagtacagggcgcatacatgcccgtggacctgttggcgtcgacggtcttttaaccactcggtgcattctgcgagggagtggacaagtagtgaacggtgacaagggagttgtgtacacccacaaggatcttcctttgcaatgagggtagaggattcctgctgtagagcaatttttatagaataatcctcttcaaagcccccttctctctgtgcgaggaatgaaggaagacaagagagcattgttgttactatgtcgctatctagttccgtgattattcgtgtacaatgatttatccatacaatgtcgtagttatggcactagctgttgtaactgtagaattgcatcggtacatctatgctacatatatgaagtagctgtactgtttctgatgaagtctcgaatccgttgtcatgttgtctttctatggcaaagagcacctgaaatgaatgtatcg

SEQ ID NO: 3318 - DNA, 1052 bp, Triticum aestivum
cgatttgagttcatcattaacaatggtggtatcgactctgaggaggactacccctacaaggagagggacaaccgttgcgatgctaacaagaaaaatgcgaaggttgttaccattgatgggtacgaggatgtgcccgtgaacagtgagaagagtctgcagaaggcagttgcaaaccagcccatcagtgttgcgattgaggctggtggcagggcattccagctctacaaatcgggtatcttcaccggaacctgtggaacagcacttgatcatggtgtcgccgccgttggttatggtacagagaacggcaaggactactggctcgtcaggaactcctggggtaccgtctggggagaggatggttacatccggatggagcgcaacatcaaggcatccagtggcaaatgtggtattgccgtcgagccttcctacccgaccaagacgggcgagaaccccccttaaccccggcccaactccaccatctcccgccccaccgtcttccgtctgtgacagctacaacgagtgccccgcgagcacgacctgctgctgcatctacgagtacggcaaggagtgcttcgcctggggctgttgcccactcgagggtgctacctgctgcgatgatcactacagctgctgccctcataactatcccatctgcaacacccagcagggaacctgcctcgcggccaaggacagcccactgtcagtgaaggctcagaggcgtaccctggccaagcctatcggtgctttctctggcattgcaactgacggcaagaagagcagcgcgtaaacatttgcatcacgacattcatacagccaacggccatggtgattaacttctgcaaatgatcacctggtgatccacgatcgaaggcgcagcatggcgatagctatgctctctagtatcttctttataatagatgctcctgtacataatcctaaaatcgggttcgatcatttacagaaccaccaaatttgcttttgcatatgtatatgtaaaactcagctcattccctcacagtttggagctgccattgttattatggaattcatca

SEQ ID NO: 3319 - DNA, 1202 bp, Triticum aestivum
gctttctcagcaatagcagctgttgaaggcatcaaccagattgttacgggcgacatgatccctctgtccgagcaagagcttgttgactgtgacacttcatacaacgagggatgcaatggaggtctgatggactatgcgtttgagttcatcattaacaatggcggtatcgactctgaggaggactacccctacaaggagagggacaaccgttgcgatgctaacaagaaaaatgcgaaggttgttaccattgatgggtacgaggatgtgcccgtgaacagtgagaagagtctgcagaaggcagttgcaaaccagcccatcagtgttgcgattgaggctggtggcagggcattccagctctacaaatcgggtatcttcactggaacctgtggaacagcacttgaccatggtgtcgccgccgttggttatggtacagagaacggcaaggactactggctcgtcaggaactcctggggtaccgtctggggagaggatggttacatccggatggagcgtaacatcaaggcatccagtggcaaatgtggtattgccgttgagccttcctacccgacgaagacgggcgagaacccccctaaccccggcccaactccaccatctcccgccccaccgtcttccgtctgtgacagctacaacgagtgccccgcgagcacgacctgctgctgcatctacgagtacggcaaggagtgcttcgcctggggctgttgcccactcgagggtgctacctgctgcgatgatcactacagctgctgccctcataactatcccatctgcaacacccagcagggaacctgccttgcggccaaggacagtccactgtcagtgaaggctcagaggcgtaccctggccaagcctatcggtgctttctctgtcattgcaactgacggcaagaaaagtagcgcgtaaacatttgcatcaccacaatcctacagccaacggccatggtggttaacttctgcaaatgatcacctggtgacccacgatagaaggcgcagcatggcaatagctgtgctctcaagtatcttctttatagtagatgctcctgtacataatcctaaaatcgggttcggttgttcacagaaccgccacatttgcttttgcatatgtatatgtaaattcagcacattcccaggcagtttggggctgctattgttatatggaattcatcaagaaacaagataagcaga

SEQ ID NO: 3320 - DNA, 1194 bp, Triticum aestivum
ctcgttgataaaggagaaccagtggtaccaacgatactatggaccatgcaaaggaagctatatctacttgggggccttcaggctgaagggttcttcagaataaatgctgacaatagacaggaacagcatgtcagggagcaactaaacagaggtgttgttccagatggagttgacttgcattatcttgcaggccttataaaggcatggttccgagaacttccaagtggagtattagactcattgactccagaacaagtgatgcattgcaacactgaagaagagtgttctcgtattgcgagtattgtacctccagtggaagcagcattactggattgggccattaatctgatggcagatgttgtggagcatgaaaactacaacaagatgaatgctcgcaacgttgctatggttttcgcgccaaacatgactcagatggccgatcccttaactgctttgatacatgcagttcaagtgatgaattttttgaagacattgatactgaagactgtcaaagaaagggaggaggcagctgccgcaacaaggggattcacctccagctctggttccccgagtgacaaagatgcgcctcaggcattaaatcttttggacaaccccttaaattgctcaagtcgggaaaatgtcgaacgccccatgattagtggggctactctcgaccactttctctttagcatggaacaagcgcttcaccaagatgcgcaagccagtgtcggagaacccaagaagtgtgacaccggtacagcacatgacaaatacaatgacgaattttctcctgtggacagtgattttagtaatagccaagatgacagcagttctggaaacaaattcagtaacgacagtgtggaaggtttgtttgacagattcaaatttaggaaaggggtaggcagaatctgcaggcacccagtgtttcagttgagtaggtccatgaagaagtctgatgaagcaggacaggcttgtgcatgacatggtaggatgtgtatgtaattgatgattcccctagttttgcagctgtttagcgcttaactcatacgccatttctcctagttcgtctgtagaagctataagcccatttgattgtactagtactgaactgctgatgtggagttcttggcgtgtacagtatatagttcaactatatcgtaccagcatcctgttgtttgaaaagatgaatgtatc

SEQ ID NO: 3321 - DNA, 1185 bp, Triticum aestivum
gagagaccaaggggccggccggagacgcgcaaagccatagcttggttcctgttgcatcgatcgttgcggttgcggagatgggtcgcgggaagatcgagatcaagcggatcgagaacgccacgaaccggcaggtgaccttctccaagcgccggggcgggctgctcaagaaggccaacgagctcgccgtgctctgcgacgcgcgcgtcggcgtcgtcatcttctccagcaccggcaggatgttcgagtactccagccccgcctccagcttgagggatctcattgagcagtaccagaacgccaccaacagtcagttcgaggagattaaccacgatcagcaaatatttgtggagatgacacggatgaggaacgagatggagaagctggatggcgccatccggaggtacacgggcgatgacctctcctccctctccctcgccgacgtcaacgacatcgagcagcagctcgagttctccgtcgccaaagtccgtgcaagaaagcatcagctcctgaaccagcagctcgacaacttacgtcgcaaggagcatatcttggaagatcagaacagtttcctgtgccgcatgatcagcgagaaccagcatggcagtgaccggaagatggcggtgatgccgccggtgctgtcgatgctgacgccggccttcccggcgacgccgtactacacgggcgaggagtcgtcgagcaccgcgctgcagctgacgtccccgcagcttcagctccacgccgccgaagccgccgggttccggctgcagccgacgcagcccaacctgcaggacccggcgtgcagcagcctccacgccggccacggcctccacctctgagatttgatcatcacgcgccgccggtgatggattggttgattcatgggctcccttgattcatggattctaggaagaagaagatcacggtggatggaagattgacccttatgatgcatgcatgaggacgactatttaatttgggagctatatgtatgtaagataagattgcagctgtgtgacctgtgtcttaggctgttctttcatcatgttgcgtacttaagctagctatatacaattgtctggtcaaatgttggtacgtacgtagaaattaaatagttgtgcacgcatggggatcgaggacgatgcatacatgtaataaatataagttcagagtgaattccacttttta

SEQ ID NO: 3322 - DNA, 1810 bp, Triticum aestivum
  misc_feature (569)..(569): n = any nucleotide
acggagtccaccaccagtctcctcccctcctccttctcctcctacccccgcctccaaggcccctccgcccgcccgccgacctggtccgctggtccggggtgctctgtccggcacgaatccatcggcgcttgttgcgggaatgcggggagttcattggtgagccgctatgggttgcttcccgtgcttcgattcgggctccgacggggagctgctctaccccaagcagggcggcggaggcggcggaaatggcacgggcggacggactgcggacgcggcatcgtacctccggcgtcggcgcccgcgaggagagacccatggtcccgccgcgcgtcgagaagctccccgcaggggctgagaaggcaagggcaaaaggcaatgccggaatgaaggagctttcagatctcagggatgccaatggcatgtcctttctgcgcagacgttcaccttccgccagcttacagctgccacgaggaacttcagggaggaatgcttcattggggagggagggttcggacgtgtttacaagggccgtcttgatggaggccaggttgttgctataaagcagctcnatagggatggaaaccaaggaaacaagaatttctggtggaggtcctcatgctcagtttgctgcatcatcaaaccttgttaatttggttggttattgtgctgatggagagcaacgccttctggtgtatgagtatatgccccttggatcattggaagaccatctccatgatctccctcctgataaggaaccgttggactggaacactaggatgaaaattgcagctggtgctgctaaagggctggaatacctccatgacaaggcacaaccaccagttatatatagagacttcaagtcatcaaatattctattgggtgatgatttccatccaaagctgtcagactttggtctcgctaaattgggtcctgttggtgacaagtctcatgtctctacacgtgtgatgggaacatacggctattgtgctccagaatatgctatgacagggcaacttacagtcaagtcagatgtctatagctttggagtggtgttgcttgagttgattactggccggaaggccattgacagcaccagacctcatggggaacaaaacctcgtgtcatgggcacgccctcttttcaatgacaggcggaagctcccaaagatggctgatccagggctgcagggacgatatcccatgcgtgggctctaccaagccctcgctgtggcgtcaatgtgtattcagtcagaggctgcttcgcgaccacttatcgctgatgttgtgactgctctttcctacttggcgtcccaaatttatgatcctaatgcgatccatgcctcgaaaaaggcaggtggcgaccagcgaagtagggtttctgatagtggaaggacgctcctgaagaatgatgaggcaggcagctcaggacacaagtcggatcgggatgattcccccagggagcctcctccggggatccttaatgacagggagaggatggtggctgaggcgaagatgtggggtgccaacctgcgggagaagacgcgtgctgctgccaatgcacaggggagcctcgattctccaactgaaaccggatagtggcagtcgtcaacctgtggccttgtgttttctctctgtcgactgtgcttgctttcgattggcgggaaaagatgaattgggtgctttccggtggtgttagatgtgtacatttataggggcaaaacaaaaacaaaacaaacagagaagaattgggtgactttgtactggatatggtcgtacctgtaaattcttggaaaattttgcgacgatggaga

SEQ ID NO: 3323 - DNA, 1050 bp, Triticum aestivum
taaccaaccagcaacaatgcacaacaactcattccaaatgatcttcactcactagtcactggtgagccttgttgtcagcacgcccgccgtccccttctccccagccgtcctcgagcggcatgtccggcatcaccttcttccagaaccagtgcttcctccacagcagcaccatctcctcgatgggcacgcccttggtctccggcaggaagacgtagacgaagacggtcatgaccgtgatccaggcggcgaagaagaggaagatgccgaacttgaaggcgcagagcatggacaggaacgcctgcgcgatgacgaaggtgaagaagaggttgacggccaccgtgatgctctgcgccgccgagcgcgtctccagcgggaagatctcgctcggcaccgtccaccccagcggcccccacgaccacccgaacgccatcacgaagaggcagatcaccaccacctctccactccactaccaccgaagcagctcccactgaagcagcggcggaagaagaagaagctagaggacatgggggcgcagagagctctcctcgcgagcttcctgctcgccgcgttggccacccaggccttcgtctccgtctcggccaggaccggcccgacggacaaggcaagccaagatgacgtgaagaagccggactgcgtgccgtcgctcgacccgcacaacttccccggccacgggggcaccaccgtgccgcttccctcgcacgggggctcctccggcacgcccccctaccacggaggttccggcacgacgccgtcgcacggcggctccggctcgactccgtcgcacagcggctctggtcgttgcctgacccttcgcacggcgggtacgggacgccgccttcgcacgggggctctggatcgttgcctgacccatcgcacagcggaggaggttacgggtccaccccagatgcgccgtcacacggcggaggcgcgtacgggagctccccgacgccttccactggcggtgcctacggcagctcacccactccgtcccacgacggaggcgcctacgggagctccccgacgccggcc

SEQ ID NO: 3324 - DNA, 664 bp, Triticum aestivum
catcagcggcggcattcagatgatcgtttgccaggtgatcggtggcggtgatactcggggtgaagttcgggacggacaagcagctgtcgcggagctactcgatcgtggtggtggtggtgatctgcctcttcgtgatggcgttcgggtggtcgtgggggccgctggggtggacggtgccgagcgagatcttcccgctggagacgcggtcggcggggcagagcatcacggtggccgtcaacctcttcttcaccttcgtcatcgcgcaggcgttcctgtccatgctctgcgccttcaagttcggcatcttcctcttcttcgccgcctggatcacggtcatgaccgtgttcgtctacattttcctgccggagaccaagggcgtgcccatcgaggagatggtgctgctgtggaggaagcactggttctggaagaaggtgatgccggacatgccgctcgaggacggctggggagaaggggacgctgggcgtgctgacaataagggtcagtgaagatcatttggaatgagttgtgcattgttggttggttagatcctgtaagacacagtattttttttcatgcgatgcaaagcctccagaatggcgggtactctaccaggcttgttcgataaatgagactcatattagcatgaaaaaaaaacactcaagag

SEQ ID NO: 3325 - DNA, 673 bp, Triticum aestivum
cattaggaagtcggaagaagagattgttgctatcaaagctcaaaatggacaagtacttggccgtggtgaatgagaaagaaactgaaaatactgagctgctggagaagatgagtcatctggaggctcagctagttgaagccaacaaggctagcgaggaagccaaggccgagacccggcaattgaaggataaactattagacaaagagaacgaattacagaacatacaagaggagaacgaggacttgcaggcaaaggaatcagctgcttctgagaagataaaggagctctcttatctagtgccgaatggaacaacaaatggtggcaacaagggagactcggctctcgacagcaacgggttgcagtcagcaaagacatacaacggcggcacgtcgccaaccaaacagcagcagcaaaagaagaagaaatttaaatttagcggcttactgaagaaaaagagctcaaattagcacaagaccaccgtcttatgttgttcctttgttgtatgctatgtgacatctcctttctttgactagccacccacccatgcctctagttttctgagtctgtcatcatggtaaagcaagtgttgggtgtttcagagaatacaaaagagccggccgattgtatttacagccatgcgtttgtttcttgcatttgtgtaagttcagtgatg

SEQ ID NO: 3326 - DNA, 812 bp, Triticum aestivum
cagaagctaagaacgtgtctgaggaatggcagtccaaagagctaagttttgtcaactccattaggaagtcggaagaagagatcgtcactatcaaagctcaaatggacaagtacttggccgtggtgaatgaaaaagaagctgaaaataccgagctgttggagaagatgaatcatctcgaggctcagctagttgaagccaacaaggccagtgaggaagccaaggccgagacccgtcaactgaaggacaaactattagacaaagagaacgaattacagaacatacaagaggagaatgaggacttgcaggcaaaggaatcagctgcttcggagaagataaaagagctctcttatctagtgccgaatggaacgacaaatggtggcaacaaggaagaagataacgagaatggtggcggtgtggatgacgaaccggtcgtggtggttgccaagatgtgggagaacagcaaggtcaccgactacgactcatccaaggagaaggagaacgacggcgagtctgaagtcgatctggagtccaacaagggagactccaccctcgacagcaacgggttgcagtccgcaaagatgaacaacggcatcacatcgccaaccaaacagcagcagcaaaagaagaagaaatttaaatttagcggcttactgaagaaaaagagctcaaattagcacaagatcaccagtcttatgttgttccttcgttgtatgctatgtgacatctcctttctttgactagccacccacccatgcccctagttttctgagtctgtcatcatggtaaagcaagtgttgggtgtttcagagaat

SEQ ID NO: 3327 - DNA, 1141 bp, Triticum aestivum
ccaggagaaatacctcatcaaacaggaagagatcgagcacgctcgggcacaagtagaggaactcaacaatagtctgcagaatgccaaggagagctatgaggtgatgctcgatgaagtaaactacgagaaagtttgcctcaagaagtccgttgagagaatggaggcagaagctaagaacgtgtctgaggaatggcagtccaaagagctaagttttgtcaactctattaggaagtcagaagaagagatcgttgctgtcaaagctcaaatggacaagtacttggccgtggtgaatgaaaaagaagctgaaaataccgagctgctggagaagatgaatcatctggaagctcagctagttgaagccaacaaggctagcgaggaagccaaggccgagacccggcaattgaaggacaaactattagacaaggagaacgaattacagaacatacaagaggagaacgaggacttgcaggcaaaggaatcggctgcttcggagaagataaaagagctctctttcctggtgccgaatggaacaacaaatggtggcaacaaggaagaagacaatgagaacggaggcggtgtggatgacgagccggttgtggtggttgccaagatgtgggagaacagcaaggttaccgactacgactcgtccaaggagaaggagaacgacggcgagtccgaagtcgatctggagtccaacaagggagactccggccttgacagcaacgggctgcagtccgcaaagctgaacaacggcatcacatcgccgaccaaacagcagcagcaaaagaagaagaaatttaaatttagcggcttactgaagaaaaagagctcaaattagcacaagatcaccatcttatgtttgttcctttgttgtatgctatgtgacatctcctttctttgactagccacccacccatgcctctagttttctgagtctgtcatcatggtaaagcaagtgttgggtgtttcagagaatacaaaagagccggccgattgtatttacagccatgcgtttgtttcttgcatttgtgtaagttcagtgatgatgattcatgttgtagtcatagtgattgtatttattcatacatatgccctgggtaatggtgttgtacatggaacagagatttccaatcaatgcagt

SEQ ID NO: 3328 - DNA, 882 bp, Triticum aestivum
taactgtacttctgatatgcaaaactggatttctgagagtaaatgctataatcaaattttaattcttttttaaagcacttggcatttgatgtctctgagaatttgtgcttaagcaccagcagatgcgtatctgtggaagttatttcttaatcaactagtgtagcaagtccacagaaatttactctgatggctgataagttcagcttggctttatgccccaggatttgaaatcatttcaaagacaagttatatcatggtaaacaaaggaacttacatgtctcttttgtaccattgattcattaggcggacgtggacaacagtgggaccattgactatatagagttcattgctgcaacattgcatctgaataaactggagcgtgaggagcatctggtggcagccttttcatattttgacaaagatggaagtggttacatcacagtggatgaactgcagcaagcttgccaagagcacaacatgccagatgcttttcttgatgatgtcattaaagaagctgaccaggacaatgatggtcgcattgactatggagaatttgttgccatgatgaccaagggcaatatgggggtggggcgaagaacaatgagaaacagcctgaacatcagcatgagggacgcacctggtgcaatctagacttccacgatgtacatacagcttgtggccttagcttcttcctgccttcccgctctacgaagacttcctgcaattttcgaatcttgtaaaatgcctgtgtggatgtgtgtttctggggattctgatttagctcgtcaattgattcgacggaacgcatgctaagctgggttggaatgatctcacacgttgctgctgcttaatccctgccaaatgttcggtgaattacctcct

SEQ ID NO: 3329 - DNA, 847 bp, Triticum aestivum
ctatctcgcattaagcaattctctgcgatgaataagttgaagaagatggctttgcgggtaatagctgagagcctctcagaggaggaaattgcagggttgaaggaaatgttccagactatggacgccgataacagtggtgcaattacatatgatgagctcaaagaaggcttgagaaaatatggctccacattgaaggataccgagattcgtgatcttatggacgcggcggatgtggacaacagtgggaccattgactatatagagttcatcgctgcaacattgcatctgaataaactggagcgtgaggaacatctagtggcagccttttcatatttcgacaaagatggaagtggttacatcacagtggatgaactgcagcaagcttgccaagagcataacatgccagatgcttttcttgatgatgtcattaaagaagctgaccaggacaatgatgggcgcatcgactatggagaatttgttgccatgatgaccaagggcaatatgggggtggggcgaagaacaatgagaaacagcctgaatatcagcatgagagacgcacctggtgcaatctagacttccacgatgtacatacagcttgtggctttagcttcttcctgtcttcctgctctaccaagacttcctgcgattttcgaatcttgtaaaatgcctgtgtggatgtgtgtttctggggattctgatttagctcgtcaattgattcgacggaacgcatgctaagctgggttgaaatgatctcacacgttgctgctgcttaatccctgcaaaatgttcagtgaattacctcctactatatctccctggaattgttaactcttaaaatggcttgtca

SEQ ID NO: 3330 - DNA, 1121 bp, Triticum aestivum
gctgtgcaaaaaatatggaccagaagctgatgtatggaccgctggtgtaattctctacattctgctgagtggtgtacccccattttgggcagagacacagcaaggaatatttgatgctgtactgaaaggtgtcatcgattttgattctgaaccctggcctgtgatatctgacagtgcaaaagatctgataacaagaatgctcaatcctcgcccagctgaacgcttgacagcacacgaagttctatgccatccatggattcgtgatcagggagttgctcctgatcgtcctcttgacacagctgtcttatctcgcattaagcaattctctgcgatgaataagttgaagaagatggctttgcgggtaatagctgagagcctctcagaggaggaaattgcaggcttgaaggagatgttccagactatggacgctgataatagtggtgcaattacatatgatgagctcaaagaaggcttgagaaaatatggctccacattgaaggatactgagattcgtgatcttatggatgcggcggacgtggacaacagtgggaccattgactatatagagttcatcgctgcaacattgcatctgaataaactggagcgtgaggagcatctggtggcagccttttcatattttgacaaagatggaagtggttacatcacagtggatgaactgcagcaagcttgccaagagcacaacatgccagatgcttttcttgatgatgtcattaaagaagctgaccaggacaatgatgggcgcatcgactatggagaatttgttgccatgatgaccaagggcaacatgggggtggggcgaagaacaatgagaaacagcctgaatatcagcatgagagacgcacctggtgcaatctagacttccacgatgtacatacagcttgtggctttagcttcttcctgtcttcatgctctacaaagacttcctgcaattttcgaatcttgtaaaatgcctgtgtggatgtgtgtttctggggattctgatttagctcgtcaattgattcgacggaacgcatgctaagctgggttgaaatgatctcacacgttgctgccgcttaatccctgcaaatgttcagtgaattacctcctactatatctgcctg

SEQ ID NO: 3331 - DNA, 1290 bp, Triticum aestivum
gtcattatctgtcatcaacagttcttccctctattgagggtgacagattaaccattccacgtgagagaatttggcgaaagatgagtacgaacgcaatttcatatcttctgttgtacctcctgatgaaattggagtgaaattcgatgatattggcgcgcttgaggatgtcaagaggacactggacgagctcgttgctcttccatgaggagaccagagcttttttctcatggcatttattaaggccctgcaaaggtgttttgctttttggtcctcctggcacaggaaaaacactcttggcaaaggcactcgcgactgaagctggggcaaattttatcagcataaccggttctacattgacatcaaagtggtttggagatgctgagaagttgacgaaggcccttttctcttttgctagccgactagctcctgtcatcatatttgtagacgaggttgacagcttacttggcgccagagggggtgcacttgagcatgaagcaacaaggaagatgcggaatgaatttatggcagcttgggatggtctaaggtccaaagagaaccaacggatccttattcttggtgctacgaatcgtccatttgatttagacgatgctgttatacggcgtttacctagacggatatatgttggccttccagatgtggaaaaccgaaagaaaattctcaagattttactggctacagaaaacttagaatctgattttaaattcgatgaacttgctaatgtgacagaaggttattcaggaagtgatctgaagaacctatgcatagcttcagcatacaggccagttcaggaacttctagaagaagaaaagaagggacgtgtgagtagcaacagcactcacttaagaccccttgtattggatgattttatacaggcaaaagccaaggtaagcccgtctatatctcataacgcaacaagtatgaacgaattaagaaaatggaacgaacagtatggtgaagatggcagcaggacaaaatcgccgtttgggtttggcaactgacatgttacagtagcaaagtgttgtttgtaaaatcaataggctgcctatttagtgacaggaagtcggcccccatttttcgccctgagcctatttatacagcctctcagtgatcctgtacaaatagcaaaatatcaagtcaaacgacaaattccaagttttcctgtagctggtactaccggggattccccaattttccaacattgcaaacgctgagctacaaatttgctccagctctgcaagagcctgacccaggtgtaagtagcaccagaaa

SEQ ID NO: 3332 - DNA, 1075 bp, Triticum aestivum
tggtgctaaattatcatgccaccttcggcacttgatcgtcttgcgtctctgcatattgagtaccctatgctatttgaagtacgcaacacagcagcagaacgcacttcacactgtggtgtcctagagttcattgcagaagaagggatgatctacatgccatactggatgatgcaaaatcttcttttgcaagaaggagatatggtgtttataaaaaatgccaacctcccaaagggcacatatgtgaagctgcagcctcatacaactgacttcttggacatttcaaatcccaaagcaatcttggaaaaaactttgcggaactactcttgtctaaccactggtgacagcattatggtggcatataataacaagaagtactacattgatatagttgaaacaaagcctgccagtgctataagtataattgagactgattgtgaggttgactttgccccaccacttgactataaagaacctgagcgacccaaacctactgctcctcccagcgctgatcctgctgcagaggctcaagatgaggaggaaccaaagttcagccccttcactggtcctggaaggcgcttggatgggaagcctgctaaagatttggatgcatcatcctcttcgcctgcaaagcgacaagctaatgcaaccaacagtgttcagccctcagcagcctccacaccacagatcacggcgccacgtaaaaccacaggaaagcttgtctttggctctggtggaagccagtcatcaaaaggaacagaaaaggtgcccgacaaggatgcaaaggaggatccgaagaaagaggagccgaagttttcagcattcacgggaaagaagtactccttgaagggctgaatgccagagtatgtatttatcagcacttcctgtcacaaacatcatcagggctaagagttcagtcagctactgtttagtttcctgatcccttgggagctggggcatctttcggtggactaccaatgcttcttttctgtcaactgtgatccttatgtcagccgccgtgggtcagtttggctgatgtgtacaaagtatttcaatgtctgttcatggattcttagcg

SEQ ID NO: 3333 - DNA, 1070 bp, Triticum aestivum
aaaggcagttgcccctgtccagatgagttccaatccttccaatcgttccaagtcaaatgctgaagatgatctgttttggggcccatctgaccactccaaacaagataagaaacagtcagaattcccaagtctagcaagtcagagtaaaagttccatgacgaaagaccagtcttcagtaaaccgtcacaagtctcaggctagcaagttgccactttcaacggctcctagtgctaacctcattgggaaagggaaagcagaggcagcaaacaagcagacagaggcaatggacttccgggattggtgcgacagcgagtggtccaggctcactggaacaaatgatacaagtttccttgagttctgcattaagcagtcgactgctgaagcagaaatgcttctccgggagaacgtcggctctctcgaccgcaacggccagttcatcgacaggttcctcaactacaaggcttttctgtccacagatgtgatcgagatggcattcagagcgcccagcaaccgtgccccccgcctgaaccccgcttctgcagccaaaggagggccaagtgctgaggcagagcaggatacaggaggaaagaaaaaagggaagaaagggaagaaggtgagcgcagcggttttagggttcaatgtagtcagcaaccgcatcatgatgggagagatccagaacgtggattagtaggactgcatacaacggtggcaccgcgctgtacatacttttggcgctctcgatagatcgttttgacttgttgcgatggcaaccgagcatatgcggtggtgattttcgtctcttttttcgagaaagtgcatccattgcccaattttggcttcctgtaactcacaccagattttgttctcgatagaacttcactgcagatgaacctagattcatttggtttacacaaaacacaaaacaaaaaagaggggggggcacaagaagacaccgttaaagcgcggtaggaggtcaaaccctttaagggcgccaaaaaaacgggggcgtaacaccggggggaaccgggtccctactgccccttcctcccagaaaacatatgtgactaatc

SEQ ID NO: 3334 - DNA, 1272 bp, Triticum aestivum
ggatctgcagccaaagccccattacctgttagttccattgattcatcagttatgtctataccagctgaaaagggcaaatcttcaaagcaagcgaaacaagaaaaggaaatacttccggctcctccaagtggtccatcctttggagattttgttccttggaagactgaccagacaaattttgcgcctgctccagcatggtccaatgactctacgaaggtgcacaaacctttgtctttgagagatattcagagagaggaagaaaggagatcaggtgttgtccagcaacaaccaccctcacctactccagcaaaggtttcggtgaaccaacggaatcatggtaatgcttcttctaagcaagcttctgggtcttctccatcaaaggcagttgcccctgtccagatgagttccaatccttccaatcgttccaagtcaaatgctgaagatgatctgttttggggcccatctgaccactccaaacaagataagaaacagtcagaattcccaagtctagcaagtcagagtaaaagttccatgacgaaagaccagtcttcagtaaaccgtcataagtctcaggctagcaagttgccactttcaacggctcctagtgctaacctcgttgggaaagggaaagcagaggcagcaaacaagcagacagaggcaatggacttccgggattggtgcgacagcgagtggtccaggctcactggaacaaatgatacaagtttccttgagttctgcattaagcagtcgactgccgaagcagaaatgcttctccgagagaacgttggctctcttgaccgcaatggtcagttcatcgacaggttcctcaactacaaggcttttctgtccacagatgtgatcgagatggcattcagagcgcctagcaaccgcgtcccccgcctgaacccctcttctgcagccaaaggagggccaagtgccgaggcagagcaggatacaggaggaaagaaaaaagggaagaaagggaagaaggtgagtgcagcggttttagggttcaatgtagtcagcaaccgcatcatgatgggagagatccagaacgtggattagtaggtctgcatacaacggtggcaccgcgctgtacatacttttggcgctctcgatagattgttttgacttgttgcgatggcaaccgagcttatgcggtggtgattttcgtctcttttttcgagaaagtgcatccattgcccaatttttggcttcctgtaactgacaccagattttgttctcgatagaacttcactgcagatgaacata

SEQ ID NO: 3335 - DNA, 726 bp, Triticum aestivum
cggtcatctcggcgagaaggcgtaccacgagcagctgtcggtgtcggagatcaccaacagcgcgttcgagccgtcgtccatgatggccaagtgcgacccgcggcacgggcaagtacatggcgtgctgcctcatgtaccggggcgacgtggtgcccaaggacgtgaacgcggcggtggccaccatcaagaccaagcgcaccatccagttcgtggactggtgccccacggggttcaagtgcggcatcaactaccagccgcccaccgtggtgcccggcggcgacctggccaaggtgcagagggccgtctgcatgatctccaactccaccagcgtcgtcgaggtcttctcccgcatcgaccacaagttcgacctcatgtacgccaagcgcgccttcgtgcactggtacgtgggcgagggcatggaggagggcgagttctccgaggcccgtgaggacctggccgccctggagaaggactacgaggaggtcggcgccgagggcggcgatgatgaggatggcgaggaggacgacgactactgatctgctcgtccgctcgacggaggatctgtctcctctgctgcctatctttaactacatgttgctgtgctgtcctgttttggaaacttgtgtctgggtgttgggttgttaagccgtcggtgctttctatgtcgctgttgaactgcatcattagtacttcgtggaacaagtgtctcgcttaattgatgttcat

SEQ ID NO: 3336 - DNA, 1052 bp, Triticum aestivum
ctagttctagtccaagctcgggttcaccgtgtacccatcccctcaggtgtcgacctctgtggtcgagccctacaacagtgtgctgtccacccactccctgctggagcacaccgatgtctccatcctgctcgacaacgaggccatctacgacatctgcaggcgctccctggacatcgagaggcccacctacaccaacctgaaccgcctcgtctctcaggtgatctcatccctgaccacctccctgaggttcgacggtgccctgaacgtggatgtgactgagttccagaccaacctggtcccatacccgaggatccacttcatgctctcgtcctatgcgccggtcatctcggccgagaaggcgtaccacgagcagctgtcggtgtctgagatcaccaacagcgcgttcgagccgtcgtccatgatggccaagtgcgacccgcgccacggcaagtacatggcgtgctgcctcatgtaccggggcgacgtggtgcccaaggacgtgaacgcggcggtggccaccatcaagaccaagcgcaccatccagttcgtggactggtgccccacggggttcaagtgcggcatcaactaccagccgcccaccgtggtgcctggcggcgacctggccaaggtgcagagggccgtctgcatgatctccaactccaccagcgtcgtcgaggtcttctcccgcatcgaccacaagttcgacctcatgtacgccaagcgcgccttcgtgcactggtatgtgggcgagggcatggaggagggcgagttctccgaggcccgtgaggacctggctgccctggagaaggactacgaggaggtcggcgctgagggtggcgacgatgaggatggcgaggaggacgacgactactgatctgctcgttcgctcgacgggggatccgtctcctctgccgcctatctttaactacatgttgccgtgctgtcctgttttggaaacttgtgttgggttgttaagccgtcggtgctttctttgtcgctgttgaactgcatcattagtacttcgtggaacaagtatctcgcttaatttgttc

SEQ ID NO: 3337 - DNA, 613 bp, Triticum aestivum
ctttgatgagagcatggcttcacatccaccgccaccgccaaggtgcctccatcgacaagaagattagggctcagcgagaagtttaccatgggcactacagtggtaaacgagaaggtcaaggagatggaccagaagttccaggtctccgacaagaccaagtcggcgctggctgcggcagagcagacggtgagcaacgctgggtccgccatcatgaagaacaggtacgtcttcacgagcgcgtcgtgggtcaccagcgcatttggcaaggttgccaaggccgccaccgacgtcagcacgatgacgaaggagaagatgtcagccgaggaccagcaaaagggctccgggggcagctcgtacacgcccatccgctgatcctcaccccccgctcctctatgtgcctcttgccatgttgtattatttattggtggatcagaagacaacattagatatatagaacacaccagatcaccccttccatatgtgaacctttgcaacccaggatttttttctctctttgtagaacaggaaatttaccttgggttttacatgttacagaactgttcaaggtagaattggaatgaaccttttactttgttaagttgtggaaggtgct

SEQ ID NO: 3338 - DNA, 1108 bp, Triticum aestivum
cctaatcaccaccgccgccggcctaacccccctttcctctgctacgcgcgcgatggcggcggcgacggctccggtggaggtgcccgtggcggcgccggtgaggactgtgaaggtcacaaatgtttccctgagtgcaactgagcaagacattaaggagttcttttctttttcaggagacattgaacatgtggatatgaaaagtggtgacgagtggtctcaaattgcatatgttacttttaaagatgcccaaggagcagagactgcgcttcttctttcgggcgcaacaatagttgacctttctgttatcattgcacctgctccagagtatcaaccgccccctactgcctctgctccactgatgagtggaaccagagtaccagtgggtggtgacaatgtggtccacaaggctgaggatgttgtcagcactatgcttgccaggggtttcaccctgggcaaagacgcctgtcggcaaggcgaaatcttttgatgagaggcatggcttcacatccactgccaccgccaaggtggcctccatcgacaagaagatagggctcagcgagaagttcaccatgggcactacagtggtaaacgagaaggtcaaggagatggaccagaagttccaggtctctgacaagaccaagtcggcgctggctgcggccgagcagacggtgagcaacgccgggtctgccatcatgaagaacaggtacgtcttcacgagcgcgtcgtgggtcaccagcgcgttcggcaaggtcgccaaggccgccaccgacgtcagcacgatgacgaaggagaagatgtcagccgaggaccagcaaaagggctccgggggcagctcgtacacgcccatccgctgatcgttgcccccgttccgctgcgcctcttgccatgttgtattatttattggtggatcagaagacaacattagatatatagaacacatcagatcaccccttccatatgtgaacttttgcaacccaggatttttctctctttgtagaagaacaggaaatttactttggggttttacatggtacagaactgttcaaggtagaattgaatgaaccttttactttgttaagttgtggaagggtgctgtaataatattgct

SEQ ID NO: 3339 - DNA, 1042 bp, Triticum aestivum
cgcccttcccccttctccacccaccaccgcctgcggaccgatcccgatctgatatcgccgccgcgcgcgcgccggacaagatggctcccgtgtcggctctggccaagtacaagctggtcttcctcggcgaccagtccgtcggcaagaccagcatcatcacccgcttcatgtacgacaagttcgacaacacctaccaggctacgattggtattgatttcctgtcgaagacaatgtaccttgaagatagaactgtgagactccaactctgggatacagctggtcaggaacgattcaggagtttaattccaagctacatcagagactcttcagttgctgttattgtattcgatgttgcaagcaggcagtctttcttaaacacgtcgaagtggatagaggaagttcgcactgagaggcatggcttcacatccactgccaccgccaaggtggcctccatcgacaagaagatagggttcagcgagaagttcaccatgggcactacagtggtaaacgagaaggtcaaggagatggaccagaagttccaggtctctgacaagaccaagtcggcgctggctgcggccgagcagacggtgagcaacgcagggtccgccatcatgaagaacaggtacgtcttcacgagcgcgtcgtgggtcaccagcgcgtttggcaaggttgccaaggctgccaccgacgtcagcacgatgacgaaggagaagatgtcagccgaggaccagcagaagggctccgggggcagctcgtacacgcccatccgctgatcctcaccccccgttcctctatgtgccttgccatgttgtattatttattggtggatcagaagacaacattagatatatagaacacatgagatcaccccttccatatgtgaacttttgcaacccaggattattttctctctttgtagaagaacaggaaatttactttggggttttacatgttacagaactgttcaaggtagaattggaatgaaccttttacttggttattaagttgtggaagggtgctgtaataatattgctagtggctg

SEQ ID NO: 3340 - DNA, 1244 bp, Triticum aestivum
atagacacttgatgctcaatatcagttgtggcaacgatggtgatgaatttacattcctgaccaataaaaatgctccaaagaataagcttgtgcggaacacttatttcttctggttacacaagtaacaagaaagatatcgaactcgatggatcacatccaactttgctatatggttatggtggattcaacataagcattaccccttctttcagtgttagtcgtcttgtcctatgcaagaacatgggttctgttgtctgcattgcgaacatccggggtggtggagaatatggggaggagtggcacaaagctggagcacttgcaaagaaacagaattgttttgatgacttcattgcttgtgcggaacaacttatttcttctggttacacaagtaacaagaaaatatgtattgaaggtggaagcaatggtggtcttctaattgctgcttgtattaaccagcggcctgacctttttgggtgtgccctggctcatgttggtgtcatggatatgcttcggtttcacaagttcacaatcggtcatgcctggactacagattatggttgttcagataaggaagaagaattcggctggcttatcaaatattctccccttcataacgtgaagagaccttgggagcaagctttggtgataattgtcagtatccagcaaccatgctgttgacagctgatcatgatgaccgtgttgtgccattgcactcgctgaagttgttggctacaatgcagcatgtcttgtgcactagcattgagaacagcccgcagaccaacccaataattggtcgcattgaccgcaagtcagggcatggagctggcaggccgactaaaaaattgattgatgagccgcggaccgttacagttttatgtcgaagatgttgggcgctacatggactgactagttcaattctgtcctggaggtgctgtgtgctgagcacacaagacggtgaaaggtgtaatcctggaggggaaagattgctatcgcttcagctgctgaacagtttttgagttcaagtactacaattctttgaagcttacaacacttacatgtttgtgttgtgcaagagcctatatattcttccatatgtgaaaggggtgtgtgtttctgcttagaaaaatgctgttgaaaacttgaaatggaccaatgaagctgtctggctggaacgatttagtcaggacgctcagcctgtccctcgcggctcagggtatgtcttgatagatttatttaaagtattt

SEQ ID NO: 3341 - DNA, 1023 bp, Triticum aestivum
ccagcctcccccgcctcgccggagatcacgagaggcccgccccccatccccgcgatggacgcctcctaccgccgctcaggtgcgggcggaggcggcggctcagccccccgcaccgtcgaggaggtgcccaccgagctgccggagccggcgctcgggatcactttgcgcgcgacgggatgaagcgcagcgactggctcgcgcttgtcgctgtccactccgattcgtggcttgtctccgtagctttctactatgcggcgcggctcacccgcaacgaccggaagcgtttatttggcatgatgaatgatttgccaaccgtgtatgaagtcatctcaggtatgagacaatcgaaggagagggacagatcgggtggtattgacaacagcggtagaaacaagctgccatcaaagcatacagtcgaggcgccgccaccaccacgtgcagaaaataacgccagggatgccgatgaaggctacgatgaagatgacggcgatcacagcgaaaccttatgcggaacatgcggtggcatatacagcgccgaggaattctggattgggtgcgacgtgtgcgagaggtggtaccatggcaagtgtgtgaagataactccggcgaaggcggagagcataaagcagtacaaatgcccaagctgcagctccaagagacctaggcagtagcagcgccgcctccttttggcgggggacggcccccatggatgggggccttgaagcagcagcagcagcggttgagactagactccttgtgcaaggctaactactaccgtcttgctatgtttactgtacctttcgtttcaggtttacatatggtgatgatgctaatgcttgtgggggaagatgacacacattttcgaagccttctaacgtttccatgtcctgaagaggagtcaaaggtgtatgttgccgggaagggatagtagaatgatgaaaatatgtgtaacttttcatgggaagttcatgttccataatccgagaggtttatttatactattctatctatgttaatatatgt

SEQ ID NO: 3342 - DNA, 912 bp, Triticum aestivum
atgaagcgcagcgactggctcgcgctcgtcgccgtccactccgattcgtggcttgtctccgtagctttctactatgccgcgcggctcacccgcaacgaccggaagcgtttatttggcatgatgaatgatttgccaaccgtgtatgaagtcatctcaggtatgagacaatcgaaggagagggacagatcgggtggtattgacaacagcggtagaaacaagctgccatcaaagcatacagtcgaggcgccgccaccaccacgtacagaaaataacgccagggatgccgatgaaggctacgatgaagatgacggcgaccacagcgagaccttatgcggaacatgcggtggcatatacagcgccgaggaattctggattgggtgcgatgtgtgcgagaggtggtaccatggcaagtgcgtgaagataactccggcgaaggcggagagcataaagcagtacaaatgcccaagctgcagctccaagagacctaggcagtagcagcgccgcctccttttggcgggggacggcccccatggacgggggccttgaagcagcagcagcagcggttgagactttagactccttgtgcaaggctaactactaccgtcttgctatgtttactgtacctttcgtttcaggtttacatatggtgatgatgctaatgcttgtgagggaagatgacacacattttcaaagccttctaatgtttccatgtcctgaagaggagtcaaaggtgtatgttgccgggaagggatagtagaatgatgaaaatatgtgtaacttttcatgggaagttcatgttccaataatccgggaggtttatttatactattctatctatgttaatatatgtattattagtctgttcagctgtcatgtggaacctgttgtgaaataacaattttggttaaaggg

SEQ ID NO: 3343 - DNA, 832 bp, Triticum aestivum
cacacagccactcagcttctggcgtaccacgcaggagccggagcgcgcatcggcgtccgacttcaagaaccaccagctgccgctggcgcggatcaagaagatcatgaaggctgacgaagacgtgcgcatgatctccgcggaggcgcccgtgctcttcgccaaggcctgcgagctcttcatcctcgagctcaccatccgctcctggctgcacgccgaggagaacaagcgccggacgctgcagcgcaacgacgtcgccgctgccatcgcgcgcaccgacgtcttcgacttcctcgtcgacattgtgccgcgcgaggaggccaaggaggagcccggcagcgcagccctcgggtttgccgccggaggggttggtgcggccggtgggggccccgccgctgggctgccgtactactatccgccgatggggcagccggcggcaccgatgatgccggcctggcatgttccggcgtgggaaccggcgtggcagcaaggcggggcggacgtggaccagggtgccgggagcttcggcgaggaagggcaagggtacacggggggccatggtggctcagctggtttccctcctgggcctccaagctccgagtgatcgatgccagagctgtatgcgcgcattgtatactcaatgctatttaccacggcgcgcaatgtaattgtaattgtgcaagtatatggcatgtcttgcgttaattaaggactaacacaagcagttatttatcccttttggaaaaaaaagcagataactaccgtgagtttgaatccgggcatgcaggatatgcatcatccatgcatctctatttttaatggagcagttggtagt

SEQ ID NO: 3344 - DNA, 1159 bp, Triticum aestivum
  misc_feature (354)..(354): n = any nucleotide
ttttcatccagccctctctctagcttggcaatggccgcgagggcgtgtcctgctgcttctggttaccgtgtgtgctgaagcatctgacgcgcttgcgccgagcagcaggagctagccgttcatgctcttcttccctccccttggcatctgaagcagtaagagctcaagttcacagagggcgttcgtccgatctacaaagcccagctgtacatcgccttagctagcttgcagatcgcaagctagatagtaatggagaaccaccagctgccctacaccacccagccgccggcaacgggcgcggccggaggagccccggtgcctggcgtgcctgggccaccgccggtgccacaccancacctgctccagcagcagcaggcccagctgcaggcgttctgggcgtaccagcggcaggaggcggagcgcgcatcggcgtccgacttcaagaaccaccagctgccgctggctcggatcaagaagatcatgaaggccgacgaagacgtgcgcatgatctccgcggaggcgcccgtgctcttcgccaaggcctgcgagctcttcatcctcgagctcaccatccgctcctggctgcacgccgaggagaacaagcgccgcacactgcagcgcaacgacgtcgccgctgccatcgcgcgcaccgacgtcttcgacttcctcgtcgacattgtgccccgcgaggaggccaaggaggagcccggcagcgcagccctcgggtttgccgccggaggggttggtgcggccggtgggggcccagccgccgggctgccgtactactatccgccgatggggcagccggcggcacctatgatgccggcctggcatgttccggcgtgggaaccggcgtggcagcaaggcggggcggacgtggaccagggtgccgggagcttcggcgaggaagggcaagggttcacgggcggccatggtggctcagctggcttccctcctggacctctaagctccgagtgatcgatgccagagctgtatgcgcgcattggatactcaatgctgtttaccacggcgcgcaatgtaactgtaattgtgtaagtatatggcatgtcttgcgttagttaaggactaacaacaagcagttatttatccatttgaaaaaaaaacaagcagaaaactaccatgagtttgaatccagaca

SEQ ID NO: 3345 - DNA, 1001 bp, Triticum aestivum
gcacgcatccatcccgtacctgtccgacgagggaggagaaaaaaatgctgcgccacgccgcccgccgcctcgcctcccgcgccgccgctgccggcagcggctccatgagccgcagggccctcgcgacggcgcaggcgcccgcggaggcgggcgaggaccccgccttcctggaggcgtggaagaaggtgacaacaatcatcgagcccccccagacgcccatgtcggccatgaagccccgcccgcccacgccggcctccatcccctccaagctcaccgtcaacttcgtcctcccctacaagtccgagatcaccgacaaggaggttgacatggtaatggtaccggctacaactggcctgatgggtattttgccaggccatgtttccacaattgcagagctcaagcctggtgttatgtctgtacatgagggaaatgatgttacaaagtactttgtgagcagtggctttgcattcatccatgcaaactccattgctgatgttgtggctgttgaggctgtcccccttgatcagattgaccaaagcttggtccagaaaggtcttgctgaattcactgccaagcttggatcagcctcgactgacctagagaaggcggaagctcagatcggagtggatgttcacagtgcgctcagtgctgcattgactggttgatgatgacatcttacatttttatgtccttttcatccgcatctttagaatgtgagtcgaagtcggcaaactcatgaacgagggtggagggaatgatcttaaataaattatactccatctcaaagaaagacttgtttcttcctgcgaggatttttgtaatggtaatattttcctgtgttccaaaatccagtgccgccttcggtttttatttcttcatttcaaatggaattgattgatttccatttcataattgcagtcaaattgtcaaaatataatcaaagttattttttttcatgtttgtgatgttgtggttcctggtgagttgaattcttcaaaatt

SEQ ID NO: 3346 - DNA, 985 bp, Triticum aestivum
gcatccatcccgtacctgtccgacgagggagaaaaaaaatgctgcgccacgccgtccgccgcctcgcctcccgcgccgccgctgccggcagcggctccatgagccgcagggccctcgcgacggcgcaggcgcccgcggaggcgggcgaggaccccgccttcctggaggcgtggaagaaggtgaccacaatcatcgagcccccccagacgcccatgtcggccatgaagccccgcccgcccacgccggcctccattccctccaagctcaccgtcaacttcgtcctcccctacaagtccgagatcaccaacaaggaggttgacatggtaatggtaccggctacaactggcctgatgggtattttgccaggccatgtttccacaattgcagagctcaagcctggtgttatgtctgtacatgagggaaatgatgttacaaagtactttgtgagcagtggctttgcattcatccatgcaaactccattactgatgttgtggctgttgaggctgtcccccttgatcagattgaccaaagcttggtccagaaaggtcttgctgaattcactgccaagcttggatcagcctcgactgacctagagaaggcggaagctcagatcggagtggatgttcacagtgcgctcaatgctgcattgactggttgatgatggcatcttacatttttatgttcttttcatccgcatctttagaatgtgagttgaagtccgcaaactcatgaacgaggatggagggaatgatcttaaataaattatactccatctcaaagaaagacttgtgtttcttcctgcgaggatttttgtaatggtaatattttcctgtgttccaaaatccagtgctgccttcagttttcatttcttcatttcaaatggaattgattgatttccatttcataattgcagtcaaattgtcaaaatataatcaaagttattttttttcatgtttgtgatgttgtggttcctggtgagttgaa

SEQ ID NO: 3347 - DNA, 968 bp, Triticum aestivum
tctgcaggtcgcacacatccatcccgtacctgtccgacgagggaggagaaaaaaaaaatgctgcgccacgccgcccgccgcctcgcgtcccgcgccgccgctgccggcagcggctccatgagccgcagggccctcgcgacggcgcaggcgcccgcggaggcgggcgaggaccccgccttcctggaggcgtggaagaaggtgaccacaatcatcgagcccccccagacgcccatgtcggccatgaagccccgcccgcccacgccggcctccattccctccaagctcaccgtcaacttcgtcctcccctacaagtccgagatcaccaacaaggaggttgacatggtaatggtaccggctacaactggcctgatgggtattttgccaggccatgtttccacaattgcagagctcaagcctggtgttatgtctgtacacgagggaaatgatgttacaaagtactttgtgagcagtggctttgcattcatccatgcaaactccattactgatgttgtggctgttgaggctgtcccccttgatcagattgaccaaagcttggtccagaaaggtcttgctgaattcactgccaagcttggatcagcctcgactgacctagagaaggcggaagctcagatcggagtggatgttcacagtgcgctcaatgctgcattgactggttgatgatgacatcttacatttttatgtccttttcatccgcatctttagaatgtgagttgaagtccgcaaactcatgaatgaggatggatggaattatcttaaataaattatactccatctcaaagaaagacttgtgtttcttcctgcgaggattttgtaatggtaatattttcctgtgttccaaaatccggtgctcccttcagttttcatttctcagttgtgacttgaatcaaatggaattgattgatttccatttcataattccagtcaaattgtcaaaatataatcaaagt

SEQ ID NO: 3348 - DNA, 1011 bp, Triticum aestivum
gttatgatgctttccacgttgaggcacccaaatatcgtaaggttcatcggggcatgcaggaagtcgattgtttggtgtatcattactgaatattgcaaaaggtggctctgtcaggcagttccttgcccgaaggcagaccaagtctgtgcccctgagattggcagtgaaacaggcgcttgatgttgccagaggaatggcatatgtgcatgccctgggatttattcacagggatctgaagtcagataaccttctaatttcagcagacaaatccatcaagattgcagactttggagttgctcgaatcgaggtaaaaaccgagggaatgactccagagacaggaacctaccgttggatggcgccggagatgatccagcacaggccttatgatcataaggtcgacgtgtatagctttgggattgtgctgtgggagctcatgaccggcatgctccccttcacaaacatgacagcggttcaggcagcttttgctgtggtgaacaagaacgctcgtcctgcgatcccacaagattgcctgcccgctctaagccatatcatgacccgttgctgggatgcaaaccctgaagtccgcccatcattcaacgaggttgtgaccatgctcgaggctgctgagacggacgttgtcagcaatgtccgtaaggcacggttccgctgctgcatctccgagcccatgaccaccgactgagactagtgccaggatacagagtaccagaaaatgaaaaatgggaagaagaacgaggatgggaaaggaggcgacgcaatctcgatgtacagaccacactgatacacctgggcgttgcgtgtgcctgcctatccggaggtctgatggctgccgtgggctaagctaggttcttcattgctgctttctactatcttgtcttagttgcatgggttggagtgattgtttgccaagtatggatgatgctaccttgtatgttttctgttttcttggaaggatgctatctggtatgttaacaaggagctatggtatggtat

SEQ ID NO: 3349 - DNA, 722 bp, Triticum aestivum
agggaatgactccagagacaggaacctaccgctggatggcaccggagatgatccagcacaggccttatgatcataaggtcgacgtgtatagctttgggattgtgctgtgggagctcatgaccggcatgctccccttcacaaacatgacagcagttcaggccgcttttgccgtggtaaacaagaacgcccgccctgcaatcccgcaagattgcctgcctgctctgagccacatcatgacacgctgctgggatgcaaaccctgaagtccgcccgtcattcaacgaggtcgtcaccatgctcgaggctgccgagacggacgtcgttagcaacgtccgtaaggcacggttccgctgctgcatctccgagcccatgaccaccgactgagactagtgccaggatacagagtaccagaaaatgaaaaaatgggaagaagaacgaggatgggaaaggaggcgacgcaatctcgatgtacagaccacactgatacacctgggggttgcgtgtgcctgcctatccgaaggtctgatggctgccctgggctaagctaggttcttcattgctgctttctactatcttgtcttagttgcatgggttggagtgattgtttgccaagtatgaatgatggtaccttgtatgttttctgttttcttggaaggatgctatctggtatgttaacaaggagctatggtatgtattctccgcaagcaaagagctatcttgtct

SEQ ID NO: 3350 - DNA, 720 bp, Triticum aestivum
ttgtggcccgtaacagcatggaacttctttcaactgttcgtttcatcctcccctcagcaggatgctttgcaggatgacttgacaaccactcttgtgcaacaatgctaccaatctcaacatactatccagagattcatcgagacggctggagacaatgaggccttgctctttgaggccttgagtgtgaacgatgaggtcctgaaagtgctatccaaatacgaagagatgaagaagcccatggcgtcggcgcgtgcagaacagccagtggtcataccaattgccacagagcatgaagattccgtgactgttggcaatgaggatgccctggtaagaaaaccagctgctgctcgagcaatgtcgggcggcgatgatgatatcctcgatgatcttgatgagatgatatttggcaagaagggaggaagcagttcccaggacgtgtccaaaaggcaggacccaaagaaggatgacctaatcaacttctaaataccgtcccagcaagttccagagttcctctagggatacacagcatgtctgctgcttttatactgctgaacgatgtctgtattcatccagtagaagactgcactgcacgtacattcagttagggatttgggtcgcttgtttatttgcatacgatgataccttgtcctccagagtttgttcagttgataagttgctgcatacttctcgtcttctggtttcatggttatatgcgtcaga

SEQ ID NO: 3351 - DNA, 1000 bp, Triticum aestivum
tgtcagctgattgatgacccccagacgtgtcaataacaggaacagccctcacgctcattgaagcatgggagaatctggtgatgagctccgctactgccggtctatgagcaaacctacaagagcctgaaatcaagaggaattcggtttcctggacgtgacaatgagagcctggcccccatatttactccaccacgctctgttgctgaagctgaagttgctgcaaatttctcccagcagatattcgaagatgtacatgtgcatacatatactgctgaagaaacaaaggaagctttcgatgtggcccgtaacagcatggaacttctttcaactgttcttgtcatcctcccctcagcaggatgctttgcaggatgacttaacaaccactcttgtgcaacaatgctaccaatctcaacatactatccagagattcatcgagacggctggggacaatgaggccttgctcttcgaggccttgagtgtgaatgatgaagtcctgaaagtgctatccaaatacgaagagatgaagaagcccatggcttcggcgcgtacagaacagccagtggtcataccaattgccacggagcatgaagattccgtgactgttggccatgaggatgccctggtcagaaaaccagctgctgctagagcaatgtcaggcggcgatgatgatatcctcgatgatctcgatgagatgatatttggcaagaagggaggaagcagttcccaggacgtgtccaaaaggcaggacccaaagaaggatgacctaatcaacttctaaataccggcccagcaagttgcggagttccattagggatacacagcatgtctgctgccttttatactgctgaacgatgtctgtattcatccggtagaagactgcactgcacgtacattcagttagggattgggtcgcttgtttatttgcatacgatgatactttgtcgtccacagtttgttcagttgataagttgctgcaacttctcatcttccagtttgcgtt

SEQ ID NO: 3352 - DNA, 1236 bp, Triticum aestivum
ccggactactgtcgttgttaccaaccagccggcaatctccatccacaagctctaaagaaagaaacgggcaatcagaaagccttctcttccaagaagtgacgcgggagaggggcagagcggcgcaagccatggccatggcggagcagcagcagcagatcgagcacagccacctcgccatcagaggcctcaacctccacgtagcccaagcaggcacaggcgagctcgggacggtgctgttcctgcacggcttcccggagatatggtactcgtggcgccaccagatgctggccgtggccgccgccgggtaccgcgccatcgcgccggactggcgggggtatggcctctccgaccagccaccggagccagaggcggcggtgtaccgcgacctggaagaggatctccttgccgtcctggatgcactatccgttcccaaggcttaccttgtggcaaggatttcggagccatgccagcttatgattttgctcttcgtcacccccccgtacatgcggtgttatgtgtttgggtatcccttttcttcacggtggctcctccttcactgccatgcccgaaggcttctatatactgcgttggcgggaaccaggaagagcagaggcagactttggcaggtatgacgtcaagcgagtcgtgcgcaccatctacattctcttctctagaagcgaaatcccgacagcgaaggaagatcaagaaatcacggatctcgcggacctgtcgactccccttccagagtggttcaccgaggaggatcttgcagtctacacgtccctctatgagaaatcaggtttcgtgtatccactgcagatgccatacaggtctctccataagaggcaaccaatcgaagacccaaattcgaagtcccggtgttcgtcgtcatgggggagaaagactacgtgatcaagttccccggggtcgaggccgtgttgaaaaatggcaccatggagaagtttgcgccggatctgaagatcacttacatccctgaaggaagccatttcgttcaggagcagttcccggacaaggtcaacgagctcctccttggcttcctcaaggaccatcctgtggcttgacacacggggtctataagtctattatgcttggcctgcacttggttgagcaccctactccgtgcacattctgcagtgttatgaacatatgatgcgtgcttcctgtgaagtgaaggatatgctagtttcatcaacaacctttaataataaatatacg

SEQ ID NO: 3353 - DNA, 998 bp, Triticum aestivum
tgcactatccgttcccaagtgccctctagccctcgattgtggggagaatcaatgtccgcttcaggggcttaccttgtggcaaaggattttcggagccatgccagcttatgattttgctcttcgtcaccccaaccgcacatgcggtgttatgtgtttgggtatcccttttcttcacggtggctcctccttcactgccatgcccgaaggcttctatatactgcgttggcgggaaccaggaagagcagaggcagactttggcaggtatgacgtcaagcgagtcgtgcgcaccatctacattctcttctctagaagcgaaatcccgacagcgaaggaagatcaagaaatcatggatctcgcggacctgtcgactccccttccagagtggttcaccgaggaggatcttgcagtctacacgtccctctatgagaaatcaggtttcgtgtatccactgcagatgccatacaggtctctccataagaggcatccaatcgaagacccaaaatttgaagtcccggtgttcgtcgtcatgggggagaaagactacgtgatcaagttccccggggtcgaggccgtcttgaaaaatggcaccatggagaagtttgcgccagatctgaagatcacttacatccctgaaggaagccatttcgttcaggagcaatttccggacaaggtcaatgagctcctccttggcttcctcaaggaccatcctgtggcttgacacacggggtctagtctactatgcttggcctgccctcggtctcataagaaccctactccgtgcacattccgcagtgttatgaacatatgatgcgtgcttccattgaagtgaaggatatgctagtttcatcaacaatctttaataaatacgtatgtatgttgggtccgtgttgtatctaatcctttagaacgccatagtgttcagtcctcctgggaaccgtgtatttcgccaaaaacctatctgaatttcacttggaattccaaggaatcgaatcgaagat

SEQ ID NO: 3354 - DNA, 734 bp, Triticum aestivum
ccacatgctaagatgaagatgaacactagtcccgaaggtaaacaaggagattgtcaagatgcagagagtgaatgctccagctgggcagatgcagctcaagggcttgattgaggcctatgttgaaaaaacgggcagcacgaaaggtgccaaaattctgaacgaatgggaggcatatctgccactgttctggcagttggtgccacccagcgaagaagactcgcctgaagcttgtgctgagtttgagagagtacttgccaggcaaaaaacagcagtacaatctgccaagtgatactagccgaagcccaatcgtcaaaatgatcaaagctaatcggaggttaagcgttcttactgcgatacttgaaagtgattttctcagaccgcggtccttctgaatcactaacgtcaccaaaggctgcaattttgtggaagctctgtccaaggcatcttctggaaacgagcttgcagattccgtcgaagattcttctgcacggtcttgcagcctaggtaaccaaccacccctgtaaattggttcgctgacgcttggctgcaaggcccggcccctgttgaactgctgctttcttgtacaggattcctggcttcgcctgtgtaattgtattttttgttctcgacacattagttcttctatttatacccgtcctgtggtaggcatgcgagttgcatgtgctttagttcagtatacagaaataaataaagtgtatgatgaagtaggactt

SEQ ID NO: 3355 - DNA, 1030 bp, Triticum aestivum
gtggagagctggttgtagttcctgtagatgatacaggacttgttcccgaggatgctgctatagttgggaacacttgtctgtatggagctacgggctgtcaagtatttgtgagatgcaagacaggagaaagatttgcagttcggaattctcttgggcaagcagtggttgagggcacaggagatcattgctgcgagtacatgaccggtggatgtgtagttgtactcggcaaagttggaagaaacgttgcagccggaatgaccggtggcctagcctacatgttagatgaagatgatacactagtcccgaaggttaacaaggagattgtcaagatgcagagagtgaatgctccagctgggcagatgcagctcaagggtttgattgaggcctatgttgaaaaaacgggcagcacgaaaggcgctaaaattctgagcgaatgggaggcatatctgccactgttctggcagttggtgccacccagcgaagaagactcaccagaagcttgtgctgagtttgagagagtacttgccaggcaaaaaacagcagtgcaatctgccaagtgatactagccaaagcccaatcgccaaaatgaccaaagctaaacggagggaaagcgttcttattgcgatactggaaagtgatcttctcagaccgcggtccttctgaagcactaacgtcaccaaaggctgcaattttgtggaagctctgtccaaggcatcttctggaaacgagcttgcagactccgtcgaggattcttctgcacgctcttgcagcctaggtaaccaaccacccctgtaaattggttcgctgacgctaggctgcaaggcccggcccctgttgaactgccgctttcttgtacaggattcctggcttcgctgtgtaattatattttttgttctggacacattagttcttatatttatacccgtcctgtggtaggcatgcgagttgcatgtgctttagttcagtatacagaataaatgaagtgtatgatgaagtaggacttctcaggtgtcgataactcggtggaact

SEQ ID NO: 3356 - DNA, 834 bp, Triticum aestivum
gttgagggcacaggagatcattgctgcgagtacatgaccggtggatgtgtagttgtactcggcaaagttggaagaaacgttgcagccggaatgaccggtggcctagcctacatgttagatgaagatgatactctagtcccgaaggtaaacaaggagattgtcaagatgcagagagtgaatgctcccgctgggcagatgcagctcaagggcttgattgaggcctatgttgaaaaaacaggcagcacaaaaggcgctaaaattctgagcgaatgggaggcatatctgccactcttctggcagttggtgccacccagcgaagaagactcgcctgaagcttgtgccgagtttgagagagtacttgccaggcaaaaaacggcagtacaatctgctaagtgatactagccaaagcccaatcgccaaaatgaccaaagctaaacggagggaaagcgttcttactgcgatacttgaaagtgattttctcagaccgcggtccttctgaagcactaacgtcaccaaaggctgcaattttgtggaagctctgtccaaggcatcttctggaaacgagcttgcagataccgtcgaggattcttctgcacgctcttgcagcctaggtaaccaaccacccctgtaaattggttcgctgacgctaggctgcaaggcccggcccctgttgaactgctgctttcttgtacatgattcctggcttcgcctgtgtaattatattttttgttctgcacacattagttcttatatttatacccgtcctgtgttaggcatgcgagttgcatgtgctgtagttcagtacagaataagtaaagtttataatgaagtagg

SEQ ID NO: 3357 - DNA, 465 bp, Triticum aestivum
gcggggaagctatttcatttatcggctgtgatgataatcagacatcagcggatacttcagccttgtcaaagatcacttcgactggcgcaatgacattttgcttcatccaagctattgaacaaggccaggccaccacatatgggagtatcctgaactccatgcgttcgacaatacggaacacgggaagtggtgcctcaatggctggaggtggtgcagttacatcactcatttcaatgcttctcacagggggaagcgctagtactggtggattgagacaggtaacttcttggggttggcatatgcatctcagaatatccttattggaaccacagctaactgcatgtgacacatttgatgtgtatgcgaaaccattttcactatgatacatttgtggtattctccattgtgttctgtgattctatcatgagtccgggtttaactatcatgtacagctagttgaaatgg

SEQ ID NO: 3358 - DNA, 1004 bp, Triticum aestivum
cctcaccacccgcttcagttccccgacgactccatcatcatgctcaccgaagaacaaaccgacccttacaaaatcccaacaaagcataacataaggatggccatgtattggcttttacaaggttgtcaacctggagactcattggtgtttcattattctggccatggggcgcaacaaagaagctacagtggagatgaagttgatgggatggatgaaaccctctgcccgttggattttgagacacagggaatgattgtggatgatgagataaatgctgcgcttgttagaccacttccccatggagctaaacttcatgcactcatagatgcttgccacagtgggactgcacttgatttgccgtttctctgcagaatgagcagaactgggcaatacgtatgggaagatcacagaccgcgatctggtgtctggaaaggaactagtggcggggaagctatttcatttagcggctgtgatgataatcagacatcagcggatacttcagccttgtcaaagatcacttcgactggcgcaatgacattttgcttcatccaagctattgaacaaggccaggctaccacatatgggagtatcctgaactccatgcgttcgacaatacggaacacgggaagtggtgcctcaatggctggaggtggtgcggttacatcactcatttcaatgcttcttacagggggaagcgctagtactggtggattgagacaggagccacagctaactgcgtgtaatacatttgatgtgtatgcgaaaccattttcgctatgatacatttgtggtattctccactgcgttctgtgattctatcacgaggccgggtttaaactatcatgtacagttaacaggtgcaatggcttctccatatatagagctaactttgtatcatttgatgctcatattcgaattaaagtgtttgccccctttgaattgttccatgtgtgagggattcgccatttattctgtcactcagaccacataataagatatggtgc

SEQ ID NO: 3359 - DNA, 973 bp, Triticum aestivum
  misc_feature (117)..(117): n = any nucleotide
  misc_feature (154)..(154): n = any nucleotide
  misc_feature (199)..(199): n = any nucleotide
  misc_feature (211)..(211): n = any nucleotide
atttgaaacactctatttagctatggaactaggtgtagactatgttgacatcgagttaaaggttgctgacaaatttgttggttttctttctgggtaataagccagataagtgtaaancttacttgtttcttcacataattatgaacagtacccncatcctggcgaggcatcttggcaaatcttgtagccaggaatacanagaagttggagnctgacatagttaaagttgcaacaactgctacagacattgttgatgtgtcaaggatgttccaagtgatggtgcactgccaagtgcctatgattggattggtgatgagtgagagaggtttgatgtcaagggtgttatccccaaaatttggtggatatcttacctttggaatacttgatgctacaaagacatcagcatctgggcaaccaacacttgaagaattattggacgtttacaatataaggtgtataggacctgatacaaaagttcttggtcttatagccaacccagtaaagcagagcaagagcccaattttgcacaataaatgtctacaatctgttggatacaatgctgtttatcttccacttctggcagacgatcttgctagatttcttgacacatattcatctccagatttttcaggatttagttgctctcttcctttcaaagtggatgcagtacattgttgccatgaacatgatgctgttgctaagtcaataggtgccataaacactatagttaggaaatcagacggcaaattagtgggctacaatacagactacattggagcaatttctgctattgaggatggtctggggtcaaaggatgctgctatgtcaccattgtctggcaggcttattgttgttgtaggtgctggtggtgctgctaaggcaattgcctatggggcaaagaagaagggtgcaagagttgtagtagcaatcgtacctatggtaagatttgtatttatccgatttgaaattcata

SEQ ID NO: 3360 - DNA, 960 bp, Triticum aestivum
ggaggtgggggcgggggagggggaggaaaccctagctccggcggcacggcggcggcgctccggcacgacccgggcctgtcgcgggagtggacgccggaggagcaggccatcctcgacgagctgctcgtcaagtatgcatctgatgcacctgttattcggtatgcaaaaatagccatgaagttgccagagaaaacagttcgagatgtggctttgcggtgtagatggatgagtaaaaaggagagtggtaaaagaaagaaagaggaccacagctcatcaaagaaaagcaaggacaaaaaggagaaggttgcagattcttcatcgaaaccacctgttcatatagctggaaggccgagtgttccgccatactccctcccagcacttcccgttgatgatgacgaaatttcatccaaagcaattggaggtccaacaggagaactccttgaaactaacgcccaggttttaagtcaaatttcaacaaaccttggcaccatgcagatacaggataacatctctctgctgtgccaaactcgagataacatactcagggtgttgaaagagatgaatgatgcccccgagatcatgaagcagatgccaccactacccgtgaagataaacgaggatcttgtcaactccatactccccaggccaactgtacctatgcagtagtgatagtgaatggaatgtgtcttccatagtctgaagagccccttagataggcagcaaaaataatactcctaagaaaaatgccagccttggccctagttcgttcgttttagacccttcctcatgtcatatatgtatctgcagatgttgatcttccaactgttactcaaattagggggttggaacatgtacagggctaccaggggttgcttctactgcagttgtgagtttccaactctggcattctttgtagtgtaatagcctaatgtgaatgtgatggaatatgtgagttggcct

SEQ ID NO: 3361 - DNA, 574 bp, Triticum aestivum
agaatcctgggaactatcagtgagcttcattagcatcatcttgattccgattgtcgggaatgcacagagcatgctggggcaatcatatttgcttttaagaacaagctggacatcaccctcggagtatctctggggtcagctacgcagatttccatgtttgtggtgccactgagtgtccttgtggcttgggtcatgggggttccaatggatcttgatttcaacctgctagagactggttctttgttcctcgcaatattggtcacaagcttcaccctccaggacgggtcgtcgcattatctgaagggactgcttctcctcctttgctacgccgtgatcggcgtgtgcttttttgtcctgagacgacgttcagctgatggaagcaactaatcgggttcagcctagcagatcggcttagttcagggttccccgaaaaccggacggtgattaagctgaagatggtgaagagaagaaggtagtagagtacctccctggggcagatgagcaagattgtagatcgagactgaatcaggtgtttatggtcatcgcagtcctgtaaattaatcgagtttaatgt

SEQ ID NO: 3362 - DNA, 652 bp, Triticum aestivum
atcatcttgattccgattgttgggaatgcaccagagcatgctgggccaataatatttgcttttaagaacaagctggacatcaccctcggagtatctctggggtcagctacgcagatttccatgtttgtggtgccactgagtgtccttgtggcttgggtcatgggggttccaatggatcttgatttcaacctgctagagaccggttctttgttcctggcaatattagtgacaagcttcaccctccaggacggatcgtcgcattatctgaagggactgcttctcctcctttgctacgccgtgatcggcgtgtgcttttttgtcctgagacgacgttcagctgacggaagcaactaatctggctcagcctagcagatcggcttagtccagagtgccggtgattgagttgcagatcgtgaagataagagaagaaggtagtagagcacctccctgggcagatgagcgtgcatgaggcagcagctaagccaagcagtagggcctgcctgcctgcgtgtaagattgtagatcgagactagtgttggctaaatcaggtgtgtttatggtcatcgcaggcctgtaaattaatcgagtttaatgtatccattagtgcacctaaaaggctatggtagctacggaggtaattaaggcaggagca

SEQ ID NO: 3363 - DNA, 588 bp, Triticum aestivum
accgtgatttcaggcgtaagaaagatgatggtacagaaccagaagttgacccagaaagagatcaaaggactgtatttgccttccagctatcgttgaaggcagatgaaagggatgtctatgagttcttctcaagagcagggaaggttcgtgatgtccgccttatcatggaccgaaactcgcggcgttccaaaggagttgggtacatcgagttctatgatgtcatgtctgttccaatggcaattgctctaaccggtcagccgcttctagggcaagcagtaatggttaagccatcagaggccgaaaagaacttagctcagtcaaatgcgacatctggtggagcagcttcaggtggagcaagaaagctgtatgttggcaaccttcattccaatattaccgaggaccaattgagacaggtctttgaaccatttgggcaagtggagcttgtccagctgcctgtagatccactcactgggctatgcaaaggttttggtttcattcagtttgcatcttttgtgataattggagatttcttctttttctttgtagcagtatacgagaatgatggatttttttctatgccatataaaa

SEQ ID NO: 3364 - DNA, 586 bp, Triticum aestivum
cctggagaacatcgcctacggcaaggacggcgtgacggaggaggaagtcgtcgaggcggccaaggtggccaacgtgcacggcttcgtcggcgcgctccccgacggttacaggacgcccgtcggcgagcgcggcgtgcagctctccggcggccagaagcagcgcatcgccatcgcccgcgcggtgctcaaggacccggccatcctcctgctggacgaggcgacgagcgccctggacgcggagtccgagtgcgtgctccaggaggcgctggggcgcatcatgaagggccggacgaccgtgctggtcgcgcaccggctgtcgaccatccgctgcgtggactccatcgccgtggtgcaggacgggcgcgtcgtggagcagggcagccacggcgatctcgtgtcgcggccggacggcgcctactcgaggctgctgcagctgcagctgcaccacgggtgacgatgatggattggcgtcctgctccggcatggcggctgtagatacagagtagaccgaggcgagctttgatcgacactccgatgagcaacagggatttgctgtagtgcggcggcggcccaaatggtgataggt

SEQ ID NO: 3365 - DNA, 906 bp, Triticum aestivum
gagttcagcctgaggatccgagctggccagagccaggcgctcgtgggagcgagcgggtcggggaagagcactgtcatcgctctcatcgagcgtttctacgatcccatggccgggaaggtcatgatcgacggcaaggacatccgtcggctcaacttgaagtctctccgtctcaagatcggcctggtgcagcaggagcccgtcctgttcgccaccagcatcctggagaacatcgcctacggcaaggacggcgtgacggaggaggaggtcgtcgaggcggccaaggtggccaacgtgcacggcttcgtcagcgcgctccccgacggctacaggacgcccgtgggcgagcgcggcgtgcagctctcgggcggccagaagcagcgcatcgccatcgcgcgcgcggtgctcaaggacccggccatcctcctgctggacgaggcgacgagcgccctggacgcggagtccgagtgcgtgctccaggaggcgctggggcgcatcatgaagggccggacgaccgtgctggtcgcgcaccggctgtcgaccatccgctgcgtggactccatcgccgtggtgcaggacgggcgcgtcgtggagcagggcagccacggcgatctcgtgtcgcggccggacggcgcctactcgaggctgctacagctgcagctgcaccatggatgatgatggattggattggcgtcctgctccggcatggcggctgtagatacagtgtagaccgaggcgagctttgatcgacactccgatgagcaacagagatttgctgtagtgcggcggcggcggcccagatggtgataggtgttagccggaagaactagtgttctcttttctctgtaaccgatcaggattatgatgaaggccttgttacattttgttcccacttgcacttatgtccgg

SEQ ID NO: 3366 - DNA, 897 bp, Triticum aestivum
ctgttcctgctgcgtatgctggggcttatgcaatccaagtgctgctgcttccggttaccagggtggccctccaggcgctaatagaggaccctggggcagtcaagctccgtctggttatggcactgggggttatgctggcaatgcaggctatggtgcatggaatagctcttctgctggtgggaatgcacccactagtcaggcacctggtgcagctgcaggttatggaaaccagggctatggttatggtggatatggaggagatgcatcatatggtaatcatggagggtatggtgcttatggtggccggggagatggtgctggaaatcctgctactggtgcagcctctgggtatggtgctgctggatatggaagtgggaatggaaactctggatatccaaatgcgtggactgatccttcacaaggcgggggatttggtggtgcagtcaatggagcttctgagggccaatcaaattatggcagtggttatggtggtatgcagcctagggttgctcagtagaagaggctgttataatgttcatggtgtgaaccagtgcatttgggcagcatatgtattattgcggtattctggctttgctctcgtcttcctgaaggccatccattctgccggttaaatcagtatttctcctggttggaatgcttgatcctttcgtggcttaactagaacttaagtcaataagtagctattatgtcgagtagctgtatcttcataatgctttatttatgtttagcttatcctttggtgtgctttgtcatgagtggagtttcaggttgctttatctctagtttaaagctagagtagcttcactgcttatggaccaaattatctagttgtatctctattctacagaatcatatattcgtgtttgactgtagtat

SEQ ID NO: 3367 - DNA, 773 bp, Triticum aestivum
gcaatgcagctatgtgcatggaatagctcttctgctggtgggaatgcacctactagtcaggcacctggtgcagctgcaggttatgggaaccagggctatggttatggtggatatggaggagatgcatcatatggtaatcatggagggtatggtgcttatggtggtcggggagatggtgctggaaatcctgctactggtgcagcctctgggtatggtgctgctggatatggaagtgggaatggaaactctggatatccaaatgcgtggactgatccttcacaaggcggaggatttggtggtgcagtcaatggagcttctgagggccaatcaaattatggcagcggttatggtggtatgcagcctagggttgctcagtagaagaggctgttgtaatgttcatggtgtgaaccagtgcatttgggcagcatatgtattattgcagtattctggctttgctctcgtcttcctgaaggccatccattctgccggttaaatcagtatttctcctggttggaatgcttgatcctttcgtggcttaactagaacttcagtcaataagtagctattatgtcgagtagctgtatcttcataatgctttatttatgtttagcttatccttcggtgtgctttgtcatgagtggagtttcaggttgctttatctctagtttaaagctagagtagcttcactgcttatggaccaaattatctagttgtatctctattctacagaatcatatattcgtgtttgactgtagtatttatgctggatactc

SEQ ID NO: 3368 - DNA, 1340 bp, Triticum aestivum
accgatgttgtggtgatgtatgaccagacaacacagcgcccccggggcttcggcttcattacctttgactcggaggatgcggttgaccgtgtgctgcacaaaaccttccacgatcttggagggaagatggtagaggtgaagcgtgctctgccccgagaggcgaatcctggctctggcggcggcggccgttccatgggaggtgggggttttcatagtaacaatggacctaactccaatgctagcagctatgatggcagaggcgatgctagcagatatgggcaggcgcagcaaggcagtggtggctacccaggttatggcgctggagcttatggcagtgctccaactggatatggatatgggcacaccaatcctggaactacatatggaaattatgggtctgcagggtatggaggtgttcctgctgcgtatgctggggcttatggcaatccaagtgctgctgcatctggttaccagggtggccctccaggcgctaatagaggaccctggggcagtcaagctccatctggttatggcactgtgggttatgctggcaatgcaggctatggtgcatggaatagctcttctgctggtgggaatgcacccactagtcaggcacctggtgcagctgcaggttatggaaaccagggctatggttatggtggatatggaggagatgcatcatatggtaatcatggagggtatggtgcttatggtggtcggggagatggtgctggaaatcctgctactggtgcagcctctgggtatggtgctgctggatatggaagtgggaatggaaactctggatatccaaatgcgtggactgatccttcacaaggcggaggatttggtggtgcagtcaatggagcttctgagggccaatcaaattatggcagcggttatggtggtatgcagcctagggttgctcagtagaagaggccgttataatgttcatggtgtgaaccagtgcatttgggcagcatatgtattattgcagtattctggctttgctctcgtcttcctgaagaccatccattctgccggttaaatcagtatttctcctggttggaatgcttgatcctttcgtggcttaactagaacttcagtcaataagtagctattatgtcgagtagctgtatcttcataatgctttatttatgtttagcttatccttcggtgtgctttgtcatcagtggagtttcaggttgctttatctctagtttaaagctagagtagcttcactgcttatggactagttgtatctctattctacagaatcatatattcgtgtttgactgtagtatttatgctggatactctctccctatctgtgttaagtcctt

SEQ ID NO: 3369 - DNA, 1249 bp, Triticum aestivum
agataatgcaaaagacctgtaaggggaatgcttaacccagatccaaggaggcgtttgacagctcagcaagtgcttggtaataatcaaatttccacaagataactgtactggattggattccttctgttcttcttaaatggatacagaattacatacattgtgtaaatttcagaagatttccgccctaagatcatttaattgcattgcttgtgtctcatgttcataatttgtattttcttccagatcatccctggtgacagaatattaagaaggctccaaatgtcaatctgggtgagacagttaaggccagacttcaacagttctctgtgatgaacaagttcaagaagcatgcacttagggtatacctcagtctgacttgaaccaatcctctttcacgttagacttgctttctagaaatttccttacatatttgtatttattacaggtcatagctgagcatctttcggtagaagaggtggccggcataaaggatatgtttgaaaagatggaccttaacaaagatagtatgattaattttgatgaactgaagcttggactgaataaacttggccaccaaatgcctgatgcagatgtccaatactaatggatgctgctgacgctgatggaaatgggtgcttagactatggagaatttgttactctgtctgttcacctgaaaaagatcggcaatgacgaacatctgcacaaggcatttggatactttgatcggaacaagagtggatatattgaaattgatgaactccgggagtcattagctgatgatctgggaccaaatcatgaagaggttatcaatgccatcatccgtgatgtggacactgataaggatggcaagataagctttgatgagtttgtggcaatgatgaaggccggaaccgactggaggaaagcctcgagacaatattcgagagaacggttcactagcctcagcttgaagctgcagaaggacggatcgttgcagataacaagtacccaatagtagatgataccgcaataggcaagttgtgaattccagatgaaaaccaaccttgtgtagcttcctggttttgttgacaagtatttcttttgttcatctgggtattctgttgcgctctaatttccgcttggtatcctgatgaagcattagttgattgttgaagatttattttgtacgtagattgtgtgatccagaccatcacaaaaagtactacgcctttgatgaaaggtagtgtacaagagaaagaggaaaaagt

SEQ ID NO: 3370 - DNA, 937 bp, Triticum aestivum
cgccgagtcgccgtcccctcgctttcaacccccctcgggcgaaagcaagaattcctcgctagaatccgaccccgggccgatttgcgtggcttctgtgcggccctttctgcgccatggacttctgatccggggcctctcggatcttggggggaagaaggtgggtggcgggcggtggtcggtgagccggccgggagatggccggcgggaaggagccgatcgaggtcaagttccggctcttcgacggcacggacatcggccccagcaagtacgaccccgccaccaccgtctccgcgctcaaggacttcatcctcgcccggtggccgcaagataaggaaataactccaaaaactgtcaatgacctgaagctcatcaatggtggaaagatattggagaataaccggacacttgccgagtcgcgtgttacaataggagaggtccctggaggtgtaattacaatgcatgtggtagtgcgccctccacaagttgacaaaaaccgtgagaagcagctgggcaattcccccaagcagaacagatgcggatgcaccatactgtgatacggcacccccctggtgatgttcgatgcgcctagttgtagaatttctcttgtgcttttgttgcgtccacgacgcggtgtgtattcattttgacatccagttcatggagccattgaaactcgatctagaaacgcatgcatgtactcctgaaagcatgtttgggaatctggtgggactggctgggagtgaaggttcctccttgggatgttgctgatgtgtgcaggagtcaaggaatggatcggatgcttgctgttgtgtaaattgtaatgtggaaacaaccatcttttcatttttcctttggctactgtttgacattatatcgattctttttagcgctgctgtttgccatgtaaaacagatatattgtaccatcctggaatata

SEQ ID NO: 3371 - DNA, 681 bp, Triticum aestivum
caagttccggctcttcacggcacggacatcggccccagcaagttacgaccccgccaccaccgtctccgcgctcaaggacttcatcctcgcccggtggccgcaagataaggaaataactccaaaaactgtcaatgacctgaagctcatcaatggtggaaagatattggagaataaccggacacttgccgagtcgcgtgttacaataggagaggtccctggaggtgtaattacaatgcatgtggtagtgcgccctccacaagttgacaaaaaccagaagcagctgggcaattcccccaagcagaacagatgcggatgcaccatactgtgatacggcacccccctggtgatgttcgatgcacctagctgtagaatttctcttatgcttttgttgcgtccacggcgcggtgtgtattcattttgacatccagttcctggagccattgaaactcgatctagaaactggctgggagtaaaggttcctccttgggatgttgctgctgtagcaagtgtgtgcaggagtcaaggaatggattggatgcttgctgttgtgtaaattgtaatgtggaaacaaccatcttttcatttttcctttggccatgtttgacattataccgattctttttagcgctgctgtttgccatgtaaaacagatatattgtaccattggaatatatatacggt

SEQ ID NO: 3372 - DNA, 662 bp, Triticum aestivum
cccggagatgccgcggaaggaccgatcgaggtcaagttccggctcttcgacggcacggacatcgggcccagcaagtacgaccccgccaccaccgtctccgcgctcaaggacttcatcctcgcccggtggccgcaagataaggaaataactccgaaaactgtcaatgacctgaagctcatcaatggtggaaagatattggagaataaccggacacttgccgagtcgcgtgttacaataggagaggtccctggaggtgtaattacaatgcatgtggtagtgcgccctccacaagttgacaaaaaccagaagcagctgggcaattcccccaagcagaacagatgtggatgcaccatactgtgatacggcacctccccggtgatgttcgatgcgcctagttgtagaatttctcttgtgcttttgttgcgtcaacggcgcggtgtgtattcattttgacatccagttcctggagccattgaaactcgatctagagacgcatgcatgtactcgacactcctgaaagcatgctggggatctggtgggactggctgggagtaaaggttcctccttgggatgttgctgctgtagcaggagtcaaggaatggattggatgcttgctgttgtgtaaattgtattgtggaaacaaccatcttttcatttttcct

SEQ ID NO: 3373 - DNA, 1047 bp, Triticum aestivum
gtggaggtatattctgcaaagaatgttccaagggaagatgcttgatgcccatgaagttcagactgcgtgatcctcagagagtgtgtgatgcttgctacgacagacttgatccactccaggccttattgatcaactacaacagtcatgccatgcagcctgccaaacatgacgtcatggattggacaagtacgaggagctggttgaatttgcctgttggattgtcaatggagtatgaaatatacaaggcaacaaacacactgaggaaatattgccaggtttctagattaaatcctgagaagtcataccatcatctatcctcaagggagcaaaggggcttgctgtgctcacagtggccaagcagatgcagttcttacgtacaaaatgggcactggtcttgtagttgctcgccgatcagatggatcatggtctgcgccatcagcgattttatctgttggattgggatggggagtgcagattggaggagaattgacagattttataattgtgcttcatgatcttaaagctgtcaaggcattcagcagccgcatgcatctttctcttggggcaggattgagtgcggcagcaggaccaattggcagagcccttgaagcagatgttcgagcaagtgaaaaaggttctgggatatgctacacttatagctgcagcaaaggtgcctttgttggggtctcccttgaaggaaatgtcgtgacaacaagaccagacaccaatctgcgcttctatggggacgcctacgtgaccacgaccgatatcctgtttgggagggtggagaagcccagagctgcgcaacccttgtactcggctctcgatgatctgttctcaaaaatggtttgctagttctagccattgtagtctcagcattcagcggtgtacatatatctaaaatatgctaggaacagtccttgggagaaaatatcccagaaaaaaatgtacagcttttattgggtgggttcactgcaagtatgtgtccacgcatgtaaatattgtcaggagatcactatgttatccgccgtcgtggcttgattattg

SEQ ID NO: 3374 - DNA, 608 bp, Triticum aestivum
aagctgtctgactatggatttagaaagctgttgcctattctaggtagctttgaagtgagcagatcttatgctgccatcgggtccattgccccggagctagcatccccgagcttgagatacagtgataagagcgatgtatttagctttggggtggtgttgcttgagattgtgacagggcggaagccagtggagagccctggggctgctatacatgtgattttgcgcgactatgtcagagagacactggaggatggtactaaatcggactgcttcgatcggagcctgaggggattcattgaagccgagttggtccaagtgctcaaactaggcctggtatgcacttccaacacaccatcaagccgaccaagcatggcggaggtggtgcagttcttggaatctgttaggactaattcttgatgttctgctatctggaacatagtagcagaataggatgttaaaacaggaaaagggttttctgattttttaacagatgaagatcacatttcttctttaattctttattattattattgtggccccagtccttttgtaaatgtgtttagatttgtctgctcattatctatacttttttttagatctgtttgatg

SEQ ID NO: 3375 - DNA, 1383 bp, Triticum aestivum
gggaaacccattactatgtggatcaccattgaacaatctgtgtggtggacagcgagcaagacgattgtcagtcgctatcataatcgtcattgtcgctgcagcgctcatacttattggggtctgcattgtctgtgctatgaacattagggcctatacaatgaggagtaaggaggagcaggaagggaaggaggacgaagaggtgctggtctccgagagcatatcagtcggatctctaggccaaaatgccatcattggtaagttggtgctcttcaccaagagcctgccttcaaggtatgaagattgggaggaaggaaccaaggcactggttgacaaagactgccttgttggtggagggtcagttggcacggtgtacaaggccacctttgagaatgggttgtccattgccgtgaagaaactggagacactcggaagtttgacaaaccaggatgagtttgagcatgagatggggcagcttggtaacctcaaccaccccaatctggtcacatttcagggttattactggtcgtcctcgatgcagttgatcctgtcggagttcgtgaccaaagggagcttgtatgatcacctgcatgggaaccgtcgtcgtgcattttccagaagtagcagcggaggtgagctctcctgggatcggaggtttagggttgcacttggaacggcgcgtgcacttgcatatcttcaccatgactggcgaccacaagtcttgcatctcaacatcaagtcttcaaacataatgatagatgaagaatatgaagccaagctgtctgactatggatttaaaaagctgctgcctattctaggtagctttgaagtgagcagatcttatgctgccatcgggtacattgccccggagctagcatccccgagcttgagatacagcgataagagtgatgtatttagcttcggggtggtgttgcttgagattgtgacagggcggaagccagtggagagccctggggctgctatacatgtgattttgcgcgactatgtcagagagatactggaggatggtactaaatcggactgcttcgatcggagcctgaggggattcattgaagccgagttggtccaagtgctcaaactaggcctggtatgcacttccaacacaccatcaagccgaccaagcatggcggaggtggtgcaattcttggaatctgttaggactaattcttgatgttctgctatctggaacatagtagcagaataggatgttaaaacaggaaaagggttttctgattttatttttttaacagatgaagatcacatttcttctttaattctttattattattgtggccccagtccttttgtaaatgtgtttagatttgactgctcagtatctatagtttttttagatcatctgcagga

SEQ ID NO: 3376 - DNA, 1002 bp, Triticum aestivum
cacccaaggattaatcaggttgttccgccacagtttgggaccagaaggaaaggtggaactcatatcttgtatgaatccttctgttagtcagaggggagttcttgtatgtgttggacgagcaccaaggaaaaaatctgttgatgattatgaggtgcaacctttaatacacaacccacatgcactgcctctattcagagatcaaccaagccgtaaacgccaaagagagaagatgatgaaagaccccctcaaatcgcacaaaccagaagctcctgttagtggtccagggtttggtggtaaaattggcacaacaaaggcagcttgctgacacagtatctcatgaaggaaggtggtttaattaaggagacctggatggatgaagatccaagagaggcaattttgaaatatgctgatgctgcaaagaatgacccaagtttattgcaccagcatatgctcaaactcagccggaaaccgtcttcgcagagtctgattccgacggagaagagaaaaagtaacatatggatgtaagctattttgtttctttagtaaaatgagcttttggcacaacaatgttctgttttctgacggagtgaatctaatgcagcgactattaagtttcttgcatgagtcctgcaacatgtacttttactgaggagaaactatagaatgctgaattagccaccatcgggagctcgttttttctgaagatacccagggaaaagcttgtcgcacaggaaaactgttacaataagacgggtccactcaagctcctttgtcaagtgaatgaagattaacataccagattcatgttacatcaggatgaggtttttgctgtaccttcagtttaccagccattatccatactctgcacgcttgatccagtgtatcgccattagcccacgagaaagctgtactgttttttccttccgtgttgttgtcgtctttgtgatgattgatgtgacgtgtagagtagacaaggaagaccgatttgcacttttcatcatg

SEQ ID NO: 3377 - DNA, 1070 bp, Triticum aestivum
ggaaaatgaagactcctttgaaagtgttcgacgatctgcgtaataactatgcggagacaaatgcttcatttagttcagacgagcaacttatttttacaggaacctctgttgagaaagatggcagaaatggaggcctactttgcttctttgatagaaggaaactagagcttgtatcaagggtgggaatttcaccacattacagtgtgataaggtcactctggcacccaaggattaatcaggtgttcgcaacagttggggacaagaaggaaggtgggactcatatcttgtatgatccttctgttagtcagaggggagctcttgtatgtgttggacgagcaccaaggaaaaaatctgttgatgattatgaggtgcaacctttaatacacaacccacatgcactgcctctattcagagatcaaccaagccgtaaacgccaaagagagaagatgatgaaagaccccctcaaatcgcacaaaccagaagctcctgttagtggtccaggtttggtggtaaaattggcacaacaaaaggcagcttgctgacacagtatctcatgaaggaaggtggtttaattaaggagacctggatggatgaagatccaagagaggcaattttgaaatatgctgatgctgcgaagaatgacccgaagtttattgcgccagcatatgctcaaactcagccagaaaccgtcttcgcagagtctgattccgacggcgaagagaaaaaataacatatggataattagcaaccatcgggagctcggttttttctgaagatacccagggaaaagttgtcgcacaggaaaactgttacaataagacgggtccatcaagctcctttgtcaagtgaatgaagattaacaaaccagattcatgttacaacaggatgaggtttttgctgtaccttcagtttaccagccattatccatactctgcacgcttgatccagtgtatcgccattagcccacgagaaagctgtactgttttttccttccgtgttgttgtcgtctttgtgatgattgatgtgacgtgtagagtagacaaggaagaccgatttgcattttcaaaatg

SEQ ID NO: 3378 - DNA, 878 bp, Triticum aestivum
tgcctcgagccgccgtcgccatggggagaagcctgcgaggtgctatcggcagatcaagaacaagccataccccaagtcaaggtactgccgtggtgtgcctgaccctaagatcaggatctatgatgttggcatgaagaagaagggtgtcgatgagttctctcactgtgttcaccttgtctcatgggagaaggagaatgtgtccagtgaggctctcgaggctgcccgtattgcttgcaacaagtacatgaccaagcatgcaggaaaggatgccttccacctcagggtcagggttcacccgttccatgtgctccgtattaacaagatgctttcgtgcgctggggctgataggctccagactggtatgaggggtgctttcgggaagccgcagggagtctgtgcccgtgttgccattgggcaggtcctcctttctgtgcggtgcaagcccaacaatgccatccatgccactgaggcccttcgtcgtgccaagttcaagttccctggccgccaaaagatcattgagagcaggaagtggggcttcaccaagttcaaccgcaacgactacctcaagttcaagagtgagggcaggatcttgcctgatggagttaacgccaagctgctcggatgccatggccgccttgcgaaccgcgcccctggacaagctttcctgtctgccgcataatctagcagaagactatcagttctgtcgaagcttattttactgtgtggaacttagattccaagcacctgtggtgctatgttattttgtctgaatgttgtgtcgaaccttgttatcgaagatattatctattttgtgatgatggtactaatatgaatggcctgttgaatcattgctgcttgaatttgtttttcaatgtatt

SEQ ID NO: 3379 - DNA, 858 bp, Triticum aestivum
gtcaaggtactgccgtggtgtgcctgaccctaagatcaggatctatgatgttggcatgaagaagaagggtgtcgacgagttctctcactgtgttcaccttgtctcatgggagaaggagaatgtgtccagtgaggctcttgaggctgcccgtattgcttgcaataagtacatgaccaagcatgcaggaaaggatgccttccacctcagggtcagggttcaccccgttccatgtgctccgtatcaacaagatgctttcgtgtgccggggctgataggctccagactggtatgaggggtgcttttgggaagccgcagggagtctgtgcccgtgttgccattgggcaggtcctcctttctgtgcggtgcaagcccaacaatgccatccatgccactgaggcccttcgtcgtgccaagttcaagttccctggccgccaaaagatcattgagagcaggaagtggggcttcaccaagttcaaccgcaacgactacctcaagttcaagagtgagggcaggatcttgcctgatggagtcaacgctaagctgctcggatgccatggccgccttgcgaaccgtgcccctggacaagctttcctgtctgccgcataatctagcagaagaagtctatccgttctatcagaacttattttactgtgtggaacttagattccaagtgcctgtggtgctatgttattttgtctgaatgttgtgtcgaaccttgttatggaagatattatctattttgtgatgatggtactaatatgaaccgcctgttgaatcattgccgcttgaattcgtttgtcaatgtattttgctgtggtggatgcttcattttatgaagctacatcaggaaaatgttata

SEQ ID NO: 3380 - DNA, 592 bp, Triticum aestivum
gcgtccgtatgaattgctctacggcaagacaccattcaggggacctggcaatgatgaaacacttacaaatgtggtctcacaggggctgaagttccctgatagcccagctgtcagctaccaggctcgcgatctgatcagagggttgctcgtgaaggagccagagctccggctaggctcgaggaaaggagctgccgagatcaagcggcatcccttcttccaaggcctgaactgggccttgatccgttggactgcaccgcccgagaccccgaagagcgtcgacgcctcaaccctcactgcagcggtggcacggaagaagaaggaaggcaagtgcctcgagttccggatgaatggagacgacattgagtttgagctcttctagtggtggcggtagtagcagtagaagttgtagtggtagtacgttgtgttctgaagaatatccataccgtggtagctagaagtagtagtcccacagttccccagtccccactcccctgcagtttttctgttgaagatgagttatcagttgtcacctgccaatgttgggatgtagagtaactgagtaaggtcgggcgttgtgcctgtaactttatta

SEQ ID NO: 3381 - DNA, 1348 bp, Triticum aestivum
gtcttgcctagtgatggagtattgtccaggcggtgacctgcatgtcctaaggcagaagcaacctactagatgcttttcagaagccgctgctaggttttatgtcgctgaagttctcctagcattggagtatctgcatatgttgggggttatatatcgcgatctgaagcctgagaacatacttgttcgtgaagatgggcacatcatgctctccgactttgatctgtccctgaggtgttcagttaatcccatgcttgtgaggtgctcatcagtaggaagagatgaacctcctaggccttccggaccttgtgctgaaagctgcatcgatccactgtgtatccagccatcctgggccaactcttcttgcttcacacctcggctggtatcttctacaccttccaggacacggagagctgagcccctgaagaaaccatcacttccgcagcttgttgtcgagccgactgatgcaaggtcaaattcgtttgtcgggacccatgaataccttgccccggagatcatcagaggagatggccatggcagctcggtcgattggtggactcttggcatctttctgtatgaattgctctacggcaagacaccattcagaggacctggcaatgacgaaacacttacaaatgtggtctcacaggggctgaagttccctgatagcccagctgtcagctaccaggctcgcgatctgatcagagggttgcttgtgaaggagccagagctccggctaggctcgaggaaaggagctgccgagatcaagcggcaccccttcttccaaggcctgaactgggccttgatccgttggactgcaccgcccgagaccccgaaaagcgtcgacgcctcgacccttacggcagcggtggcacggaagaagaaggaaggcaagtgccttgagttccggatgaatggagacgacattgagttcgagctcttctagtggtggcagtagtagcagtagaagttgtagtggtagtacgttgtgttctgaagaatatccataccgtggtagctagaagtagtagtcccacagttccccactccccactcccctgcagtttttctgttgaaaatgagttatcagtagagtaaggtcgggtgttgtgcctgtttattccttgttaataccagtccagatatccagatgagcccatgggtcttgtgcaagcatttttcttttgaatgcagccatggtcttgcaagcaatggcatctggttgcagttgtgcactactgcttgcagtagtcgttgttgcttgatacagtatgtagcagtagtaactcaagtaaggtccagtaataagttgtgtaacatatgttcttgttcattaataatatcataaagt

SEQ ID NO: 3382 - DNA, 765 bp, Triticum aestivum
ctcaggatcattcgggaagctcgatttcctgataaacatcaggcatttcaggctgatcgagatcccagttctgcttgcgaaagttaaagaacaggttgaaagcatggatgtagatcagagagttcaatggatgaaagaaaattccaaggagacatatgaggaagcacaaagaatgcatgagaacaactactatggggcaaagcttgtcacagaggcactacttcctcttcttcagttgtcctcctctgggagaattgtcaatgtctcatcaggtttttcactgctaagaaacttcaacagtgaagaactgaagaatgagtttaacgacgtcgacaaccttactgaaaagagactagaggagctgttggattcattcctagaagatttcaaggccaatttgatagaggcacatgggtggccgaccggtggctcgtcagcgtacaaagtcgccaaagctgccctcaatgcttacacaaggattctcgccaagaagtaccctaggatgcgcatcaactgtttgacgcctggttatgtcaagagcgacatgtcgatgcacatgggagttttgacgcctgaggagggcgctagcaacccggtgaaggtcgctctcttgcccgacgatggcccgacgggtgcttattttgatagggatggcgtggcctcgtttgtgtgactctgtcgtacgtgtaatggtttcgtccggttttactttcagaatatgagacacctgtaactgtagttgtcaataaacattgtgcagtttaa

SEQ ID NO: 3383 - DNA, 739 bp, Triticum aestivum
tgcgaaagttaaagaacaggttgaaagcatggatgtagatcagagagttcaatggatgaaagaaaattccaaggagacatatgaggaagcaaaagaatgcatgagaacaaactactatggggcaaagcttgtcacggaggcactacttcctcttcttcagttgtcctcctctgggagaattgtcaatgtctcatcaggcttttcactgctaagaaacttcaacagtgaaaaactgaagaatgagtttaacaacgctgacaatcttactgaaaagagactagaggagctgttggattcgttcctagaagatttcaaggccaatttgatagaggcacatgggtggccgaccggtggctcgtcagcctacaaagtcgccaaagctgccctcaatgcttacacaaggattctcgccaagaagtaccctaggatgcgcatcaactgtttgacgcctggttatgtcaagagcgacatgtcgatgcacatgggagttttgacgcccgaggagggcgctagcaaccctgtgaaggtcgctctcttgcccgacgatggcccgacgggtgcttattttgatagggatggcgtggcctcgtttgtgtgactctgtcgtacgtgtaatgttttcgtccggttttactctcagaatatgagacaccgtaacagtagttgtcaataaacagtgtgcagtttaacctgtgctgtgcactcgaatcgacatgcaaattgacaaatttgatctatg

SEQ ID NO: 3384 - DNA, 854 bp, Triticum aestivum
agcgagttcaatggatgaaagaaaattcgaaggagacatatgaggaagcaaaagaatgcatgagaacaaactactatggggcaaagcttgtcacggaggcactacttcctcttcttcagttgtcctcctccgggagaattgtcaatgtctcatcaggcttttcactgctaagaaacttcaacaacgaagaactgaagaatgagtttaacgacgtcgacaaccttactgaaaagaaactagaggagctgttggattcgttcctagaagatttcaaggccaatttgatagaggcacatgggtggccgaccggtggctcgtcagcgtacaaagtcgcgaaagccaccctcaatgcatacacaaggatccttgccaagaattaccctaggatgcgcatcaactgtttgacgcctggttatgtcaagagcgacatgtcgatgcacatgggagttttgacgcctgaggagggcgctagcaaccctgtgaaggtcgctctcttgcccgacgatggcccgacgggtgcttattttgatagggacggcgtggcgtcgtttgtgtgactgtcgtacgtgtaatggttttgtccggttttactttcagaatatgagacacctgtagcagtagttgtcaataaacattgtgcagtttaatctgtgctgtgcactcaaaaatggacatgcgtgtgtgtatgatccatattggtcgatgaggtctatcgatcttgtgggtatgtgtagggtcaaacaatgcgacaacacacacacgatgacgtatgggtgttgctggcaggcaataggatgacgtatgggtgttgctggctgatggacatgcttggtttgttaacaaattagccaacc

SEQ ID NO: 3385 - DNA, 505 bp, Triticum aestivum
ggacagctccaaaagaggcacgaggtgcctgtggatcctgaggagtatgcacgtgataatctcaagtttggtcttgttgaggttgtctacgaatgggcaaagggaacgcctttcgcggacatatgtgagctgacagatgtatctgaagggctgattgtaagaacaattgtgcggttggatgaaacatgtagggagttcaggaatgcggcttccataatgggcaactctgctttgtacaagaaaatggagatcgcgtccaacgcaatcaagcgtgacattgtctttgcagcaagtttgtatgtcacaggaatatgatgcatgtaggcccggtgtagcctaaacctagcggtgtttgtaagtagagaaattcctgttctggatgtctaatttcttcacaagcccaatcatgacaagcgcacaactgtaaagatgtttttagtgacagtaccatctgacaccgttgacaccaggtgcccatgagtgagcagaatcaacaaaatctact

SEQ ID NO: 3386 - DNA, 1379 bp, Triticum aestivum
aaaagctggtcgcaaacctgttcgaaatggctcgtgaaaatgccccctccatcatcttcatcgatgaaattgattctttgtgtggccaacgtggagaaggtaatgaaagcgagtcttctaggagggttaagacggagctgctcgtccaaatgcagggtgttggccataacgatgacaaggtccttgttcttgctgctacaaacactccatatgctctggatcaggccgtcaggcggcgttttgacaaacgcatctacattccactgcctgaccttaaagctagacaacgcatgctcaaggtccatctcggcgacacccctcacagcctgaccaagagcgatttcgagagcgtggctcaccggacagatggcttctccggctcggacatcgccgtctgcgtgaaggacgtgctgtttgagcccatacgcaagacgcaggacgccatgttcttcttcaggtcagaggacggcggcggcggcacgtggacgccgtgcgggccaaagcaaccaggggccgtgcagaccaccatggaggagctcgcggcggaaggcatggctgaccagattaccccgcctccgatctccaggacagacttcgacaaggtccttgcgaggcagagaccgacggtgagcaaggcggagctgggagtgtatacaaggttcaccaaagagtttggggaggagggctgaattttacgtacacccaggattttacgttctgtaaatgttgccatacgattactgacttgaacatttataggcctgtatagctttgtgaagtcatagcaattcttcttgtacatgcttgttggttaaaagcatcagaaattgattagacaaaacagtagattttgctgatactactcactcatgggcacctgctgtcaacggtatcagatggtactttcactaagacatattctctacttacaaacaccgttaggcctacatgcatcatattcctgtgacatacaaacttgctgcaaagacaatgtcacgcttgattgcgttggacgcgatctccattttcttgtacaaagcagagttacccattatggaagccgcattcctgaactccctacatgtttcatccaaccgcacaattgttcttacaatcagcccttcagatacatctgtcagctcacatatgtccgcgaaaggcgttccctttgcccattcgtagacaacctcaacaagaccaaacttgagattatcacgtgcatactcttcaggatccacaggcacctcgtgcctctttggagctgtcctaagttgattgccgtgtcatagagcctaatacggagacagagagaagaacaaaaggtacttgaggtatgtatcatgtaagcaagcaattacaccctctgttcgttagtactt

SEQ ID NO: 3387 - DNA, 690 bp, Triticum aestivum
atggctcataggcgctgactgccccttgattggacaccagaatgaagatagcacttgatgctgcaaggggattagcataccttcacgaggattcacagccttgtgtaatccacagggatttcaaagcttctaatatattgctcgagaatgactttcatgctaaagtgtctgattttggtttggccaaacaggcgccagaagggcgcttaaattatctttcaactcgtgttatgggaacttttgggtacgtagcaccagagtatgcaatgacaggacacttaattgtaaaaagtgatgtatatagctatggagttgttctacttgaactacttactgggaggaggcctgttgacatgtcacaatcttcggggcaggagaatctagtcacatggacacggccagttcttcgggataaagataggctacaggaactagctgaccccaagcttggtggacaatatccgaaagatgattttgtgagggtgtgcacaatcgcagcagcctgtgtttccccggaggcgaaccaaaggccaacgatgggcgaggtggtgcagtcacttaagatggtgcaacgctccacggagttccaagaatctgtaccgacaccgccagctcgtcctaatgcccggcatactgcaacgacctatgaatctgatggcacttcatccatgttctcatctggacccttct

SEQ ID NO: 3388 - DNA, 908 bp, Triticum aestivum
gctttcttctgcagctggagttagcttccaagcggcgcagtcaggaaagcacaagcaaccaaaaaattctcagaaggcacttcaaatccctagggccttccctgccaatccagaaaggttctacggtgatgaagatgacgaggacgaagatgatgataatgttgttcgagaagatgacaatgatgttgagttaccggagtctctcccaagctcaaccgaatgtgaatcttccatccatccagcgaaagagctcaatctgctcgaacacgaagacaagacaaggatgttcttgttccagttgccgaaatctcttcctctgctcagaacaccatccactgtagttcataggaatggaagggccattgtcaaggaggtgaaagaagggtacaacctgaatgatctgccaggggggtacatgggcaagatgctggtgtacaagagcggcaaggtcaagatgaagctgggagatgccgtgttcgatgtgagcccaggcacggaatgcgggatgcagcagcacgcagtagcggtgaacactagaaggaaacattgctgccagcttggggagatcgagaggcagcatgtcgtggtgaccccggatgtcaactccctgctgaatgacaatagggactagctgcaacccgcgaaccgatcaattctaatagcttggcaaatatggtgtgcatatatgctagaataacttatgcgttttaactgcattatgataaatgtaaatttgtagctgtagcctgtagctgttggtagcgctcgtgtcacagcagtagtctagaaatgctgcttgcagctgatgagtgctgtatcttgagtacccttgtatcttactagcaggcagaaggcgcagcggcacgctgcgcccgtgtttaaacacgttgttgtttgagttatatcga

SEQ ID NO: 3389 - DNA, 720 bp, Triticum aestivum
atccacgaagagctcatctgctcgaaccggacgacaagacaaggatgttcttgtttcagttgccgaaatctcttcctctgctcagaacaccatccactatagttcataggaatggaagggccattgtcaaggaggtgaaagaagggtacaacctgaatgatctgccagaggggtacatgggcaagatgctggtgtacaagagcggcaaggtcaagatgaagcttggagatgccgtgttcgatgtgagcccgggcacggaatgcgggatgcagcagcacgcagtagcggtgaacactagaaggaaacattgctgccagcttggggagatcgagaggcagcatgtcgtggtgaccccggatgtcaactccctgctgaatgacaatagggactagttgcaacacgcgaaccgatcaattctagtaatagcttggcaaatatggtgtgcatatatgctagaataacgtatgcgttttaactgcatgatgataaatgtaaatttgtagctgtagcctgtagctgttggtagcactcgtgtcgcagcagtagtctagaaatgctgcttgcagctgatgagtgttgtatcttgagtaccctgctgatgagtgttgtatcttgagtacccttgtttcttactagcaggcagaaggtatggcggcacgccgcgcccgtgtttaaacacgttgttgtttgagttatatcgaggtttttcttaacaccatg

SEQ ID NO: 3390 - DNA, 610 bp, Triticum aestivum
gcgcactccccctaacaagtagccacgcgggagagaggaagccatggccatgtcgctctccctcgcgcgtcctggccctcccgccggtcctccaggccctccccggcaggaggcaggcccactccgccctcgccttcccggccaactcattcttcggcgcgccgctggccgtggccgccgccggcgccgccgcgctctccccggcggccccgctcccgcgctccctcgccgtcgtcgccgccgggaaggggtacaagatgaagacgcacaaggcatcggcgaagcggttcagggtgacgggcaccgggaagatcgtgcggcgctgcgccgggaagcagcatctgctcagcaagaagaacgccaagcgccggaagaggctctccaagacggtccaagttaacaagagcgactacagcaacgtgatgggtgcgctgccctacctcaaagtgaacaagaaagcaggctgagatctaccgggtctggtgaaatgactgccactgagtttctgttcacccacttgtaattttgtgcatctttatctgtatgcctttttttcttaaatacataccaatgccagacttcacattccaagcaatcataaacaactatt

SEQ ID NO: 3391 - DNA, 691 bp, Triticum aestivum
taatccagtcaaccgtgaaggatccatccaatctggatgccagggtgaagctttcctcaacatgtttgaagtcacactacacgaaatgcctgatgcagaattcaagagtaatgtcaatgctctcattgacatgaaacgggagaaatacaagaacataagggaggaatcagcattcttttggggggagatttctcaaggaacactgaaatttgatagaaaggaagcagagattgctgcactggaggagcttaagaaggaagagctgatagagttcttcgataatcatgtcaaggttggcgcgccagaaaagaagatccttagcatacaaatctatggtggtctccatgcctccgagtacgaaaagattgttcatgatgctccgccaccgcattcgcatcgaataactgatatattcagcttcaggaggtcgagacctttatatggttcattcaaaggtggtgctggtcagatgaagctataggacaactttgtttcgagtcatatttacatgtcacacttgaattgttcctatagaaaataatgtgtgggacaaatgttcgcacttttggctaggctgaatattccataccaaatctagtagtatcagtttgaaattttacatgttgtattcttctctatactgattatcagacctgaaagtgttcgaccggcataattctaaacctgttta

SEQ ID NO: 3392 - DNA, 646 bp, Triticum aestivum
tttcctgaagatgtttgaagtcacctacacgaaatgcctgatgcagaattcaagagtaaatgtcaatgctctcattgacatgaaacgggagaaatacaagaacataagggaggaatcagcattcttttggggggagatttctcaaggaacactgaaatttgatagaaaggaaacagagattgctgcactggaggagcttaagaaggaagagctgatagagttcttcgataatcatgtcaaggttggcgcaccagaaaagaagatccttagcatacaaatctatggtggtctccattcctccgagtacgaaaagattattcatgatgccccgccaccacattcgcatcgaataactgatatattcagcttcaggaggtcgagacctttatatggttcattcaaaggtggtgctggtcagatgaagctataggacaacttcgtttcgggtcatatttacatgtcacttgaattgttcctactatagaaaataatgtgtgggacaaatgttcgcacttttggctaggctgaatatattccataccgaatctgtcatatcagtttgaaattttacatgtaattcttttttatactgattatcagacctgaaagtgtttgactggcatacattctacacctgtttatatca

SEQ ID NO: 3393 - DNA, 831 bp, Triticum aestivum
gtcctacttcagttgcttgctgttgtagctaagcaaccggcttttcaccaattacgttcggtcgagcaacttgggtacatagcactgcttagacagagaaatgattcaggagtccgtgggttgcaatttataatccagtcaaccgtgaaggatccatccaatctggatgcaagggttgaagctttcctgaagatgtttgaagtcacactacacgaaatgcctgatgcagaattcaagagtaatgtcaatgctctcattgacatgaaacgggagaaatacaagaacataagggaggaatcagcattctttggggggagatttctcaaggaacactgaaatttgatagaaaggaaacagagattgctgcactggaggagcttaagaaggaagagctgatagagttcttcgataatcatgtcaaggttggcgcaccagaaaagaagatccttagcattcaaatctatggcggtctccattcctccgaatacgaaaagattattcatgatgctccgccaccgcattcgcatcgaataactgatatattcagcttcaggaggtcgagacctttatatggttcattcagaggtggtgctggtcagatgaagctataggacaactttgtttcgagtcatatttacattcacttgaattgttcctatagaaaataatgtgttggacaaatgctcgcacttttggctaggctgaatattccataccaaatctagtcatatcactttgaaattttacatggtattcttttctatactgattatcagacctgaaagtgttcgaccggcatactttctaaacctgtttatatcatgaatcaga

SEQ ID NO: 3394 - DNA, 735 bp, Triticum aestivum
aacgacagcctcgagagcatctccgatccttcgtctccaagccgagatgcagaaggagtgagatgctgcaggaggccaatatctccaagttcaagtcgcaagtgcagagctcgcaggaaaaccatttctctttgttacagcgggagactgaaaaactccgtggagacattgataagatgaggagtgaactgaagtatgagattgacaaggtcactgcagggcagcggttggatctgaaccttgaaagagggcgcatacgtgatgagctcgccaagcagaatgaagaaaccacagatctcaccacaaagcttgacaaggaaattcattcactgaaggcccagctggaggcagcaaagtatgatgtcatcaaatactgcataggtaccatcgtttcgatatcagccgttggactcgccgttctccgcatcgtgatgtgaacccgaacacatgttctttcgtttacccatttatccatggaggccacaaagaggatagttccgattctgttcctagttttttcaatgggggcaaaacttggtcaggggaatgctgtaacatctgtaagatagatcgacctgcagaaggaatatacaaccgaaatgattctttacctgtgcttgagctttgtggtattgacgcttaactagcatgcttccccagtctctgccgacgcggaagtcactgttgtgttgcaattaacacgctgtggacatctaatcctagcaatgaaggaag

SEQ ID NO: 3395 - DNA, 820 bp, Triticum aestivum
accctaatggcattttaagttttaagtacatttatagttgatttctgaagtattaatgagttatgggagaatgaactttttgtagaatagttccaaacaggccaggctagcagcaagtgggaaccttaattcttcttccccttgacccccattgaccttttgaaaatgaaacaaagtagtttcatctattagtgcttacactgggcattacttatttacttccatgacaattccagtggttgctctgtctttgtcatgtttctgtcacaattattaagattgttttgtcggtgttatatgattaaaacatgattgctccaggcgcatacgtgatgagctcgccaagcagaatgaagaaaccacagatctcaccacaaagcttgacaaggaaattcattcactgaaggcccagctggaggcagcaaagtatgatgtcatcaaatactgcataggtaccatcgtttcgatatcagccgttggactcgccgttctccgcatcgtgatgtgaacccgaacacatgttctttcgtttacccatttatccatggaggccacaaagaggatagttccgattctgttcctagttttttcaatgggggcaaaacttggtcaggggaatgctgtaacatctgttagggtgaaaaagttcctcaagacctgtaagatagatcgacctgcagaaggaatatacaaccgaaatgattctttacctgtgcttgagcttcgtggtattgtcgcctaactagcatgcttccccagtctctgccgacgcggaagtcactgttgtgttgcaattaacacgctgtggacatctaatcct

SEQ ID NO: 3396 - DNA, 771 bp, Triticum aestivum
gtcctcaacgacagcctcgagagcatctccgagtccttcgtctccaaggccgagatgcagaagagtgagatgctgcaggaggccaatatctccaagttcaagtcacaagtgcagagctcgcaggaaaaccatttctctttgttacagcgggagactgaaaaactccgtggagacattgataagatgaggagtgaactgaagtatgagattgacaaggtcactgcagggcagcggttggatctgaaccttgaaagagggcgcatacgtgatgagctcgccaagcagaatgaagaaaccacagatctcaccacaaagcttgacaaggaaattcattcactgaaggcccagctggaggcagcaaagtatgatgtcatcaaatactgcataggtaccatcgtttcgatatcagccgttggactcgccgttctccgcatcgtgatgtgaacccgacgacatgttctttcgtttacccatttatccatggaggccacaaagaggatagttccgattctgttcctagttttttcaatgggggcaaaacttggtcaggggaatgctgtaacatctgttagagtgaaaaagttcctcaagacctgtaagatagatcgacctgcagaaggaatatacaaccgaaatgattctttacctgtgcttgagcttcgtggtattgtcgcttaactagcatgcttccccaatctctgccgacgcggaagtcactgttgtgttgcaattaacacgctgtggacatctaatcctagcaatgaaggaaga

SEQ ID NO: 3397 - DNA, 817 bp, Triticum aestivum
  misc_feature (149)..(150): n = any nucleotide
  misc_feature (158)..(158): n = any nucleotide
  misc_feature (160)..(160): n = any nucleotide
  misc_feature (166)..(166): n = any nucleotide
  misc_feature (613)..(633): n = any nucleotide
gcactgcttcataagaaaatacgcgattcatatactcatcctcagtttatatccgatgtaatgaagccactacaaattgagcagctcatggatcaggaggtgctgaatttatcaggtggagaactccaaagggtggcgctatgttcttnntgccttgngnaccagncccgtggccagaaaaaatctaccttatcgatgagccgagtgcgtaccttgattcggagcagcgcattgtcgcctcgaaggtgatcaagaggttcatcctccatgccaagaagacggcgttcatcgtcgagcacgacttcatcatggcagcctacctggcggacaaggtggtggtctatgaggggcgcccctccgtcgagtgcactgcctgcacgccacagtccctggtgtctgggatgaacaggttcctatcgcaccttgacatcacgtttcggagggacccgaccaactaccggcctcggatcaacaagatggactcgaccaaggaccgggagcagaaggccgcggggtcctactactacctcgacgactgactgataggcgcgccgcccctcccgagagaatttggtttgactgatcttgtttttaggtgaattgaattacgctnnnnnnnnnnnnnnnnnnnnnctgggtttgtccccgtttttgtcctgggttttgtactgacgttggagagatttggcagatgagacagcgaactgcacctgctctgtcccaggtcaaaagcaactctgttatcttggttacttaattagcagctactaattgaattagcatacatgcaaagccagacctgatctgaatctgatgg

SEQ ID NO: 3398 - DNA, 811 bp, Triticum aestivum
ctgtttccttgatagccttgcaggcaagctccacacggctttgacgttctattcttgtacaaatctgaaagtgaataatgtagaagtgttgtaacagccaacaaatccacatatcaatggagcgttgcagtcgatgtaaggatgtcacgccgtatcatatcagagcacctggcactagccccaacaccgacgacatccatatcacccatagtaaggatgtgaaagttatggactgtgcaatcaagactggggacgactgcatgtcaatcgaggatgggactgagaatctacatgtcaagaacattgtgtgtggaccagggcatgggataagcattgggagcttaggtgatcgcaactctcaagctcaagttgcaaacatcaccattgacggggtgcgactgcacgacacgacgaatggagctcgtatcaagatatggcagggcgggcggggttatgcaaagaatatcgtgttcaagaacatgataatggataatgtacgggacccgatcattatcgaccagaactactgcgactcggctacaccatgtactaaacaggtgaaagaacatgacgaccatgatgggtttattcatttgtttatgtacattgattttattttttgttgattgttttctgagatagcaacccgctcataccaagcggtgtatgtacatagatataacctggtgtgttattcttttgtatagaaagcggctgtggaggtgagcatgtgttgtttaagaacattagggggacagggcctcaagagaggctatcaagctcagttgcagtaaagctgtaccttgccatg

SEQ ID NO: 3399 - DNA, 679 bp, Triticum aestivum
ggccgccgcgaagaaaaggagcttatcatggcttcaaaacgtatcctgaaggaactcaaggacttgcagaaagatcctccgacatcatgcagtgcaggtccttctggcgaggatatgttccattggcaggcaaccattatgggtcctcctgatagtccctatgctggaggtgttttcttagtgaatatccatttccccccggactaccccttcaagcctccgaaggtatcgttcaagacaaaggtcttccatccgaacatcaatagcaatggaagcatatgcctcgacattctgaaggagcaatggagtcctgctttgacaatctctaaggttctgctttcaatctgctcactgcttaccgaccctaacccggacgaccctctcgtccctgagattgcccacatgtacaagacggatcggtccaagtacgagacgacagcccgcagctggacgcagaagtatgccatgggatgatccgaagcccatgctcgtatccactgcttgcatgcagaagattgtgttgctgtcccgagaaactatctctgggccattattttctttgattacttgttggtcgcgtgtgtctccctgatccatgtaggatcgcgtcgtagtcaaaacatcaacgtatcattgccaaagtccataatgaaattgacatatgcttctcttagataac

SEQ ID NO: 3400 - DNA, 747 bp, Triticum aestivum
gagggcctctctctccatcccgacctctcgtggccgccgcgaagaaaaggagcttatcatggcttcaaaacgtatcctgaaggaactgaaggacttgcagaaagatcctccgacatcatgcagtgcaggtccttctggcgaggatatgttccattggcaggcaacaattatgggtcctcctgatagtccctatgctggaggtgttttcttagtgaatatccatttccccccggactaccccttcaagcctccgaaggtatcgttcaagacaaaggtcttccatccgaacatcaatagcaatggaagcatatgcctcgacattctgaaggagcaatggagtcctgctttgacaatctctaaggttctgctttcaatctgctcgctgcttaccgaccctaacccggacgaccctctcgtccccgagattgcccacatgtacaagacggatcggtccaagtatgagacgacagcccgcagctggacgcagaagtatgccatgggatgatacgaagcccatgctcgtatccactgcttgcatgcagaagattgtgttgctgtcctgagaaactatctctgggccattattttctttgattacttgtcggtcgcgtgtgtctccctgatccatgtaggatcgcgtcgtagtcaaaacatcaacctatcattgccaaagtccataatgaaattgacatatgcttctcgtgataactacgtctggtgttggttctccctcccattcgctaaata

SEQ ID NO: 3401 - DNA, 808 bp, Triticum aestivum
gcaaagacccgagcggaaaaggagcgagggcctctctctccatcccgacctctcgtggccgccgcgaagaaaaggagcttatcatggcttcaaaacgtatcctgaaggaactgaaggacttgcagaaagatcctccgacatcatgcagtgcaggtccttctggtgaggatatgttccattggcaggcaaccattatgggtcctcctgatagtccctatgctggaggtgttttcttagtgaatatccatttccccccggactaccccttcaagccgccgaaggtatcgttcaagacaaaggtcttccatccgaacatcaatagcaatggaagcatatgccttgacattctgaaggagcaatggagtcctgctttgacaatctctaaggttctgctttcaatctgctcgctgcttaccgaccctaacccggacgaccctctcgtccccgagattgcccacatgtacaagacggatcggtccaagtatgagacgacagcccgcagctggacgcagaagtatgccatgggatgatacgaagcccatgctcgtatccactgcttgcatgcagaagattgtgtcactgtcccgagaaactatctctgggccattattttctttgattacttgtcggtcgcgtgtgtctccctgatccatgtaggatcgcgtcgtagtcaaaacatcaacctatcattgccaaagtccataatgaaattgacatatgcttctcgttataactacggtagtgttggttctcccattcgctatatggtgcctgtggatggaaatgtttgttctgtggccagttggcc

SEQ ID NO: 3402 - DNA, 559 bp, Triticum aestivum
cattggagagaagccccatgatgttttcaccagggaaggaaacgatcttgtcatgacacagaagatctccttggtggaagcattgactggctataccgtgcaactcacaacgctcgacgggcggagcttgtctagacaagttaactcggtaatccaccctagctatgaagaggtgatccctggagaggggatgccaatacccaaggagccctgtaagaagggaaatctgcgcgttaagttcagcatcaagttcccttccaggctgacatctgaccagaaagctgggatcaaaaggctgttgggttcttagccctgtgtgccattttctatagactgatgaaagcgactgtgaatatctccagcatgtggctaggtagatttctatctgtccggtttggacaatgagcggaattggtcttggttattccgtttacatacctgtagaaatgatgttgtcattctatgtgttgtttttccccataacttggtagaggctttttcacatatgtgaccaggctggttgttgtcaatgttttaatctgttcttcctcgggattgc

SEQ ID NO: 3403 - DNA, 795 bp, Triticum aestivum
gatattgtcttcatcattgaagagaagccccatgatgttttcaccagggaaggaaatgatctagtcatgacacagaagatctcgttggtggaagcactgactggctataccatgcaactcacaacgctcgacgggcggaacctgtccatacaagttaactcggtgatccaccctagctatgaagaggtgatccctggagaggggatgccaatacccaaggagcccggtaagaacggaaatctgcgtgttaagttcagcatcaagttcccttccaggctgacgtctgaccagaaagctgggatcaaaaggcttttgggttcttagcctttgtgtgccatttctatagactgatgaaagcgactgtgaatatctccagcgtgtggctaggtagatttctatctgtccggatgggacaatgagcggaattggtcttggttattccgtttacatatacctgtagaaatgatgttgtcattctatgtgttgttttccccataacttggtagaggctttttcacatatgtgaccaggctggttgttgtcaatgttttaatctgttcttcctcgggatcgtaggaaggtttgagttcagaaaggttatacagattttgttccctgtcgtgttgggataattcggctttgttatatatttgaactagctatggtcccgtgtacaaatgacataggaactatggtgcattctcagtaccaatttagtgtacgaatgacatgggaagtctggtgcattctcagaaccaatttatgctatacatgagatagagcacagggaagtct

SEQ ID NO: 3404 - DNA, 836 bp, Triticum aestivum
gccgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgcggtcgtcagtatttttgctctgctctatggttgtcagtcgactctccaatgttgtgtcggtaactatcagatgttgagtgtcttgaaaactttctgataattgtgggatttgctttgtaatggtaatcgtgaaattggtgtggttatgttttggtcaatgcctcggcttttactcgctagaatcaagcgattttgcccctgttattctatcagattatcttatgtc

SEQ ID NO: 3405 - DNA, 652 bp, Triticum aestivum
gaagctgacaaagccatcgagacgttcaatcgctacgacatcagtggaaggcttctgaacgtaaacagggcagctcaaaggggctcccgtgttgagagacctcctcgacagtttgcatcttctttcagggcttatgttggtaacctgccatggcaagcggaagactctaggttggtgcaattgttcagcgagcatggggaagtagttaacgctacagttgtgtacgacagagaaactgggcgttcacgaggatttggttttgtaactatggcttcaaaggaggatcttgacagtgctatttcagcgcttgatggacaggagatggatggccgcccactccgagtgaacgttgccgcggagcgaccacagcgagggttctgatgcagaggagagcgggtgcttcttttggacacacgagagcaacactgctgaaatgttactgcagaagactgaagcatgtcaccacttaaaaatcctgcactagcctcctgatgctgggctatctcctcccatcccatgttcttttttcatgcttccgtttgctgctgatgtcatcatgttaatttcttgtcaacaccatgagttcaacttttcaagtaggctactgtaatgatgtcctagtgttctcatgataatcgaagaaggttttgtt

SEQ ID NO: 3406 - DNA, 781 bp, Triticum aestivum
caacagagagtcaggccagagccgtgatttgatttgttaccatgagtactattgaggaagctgacaaagccatcgagacgttcaaccgctacgacatcagcggaaggcttctgaacgtaaacagggcagctcaaaggggctcccgtgttgagagacctcctcgacagtttgcatcttctttcagggcttatgttggtaacctgccatggcaagcggaagactctaggttggtgcaattgttcagcgagcatggggaagtagttaacgctacagttgtgtacgacagagaaactgggcgttcacgaggatttggttttgtaactatggcttcaaaggaagatcttgacagtgctatttcagcgcttgatggacaggagatggatggccgtccactccgagtgaacgttgccgcggagcgaccgcagcgagggttctgatgcagaggagagcgggtgtttcttttggacacacgagaacaacactgctgaaatgttactgcggaagactgaagcatgtcaccacttaaaaatcctgcactggcctcctgatgttgggctatctcctcccatcccatattcttttttcatgcttccgtttgctgttgatgtcatcatgttactttcttgtcaacaccgtaagttcaacttttcaagtaggctactgtaatgatgtcctagtgttctcatgataatcgaagaaggttttgttggtaatgctaatatgatatgtatgcaaagggcagactgcacggcagcgttgtttactgtttgcaaattatata

SEQ ID NO: 3407 - DNA, 737 bp, Triticum aestivum
cagagagtcaggcagagcgtggatttgattgtaccatgagtactattgaggaagctgacaaggccatcgagacattcaaccgctacgacatcagcggaaggcttctgaacgtaaacagggcagctcaaaggggctcccgtgttgagagacctcctcgacagtttgcatcttctttcagggcttatgttggtaacctgccatggcaagcggaagactctaggttggtgcaattgttcagcgagcatggggaagtagttaacgctacagttgtgtacgacagagaaactgggcgttcacgaggatttggttttgtaactatggcttcaaaggaggatcttgacagtgctatttcagcgcttgatggacaggagatggatggccgcccactccgagtgaacgttgccgcggagcgaccgcagcgagggttctgatgcagaggagagcgggtgtttcttttggacacacgagaacaacactgctgaaatgttactgcggaagactgaagcatgtcaccacttaaaaatcctgcactagcctcctgatgttgggctatctcctctcatcccatattcttttttcatgcttccgtttgctgctgatgtcatcatgtcactttcttgtcaacaccatccagttcaacttttcaagtaggctactgtaatgatgtcctagtgttctcatgataatcgaagaaggttttgttggtaatgctaatatggtatgtatgcaaagggcaa

SEQ ID NO: 3408 - DNA, 626 bp, Triticum aestivum
ccgtctcgtcgctttgctccccacgaaagaattctaaattcttgcttaacaaaacgagaaagcggatcctatccttcgtgggatccgcgtcggttcttgccctcgccgcgtcgaatccggcagcttttctttcctcctctgaatccctccgcccggccagccgccgtcgactgagccggcggttgttgggatcttgcgtcgcggggcgatccggcccggggggagatggccggcgggaaagagccgatcgaggtgaagttccgcctgttcgacggcacggacatcgggcccaacaagtacgactccgccaccaccgtcacggcgctcaaggagttcgtcctcgctcggtggccgcaggacaaagacattattccaaaaactctcaatgacgtgaagctcatcaatgctggaaggatacttgagaataacaaaactcttgctgagtctcgagtcccagtaggggaagttccaggaggtgtgatcacgatgcatgttgttgtacgccctccccaaagtgacaaaagtggtattgatttgatttccctcttatttattcaaagtcccatctctttatatgtttgatgatctcacttggtttaagatccgaagggttgaacttctgttat

SEQ ID NO: 3409 - DNA, 690 bp, Triticum aestivum
ctcgcaccgcgtcccctccctctcctgtcgcgtgcgctcggccagcaaaaagcttccacataaaggccaacaagagaaaccataatctgttgggtgccagtcaaacctcaacaacaaagtttcatgtctgatctcgacgttactctgccatctgccttcgatccttttgctgaggcaaatgctgaggatgctggtgcaggcccgggcgcaaaagattatgtgcatgtgcgcatccagcagcgcaacggcaggaagagtctgaccactgtccagggcctgaagaaggagttcagctacaacaagatcctcaaggatctcaagaaggaattctgctgcaatggcacagtagtccaggatccagagctaggccaggtcattcagcttcagggtgatcagcgtaagaatgttgctactttcctagtccaggctggaattgcgaagaaggagctcatcaagatccacggcttctaagctgaagccgcctccgataaatgcccgaaccgccagccggttctactctatattgaagacttaaggcatctatattgccgcccgcttgttgaaccggtttcttgcttgatgcaagttgtgttgtcacctggttattatgctgctgctgtaccagcatatcagtatggtttgtctaagatgttgccgactaaataaaaatccgtatcgtttggctgcaaa

SEQ ID NO: 3410 - DNA, 1119 bp, Triticum aestivum
tttgcatccctgttccagatggtggtgttggttttgactaccgcctgcatatggctgtagcagataaatggattgaactcctcaagcaaagtgacgaatcttggaaaatgggcgatattgtgcacaccctaacaaatagaaggtggcttgagaagtgtgtaacttatgcagaaagtcatgatcaagcactagttggtgacaagactattgcattctggttgatggataaggatatgtatgatttcatggctctggataggccttcaactcctcgcattgatcgtggcatagcattacataaaatgatcaggcttgtcaccatgggtttaggtggtgaaggctatcttaacttcatgggaaatgagtttgggcatcctgaatggatagattttcccaagaggcccacaaactcttccaaccggcaaagttctccctggaaataacaatagttatgataaatgccgccgtagatttgatcttgaggaaaaatatgggtttatgacatctgagcaccagtatgtttcacggaaacatgaggaagataaggtgatcatcttcgaaagaggagatttggtatttgttttcaacttccactggagcaatagcttttttgactaccgtgttgggtgttccaagcctgggaagtacaaggtggccttggactccgacgatgcactctttggtggattcagcaggcttgatcatgatgtcgactacttcacaaccgaacatccgcatgacaacaggccgcgctctttctcggtgtacactccgagcagaactgcggtcgtgtatgcccttacagagtaagaaccagcagcggcttgttacaaggcaaagagagaactccagagagctcgtggatcgtgagcgaagcgacgggcaacggcgcgaggctgctccaagcgccatgactgggaggggatcgtgcctcttccccagatgccaggaggagcagatggataggtagcttgttggtgagcgctcgaaagaaaatggacgggcctgggtgtttgttgtgctgcactgaaccctcctcctatcttgcacattcccggttgtttttgtacatataactaataattgcccgtgcgcttcaacatgaacatataatattct

SEQ ID NO: 3411 - DNA, 822 bp, Triticum aestivum
tgttgtgttctggcccactcatctccttgtcggctgttgaagaaggtgggcacatcgttcatgcgttaaggatcacgggccacaacgggttcccagtggtcgacgagccgcctgtatcagaagctccggagctggttgggctggtgcttaggtcacatgtgttggttcttctgagtgggaggaacttcatgaaggagaaggtgaaaacaagtggtagctttgtgctcagaagatttggtgcgtttgactttgcaaagcctggttccgggaaaggtatgaaaatcgaggacctagatttcaccgaggaagaaatggagatgtatgtggatctccatccaatcacaaacacttcgccgtacacggtggtcgaaacaatgtcgcttgcaaaggctgcagtcctgttcagggcactagggctaagacacctgctggttgtgccaaagaccccagggagatttcctattgttgggattctcacgaggcacgatctgatgccggagcatatccatgggctgttccccaatctccgcaagtcacactgagaagcaaaatcagcaggccacacaaaattttcttgcagtattgttatttctcatgaaggtgctgcttcattggatcatggaataatcaatctgatatatttattgtaaaaagagctgattccccaatcagcagtcgagtggatttcattttggcagcttgtgtaacaaacaatcctctccttgtcagtacatgttctctcttttgcctcacacatcttctcatatgcacctgctgtaacttggaacgcaacaccttgtcggtagtagcagaatgctatcc

SEQ ID NO: 3412 - DNA, 1503 bp, Triticum aestivum
tcacaaatgagctccacatgctccccttggtcatgctcgtcctcctgatatcgaagaccataccgattgcttcaacaaaggtgtgtatgaccagatcgtggtgatgaaaggcttgccattcatggaggctcatgctgaaccgtacatgaggcacttggtagctagtgatgttgtgtctgggccactcatctccttttcgggtgttgagaaggtgggcaacatcgttcatgcgttaaggatcacgggccacaacgggttcccggtggtcgacgagccgcctgtatcagaagctccggagctggttgggctggtgcttaggtcacatgtgttggttcttctgagtgggaggaacttcatgaaggagaaggtgaaaacaagtggtagctttgtgcttagaagatttggtgcgtttgacttcgccaagcctggttccgggaaaggtatgaaaatcgaggacctagatttcaccgaggaagaaatggagatgtatgtggatctccatccaatcacaacacttcaccgtacacggtggtcgaaacaatgtcgcttgcaaaggctgcagtcctgttcagggcactagggctaagacacctgctggttgtgccaaagaccccagggagatttcctatagttgggattctcaccaggcacgatctgatgccggagcatatccatgggctgttccccatctccgcaagtcacattgagaagtaaatcagcaggccatacaacattttcttgctgtattgttatttctcatgaaggtgcttcttcattggatcatggaataatcaatctgatatatttattgtaaaaagggctgattccctgatcagcagtcgagtggatttcattttgtcagcctgtgatctttgtgtaacaaacaatcctctccttgtcagtacatgttctctctttttgcttcacacgtcttctcatatgcacctgctgtaacttggaccgcaacaccttgtcggtagtagcagaatgctatccatagagatttctgaacaaatgatgccgacaaggctctgaaatctgaatcttagtgttcattcatgaccaaggaaatgcagctgcttccatacgcgctggctggctgtccacacgccagtggggtggcgcctcgtttgttgctgtcacatgctggtgttggttcttgcagcaggatcgccgggatcctcctttccacagcgactccggtggcacctactgctgacctgaccaccggagctccgttggcccacaggccagtggcgggtagggcgaccccggacatgaaccgatgaacggaaagggggaacagtgacaggcaaagcaccatgatgctgcctctattgattccagcagcaggtgcggtcattgcttgctagtagtgtctctcgccgctagttgcttttccttcttttcttttttgtgcgaggcatcaggcgtggcaaatgccaagaacttttttttgaactttatgcacaaactcctcaacagctttggtgctagtattaa

SEQ ID NO: 3413 - DNA, 748 bp, Triticum aestivum
cgttcgaccgatcagctccatcgtacagaatttgccgatgtcggcctcgacacgaaagacgtcgtggtcttgtcaggtgcccacacgatcgggcgagcccggtgcgtgctgttcagcgaccggctgacgtccaccaagagctcggccgacccgacgctggacgctaccatggccgccgacctgcagaagctctgcaccggcggcgacggcaaccagaccaccgcgctggacgtgagctccgcggacgtgttcgacaagcagtactaccacaacctgctgagcaagaagggcctcctgacctctgaccagggcctcttctccgccgacgaggacatcgtcgccagcaccacaaaggcgttggtgcagacgtacagcgacgacggcgagcagttcttctcggacttcggcgcgtccatggtgaagatggggagcataccgttgccagccggatccgccggcgagatccgctgcaactgcagggttcccaataaaaaatgagcaacggcgagcagagctcatcatctgctaggtgaaagatgaacgggtagctaggaagaactagccgactggttaataaagcaggagtgaggattcaatcccaggcacctgtgcactggtgctagccagtagaacacactgggtgttacttcatcagctgctagatgatcttggaattaaatatagtcaatgaaatgtgttgttgtgtgtaatattaatatgttaaatgctcgaaaaaaaaagatcaaat

SEQ ID NO: 3414 - DNA, 590 bp, Triticum aestivum
  misc_feature (351)..(351): n = any nucleotide
ccgcttcataacctacaggctggagaaccagaaggaggtcattgtggaccaaactggggagcgcgaggccacctatgaggacttcaccaagaccctgcctgagaacgactgccgattcgcagtgtttgacttcgacttcaccaccccggaggatgtgccaaagagcaggatcttctatatcttctggtctcctgacaccgcaaaggtgaggagcaagatgacgtacgcgagcaccaacgagaagttcaagaggaccctggacggcatccagattgagatgcaggccactgacccgagcgaaatcagcctggacgtgatcaaggagcgcgcgcactaaggcaaatcatcccnatgcctcgcaatatggatttatgtcaactatagatttggcggtgtgactcttgaaactttcttgatgatttgtggctttgttaccgtgtcgaaaggccctcctcccgtggtccgtgagaccacggagggcttgctctatcatgtaatctgttctttttcctctgcccatttatatgccgggccttatgctgctgcactgcactgttcttccaagttacggttataaataatcaaatgtt

SEQ ID NO: 3415 - DNA, 435 bp, Triticum aestivum
gagaatttccctgataagatggttccttgtgcatcaggattccaaagcaggattggctttggcatgattggcttaggggacagcatatgtttgtttggtggagtgattgggcctgggccaagaaatcagtgcattaagccattgtctgatgttgatatcttgaatgtcgcaagcgagaggccaacctggcgacaaggatcgccgatgacgcgttgccgagggagtatcgcaggctgtgctctgctgaagatataggcttgttccagtgtgggatcgtgctgttgctgaaaactgcagatggattttatttattctgcatctcatttaatttctgaaaaaaaggttaactatgcttttagttctggatcacttgttgtagcattgaggatatatgttggccatgactcgaatgtcagattgtcaatcagttattat

SEQ ID NO: 3416 - DNA, 746 bp, Triticum aestivum
gcaatcgatatcggagctgagattacgatcctgaactgacaccttgggagtccctccctgacctccgtcaggcacatcccctctgcatgctctgtcttgtcatcaaggaataagatgcacgtattgcataaagggatatccacagtccagattctcgacagatgcggtaaattattggctgttgaggacttacttctttggctgccaaggcccaatggcaatggttggtggagagttgtatgtgctgagcaatagctgcattaggaagcagcatggagagaatttccctgataagatggttccttgtgcatcaggattccaaagcaggatcggctttggcatgattggtttaggggacagcatatgtttgtttggtggagtgatcgggcctgggccaagaaatcagtgcattaagccattgtctgatgttgatatcttgaatgtcgcaagtgagaggccaacctggcgacaaggatcaccgatgacgcgttgccgaggtagtatcgcaggctgtgctctgctgaagatctaggctcgttccagtgtggcaatgctgttcctgaaaactgcagatggattttatttattctgcatctcatttaatttctgaaaaaagattaactatgcttttagttttggatcacttgttgtagcagtgaggatatatgttggccatgactcgaatgtcagattgtcaatcagttatcatactactactatattatacatttatactacatgtgcct

SEQ ID NO: 3417 - DNA, 711 bp, Triticum aestivum
aaaaaatctctcctcgctctcgtccgagtcgcgtgaggagaaaggagggaagccggaaagggggttctcgccgaggcggaaggaggagatggccgggaagggaggcaagggcctgctcgcggccaagacgacggccgccaagaccgccgagaaggacaaggggaagaaggcccccatctcccgctcgtcccgcgcgggacttcagttccctgtgggccgtatccatcgtcagctgaagcaaaggactcaggccaatggccgtgttggtgctactgcggcggtctactctgctgccatcctggagtacctgacggctgaggtcctggagctggctggcaacgccagcaaggatctcaaggtgaagcgtatcacccctcgtcacctccagctggccatccgtggagacgaggagctcgacaccctcatcaagggcaccattgctggtggaggtgtgatcccgcacatccacaagtccctgatcaacaagtcttccaaagagtgagaaaatatatagcaaaggagcatctctagcttaaactggacattttctcagtcgtctgtgagataagtttatcgtcgcgtcgtttagcgtttagctgtgctccttccagatccaagtcgttgtctgtctgtgtaatgtttacctggtactgattcagtcatttggacatggtgtttatgttggttcgttgactctgtgactggactctg

SEQ ID NO: 3418 - DNA, 708 bp, Triticum aestivum
aaatctctctccgctccccgctccgagtcgcgtcgcgtgaggagaaaggaagggaagccggaaagggttctcgccgaggcggaaggaggagatggccgggaagggaggcaagggcctgctcgcggccaagacgacggccgccaagaccgccgagaaggacaaggggaagaaggcccccatctcccgctcgtcccgcgcggggctgcagttccctgtgggccgtatccatcgtcagctgaagcaaaggactcaggccaatggccgtgttggtgctactgcggcggtctactctgctgctatcctggagtacctgacagctgaggttctggagctggctgggaacgccagcaaggatctcaaggtcaagcgtatcacccctcgtcacctccaactggccatccgtggagacgaggagctcgacaccctcatcaagggcaccattgctggtggaggtgtgatcccgcacatccacaagtccctgatcaacaagtcctccaaagagtgaacagaaaaaatagcaaaggagcatctctagcttgaactggacattttctcagtcgtctgtcagataagtttatcgtcgtgtcatttagtgtttagctgtgctccttccagatcgaagtcgttgtctgtctgtgtaatgtttacctggtactgattcagtcatttggacatggtgtttatgttcgttcgttgactctgtgatta

SEQ ID NO: 3419 - DNA, 746 bp, Triticum aestivum
acgcggggaaaaaatcctctctcgggctccccgctccgagtcgcgtcgcgttgaggagaaaaggaagggaagccggaaaagggttctcgccgacgcggaaggaggagatggccgggaagggaggcaagggcctgctcgcggccaagacgacggccgccaagaccgccgagaaggacaaggggaagaaggcccccatctcccgctcgtcccgcgcggggctccagttccctgtgggccgtatccatcgtcagctgaagcaaaggactcaggccaatggccgtgttggtgctactgcggcggtctactctgctgctatcctggagtacctgacagctgaggtcctggagctggctggcaacgccagcaaggatctcaaggtgaagcgtatcacccctcgtcacctccagctggccatccgtggagacgaggagcttgacaccctcatcaagggcaccattgctggtggaggtgtgatcccgcacatccacaagtccctgatcaacaagtcctccaaagagtgaacagaaaaaatagcaaaggagcatctctagcttaaactggacattttctcagtcgtctgtgagataagtttatcgtcgtgtcgtttagcgtttagctgtgctccttccagatcgaagtcgttgtctgtctgtgtaatgtttacctggtactgattcagtcatttggacatggtgtttatgttcgtcgttgactctgtgattggactctgaatgcaaaaacctttt

SEQ ID NO: 3420 - DNA, 734 bp, Triticum aestivum
ggcagtgccaaaagaatacgtaccaggcgtgatgaaggggattgaagaaagcttgcccaacggtgtccttgctggttacccagttgtggatctaagagcagtgctggttgatggctcctaccacgatgttgattcaagtgtccttgcctttcaaattgcagccaggggggccttccgtgaaggattgaggaaagctggcccacgactcctggaacctataatgagggttgaagtgattacccctgaggagcatttgggtgatgttattggtgacttgaactctagaagaggacaagttaacagcttcggagataagtccaggtggacttaaggtggttgatgctttcgtgccgctggccgagatgttccagtatgtcagcactctgaggggaatgtccaaggggcgcgcgtcgtacacaatgcagcttgccaagtttgacgttgtcccacagcatatccagaaccagctttctgcggcaaaagaggaagctgctgcttaaatcttcagtattcgtagataatatatatgaggacggcagagcaggtgagtataggacatcaaggtgtatgtagctttgtagtgtcgaacccagtgggtgatattatttgccattgtttttggacctgataatgtccataattttgcaagctgttataatttcataatgaccttgtcaagttctcacaaacgagaaaacagttcgttataaattttgcctacatgcttcagtcca

SEQ ID NO: 3421 - DNA, 724 bp, Triticum aestivum
gagtgaataaaggagggcagtgccaaaagaatacttaccaggcgtgatgaaggggattgaagaaagcttgcccaacggtgtccttgctggttacccagttgtggatctacgagcagtgctggttgatggttcctaccacgatgttgattcaagtgtccttgccttccaaattgcagccaggggtgccttccgtgaaggattgaggaaagctggcccacgactcctggaacctataatgagggttgaagtgattacccctgaggagcatttgggtgatgttattggtgacttgaactctagaagaggacaagttaacagcttcggagataagccaggtggacttaaggtggttgatgctttcgtgccgctggccgagatgttccagtatgtcagcactctgaggggaatgtccaaggggcgcgcgtcatacacaatgcagcttgccaagttcgacgttgtcccacagcatatccagaaccagctttctgcggcaaaagaggaagctgctgcttaaatcttcagtattcgtagataatatatatgaggacggcagagcaggtgagtataggacatcaaggtgtatgtagctttgtagtgtcgaacccagcgggtgatattatttgccattgtttttggacctgataatgtccataattttgcaagctgttataatttcataatgaccttgtcaagttctcacaaacgggaaaacagttcgtaataa

SEQ ID NO: 3422 - DNA, 636 bp, Triticum aestivum
ctggacgcccttgacctcaatgcccgcatcccgactactgcctgcccgcctgatgacccagccggcgtcgtcgagcagattgtcgacctgggggcgctgggctaccgtgccccggagctggcggcatccaagaagccatccccctcgttcaagtctgacgtctacgcctttggtgttgcgctgctggagctcctgactggccgatgcgcgggtgacgtcatcacggggtctgaaggcggcgtcgacctgaccgactgggtgcggctgcgggtggcggaaggccaagaatcggagtgctttgacccggccatggcttcggactcggagaaccagcagggggtgaagggcatgaaggaggtgctgggcattgcgttgagatgcatccgaccggtctccgaaaggcctgggatcaaatctgtctacgaggatctttcatcaatctagctagccaccatcattctgtagctttagagttggatgctcatgtgctgttagcttgtgcctcaaacactggtgtttctgtaggtgtgtggcatcaacttgatgcctgcaagttcagatggcaatgtctcattggttcccaagtgccgccgtgctgtacttacattgtttattatggaatctgcttttgcaagt

SEQ ID NO: 3423 - DNA, 738 bp, Triticum aestivum
  misc_feature (93)..(93): n = any nucleotide
gatccgttgatgtggcacgtggcctgaatacctccatttcgaccgtgcaatgcctcatggaacctcaaggccaccaacatcttgctggacgcnccttgacctgaatgcccgtgtcgcggactactgcctgcaccgcctgatgacccaggccggcgttgtcgagcagattgtcgacctgggggtgctgggctaccgtgccccggagctggcggcatccaagaagccacccccctcgttcaagtctgacgtctacgcctttggtgttgcgctgcttgagctcctgactggccgatgcgcgggcgacgtcatcacggggtctgaaggtggcgtcgacctgaccgactgggtgcagctgcgggtggcggaaggccaagaatcggagtgctttgacccggccatggcttcggactcggagaacccgcagggggtgaagggcatgaaggaggtgctgggcattgcgttgagatgcatccgaccggtctccgaaaggcctgggatcaagtctgtgtacgaggatctttcatcaatctagctagccaccatcattctgtagctttagagttggatgctcatgtgctgttagtttgtgcctcaaactctagtgtttctgtaggtgtgtggcatcaacttgatgcctgcaagttcagatggcaatgtctcattggttgcctagtgccgccgtgttgtacttacattgtttattatggaatctgcttttgcaagtagattagccaactt

SEQ ID NO: 3424 - DNA, 739 bp, Triticum aestivum
cgacctcaagacgcgcgtgtgccagagagagacgctggcagactggtcaaggcagcaaccaccataatctggaccaggtcggccctgcacgccgctgtaaacttcggcagtacccgtacgcaggttaccaccccaacaagccgtcagcgagccgtcgtccgatgccggagccgggcaccgaggaatatgccatgctggcccgcgagcccgaaaaggtattcatccacactatcaccaaccaggtgcaggccatcattggcatttcactgctcgagatcctatccaagcactcctccgacgagatttacctcgggcaacgtgacacgccggagtggacatcagacgcgaaggctctagaggcgttcaagcggtttggcacgaggttggagggcatcgagagcgaggtggttgccttgaacgggaacccccagctcaagaaccgcaatgggccagtcaagttctcatacatgttgctctaccccaatacctctgaccacatggcgatgccaccgggctcacggctaggggcatccccaatagcatctccatttgatgagatatttggagaatggttgctgctcgctagcatgcggaaatgttggggtgcatgcttcctgggtcattgcttgaataatctacgtacatcatgcccatttgccatccaagtgatgtgtgcttggctagccactggcaatgtatcttccatgtatatttccctttcatttatatcaataaaatg

SEQ ID NO: 3425 - DNA, 940 bp, Triticum aestivum
atggctcgacttgatagagaagcaccaaactaccaaaaggatggctacaacgattttaatacattctacatacaggctgcatctggtactaaaggtggctctagtggttcccctgttgttgattgccaaggaagagctgttgcactgaatgcaggaagcagcagttccagtgcttcggccttctaccttccattagacggtgtagttagagcactcaatctgatacgtggctgttgggacacatttggtagcaagccagaatctgcttatattcctcgtggtacacttcaggtgacttttcaacacaaaggtttcgaagaaacttgatgtcttggacgcaggaatgaaaccgagcaggctgtacgacttgtttctccagcaggggagactggaatgctggttgttgattctttgttctgttattgcaggtgccagatggacctgcagacaaacatctgaaacctggtgacgtgctgattcgcatgaatggggagattgtaacgcaatttctcactatggagtccttacttgatgagagtgttggcagcgagataaatttgcagatcgaaagaggtggaactcctttgacagtaaagctgaaggtaggggatttgcactccataactccaaatcatttcctggaagttagtggtgctgtcatccatccactttcataccagcagtgtttttgcagcattggcacccgttgtctaagcagcgggaccgaaagaggctgggactgatgatgaacccgttgtgtgatgatgctagcctccttgcctcgcaacaagccccctcactcagtggccacttggtggtctttctccctattggttttatgcttttcttaggtgtgtttgtgcgtgagtgccccagtaggatcttctatttcgttgaacttgacagtcttgtatggacgtggtgttgactttatttatat

SEQ ID NO: 3426 - DNA, 1125 bp, Triticum aestivum
tagattgcttgcaaggctggaagtgtcagcgctttgtgctgtatgccgtgacacacctgaggatgctgttgtggcgatgtgtggtcatattttctgctatcagtgtatatacgagcggataacaactgatgaaaacatgtgccccgtccctaattgcagaaacacgttaagtactgaatcagtattttcatcagggacattaaagatttgtatctccggcaagaccagtactcatgcgatagcgagttcatcagcagacgatgagctatcttctatcagtcaaagcagttacatctcctcgaagatacaagcaaccgtcgatatactgaattctatcattaacatgcatgcccttacagacagtgataccattgaatcaaatccaaaccgagtatcccctgtgaaagccattgtcttctcgcagtggactggcatgctggatttgctggagttttcactgaacagcaatcttatacagtacaggagactagacggaacaatgtccctcaattcaagagataaagccgtgaaggattttaacaccgacccagaggttagagttatgattatgtcattgaaagcgggtaatcttggtctgaacatggttgctgcttgccatgtaatactccttgatctttggtggaatccttatgctgaggaccaggcaattgatagagcacacagaattggtcagactcgtccggtcactgtctctcgtctaaccattacagatacggtggaagatcgtattttatctctgcaggaggaaaagagagcgatggtcaactctgctttcggtgaagacaaatccagtgcccacgctactcggctgactgtagatgatctgaggtatctgtttaggatatgattgcgaggagatgatcccttgttgcgttgctagctttggaaatcgtcaaagtggtggcagcatgtacgttgcttgcaatctacctatgtctctccctgccccgccgacgatccagttttgtcatgctccgatcgatcttacatgtgacatcggagggccaactagctagcatgtctagtgtaacgtacttatgtccctgagaattcttgtgtgctctgttccctgtgatgacaggagagatccatatgtatagtgtg

SEQ ID NO: 3427 - DNA, 820 bp, Triticum aestivum
gactacgtcgtggccgccggagccgcgttcctcgcgtacctgctcctgccgccggcctggtccctgctctcatacggcctacgcggctacaaaggtgacctgagcccagctcaagctctggacatggtcacctctcaaggttacctgatcatcgacgtgcgaagcgagaacgacaaggccaaagccggcgtgccgcagctcccctccaacgcaaagaacaagatcatcgctctgccgcttgaagagcttccgaacaagataaagggaatggtgcgcaatgcgaagcgagccgaggcggagatcgccgcgctgaagatctcctacctcaagaggatcggcaagggctccaacatcgtcgtcatggactcgtacggtgacaactccaagattgtggccaagacactcaacagcgtggggttcaagaactgctgggtcatggccggcggcttctccggccgaaaagggtgggcgcagagccgccttgggacggactcctacaacctctccgtggtcgaagtcgtgaagccgtcacgggtgattccggcggccgctgaacggttcgtgacggtctcgtcgacttcgactccctccaggacgagtcgcaagcttctccctggcagtgtggacagctgagaaaagatttgaactctgtagaaatccaatgtccatttcactgaatttccagctttttgttctgtaacctgtacaatgttagtgctgcaagctgcttataagcatcctcagaaaaaaacgccgcaaacatccagggcatataaccattggtggaaaattagaaactgttttagaggactaatgttaa

SEQ ID NO: 3428 - DNA, 579 bp, Triticum aestivum
aactcctgccagtattttttgtcgcaaccctgcaaagagaataacaatgagggagatcaggaaccacccctggttcttgaagaacttgccaagagagctcacggaagctgcccaagcaatgtactacaagagagacaacagcgccccgacctactcggtccagtccgtggaggagatcatgaagatcgtggaggaggcgcagaaaccgcctccttccaccactccggtggcgggtttcgggtgggcggaggaggacgagcaggaggatggcaagaagccagaggaggaagcggaggaggaagacgaggaagatgagtatgagaagcagttgaatgaggtccgtgccagcggtgagttccacatcagctagctgatgggggtgcttcactggcgtgagaaggccacagaccggggataaaatttgtcatatagtttgtagtgtgtggttttgttctcgagtttttctcttcattattgtctcgattctgcaacagtgtaaattaccaaagtggttccgtcgctgtctttacaatgactgattaagctagcattgcggaaacataatgtatggaataaatc

SEQ ID NO: 3429 - DNA, 1163 bp, Triticum aestivum
aagatgacgagaatgtggcgagggagatcaataaaccccggtcgctgcggcatccccacataatccgattcaaggaggtggtggtcacgccgacgcacctggcgattgtgatggagtacgcggccggcggcgagctcttcgaccggatctgcaacgccgggaggttcagcgaggacgaggccaggtacttcttccagcagctcatctgcggcgtgagttactgccacttcatgcaaatttgccaccgggacctgaagctggagaacactctgctggacggcagcccggcgccccgcctcaagatctgcgacttcggttactcaaagtcgtcgttgctgcactcgaagcccaagtcgacggtcggcacgccggcgtacatcgccccggaggtgctctcccgccgggaatacgacggcaagacagcagatgtgtggtcttgtggagtgaccctttatgtgatgctagtcggcggttacccttttgaggatcctgatgaccccaagaacttcagaaagaccattgggagaataatgtcaatccaatacaaaataccggagtacgtccacgtatcccaagactgcaagcaactccttgccagtattttcgtcgcaaaccctgcaaagagaataacaatgagggagatcaggaaccaccctggttcttgaagaacttgccaagagagctcacggaagctgcccaagcaatgtactacaagagagacaacagcgccccgacctactcggtccagtccgtggaggagatcatgaagatcgtggaggaggcgcagaaaccgcctccttccaccactccggtggcgggtttcgggtgggcggaggaggacgagcaggaggatggcaagaagccagaggaggaagtggaggaggaagacgaggaagatgagtatgagaagcagttgaatgaggtccgtgccagcggtgagttccacatcagctagctgatgggggtgcttcactggcgtgagaaggccacagaccggggataaaatttgtcatatagtttgtagtttgtggttttgttcttgagtttttctctttcattcttgtctccgattctgcaacagtgtaaattaccaaagtggttccgtcgctgtctttacaatgactgattaagctagcattgcggaaacataatgtatggaataa

SEQ ID NO: 3430 - DNA, 896 bp, Triticum aestivum
  misc_feature (112)..(112): n = any nucleotide
  misc_feature (227)..(227): n = any nucleotide
  misc_feature (314)..(314): n = any nucleotide
tgctaacatcccatcagacccccagagaattctgtatttctactgatgctgattcagagaatgggaccccagtaaaaacgccatcccctccttgacctgtattctgtttgtngggatgtcaacagggctgtgcttgggttcagcacttgctggcctgaaacttgaaacaaatgggctgttgacctgaacaactttgcatgcaagagccttaaatataaccatcccanaacagaggttcgaaatgaaaaagccgaggattttcttgcacttcttaaggaatgggcgattctatgtgacaaatatgtccatagcantgattctgatgcagcagatcctgttgaggaagaggaagatgatgagcctcttggaaaggatgagtttgtggtggaaaagctacttgagatctgctatggtggcactgggaggaaaaatggaatccattttaaggttcaatggaaaggatatggcccagaagaggatacctgggagcccatagaaaacctgagtgactgcccattgaaaattaaagagtttgtgcaagaagggtacaggcgaaacattctaccccagcctggtcaggttgatgttatttgtggtggcccgccctgccaagggataagtgggttcaaccgatttagaaaccgtgataaccctttagaagatgagaaaaatcaacaaatggttacctacatggacattgtctcttatctgcaaccaaagttcgtcctgatggagaatgtggtggacattctgaaatttgctgatggctatcttggaagatatgcattgagccgtcttgtatctctgaactaccaagcccgccttggaatgatggtagctggttgctacgggcttcctcagttcagaatgcgtgtgttcctttggggagctctccc

SEQ ID NO: 3431 - DNA, 631 bp, Triticum aestivum
cacgactcgccggctgtcgccagccgatataattcaccgaccacagttaagtgctattatgaccagctgttgttcgggggctggagcctgccatgaccgcggggtgctgcaccgtgatattaagggtcgaatctgcttttggataacaatggcatgttgaagattgcagattttggtctggcgtcattctttgatccgagccgtaagcaaccgatgacaagcagggttgtgacactatggtaccgcccaccagagttacttttgggcgcgaccgattatggggtgggcgtggacctatggagcgcgggatgtatactcgcggagttgttggctgggaggcctattatgccaggccgaaccgaggtggaacagctgcacaaaatttttaagctgtgtggctcccccacagaagaatattggaaaaagtcgaagttgcctcatgcaacgatatttaagcctcagcagccatacaaaagacgaataacggatacattcaaagattttccacatccgcactgcggttgattgaaacactacttgcaattgatccggctgatcgtttgacagcgtcctctgcattaagaagtgatttctttaccactgaaccttatgcatgcgaaccatcgagtct

SEQ ID NO: 3432 - DNA, 1425 bp, Triticum aestivum
ccgagcactgtgtcagctgaattgttctaaggtttctttagtagattgtcttagtttttgtgtttagttgatgttgatgaatctctatcagtcaaatttcgaacctgtaaattgatagatcttcaccgttcagtttctgttgctttaataataatagattcttatcattgtattttttctatttttgttgtaattctacattttgctctcggacaacaatacaatgcagaaggtttaacagtaggataatttcagcaaaatgcattgaacttgtttattttacttttagagagggcttggtgccaggtacaaaatgtaggcgcctccccccctccaggtttcctgcataaaactcatttcaggctgttgtggtttatacagaatggaaatgaaagcaaaatatcttaagatggcaacatcggagcaacagagggcggatgaaaatgtgctgaagcttgtggaaaaacacaagagggagaaacaagctgctctaaatgagattatcaagttagagcagaaactggatgccaagcagaagcttgaattagaaataaaacagatgcagggaaaattggaagtgatgaagcatatgccaggtgtggaagactccgaatcaaaaggaagatagatgaacttagttgccgagcttgaggacaagtatgatgaaatggatgcaatggaatcactccaccatactctacttatgaaggaaaggataagcaatgatgagttgcaagatgctcggaagaagttaatagatggtttgcgggatcttacaactggccgaggaattataggaattaaaagaatgggtgatcttgatctgaaatcatttgcgattgcttgcaaaaataaaatgtcaaaagaagatgcaggcgttactgcttccattctttgttcaaagtgggaggaggagattaaagatccagaatggcacccttttaaagttatcgtggatgaaggcaaagagaaggaaattctccgcgaggatgacgagaagctgcgagaactgaaagaagagtatggcgaagtgtatggcttggtaacaaggctctgcttgaagttaacgagtataaccctagtggccgctatcctgtacccgagctgtggaacttcaaagagaagaggaaagcaactctcaaagaagctgtccagtacgtcctgagacagtggcgcacacagaagaggaagcgctgagcccagatatctaaattcctgtagtgaactagaagtgcgtttctgttattttcctcatgaatgttggtaaacgtttagttgtctaggtttccttggattattcagcctggtgtagcattgacatgaatgctagtacttggagattgtgaatcgccctttcaggataatctttttcgtgccaagctatgtgctagtatgaatgaacggctactagtttgttgatttcaa

SEQ ID NO: 3433 - DNA, 571 bp, Triticum aestivum
tgtcgcacgcggagcaggcgcacccggacgagctggacgaggagttcgacacgttcccgacgtccaagccgagcgacgtggtgcgcatgcggtacgaccggctgcgcagcgtggccggcagggtgcagacggtggtgggcgacctggccatgcagggggagcgcgcgcagtcgctgctgagctggcgcgacccaagggcgacggccatcttcatcaccatgtcgctcgtcgtggccgtggtgctctacatcacgccgttccaggtggtggccgtggtgttggggctcttcatgctccgccacccccgcttccgcagcaagcagccgtccgtgcccttcaacttctacaagcgcctccccgccaagggtgacatgctcctatgaccatgtttcttttctcttcttttttgcgtagagtcctcgaaattaatttcagtacatatatattcactactacgtactactactacactgcacaatcgatcactttgtgtttgtgtgatcagagaatcatagaaataaaaataagaaaggctggaatggattccgtggatagatactctgaacattca

SEQ ID NO: 3434 - DNA, 621 bp, Triticum aestivum
acgatactggtgcacgtgctcttcgctcatcctggtgtgctacccggagctgatcctggccgacggtgttcttatacctgttcatgatcggggtgtggactaccggcggcggccgcggaagccgccgcacatggacacggtgctgtcgcacgcggagcaggcgcacccggagcgagctggagcgaggagttcgacacgttcccgacgtccaagccctcggacgtggtgcgcatgcggtacgaccggctgcgcagcgtcgccggcagggtgcagacggtggtgggcgacctggccatgcagggggagcgcgcgcagtcgctgctcagctggcgcgaccccagggcgacggccatcttcatcacgatgtcgctcatcgtggccgtggtgctctacatcacgccgttccaggtggtggccgtcgtcttcgggctcttcatgctccgccacccccggttccggagcaagcagccgtccgtgccattcaacttctacaagcggctccccgccaagggtgacatgctcctatgaccatgccatgcatggatctctcctcttctctttttttttgcatagagttatctaaattaatttcagtatatatatatatattcactattacta

SEQ ID NO: 3435 - DNA, 765 bp, Triticum aestivum
cccgcgcgaggctccccgcggtcacctctatcactccgtttgcatcgtcagtgctggagatgcacaattcctgccctgtctccgctcttgcctcccgcccctatcctcgaggaggtggagccccaggaactggatcggccaccaacacagatcactatcaggtttaccaccaaccgccgccgcatccgcacaaacagtgatgcagtggctccggtcgcgacatcgcctactcagctcgcagaggcgatgacaggggaaggaggtactggacctgcgaatagcgcagaaactgtatcgtctgaatggccaccgcccccagaatctgatgccgtcgtgtcagagacccgtgagattgagggcttctttgattgagccagaagatagagtttgcaggtatgaacatcttatgactagtgtccatggagcatgaattgaacttctgcttagtggactaatcagttgcagtgaagccagtactttggttcggtgatatggactagttgagttacatttgcttgtgtgttctatcttctatgctagttgatcgatggtaagctggaatagcttataatcatatgaacattcatatgtagctgaacttggagttattatacttactttggaccgcatgttagctgatatgtggtgatatatgtgttttctgttgttaattttgtaagtcttgtaccttgtacactcttttttggtacactgtaattatttgtcgagagttgttattttttaaagatgttctatatatccaac

SEQ ID NO: 3436 - DNA, 613 bp, Triticum aestivum
acagaggttctactccaagattgcaggactaacagtatgaaaaggaatgctagcttgcattctctgaggatcaccacccgtccccgtccttccgcaaccagaaaataaggcgaggaggcgtgcctgatcactggaacactgcgatccatgagtaccagaactcgaagcaggcgctccaaggggggccgccccagagccaccgtgtggacgtggaggagctcaagctgcgtgatgccacgagcgccgcgcagcacgccgcgacgatggccaggctcaagagggagaaggcccattgcctgatgcacaaggcggacctggccctccacaaggcctcggtggccgtcatgatcgcggacgcgatcaaggcgtccagcagggactcgtcgcgggcggcggcggctgacagcaggagggacgacgggcggtgacgcctcgttgtcgggcgtgagcatgatgcgtgcggacgcatcgttttgtcgataggatcaatgcagtagatagcgtcgggccgtagaaaaaccaaccttcctccaaaccccaaaccagttctgtttgatccttttgtacatgtgatatttcttcctccttaccttgttcagagtcttgtctgggg

SEQ ID NO: 3437 - DNA, 669 bp, Triticum aestivum
agatcatcgtgaatgtgttcaggctaccacattgatccctaccagggtgacaagctctctgctctgctcgttgagttctttgagaagtgccaggttgaccccagccactggaccaagatctcacagggtgggcttcagcgtattgaggagaaatacacctggaagctttactctgagaggctgatgaccctcaccggtgtgtatgggttctggaagtacgtctccaaccttgagaggcgcgagacccgccgctacctcgagatgttgtatgccctcaagtaccgcaccatggccagcacagttccattggctgtcgagggagactccgcgagcaagtaatttggccacctcctgaccaaaagaagagtggcttggattcctgcaaagattgagatttgagaatgctttggttttcttcctagacgctgctctttttaagattcaaggtcgagtcagtgtgctagtttggtttagtagttggagtgagtcgagactcgggacagaggaaaatgtggtgtgtgtcagtcggttggtgcttgtcgtatttcttggatgttactgttgaataatagaagcggccttggcgtcgtttctgaaataataatagtagcatccttcctcgttttcaagaaaatctttgtcacagctgctgacctctattatttaata

SEQ ID NO: 3438 - DNA, 472 bp, Triticum aestivum
ccaacggtgacacccatcttggaggtgaggactttgaccacagaatcatggattacttcatcaagttgatcaagaagaagcacggcaaggacatcagcaaggacaaccgtgctcttggaaagctgaggagggaagctgagcgtgccaagagagccctcagcaaccagcaccaggtccgcgttgagatcgagtccctctttgacgggactgatttctcggagccactgacccgtgcgaggttcgaggagctgaacaacgatctgttccgcaagaccatgggaccagtgaagaaggccatggatgatgctggtctcgagaagacccagatccatgagattgttcttgttggtggcagcaccaggattcccaaggtccagcagctcctcagggactactttgacggcaaggagccaaacaagggtgtgaaccctgatgaggctgttgccttcggagctgcagtgcagggaagcat

SEQ ID NO: 3439 - DNA, 726 bp, Triticum aestivum
caagagggcggcgagaagtacatcctgtgttttgacctggttggtggtacttttgatgtcaggtatcttgaccatgacaaatggcgtctttgaggtgttggccacacaacggtgacacccatctcggaggtgaggactttgaccacagaatcatggattacttcatcaagttgatcaagaagaagcacggcaaggacatcagcaaggacaaccgtgctcttggaaagctgaggagggaagctgagcgtgccaagagagccctcagcaaccagcaccaggtccgcgttgagattgagtccctctttgacgggactgatttctcggagccactgacccgtgccaggtttgaggagctgaacaacgatctgttccgcaagaccatgggaccagtgaagaaggccatggatgacgctggcctcgagaagacccagatccacgagattgttcttgttggtggcagcaccaggattcccaaggtccagcagctcctcagggactactttgacggcaaggagccaaacaagggtgtgaaccctgacgaggctgttgccttcggagctgcagtgcagggaagcatcttgagcggcgagggcggtgacgagaccaaggatatcctgctcctcgatgtggcgcccctcaccctcggtatcgagacagttggaggagtcatgaccaagctgatccccagtgacaccgtcaatcccatcaaagagtcgcaggttttca

SEQ ID NO: 3440 - DNA, 610 bp, Triticum aestivum
gcgctcatcgcgcgttcgccgactgcactcgccaacaggcgtcatgcgcgtcttcgagacgtcggatttctgcctggagccgcgcggggacacggcgacgcggcggtcaacgttcgacgccatccttgccggctgcatcccggtcttcttccaccccgggtcggcgtacactcagtacacgctgcactttccgagggaccacgggaggtactcggtgctcatcccgcacgccggcgttgccgcggggaacgtgagcatcgaggagaccctgaggaagatcccgccggaggaggtgaggaggatgcgggaggaggtggtccggctcatcccgagggtggtgtacgcggaccccaggtcccggcgcgtgggcttcagggacgcgttcgatgtcgcgctggaggccgtcatcggtcgggtggcgaagcggcggcggggcgaggccgccggccggtagcagtggcactagtcgccatcgacggttgtgcacgctattgtgccgtgctgaattgagtccaacaatttcaggattacgtgcgcgagtggaacgacttttccctttctggtttcgtgcctggagttccggatcgggtcgttaccgtgtaatcagcta

SEQ ID NO: 3441 - DNA, 587 bp, Triticum aestivum
tgacccccctaactcatcaaagcgccgattcagggtcaagccctgtgatccaagcaccgtagagcctccacagcgaatgcttcatggctttggatgctatcttttctccgtcggcatcggtgcagatagaatcatatgtggaggcgaggatggctctgtcagggtctggaacttctcagaagcactggagattgagaagaaggcacaggctttaaggagtctgagacaggagaaccgcatgaggcggaggaaggcgcaagtggagatgaatgcaaatggtagaagggttgaccattgctcagtagccatgaaaaggaacccattgaagggtgataagagtgtcacctggcaaatcaagcgccccatcagtgacaaggtcaaatcctagattgggtatttgtacccttcgtaatataacatttttcttttccgattccatccataagctcggtttgctacatgtaggtcaacatttggcaatttcctatattcaacttatatctagtgcactgtggtcgcatttgatatgtatgcaattcttatttgacctggtgtacattgggtccactggaagaaagttttccata

SEQ ID NO: 3442 - DNA, 608 bp, Triticum aestivum
tgatgcaggatcgcactaattgatttgaggaagatcctgacccccctaactcatcaaagcgccgattcagagttaagccctttgatccaagcaccgtagagcctccacagagaatgcttcatggctttggatgctatcttttctccgtcggcatcggtgcagatagaatcatatgtggaggcgaggatggctctgtcagggtctggaacttctcagaagcactggagattgagaagaaggcgcaggctttaaggagtctgaggcaggagaaccgcatgaggcggaggaaggcccaagtggagatgaatgcaaatggtagaagggttgaccattgctcagtagccatgaaaaggaacccattgaagggtgataaaagtgtcacttggcaaatcaagcgtcccatcggtgacaaggtcaagtcttagattgggtatttttacccttcgtaatataacatttttcttttccaattccatccataagctcggtttgctacatgtaggtcaacatttggcatttccctatattcaacttatatctagtgccctgtggtcgcatttgatatgtatgcaattcttatttgacctggtgtacattgggtccaatgg

SEQ ID NO: 3443 - DNA, 584 bp, Triticum aestivum
gacccccctaaactcatcaaagcgccgtttcagggttaagccctttgatccaagtaccgtagagcctccacagcgaatgcttcatggctttggatgctatcttttctccgtcggcatcggtgcagatagaatcatatgtggaggcgaggatggctctgtcagggtctggaacttctcggaagcactggagattgagaagaaggcacaggctttaaggagtctgagacaggagaaccgcatgaggcggaggaaggcgcaagtggagatgaatgcaaatggtagaagggttgaccattgctcagtagccatgaaaaggaacccattgaagggtgataagagtgtcacttggcaaatcaagcgtcccatcagtgacaaggtcaagtcttagattgggtatttgtacccttcgtaatataacatttttcttttccgattccatccataagctcggtttgctacatgtaggtcaacatttggcattttcctatattcaacttatatctggtgcaccgtggtcgcatttgatatgtatgcattcttatttgacctggtgtacattgggtctaatggaagaaagtccccat

SEQ ID NO: 3444 - DNA, 800 bp, Triticum aestivum
agggaaggatcacttccctggtctaacatcctactggagatgagtatgttcctgtgcagctattaaaggatcaatactgcaaccggaggaatcagcaagggccaggattcctggtgagaatggaacagttacaggaagagcttgcccaaaggtctttatggtacattttgcaaggaatgccctttgggaacatacaagaatgttaccggatcttcaaaatctctctgctttccgtgcccttcaggcgaacttcctcgccgtgccgtgtacacaagtgtccgaggaggggctgctgaaactccatgcccgtacatatgtgtgtcagacagatatcgcatgcctcactgttatactgctcttgaagagttaatatacacttttgggggaccttggttatttggtctacttctttcaggccttcttattttgttagctcttgttttaagtgttgctcggatgaaatttgctggcactgatgagttacccgggccagcaccaactcaacaagggtcgcagattgatcactccttccctttcctagaatcactaaatgaggtcttggaaactaatagagctgaagaatcacatggtcatgtacacaggatgtatttcatgggcccaaacaccttcagtgaaccttggcatctcccacacaccccagcagaacagattacagagattgtgtatgaggatgcatttaatcggtttgtcgatgagataaacacacttgcagcttatcagtggtgggaaggatcaatttacagtatcctttgtatacttgcataccctttggcttggtc

SEQ ID NO: 3445 - DNA, 605 bp, Triticum aestivum
gcaagaatttgttgatggtgcactcagtcatatagtgcacatgtcaaagatcataggtgaagaaatcggctgtggacatccaatgtggcctgctgtgattcatggtcattatgccagtgcaggagttgctgctgctctgatatctggagcacttaacgttcacatggtatttactgggcattttcttgggaaagacaagttggaagggcttctcaagcaagggagacagacaagggaagaaataaatatgacatacaaaataatgcgccgaattgaagcagaagaattatctcttgatgcatctgaaatagtaattgcaagtactagacaagagatagaagagcaatggaatttgtatgatggttttgaggtcatgcttgcaaggaagcttcgtgcgagagtcaagcgtggtgctaattgctatggacgttacatgcctcgtatggttataattcctccaggtgttgaatttggccatatgattcatgaatttgatatggaaggcgaggaagatagccattccccagcctctgaagatccgcctatttggtctgagataatgcggttcttcacaaatcctaggaaacctttgattctggctgttg

SEQ ID NO: 3446 - DNA, 607 bp, Triticum aestivum
ccattcttggttcaaagtgggaagaggagattaaaaatccagaatggcacccttttaaagtttatcatggtcgagggtagagagaaggaaatttctccgtgaggatgacgagaagctgcaggaactgaaagaagagcatggtgaggaagtctatgggctggtgacaaaggctttgcttgaagtgaatgagtacaaccctagcggccgctattctgtgccggagctgtggaactacaaagagaataggaaggcaaccctgaaagaagtggtccagtacgtgctgaggcagtggcgcacacagaagcggaagcgctgagcccaagtacctaggttcctgaagcaatgaagtagtgaagtagaagtgtattgatcttatattgtcatgaactcgtgaatgttggtgatggtttagctgtggatcattcagccttggccctggccctggccctggttggtatagcattgacatgaatgctggtaattggagattgcgaactgtcctgttaggatgtattttgtaccaagctatgaagtaactgtcgctggaatgcgtgtaagattcactgatttcagcgacagttaaatccgaacggagttagtagtatga

SEQ ID NO: 3447 - DNA, 1374 bp, Triticum aestivum
ttcatctgttggatctctgaagtcaagaacccaccactgataatcttgttctgcagcagactaggcttgagtgatgggggaagccgccggcgaccgtgtcctcagccgcctccacagcgtcagggagcgcatcggcgactccctctccgcgcaccccaacgagctcgtcgccgtcttcaccaggttggtcaaccttggaaatggaatgctgcagtcccaccagatcattgctgaatacaacaccgcaatccctgaggcagagcgcgagaagctcaaggacggcgcctttgaggatgtgctcagggcagcgcaggaggcaattgttatctcgccgtgggtcgcgcttgccatccgtccaaggcctggtgtctgggagtatgtgagggtcaacgtgagcgagctcgctgtcgaggagttgagcgtccctgagtacctgcagttcaaggaacagcttgttgaaggaagcaacaaggactttgtgcttgagctggacttcgagccattcaatgcctccttccctcgcccttcgctgtccaagtccatcggtaacggcgtgcagttcctcaacaggcacctgtcatcgaagctcttccatgacaaggagagcatgtaccccctgctcaacttcctccgcgcacacaactacaagggcatgactatgatgttgaacgacagaatccgcagcctaagtgccctccagggagctctgaggaaggccgaggagcatctgtctggtctcccggcagacaccccgtactcggacttccaccacaggttccaagaacttggtctggagaagggttggggtgactgcgccaagcgtgcgcaggagacccttcacctgctcctcgaccttctcgaggctcccgacccgtccacgctcgagaagttccttggcacaatcccgatggtgttcaatgttgtcatcctctcgccgcacggttactttgcccaagccaatgtcttggggtaccctgacaccggaggccaggttgtctacattctggatcaagtccgtgctatggagaatgagatgctgctgaggatcaagcagcaaggccttgacatcacaccacggatccttattgtcaccaggcttctcccagatgcaaccggcacgacctgcggtcagcgtctggagaaggtcctcggtacagagcacacccacatccttcgtgtgccattcagaactgaaagtggaattgttcgcaagtggatctctcgttttgaagtctggccgtacctggagactttcactgaagatgtggcacacgagatctctggagagctccaggccaatcccgacctcatcatcggaaactacagcgatggaaaccttgttgcgtgcttgcttgcacacaagatgggtgttac

SEQ ID NO: 3448 - DNA, 602 bp, Triticum aestivum
atttggatgaagtggatgctaatccggaggaatacattaaggaggctcgtctctgtgttagcgaacgaccatgacaaaaggagaagcagttgaacggcacccacaaagcgcatgtgcactcacaagaggaggctgagatcctagcgaggttcaaaccggaggtggacgtgtcatctctgatcccaagcatgagaagcgcggagcagtccatggacgcctgcctgcgccgcttccgcgccacgcgccacatgatcctctactacgaggacttaatccgcgacaacaatgcgctgtctcgggtgcaggagttcctggggctcccggtgaggaggctgtccagcaggcacgtcaagatccacaccagcccactcccggacctggtggacaactgggaggacgtgagacgcacgctcaagcccacggagtttgctcgtttccttgacggctgaagactactagtagacagaacatgtcgattcatctgtttttgctacggcaggcccttctgttttcttttctttcgtgggactgcacaatggggttggaagttgttgttcagctgttttccttctcaaagataacggagtagtgcccagataata

SEQ ID NO: 3449 - DNA, 708 bp, Triticum aestivum
gaggaacatcttaggaatgcagaaagatgtgtttgcatgctagagagctaccttgcgagggaatcggcagggtagccgcccctgtttctgctttgattgaccttgatgacaccgcttcacagcagcacacaacacacctcttcttccatgtgcttctgcacaatggggttcgacgtggcatctcaaccatcatcttagattaccacctcggaggggacggttgaggtcatataccacccgcaggctccctttgaaggtccgggatcgctgctgctgttctgtgtgcatagcatacatctgcctgccatcatgggagagcagaaggggaatattctgatggggaagtacgagatggggaagatgctcgggcaagggacctttgccaaggtctaccatgcccgtaacatcgagacctcgcagagtgttgccatcaaggtgaccgacaaggagaaggttctgaagggcgggctcacggatcagatcaagcgcgagatatctgtgatgaagctggtgaagcacccaaacattgttcagatgtatgaggtcatggcaaccaaaacaaagatttattttgtgttggagcatgtgaagggtggagagctgttcaacaaggttcagaggggaaggctcaaggaagatgctgcaaggaagtacttccagcagctgatctgcgcggttgacttttgtcacagcaggggtgtctatcac

SEQ ID NO: 3450 - DNA, 752 bp, Triticum aestivum
catgtgtatcaggcatgtggaagacaccagctgagaggtgtttcctatggcttggaggtttccgaccttctgagcttttaaagcttctttcgacccagcttgaacccctaactgagcagcagctgtcagggatatgcaaccttcagcaatcatcacaacaagctgaggatgctctttcacaaggaatggaggctcttcagcagtctttggcagaaacgttggctgggtctatcggctcttctggatctggatcaacaggaaatgtggcaaactacatggggcaaatggccatggccatgggaaagcttggaacccttgaaaatttccttcgccaggctgacaacctgcggcagcagactcttcagcagatgcaaaggatcctgaccacaaggcagtctgcccgtgcacttcttgtgataagtgattactcatcccggcttcgtgccctaagttctctctggcttgctcgaccaaaggaataacaagcgcgtgtgatttgactgcaatacattttcgcagtttgggggtgatggtggtggcagtcatgcaacagacttgattcagagaaacttgcacatactataatccaaagcgatgttgtgttcaggtagcttagccatatagtgaagttgagtgcattagggccgggtccttgttgtaccgttaaccgctgtaaaattggcatctaatggttgccaagtaatctttaagatcctaatttgcagagagccatccctgttagatgtgcattt

SEQ ID NO: 3451 - DNA, 674 bp, Triticum aestivum
ctcgagctccagcgcatggggatcggtctttttgtgtccaccatcgcagtggcagtcgcagcattggtcgagatcaagcgcctggagagcgcaagatccgagggcctggtccatcagaaggtgcctgtttccatgagcattctctggcaggcgcctcagtacctgctgatcggggtcggtgaggtgttcacgtccatcgggcaggctgagttcttctacaaccagtctccggattccatgagaagcctgtgctcggctttcgcccttgtcaccgtgtcgcttggaagctatcttagctcgttcatactgacctggtgtcgtatcttacgacgcgtggggagcagatggggtggattcctgacaacctgaatgaaggccaccttgaccgcttcttctggctcattgctggcctcagctccctgaattttctcgcttttgtttattttgcacagcagtacaagtgcaagaaagcttctgtactttgatgtttccgcctttgccttgtattgtacagaaagttgtgtggatatttctctcatgaacaagctaacaatgtacaggctacaatgtatagtcttctgtaatgtacagtcttgtatcctttgatagttgtatacatttgtttacttggagagtgggaatagtgtgccttttccccttgttaatgaagctta

SEQ ID NO: 3452 - DNA, 460 bp, Triticum aestivum
ctgccagtgagcgatcttagaagaatatccaggccaagcctccgagcatcaacttcgtcaaatctgccaaatcatgagccgccagttgatggaatccatgctgctgcagcaccgtctgcagatcaaacttctaattcgagcacaatggctgtgattcaggaggatgctgcttttactgaaagcgtaggagaaccaagcaatgcaggttcctcaagaaccctgaggaggaggggaagaagcgatgccttaggttcgttggatgtggatggtggcgaaacacaccggaacaagagaaggcggctgaactaaagctaagaaggccgaaccgagtattgcagaggcttcagcgttgctccagtttttacggttcgctcttctcaatgagcccattttatctctttgggcacactgtgctgagtctgatcaaaagtcttcctcttccgcttgtttaatagggtac

SEQ ID NO: 3453 - DNA, 493 bp, Triticum aestivum
ccttgttggccttgcaaatacggaaaggttggcaactgcagtgagcgatcttagaagaatatccaggccaagcctccgagcatcaacttcgtcaaatttaccaaatcatgagccgctagttgatggaattcatgctgctgcagcaccgtctgcagatcaaacttctaattcaagcacaatggctgtgattcaggaggatgctgcttttactgaaagcgtaggagaacctagcaatgcagggtcctcaagaaccctgaggaggaggggaagaagcgacgccttaggttcgttggatgtggatggtggcgaaacacaccggaacaagagaaggcggctgaactaaagctaagaaggccgaaccgagtattgcagaggcttcaatgttgctccagtttttacggttcgctcttctcaatgagcccattttatctctttgggcactatatgctgagtgtgatcaaagtcttcctcttctgcttggttaatagggtgc

SEQ ID NO: 3454 - DNA, 595 bp, Triticum aestivum
cgatcttacgtgggaataacttaaaacagacaatggggagtacaaatgcattttgttgcctgcaaataggaaatggtcctccaaggcaaaccaagctggttaaccagagcatctgcccggtatggaacgagggattcacttggttattcgacatccccccaaaagggcagaagctgtacatcttgtgcaaaagcaaaaatacatttggaaagtcaaccctcggaagagtaaccatccagatcgacaaagttgtcactgagggagtttacagtgggttctttagcctcagccatgacggcggtaaggatggctcaagaacactagagatagagattgtatggtcaaatagaccggccaacgacaatatgtagcatggctaatttcgcatggtgccaatattattgtcggggcgcttagatgtaaatcagccccataaacatccacattcatcgcagtgtagaaaattacatggtttacagacatctgcctcaacattatttcgaggtcgttcttggtttagcccctgtagctgcatacggattttggaccggctattttgtttgtacaggtttatttcctgtaattataatttaga

SEQ ID NO: 3455 - DNA, 697 bp, Triticum aestivum
actacagatgcttatgaagacctgtcctcccagttttcatgacagagctgatagcttactgcattgcctgcctggttgcttgaccgtgaccatcttacgtgggaataatttaaaacagacaatggggagtacaaatgcattttgttgcctgcaaataggaaatggtcctccaaggcaaaccaagctggttaaccagagcatctgcccggtatggaacgagggattcacttggttattcgacatccccccaaaagggcagaagttgtacatcttgtgcaaaagcaaaaatacatttggaaagtcaaccctcggaagagtaaccatccagatcgacaaagtggtcaccgagggagtttacagtgggttcttcagcctcagccatgacggcggtaaggatggctcaagaacactagagatagagattgtatggtcaaatagaccggccaacgacaatgtgtagcatggctaatttcacatggtgccaatattattgtccgatcgcttagatgtaaatcacccccataaacatccacattcattgcactgtagaaaattacatggtttacagacatctgcctcacgattatttcgaggtctttcggtttgtagcccctgtagctgtaaacgtattttggaccggctattttgtttgtacaggtttatttcctgtaattataatttagagtagcttggtgtg

SEQ ID NO: 3456 - DNA, 601 bp, Triticum aestivum
cctttgtggcacacatgagtatcttgcaccagaatcatcaaaggggatgggtcacgggagtgctgttgactggtggacgtttggtgtgttccttttatgaacttgtgtatggtaggacacccttcagaggtcctgggaatgatgaaacattggcaaatgttgtttcccagaatctccggttcccggataacccggttgtcagcagcaatgcaaaggatctcatcagaggattgctagtcaaggagccggagaacaggctgggaacgttgagaggagcagctgaaatcaagcagcaccctttctttgaagggttgaactgggccttgatacgatctgctgccccaccagagacacggccttgcgatgtcgtgactcttgcgacggtgcggaagaagaaagaaggcaaatgtctggacttcaggagcgccgaggagctggagtttgaagttttctagtgaggtcttggtacagtttagcacaatttctgccgatagtctacaatttttctgttgagtaggtaaaggttggggctgtctgtacatggtagattcttgtatgctcagttgctgctatattctgtgaatagatcacttttcttaat

SEQ ID NO: 3457 - DNA, 659 bp, Triticum aestivum
gttgatcgatggcttccaagagatcctgaaggagttgaaggacctgcaagaaggaccctcccacctcatgcagcgcaggtcctgtgggtgagacatgttccattggcaagctactattatggaccctcagacagcccatttgctggtggggtattcttggtgaacattcatttcccaccggattatccttttaaaccaccgaaggtctctttccgcaaccaaggttttccacccgaacattaatagcaatggcagcatttgcctcgacatcctcaaggaacagtggagtcctgcacttaccatatcaaaggtcctcctgtcaatttgttcactgctgacggacccgaaccccgatgatccgttggtgccggagattgctcacatgtacaagactgatagggccaagtatgaatccaccgctcgctcctggacacagaagtacgccatgggctaaagccagccaaactggtggacgtgtcgaaacccaacgacgttatcacctaaataaccatcaagtcaccactctccccccaacgaagtatgaatggacttttgagggctgttgtgcccagttgaactcatatgtaccctaccttgtgaagtccgtttcagtctggtagtctgttctacctgactgttctgttatttaagtcgtttcc

SEQ ID NO: 3458 - DNA, 739 bp, Triticum aestivum
tgccacacagtttccgagttttcgccttgagaatttgctcttggtgcttgtgggaaatttggaagtctcacgtcgtcgaatcaggaaatagccaacactgatggaagacctttgtttcttagacattgtgcatatcacacatacttctctgtttctgacataagtgaagtacgtgtcgaagggctggaaacaatggactaccttgacaacatgaagggaaaggagcgtttcacagagcaaggagatgctattgtattcgaatcagaagttgataaggtatatcttgctgcaccctcgaaagttgcaattattgatcatgacatgagaagaacattcgtcgtgacaaaagaaggacttccagatgctgttgtttggaacccttgggataagaaggcaaaagctatgcaagattttggggatttagaatacaagcacatgctttgtgtggagcctgcagccgttgagaagccaattaccctcaagcctggtgaagagtggaaaggaaggcttgggctctccgctgttccttccagctactgtagtgggcagttagatccattaaaggtccttcatggttgagttctcacttcttcctcatgtacaggttatgttttactctagctaagctgtgttctggtttcaatgtatcacttattggattatgttctggtacttacataccacggcaacaacaagtctctcggagcattatggttatgaatatacctggtatgtgatt

SEQ ID NO: 3459 - DNA, 707 bp, Triticum aestivum
atctgagcaaggacaagttgtccctgcaaaggctcagggaactgctgagaaggcgaaggttgagctttcctcaactccacagactgaaatcatctccccttcatcacagcagatgcctctggtgcgaagcatttcaacattaccttgaccagatcaaagtttgagtctcttgtgggcaacctcattgagagaactcgcatcccatgcacaaactgcctcaaggatgctggtgtttctgcaaaggagattgatgaggttctactggttggtggtatgacaagggtgccaaaggtccaggatattgtttctcagatattcggcaagtctccaagcaagggtgtcaatcctgatgaggctgttgccatgggagctgccattcagggtggcatcttgaggggtgatgtgaaggagctcttgttgctggatgtaacacccctttcccttggtattgagactcttggaggcatcttcacaaggctaatcaacaggaacaccacaattccaaccaagaagagccagaccttctccactgctgcagataaccagacgcaggttggaatcaaggtgcttcagggtgagagggagatggccacagataacaagcttcttggtgaattccagcttgaaggtattccaccagccccgaggggtatgccacagatcgaggtcacttttgacattgatgccatggtattgtcaaggtgtca

SEQ ID NO: 3460 - DNA, 591 bp, Triticum aestivum
gtgaccccactaagacatctttatttgatctagttcaacagtttaagggacttcagcacaaatttctatgagaggaaaaagaagaatattgttagtttcttaggcagacgaagccacgcagaataagttacagactcttcaactgtaagctgtggggaatgtatgtcgacttgttcgcagtaacccaagattctgacaaatgtttcctgcaccttgggatatgcacctattcttatgtccccttcaatataacctcctgttttccttcctgctaatacatctagtagagttgtcttcccagctccactaacacccattagtgcagaaagaacaccgggacgtaaagctccagttatgttattaagcagtcgaagtcttcttgttggatagccttgtttcagcatttcctacaagagagtacatttcttacgtacctccatcatcaaatacgaaccaggcaagaaatataaaaaactacaaagcaaatgtatagggggcttgcttaattaccggtggggtatcaatgtagtagttcagattgtggaatgtaattggaagatgcatagttggtatagtcatctttgctgcaat

SEQ ID NO: 3461 - DNA, 629 bp, Triticum aestivum
ctaagacatcgtggttatttgatctagttcaacagtttcaaggacttcagcaacaaatttctatgagaggaaaaagaagaatattgttagtttcttagatcttgtttgtttgtcgacatgagaaggcagacgaagccacgcagaataagttacagactcttcaactgtaagctgtggggaatgtatgtcgacttgttcgcagtaacccaagattctgacaaatgtttcctgcaccttgggatatgcacctattcttatgtccccttcaatataacctcctgttttccttcctgctaatacatctagtagagttgtcttcccagctccactaacacccattagtgcagaaagaacaccgggacgtaaagctccagttatgttattaagcagtcgaagtcttcttgttggatagccttgtttcagcatttcctacaagagagtacatttcttacgtacctccatcatcaaatacgaaccaggcaagaaatataaaaaactacaaagcaaatgtatagggggcttgcttaattaccggtggggtatcaatgtagtagttcagattgtggaatgtaattggaagatgcatagttggtatagtcatctttctgcaataagatgaatgcattgaa

SEQ ID NO: 3462 - DNA, 591 bp, Triticum aestivum
catgtgttcaaatggagcagaggaatatactagggaggagataaactggagttacatagagtttgttgataatcaagatgtgctagacttgattgagaagaaaggtggattgattgcgcttctggatgaagcatgtatgtttcccagatcaacacatgagacatttgcacagaagctgtatacacatttaagaataacaagcgattcgtcaaaccaagctttcacgtacagactttacagttgtccattatgctggcgatgtgacataccaggctgatcatttcttagacaagaacaaagattatgtagtggcggaacatcaggatttgctgaatgcttcttcatgtccttttgtagctagtttattcccttcactccctgaagaatcatcaaagtcttcaaaattttcatctattgggtcacgttttaagctgcaacttcagtctctcatggagaccttgagctctactgaaccccattatattagatgtgtgaagccaaacaatctcctcaagccagccatttttgagaacacaaatgttatacaacaactacgatgtggaggtgttcttgaagctatcaggataagct

SEQ ID NO: 3463 - DNA, 970 bp, Triticum aestivum
ccagctgatgttgcctggaaaatgatgacacgctgtcgctaaagagcacttctgtgcgagcccaggaccatccaaccactaactctgttattgttgcagcagaaatcagatctactgatctgtcatggtgtcgtggacacattgtcaaacgaagaagacgatgctgaacttgatctggatagcccgaccgagggcttctcatctatttcggaggctattgaggacattcgacaaggaaaacttgtgattgtcgttgatgacgaatcaagagaaaatgaaggtgatcttatattggctgcttctttggttaccccagaggctatggctttcatagtaaggcatagcacaggaattgtgtgtgttagcatgaaagaaaatgatctggaaagattgaaccttcctttgatggtttcacacaaaggaaaatgaggagaagctatgtactgctttcaccattactgtggatgctaaagaaggcacaacgactggggtatctgcaaaggatagggcaaagacagtcatgactcttgcatctccttactcaaagcctgaagatttcaatcggcctggccatattttccctctgaagtacagagatgggggtgttctcaaacgagctggacacactgaagcatctgttgatcttgcgaaacatcgtaggaagaactaccgaccctgcaaactaactccttagagttagactgaatctttctaactactgttgatgtagtagttcatctcataggtaaccactcttattgtatccgcactgggattggagcttgtgttgcccccatctctctgcattcgtctagaatgtcagttgtgggtgatttttggactggttttgtcaagcacttcgttaggtggtattttggtgaacctggaaatggcgcgcagctgctgttatctgggagcttaggaaactacttagaatttagacttttttgccatcctgtcttacaggctg

SEQ ID NO: 3464 - DNA, 1075 bp, Triticum aestivum
gcggccggtggaggcggccaagaacgccgcggcgcggtaccgggaggccgtggggctgcaggtcgaggccttctggcggcgcaactacctgctgctcgtcggcgccggaggcgtcatcgtctgcatcgcgctctggcgggtcatgttcggcatcgccagcaccttcgtcggcctctccgagggcatggccaagtacggcttcctcgcgctcgccaccgccatggttgccttcgctggtatgtacgcacgtgcaaggttcaccataaatcctgacaaggtttacaggattgcaatgacaaagctcaatacatctgctgcaatccttgaagtgatgggtgcacccttagctggcactgatgtcagagcatatgttatgtctggtggaggccctaaactaaaggacttcaaattcagggttggtggcaaacggtgctttcttatcttccccatcaaaggatcagaaagaaagggtcttgtaagtgttgaggtcaagaagaaaaaaggacagtatgacatgaagctgcttgctgttgacataccgatggcgacagggcctgaccagcggctattccttgtcggcgacgagcaggagtacaaggttggtggaggcttgatatccgagctgcgggatcctatagtgaaggctatggctgcagaaaaggagtttgattatcttgatgaaagagaggacgcagaggatgagcgcagggagcgagaggaggccgaggaagaggcagccgaagcgttaaggcgagaggaggacagattacgggaggaggcgaaagagaggcagcggcgagaagctgagaatcttgagaaaggcagctgacccaattgacccacaccgcttttttcttcgtgttgtgcatttctcaactttacctcctcactcttacatgcgtagcgatcagcattttcgcggcgacggaaagattgcgtctgagtttcagagaggcggtttcgcctttcacagcgtgtcgatagggtaataaattttggctgctcctcaaaatggtttactcgggagcgcattgtgtaatttagtggctgcatgaatgaatgatggctgtagcct

SEQ ID NO: 3465 - DNA, 760 bp, Triticum aestivum
acagtataacagcaaggctctttgttgccattggaagaggagagatgcttccgtccaggacactcgtcttctcctcctgcaagtctggctgcaagcactcatcgatgactactcatggctacaatgcagctgccggtcatttgataggaagcttgtcgaggaagggattgggcagacaatcctgacacttcctttggaagaccagcggtctatattactgtcatggctcgggaggttcttgaaattaggcgataactgtccgaatttgcagagggcattcgaggtatggtggagaaggactttcgtcagaccttatgtcaaccaagcaaggtaatgtctgtcctatgatcaaacagaagctcatcttgaaacgatagggaagagtagtgattgtagccatagattctttcggggattgtcgtggtcaatctgatagtggacatgaaacccggtgagaatttcagtggctagtttttccttactgcgtaaatgtcgatgacacaggaaatttgtatgactgcacgttttagcctatgatgtaaaaccatatgcttttccagtagttgttataagaaaacctcgatcaacagctccttctccattgtacttcttttttactttcaagttgttatcaaatatgaccagcatttccccttctccttgttagttgaaggttgcgcatggattgtccaaggactgtacacattatttccttctccagcagaaattcagggttgtaaacagcccatatagcaatcaa

SEQ ID NO: 3466 - DNA, 581 bp, Triticum aestivum
taagaagcacaataaagtcggtatgaagcctatgagaggatggcaatacagatattgacagggctggaataccttcacagtcagaagccagcgattattcatagggatttaaagtgtgacaatatattcataaacggtcatgatggacaagtgaagattggtgactttggtctggcgacatttttgcatcaacggaaaaccagaagtatcaaaggcacattagagtttatggcaccagaactcttcaccgggaattacaatgagttggtggatatatattcatttgggatgtgcatgcttgaaatggtgacatgtgaatatccatacagtgaatgcgaaggcaagccatggatatacaagaaaatttctgaaggtataaaaccagctgtgctttccaaggttgaagatgcagaagtaagaggtttcatagaaatctgtttggctcccgcagctgaaagactttgtgcaagtgagctcttgaagaactgtttcctccagaaagacaagcctatcccaatcccagcgcctcctatttcagtctccctggtcttgagtgtgactaaagatgggcggcagtctgc

SEQ ID NO: 3467 - DNA, 571 bp, Triticum aestivum
ccaagattagcatccctgaggaaaataatggccagtctgaagaagattcctgttctaacagatcctgcacagcactcgaggctcggtctagtgcctagaagagctgatctggacatgaaccaacatgtcaataatgtcacttacattggttgggtcctcgaaagcatacctcaagatattattgatacccacgagttgcaaacaatcactcttgactacagaagagaatgccagcatgatgacatagtcgattctctcacctatatagaggaaggggatgagataaattctaatggatctctgttttcagcgccgcacccagaagagcagcgccagttcttgcactgcttgagatttgctggggctggggatgagatcaaccgtggtcgcaccgtgtggaggaaactagctagatagaaagtgatatgtatttgctcatatgtattgtgctgttccatttgttttaccgttttgctctttgcgaccggcgccgcatcacgagagaatcaactgtacccggaattttgtgattacgtttgtgacctgtgtaacaatcaatgccatctgtggc

SEQ ID NO: 3468 - DNA, 671 bp, Triticum aestivum
atgatgaaccgaatacacgcagacttcaaagagtcagtgacgaagtcagggatgaggtgtttatccactgtccgaagagtccaagattagcattccctgaggaaaataatggcagtctgaagaagattcctgttctaacagatcctgcacagcactcgaggctcggtctagtgcctagaagagctgatctggacatgaaccaacatgtcaataatgtcacttacattggttgggtcctcgaaagcatacctcaagatattattgatacccatgagttgcaaacaatcactcttgactacagaagagagtgccagcatgatgacatagtcgattctctcacctatatagaggaaggggaggagataaattctaatggatctctgttttcagcgccgcacccagaagagcagcgtcagttcttgcactgcttgagatttgctggggctggggacgagatcaaccgtggtcgcaccgtgtggaggaaactagctagataaaaagtgatatgtatttgctcatatgtattgtgctgttccttttgttttactgttttgctctttgcgaccggcgccgcatcacgagagaatcaactgtacccggaattttgtgattacctttgtgacctgtgtaacaatcaatgccaatctgtggcaaatgttggacctcagctg

SEQ ID NO: 3469 - DNA, 728 bp, Triticum aestivum
tactcccgatgttagaccggtatgtgctgagcagtaagatccagagtgcacttggatatatggcgccagaattcgcatgcaagacggtgaagatcaccgagaagtgcgacgtctacggctttggggtgcttgcactggaaatcttgacgggcaggaggcccgttgagtacttggaagatgacgtggtcgtgctatgtgacttggtgagaagcgcgctggaggaaggcaggctggaggactgcatggatccgcgactgtgcggcgagttcgcgatggaggaggccattccgatcatcaagctgggcctcgtttgcacatcgcaggtgccgtcgaaccggccggacatgggcgaggtgttgagtatacttgatgtggtgaggagccctcaggacagtccaggggatgagatggtataagcaaggtctcttttgaaactctgttctgtgtgtgcctgggtttttgtttttctactagatgcatatatgatgcccggttgggaagaagggaggaagcaaagagtggtgatgcattgtggaatgcttgtagcttgtagtttggttctgaaatcttagggggttggcgatgctgttttgctgcttctctgcgattctttggttcattccttggatgaaactgtagctttctctgctcgtgtggggtattgccgcgagaggttgtggccggcatctcaggcacccctgaaatgactgatatctgattgccttctt

SEQ ID NO: 3470 - DNA, 564 bp, Triticum aestivum
  misc_feature (142)..(164): n = any nucleotide
cgacgcccaccggtgtacgtccagtggcgacgccttccgcgaccactcgtgctgggagcggcccgaggaacatggacaccccgcgcaccgtctacaaggtggacccccagcagcccgggctccgacgtcggccggccgagannnnnnnnnnnnnnnnnnnnnnntccatcgtcttccgcgacgccgaccccgcctactccaagcgcctgctcgaccgcgccatctccgtgtttgagttcgcggacaagtaccgcggggcgtacagcagcagcctgtactcggcggtgtgcccgtgctactgcgactacgacgggtaccaggacgagctgctgtggggggcggcgtggctgcacaaggcgtcgcgccagcgggtgtaccgcgactacatcaagaagaacgaggtggcgctcggcgccagcgactccatcaacgagttcggctgggacaacaagcacgccggcatcaacatcctcatctccaaggaggtgctgatgggcaaggactccttcttcaagtcgttccgggtgaacgccgacaacttcatctgcaccctcctccccggca

SEQ ID NO: 3471 - DNA, 565 bp, Triticum aestivum
ctccttgccgacgatgttgtcttctcactctgaaggccagtgcagctatggggtatcttgcccctgagtacgccacacgggacgcttcaccgagaagagcgacgtctttgcctttgggattgttgttctccaggtcatcacaggcagaagggccgtctcacaagtgaagataggcactgctaccagcgacctcgaaggcctgatagatcccagcctcggcggcatcttctcgaggaccgaggctgccaagcttgcagaggttgccgcacattgcacaagcgaagcggcgagccagaggccgatgatggatgctgtggttcagcaactcagcggctgatgccgaggatccgaaccgggctgatgaagatgtcttttgggaggccatttgtagtagtaagctggaggacggtaatgatccagttgccacccaatgaggtcttttgtaatagtaatctgacctgctaatgtgggacgcgtctccactaattcactagtcactttccaagtgatctcacttctcaccatttcatggttaagtatcacatctctttgccactggaatatg

SEQ ID NO: 3472 - DNA, 1040 bp, Triticum aestivum
caggacgccatgggggaaaaggtcggcaagttcatccagctgatggtgacgttctttggaggcttcgctgtggccttcgcgcagggatggctcctcaccctcgtcatggtggccaccatcccgccgctcgtcctctccggcgcggtcatgtccaatgtcgtcgccaggatggcgtcgctggggcaggccgcctacgccgaagccgcggtcgtcgtcgagcagaccgtcggctccatcagaacagttgcatctttcactggggagaagaaagcggtggagaagtacaacaagtcgcttaagtgcgcttacagttccggtgtccgggaaggcctagtcgctgccatcggcatgggcaccgtcatgatgctcctgttctgcggctactccctgggggtatggtatggagccaagctgatcctagagaagggatacacaggtgcccaggtcatgaatgtcatcttcgcggtgcttaccggctcactagctctaggacaggcgtcaccaagcatgaaagcattcgcaggaggacaggctgcagcatacaagatgtttgaaacaatcaacagggagcccgaaatcgatgcatacagcacagagggtaggatgctagatgacattcagggggatatcgagttcagagatgttcacttctcctacccaacaaggcccaatgagcaaatattcagaggtttctcccttgccatacagagcgccaaaaccgttgcattgttggccagagtgggagtggaaaatcaacagttatcagcttgatcgaacggttttatgatcctcagctcggagaagttctaatagatggagtgaatatcaaggagttgcagttaaagtggatcagaagtaaaattggcttagtgagccaggagccggccctgtttgctgctagcataagagataacatagcttatggtaaggacaatgcgacagatcaggaaatcagagctgcggctgagcttgctaacgcctccaaattcattgataaattaccccagggtttcgctacttcggttggtgaacatggaaca

SEQ ID NO: 3473 - DNA, 383 bp, Triticum aestivum
tataaaggaggtgatggttaatgggatgcttgtgaagataaagtattgcgacacctgcatgatttaccggcctcctcggtgctctcactgttcgatatgcaacaactgtgtggagcgattcgaccatcattgcccctgggttggacaatgcattggtcagcgcaattaccgatactttttcctatttgtttcgtcctcgactcttctttgcatttatgtctttgccatgtcggcactacacatcaagtttctcatggacggagactatcctacagtatggaaggctttcaaacactctccagcttgcttggtgcttatgatatattgtttcattgctctatggtttgttggcgggctcactggatttcattcgtatctcatta

SEQ ID NO: 3474 - DNA, 675 bp, Triticum aestivum
cttccgcagcaaatgcccaatgtctttgatcaagaaagtaaagtagtcgggatgacaggtgttgatgagttgaccagtcctattcaaccttatcctaatccagaaaatctctctttatactacaaagatccacaaggtcgaattcaaggcccattttctggtgctgacatcattggctggtttgaggctagttattttggtattgatttactggttcgagttgcaaatgctcctcctgatgcgcctttcttaatgcttggagatgttatgcctcacctacgagcaaaggcagggccacctccagggtttagcagcacaaaatcaagtgatatgctaatgccggagactccacctacagggaaatttgtcagctccagcagcacacatagcggatcagctggtgtcggtatttttaacagtgggccaagcaggaatggcggtgctgttgaagctcagaatcgttttctggagtcactgatgtctaatggtatgcaaggtccttcagctgctatgactggagggctgaatgaatataacagcagtagctttggcaacattgcgatggccggaggcgagatggggaatagcatgaattatcttttggcacagcagagattgttggaaagacaaaatcttcccaaaatgctgttccatattggtctgcagatggtattc

SEQ ID NO: 3475 - DNA, 540 bp, Triticum aestivum
cagctccgcaggaggcgagcttaactccgcaatggcatccggcttgaagaatatgaaacgcgagagggacatgctctacaagcagatgctgaagaagctcaccaacggggacaaggagggcatctacaccagatgggggatcgatctgggctccaaacagcggcggcttcagctatctcgcctggtatggacgcgggctgacatggagcatgtccgagagagcgcctcgctggtggcgaggctgatcgacttggttgagccagggcaggctctcaaggagatgttcggcctcaacttcacgctggctcccagaaccgaacgccggtctttcagcctgctgggcgcttgatctttgacgtatgtatggaggtagaagggtttggtttacgtagtacaggaggttcacttaacaggaggagaggactatgctccaccgcatcgattggtttcactcgtgtctctaccttgttcttgtttttgcttgtgtattgtgtgcgtgtgcgtgtgcgatattcctgtgtgcaatcttacaaaagtgaa

SEQ ID NO: 3476 - DNA, 719 bp, Triticum aestivum
cgtctacatggaagtggagcacaggagactgtccttcatcctgagctcgttcagcaccagctccgcaggaggcgagcttaactccgcaaccgcatccagcttgaagaatatgaaacgcgagagggacatgctctacaagcagatgctgaagaagctcaccaacggggacaaggagggcatctacgccagatgggggatcgatctgggctccaaacagcggcggcttcagctatctcgcctggtatgggcgcgggctgacatggagcatgttcgagagagcgcctcgctggtggcgaggctgatcgacctggttgagccagggcaggctctcaaggagatgttcggcctcaacttcacgctggctcccagaacccaacgccggtctttcagcctgctgggcgcttgatctttgacgtatggatggaggtagaatggtttggtttacgtagtacaggaggttcacttaacaggaggagaggactatgctccgccgcatcaattcgtttcactcatgtgtctctgccttgattttgcttgtgaattgtgtgtgtagaagtgtgtgcgcgcgcgatattcctgtgtgcaatcttacaaaagtgaatcaatcagacagtacagttctgactatccgtgctgtcgtatgcccgtttgtggggattcgtccatctagtccatcttttttgccgcaaaagcgaagtcaagcaataataagggaactt

SEQ ID NO: 3477 - DNA, 1005 bp, Triticum aestivum
cccaactcaggaccggcgacgacctccgctcttcgccaaatcccagctgaacacattcttggggacaacccgatgaagatgagctacgtggtggggtacggcaagaagacccgaagcggctgcaccaccgtggggcgtccacgcccaagaacgggatcaagtactcgtgcaccggcgggaacaagtggcgcgactccaagaaggccgaccctcacgtgctcgtaggcgccatggtcggcggcccggacaagaacgacaagttcaaggacgcgaggatcagctacgcgcagaacgagcccacgctggtcggcaacgccgggctcgtcgccgcgctcgtcgccatcaccaacagcggacgcggcacgggcgtcggcgccgtcgacaagaacaccatgttctccgccgtgccgcccatgttccccgccgccccgccgccgccggccacgtggaagccctgaggagaggtctgcccgaccggccggttttacgccgacgttgagcaggtcgaacacttcgattgggttcggttggtagtgcaattttctggccatcatgtaaaattcttttgtattatacacacgttaaccgtggcgcgcgatacgacggtggcatgcctcacgcatggcctgtactactgtagatgtttcttgtgcacaatttgggtatggacaattaatggatacttgttgattcccaaaaatgaacgccgaagaaaaagggggcggccgccaaagggccccaggtttacatcccgggggaagccccgatgaagcccatctaaggggcgcctacatcaagacgcagggggaggcgtatacacaccgggggcggggaaccccgtgggggccccaattatcgggggtggggaccccctttaaacatagggggaggaactagcagccccgtcggcatggcggtcgcgaccaaggcagtcatgaccagacaatcgtgcacgtccgcggcggaagggagtcagccttacctaatgaacgacaagacacatct

SEQ ID NO: 3478 - DNA, 575 bp, Triticum aestivum
ccatctccgatcgtgctgtcgagaggctgagaagattgccggaccaatctatcctggtgaatactggtatgattaccgtgcagggttctggggtgtaatgggccaatcgtgccttggcatgatacctcccgtacattccgcaacttaactatcctatgcccaagaactgcgccggtggaaatactggtatttgtatcaatgggagagaacttcaccagaaagatttcgacttgctcgtgggtcgaggtctctcagaatctcctgacagatcatataaggttgagatgtctggtaaagtgtacgatgaagtctctggtgaagaactttattgtcttggcaaacttgcaccaactgtcgagaagatgaagcgcggtttcggtatgcgccccccaaggaccatccgttgagaaagaggggtcaaaaaattggcctcaggatctgggtaactcaccgcgccagaactggggatatcgtggtcctggagatcattcgccgagtcggtcgatagacgatagcccacattgtggactacataaaatcattttgcaagttctggttctcctatgtagctatga

SEQ ID NO: 3479 - DNA, 532 bp, Triticum aestivum
ggtgctctcaagttcactagcagtgagaaacttgtgggcatgctgaagaaacaggcggaatctggtagaccctatggtgcaatatgcgcttcccctgcttacgtcctcgagccacacggattactcaagggtaagaaagcaacatcatttccacccatggcgcacctgcttacagaccagagcgcgtgcgaatacagggtcgtcgtcgacggtaaccttatcacgagcagagcgccagggaccgccacagagttcgccctagccatcgtcgagaagctatttggtgaggagaaagcggtcgcattagccaaggagttggtttttatgtgacaatgtgcatcgttgaggctgggagtgcccattttacatggctaatatggggctctatctaggttggtcacttgttgattatgtataagctataggtacacatattaaacaatcccgtctgatatatctgatgaatgtcagtttgaagatctttaataaggttgacatggactgcaaagcagcaattgttcataatggaatt

SEQ ID NO: 3480 - DNA, 1267 bp, Triticum aestivum
catatggctgttgccgacaaatggattgaacttctcaaaggaaacgatgaagcttgggagatgggtaatattgtgcacacactaacaaacagaaggtggctggaaaagtgtgttacttatgctgaaagtcacgatcaagcacttgttggagacaagactattgcattctggttgatggacaaggatatgtatgatttcatggcgctgaacggaccttcgactgacctaatattgatcgtggaatagcactgcataaaatgattagacttatcacaatgggtctaggaggagagggttatcttaactttatgggaaatgagttcgggcatcctgaatggatagactttccaagaggcccacaagtacttccaagtggtaagttcatcccaggaaacaacaacagttacgacaaatgccgtcgaagatttgacctgggtgatgcagaatttcttaggtatcatggtatgcagcagtttgatcaggcaatgcagcatcttgaggaaaaatatggttttatgacatcagaccaccagtacgtatctcggaaacatgaggaagataaggtgatcgtgtttgaaaaaggggacttggtatttgtgttcaacttccactggagtagtagctatttcgactaccgggtcggctgtttaaagcctgggaagtacaaggtggtcttagactcagtacgctggactctttggtggatttggtaggatccatcacactgcagagcacttcacttctgactgccaacatgacaacaggccccattcattctcagtgtacactcctagcagaacctgtgttgtctatgctcctatatgaactaacagcaaagtgcagcatacgcgtgcgcgctgttgttgctagtagcaagaaaaatcgtatggtccaatacaaccaggtgcaaggtttaataaggatttttgcttcaacgagtcctggatagacaagacaacatgatgttgtgctgtgtgctccccaatccccagggcgttgtgaagaaaacatgctcatctgtgttattttatggatcagcgacgaaacctcccccaaataccccttttttttttgaaaggaggataggcccccggtctctgcatctggatgcctccttaaatctttgtagccataaaccattgctagtgtcctctaaattgacagtttagaatagaggttctacttttgtatcttctttttgacagttagactgtattcctcaaataatcgacatgttgtttactcgaagatgagaaataaaatcaga

SEQ ID NO: 3481 - DNA, 531 bp, Triticum aestivum
acatgttctacttcagaatcgagatgtgcctggtagggttaaatagtcagagcatggcagggatagattatatgtctgctaagtttggtaacgaggaggaccccgtggccattagtattgtgtcagctggtgtgtataggatgaccaaaagcttgagagaggtaatcttgcactggagaggagtttgcataggggtaatcccattagagtcgttcgcactgtgaaagacttgacttgttcaactggtaagatatacatatatgatggcctttaccagattagagaagcctgggtggagaaagggaaatctggtttcaatatgtttaaacacaagttgctcagagaacctggacaacctgatggcattgcagtgtggaagaagactgaaaaatggagggaaaatccatcctctagagatcgtgttatattgcacgacatatcatacggtgtggaaagtaagcctatctgccttgtaaatgaggttgacgatgagaaaggtcctagccacttcacctatacaactaaacttaa

SEQ ID NO: 3482 - DNA, 686 bp, Triticum aestivum
cttgaagctgggagtatcatgatggaacgcttgaactttcgccctcaaataagaacacagaggattgggagaggttccaaggtgtcgaggtcggtgacatgttctacttcaagaatcgagatgtgcctggtagggttaaatagtcagagcatgcagggatagattatatgtctgctaagtttggtaacgaggaggaccccgtggccattagtattgtgtcagctggtgtgtatgaggatgccgaagatgatgatccagatgttctggtttacagtggacatggcatgtctggtaaggatgaccaaagcttgagagaggtaatcttgcactggagaggagtttgcataggggtaatcccattagagtcgttcgcactgtgaaagacttgacttgttcaactggtaagatatacatatatgatggcctttaccagattagagaagcctgggtggagaaagggaaatctggtttcaatatgtttaaacacaagttgctcagagaacctggacaacctgatggcattgcagtgtggaagaagactgaaaaatggagggaaaatccatcctctagagatcgtgttatattgcacgacatatcatacggtgtggaaagtaagcctatctgccttgtaaatgaggttgacgatgagaaaggtcctagccacttcacctatacactaaacttaa

SEQ ID NO: 3483 - DNA, 1550 bp, Triticum aestivum
  misc_feature (152)..(177): n = any nucleotide
atctgagccgcgtaaaaccctagccgtctccaaatcagtcacccgccaccgccgccaccgtccatggacacttccctggctgccgccgctgtcaccgcagaggcctccgcccccgccgccgcatcaacggaaccttccgcggctcctgatgnnnnnnnnnnnnnnnnnnnnnnnnnngctgccggcgccggcgccgaagacctcgcggggggcgtggcggcattgagcctggacgagcggttcgacttgctgatgagcataggcgaggagtgcattcagcccgacgagcttaagcggcttctgcagaacaagcccgtccctatctgctacgacgggttcgagccctccggccgcatgcacattgcccagggtgttgtgaaggcaattaatgttaacaagatgatcagagcgggatgcaaagtgaaaatctggatagcagactggtttgcacagctaaacaacaaaatgggtggcgatctgaaaaaaatccagactgtcgggcgctacatgattgaaatatggaaagcagctggtatgaaccttgatggcgttgaattcttatggtcttcagaggaaattaataggcgtgcaaatgaatactggccacttgtaatggacattggcaggaaaaataatatcaaaagaataacgaggtgttgtacgattatgggtcgctctgacaatgaggaattgactgctgcacagatcttctatccttgcatgcagtgtgctgatatattcttcctgaaggctgacatatgccagttgggtatggaccaaaggaaggttaacatgttagcaagggaatattgcgatgacatcaaaaggaaaaacagccaattattctgtcacatcatatgctccccggtttcaaagaaggccaggagaagatgtcaaagagtgatccgacatcggctatctttatggaagatgatgaggctcaggtaaatttgaagataaagcaagctttctgtcctcccaaaattgttgataaaaatccgtgcctggagtacatccagtacattgttttcccttggtttgacaagtttgaggttgtccgcaaagaaaacaatggcggtaacaagacatttttaaccatggatgaacttgttgctgattatgaagcgggtgatttgcatcctgccgacgttaaacctgctttggcgaaagcgatcaatgaaatattgaagcctgttcgtgaccacttcaacagcagcagtgaagccaaaattctcctcaatactgttaagaagtacagggtaagcaattgaggagcaaataccttcctggtcattacatggacacccaacagacaatggaagcatacacattttggttggcagagtttcgtgggcacaatttttggcaatactaatacctctatagctgatatgcatcagaaactgtcgtgattatgttgatcagtgtacaatatctttgcgtgtcaccttcaattgagaagttataagatgcttggcgtgacattgtagctaacatttaaggtaaacgcattaaatcaggcgactgattttgtcaattgtcagtccgtt

SEQ ID NO: 3484 - DNA, 525 bp, Triticum aestivum
actgcatttcctcttgctctgatattatctcctacccgcgagctatcagtccaaattcatgaagaagcaaagaaatttgcataccagactggtgttaaggcttgtgttgcatatggtggagcaccattcatcagcagttgagagaactggaaagaggtgttgatatactagtggcaactcctggtcgtttgatggatctgctggagagagctagagtatcactgcaaatggtgaattacttggctcttgatgaagctgaccggatgctcgatatggggtttgagccacagatacgcaagattgttgagcagatggacatgccccctcgtggtgtgagacagaccatgctgttcagtgctacttttccaaaggagatacaacgcctggcatcagatttccttgcagactacatcttccttgctgttggaagagttggctcaagtactgatttgattgcacaaagggtagagtttgtccttgaagcggataaaagaagttacctcatggaccttattcatgcgcaga

SEQ ID NO: 3485 - DNA, 614 bp, Triticum aestivum
cactgcatatgtggtccactgagatcattgtgcacggttgtccggctaccacatcgatccttaccagaatgacaaggcctccgcactgcttgtggacttctttgggaagtgccaggaagacccgagccactggaacaagatctcgcagggaggactccagcgcatcgaggagaagtacacctggaagctgtactctgagaggctgatgaccctttctggtgtctatggtttctggaagtatgtctccaacctcgacaggcgcgagactcgtcgctaccttgaaatgctctacgccctcaagtaccgcaaaatggctgcaactgtcccattggctgttgagggcgagacctcgggcaaatgatttgtccttaccagagaaataaatggcgggcgagcgctccgctttaccgttcttgattcagtgatgaagcacagatcggagagtgttatgcctttgattgtcctttgttaccgttcttgattcagtatgaactttagttcctgttgaggccccggccgtgttgtcgcggtaggggaactggatggatgctgtgttgttggtactttctcatggatacagtatttgaatgaatgaataagatagtctttgtttt

SEQ ID NO: 3486 - DNA, 1064 bp, Triticum aestivum
cttacctccctccatactgagattgaggagctactcttcagtgatattgagaatgctgagcacaaatttgtgctgaaggacaagaagaagccgatcatcttctcgatggctaggttggaccgtgtcaagaatatgactggcctggtagaaatgtatgggcggaatcctcgcctacaggagctggtaaacctagtggttgtctgtggtgaccatggaaaggtgtccaaggacaaggaggagcaggcagagttcaagaagatgtttgatcttattgaacagtacaacctgattggacacatccgctggatctctgctcagatgaaccgtgtccgcaatggtgagctctaccgctacatctgcgacatgaagggagcctttgtgcagcctgctttctatgaggctttcggtcttactgtgatagaggccatgacatgtggccttccaacattcgccactgcatatggtggtccagctgagatcattgtgaatggtgtgtccggctaccacatcgatccttaccagaatgacaaggcctccgcactgcttgtggacttctttgggaagtgcaaggaagacccgagccactggaacaagatctcgcagggaggactccagcgcatcgaggagaagtacacctggaagctgtactctgagaggttgatgaccctttctggtgtctatggtttctggaagtacgtctccaacctcgacaggcgcgagactcgtcgctaccttgaaatgctctacgccctcaagtaccgcaaaatggctgaaactgtcccattggctgttgagggcgagacctcgggcaaatgatttgttcttaccagagaaataaatggcgggcgagcgctccgctttaccgttcttgattcagtgatggagcacagatcggagggtgttatgcctttgcttgtcctttgttaccgttcttgattcagtgatgaactttttcctgttgagtccccgtgttgtcgcggtaggggaactggatggatgctgtgttgttggtactttctcatggatacagtatttgaatgaatgaataagatagtctttgtttt

SEQ ID NO: 3487 - DNA, 861 bp, Triticum aestivum
ccaaaccaaatcccaaagcgacaacagaaaagctcgagctcttgcttgggtggacgagcgagcagagcgccgatcgcagcagtagcagcaggaggaagatgtcgtcggtgttcagcggcgatgagaccgcccccttcttcggctttctcggcgccgccgcggcgctcgtcttctcatgtatgggagcggcctacgggacggccaagagcggcgtcggcgtggcgtccatgggagtcatgcgcccggagctcgtcatgaagtccatcgtgcccgttgtcatggctggagtgctcggtatctacgggcttattatcgccgtcatcatcagtaccgggatcaaccccaaggccaagccctactacctcttcgacggctacgcccacctctcgtccggcctcgcctgtggccttgcaggccttgctgctggcatggccatcggcattgttggtgatgctggagtcagggcaaatgctcaacagcccaagctgtttgtcggcatgatcctcatcctcatcttcgcagaggcgctcgctctctacggtctcattgtcggcatcatcctgtcatcccgagctggccagtctcgtgctgattaggcatgttccatacacgcggccctgtgtgccctcttgttttatattattcagacagcaaactgagctctagaggttatcatgtctagttttcattcttctgtttggtggagaaaaaaacatctgtagcaaagggagctttgcccttgatgtaccattctttttccgtctggatgctgggtgggggttgatgcttatttatgcacagttatttaccttttgggtctggctggacggtgtaatctggtgaataagcgagaacttaatg

SEQ ID NO: 3488 - DNA, 714 bp, Triticum aestivum
gcggctctcgtcttctcatgtatgggggcggcctacgggacggccaagagcggcgtcggcgtggcgtccatgggagtcatgcgcccggagctcgtcatgaagtccatcgtgcccgttgtcatggctggagtgctcggtatctacgggcttattatcgctgtcatcatcagtaccgggatcaaccccaaggccaagccctactacctcttcgacggctacgcccacctctcgtccgggctcgcctgtggccttgccggacttgctgctggcatggccatcggcattgttggtgatgctggagtcagggcaaatgctcagcagcccaagctgtttgtcggcatgatcctcatcctcatcttcgcagaggcgctcgctctctacggtctcattgtcggcatcatcctgtcatcccgagctggccagtctcgtgccgattagccaattaggcatgttccacacacgcggccctgtgtgccctcttgttttatattattcagacagcaaactgagctctagaggttatcatgtctagttttcattcttctgtttggtggagaaaaaaacatctgtagccaagggagttttgcccttgatgtaccattcttttcccgtcaagatgctgggagggggttggtgcttatgtatgcacagttatttaccttttgggtctggctggacggtgtaatctggtgaataagcgagaacttgcaatgc

SEQ ID NO: 3489 - DNA, 676 bp, Triticum aestivum
ggcttgaacaagtgagcatgatgctgtagggccattccataattggcactgtcagtagacggaatcttgtggcatggggtaataatgaatatggccagctggggattggagatacccaaccgagatcacaacctatccgtgttgaagggctatctaacctctcattggttgacattgctgctggaggttggcattcagccgcattaactaaagaaggagaggtatatgcttggggaagaggagaacatgggaggctcggctttggggatgataagagcagtcacatggtgccgctaaaggttcagcttctagctggcgaggatattgttcagttcagcaccagggttcactcttctaaatgcttgcaggtatcatgtggagggacccattcagttgtgctaaccagtgatggccgaatgttctcttatgggaggggcgatcatggccgtctaggcgacggtaggaaggtgactacgggtcacccaatggaagtgcccataaacttgccgccaccaaagaccagcaccagctccgaagggctatggcaagcgaactacgttgcctgtggcggacgacacacactcgccaccgtgacatggaccgatatgtaacagggcatgatcacttgagtgtatgaattgaaattgtggtaacagtaatggagaataagaagtag

SEQ ID NO: 3490 - DNA, 1043 bp, Triticum aestivum
gctcgggcacccgccggagaccaagacagagagctccccggcgcatgtcgacgccctcatcggggtcaagatcgtgcaggcagcgatcggcgggtggcattgcctcgcggtggacgacaagggccgggcttacgcttgggggggcaacgaatatgggcagtgcggggaggagcctgagaggaaggaagatggcacaagggcactcaggagggacatccccatcccacagcgatgcgctctcaagctcaaagttcggcaagtagctgcgggggggactcactcagtggttttgacacaagaaggccatgtctggacttggggacaaccgtggcctccgggtgatatcaaaaaaatatctacgccagtacgtgtgcaagggcttgaacaagtgagcatgattgctgtaggggcattccataatttggcactgtcagtagacggaatcttgtgggcatggggtaataatgaatatggccagctggggattggagatacccaaccgagatcacaaccgatccgtgttgaagggctatctaacctctcattggttgacattgctgctggaggttggcattcagccgcattaactaaagaaggagaggtatatgcttggggaagaggagaacatgggaggctcggctttggggatgacaagagcagtcacatggtgccgctaaaggttcagcttctagctggagaggatattgttcaggtatcatgtggagggacccattcggttgtgctaaccagtgatggccgaatattctcttatgggaggggcgatcatggccgtctaggcgacggtaggaaggtgactacgggtcacccaatggaagtgcccgtaaacttgccgccaccaaagaccagcaccagctccgaagggctatggcaagcgaactacgttgcctgtggcggacgacacacactcgccatcgtgacatggaccgatatgtaacaaggcatgatcacttgagtgtatgaattgaaattgtggtaacagtaatggagaataagaactagaagttgtgcacttcaggcttcat

SEQ ID NO: 3491 - DNA, 672 bp, Triticum aestivum
gaagatcctgctctgaacttctcaagatctgcttgaaaatgctggggctgtgttccgcaccagcgagaggtttctaggtgctatcaagcagtatttgtgcctatcacttttgaagaactgtgcctcgtcacatatgattgtttttcagttatcttgttctatttttattagcttggtttcaagatttaggccaggattgaaggcagaaattggagtattttttcccatgatcattctaagagttctggaaaatattgcacaaccaaattttcaagcaaagatgatagttcttcgttttttggagaagctctgtactgattctcaaatcttggttgacattttcatcaattacgactgtgatgtccactcatcgaacatatttgagaggatggtcaacggtctgcttaaaacagctcaagggcctcctgcgggtattgctaccacattggtaccgcctcaggatacgacaatgaagagtgaagcaatgaaatgcttagtttctatcctcagatccatgggagatcggatgaataagcagctaagtattccagatcctgaatctcctaagattgaatcagagcaaaacgataatgatggtggacatgagtttccccagacagagatcctgggagatggtctagcgaggtatccgattcaattccgaagtttcaa

SEQ ID NO: 3492 - DNA, 996 bp, Triticum aestivum
attacgactgtgatgtccactcgtcgaacatatttgagaggtgctgcatcactcacttttcattatcattactatagttgactagtgaggttttattctcataaatagctgcagaaacctatttactattgtgtttcattttctgtatgtttttccgacaggatggtcaacggtctgcttaaaacagctcaagggcctcctgcgggtatcgctaccacattggtaccgcctcaggataccacaatgaagagtgaagcaatgaaatgcttagtttctatcctcagatccatgggagattggatgaataagcagctacgtattccagatcctgactctcctaagattgaatcagagcaaaacgataatgatggtggaaatgagtttccccagacagagatcaatggagatgcttctagcgaggtatccgattcacattcagaagtatcaaatggggtttcagaggctgcatctttggagcagcgtcgagcttacaaaatggaacttcaggagggtatcgctctgtttaaccggaagcctagaaagggaattgaattcttaataaatgccaacaaggtcggggagtcagctgaggatatagctgctttcctgaaaagtacttctggcttgaacaagactatgattggtgattatttaggggaaagggaagatttatccctcaaagtcatgcatgcatatgtggattcttttaattttcagaatatggaatttgatgaagcgatcagagcctttcttcaaggttttaggcttcctggagaagctcaaaagattgatcgggttatggagaaatttgcagagcgttactgcaaatgcaacccaaaggccttttcgagtgcagacacagcttatgttcttgcttattcagtcataatgcttaacactgatgcacataacccaatggtcaaaaataagatgtcaccagaagatttcataagaaacaatcgtggtattgatgatgggaaagcctaccagaagaat

SEQ ID NO: 3493 - DNA, 686 bp, Triticum aestivum
tgatctttctttatggtgttcaacaatgttgtctcttcatgcacgctccgcgtgactcgcacattcagttgctaaagcgcatccggcgctaccttcgtggtcctcgaagcagcaacacaccgtctcgcgctccagtgcggaggctgagtaccgggctgtcgcgcacgccgttgccgaggcagtctggttgcgacaactccttggcgagctccaccaggctcccacgcgtgctaccgtggtctattgtgacaacgtgagcgcgatgtacatgtcaactaatcctgtgcaacaccagcgtacgaagcacgtggagattgacttgcacttcgtccgggagcgtgtgtcgctcggcgagttcgcgtcctccatgtcccgacgagctcccagtttgccgacgtcttcaccaaggggctacggacgagcatcttcctcgacttccggtccaacctcaacgttcgggagccccacgtttcggctgcggggggctgttggaagtctactacatgacctgatggacaacggccttgaccaggtccttcggatagttcaggaggtgcgtgcactacgtgcgcacgtccaccacgcatgcatgacatgctcggccacggccattgtacacgatctctccctcacccccttgtacctctccgcatgtataaataaccttgcgagatatgaatacatgt

SEQ ID NO: 3494 - DNA, 792 bp, Triticum aestivum
gcagccgccgccagcagctgcgcaaaggctcgacaaaccctaaccctagctccatagctagcttagcttccttcctctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgatctcggagcgcctcatcggcgatgccgccaagaaccaggtcgccatgaaccccagtcaacgccgtcttcgatgcgaagcgtcttatcggcagaaggtttgctgatgctcctgtccagagtgatattaagatgtggccgtacaaggttattcctggcccagcagacaagcctatgattgtagtgcagtacaagggtgaggacaaccagttttcagctgaagaaatttcttccatggtcctcatcaagatgcgtgagatcgccgaggcttacctaggagtaactattaagaatgctgttgtcacccgtgcctgcttacttcaatgattcccagaggcaggcaaccaaggatgccggtgttattgctggtcttaatgtgatgcgtatcatcaaacgagccaacagcagctgcaattgcctatggtcttgacaagaaggctaccagtgtcggtgagaagaatgtgcttatctttgaccttggtggtggcacttttgaatgtctctctccttaccattgaggagggatttttgaggtgaagcaccggctggtac

SEQ ID NO: 3495 - DNA, 711 bp, Triticum aestivum
caagttttggatctctgcagattgtttatgggagaacgatggaagttgcgagggatatgggtcctcgtgcttttccggtgaaggaggtacacaaaatagcagtgttagatattaggttagcgaatgctgatcgtcatgcagggaacattctagtgtccaaggaagaaggtgccacctgcaagctgattccaattgatcatggttactgcctgccagagaagtttgaggattgtaccttcgagtggctttactggcctcaagcccgtgagcggttcagtgatgaaaccattgcatacattgaatctctcgacgcggaagaggacatcaagcttctcaggttccacgggtgggagctgtcttcaagctgtgcccgcgtcctgcgcatcagcaccatgctcctgaagaagggcgcggcgcgaggcctcacaccctatgacataggacgtatactgtgcagggagactgtgaatagagattctgtgatcgaggacatcatccaggaagcggagggcgccgtcctcccggggacgagcgagaacctgttcctggagacggtgtcggagatcatagaccgctacctcctcgtcaagtaatatctgtttagaaacactcagaataactgatctagttgttcggctgtatccggtttgctgtaagtatgtttcacaaggcactgccccaggcctcctcctcaagggactaatgatttca

SEQ ID NO: 3496 - DNA, 695 bp, Triticum aestivum
aaatagcagtgttagatattagtttacgaatcctgatcgtcatgcagggaacattctagtgtccaaggaagaaggtgccacctgcaagctgattccaattgatcatggctactgcctgccagagaagtttgaggattgcaccttcgagtggctttactggcctcaagcccgtgagcggttcagtgatgaaaccattgcatacattgaatctcttgacgcggaagaggacatcaagcttctcaggttccacgggtgggagctgtcttcgagctgcgcccgcgtcctgcgcatcagcaccatgctcctgaagaagggcgcggcgcgaggcctcacaccctatgacataggacgtatactgtgcagggaaaccgtgaatagagactctgtgatcgaggacatcatccaggaagcggaggacgccgtcctcccggggacgagcgagaacctgttcctggagacggtgtccgagatcatagaccgccacctcctcggcaagtaatatctgtttagaaacactcagaataactgatctagttgttcggctgtatccggtttgctgtaagtatgtttcacagggcactgccccagacatcctcctcaagggactaatgatttcatttgtttctagccccgaacgattctcgtttgtttgtagccgctcaagaacatttccttctgtgaatatagatgtctgt

SEQ ID NO: 3497 - DNA, 694 bp, Triticum aestivum
acatgtggtgatgatcctcgcagtaagggagaacgcgaacccatcaggcgcgccagttggttggagcggagacggccgcaaattgcgcgtgttgcgcactgacaacggcggcgagttcacggcggctgaattcgcgtcgtactgcgccgatgagggcatccagcgccactactccgcgccgtacagcccgcagcaaaacggcgtcgtcgagcggcgcaaccagacggttgtggggatggctcgggctctcctcaagcagagagggatgccggctgtcttctggggagaggcggtgctaacagccgtctacatcctcaaccgctctcctactaaggcactcgacggcagaactccgtacgaggcctggcatgggcagaagccggcggtctctcatttgcgggtctttggctgccttgcgttcgccaaggagctcggccacatcggcaagctcgacgacaggagcactccgggagtcttcatcggctacgcggagggctaaaaggcctaccgcatcctcgacccaaagacacaacgtgtgcgcacagcgcgagacgtcgtgttcaacgaagggcgagggtggcaatgggacaaggcggtggacgacggctcgacgccgacgtatgacgacttcattgtcgagtacgctcacttcaaggaagctgggggagcaagcagctcctcttcaccgggcacg

SEQ ID NO: 3498 - DNA, 669 bp, Triticum aestivum
acaacaacaaataaaattacatttcactcctacagctcactacatcatagatagtacatggcaatcattcaattttactaggcagtatacgagtacatctcatttcaaataaacagtactgctcttggaagcaaaataggccgccacacgccatggtgcgccatcttactcgatctggccccaagtaaccagaagtgctgcttgctcccttgtaatagccaaaatggacggcacaaacaatgagcatcctcgtgccaagcccgatgggttccccacgatactcttctacccagctgggaagaaaagctttgagcctataactttcgagggggaccggacagtggtagagatgtacaagttcctcaagaagcatgccgccatccctttcaagctcaagcgcccggactcgtcagcggcacggaccgacagcgccgagggcccaggctcgaccaccgacagcgagaagagctccggctcgaacccgaaggacgagttgtaggggattagatacaccattgacaacaagtacgaggaggcgccgatgatgttgaaatcaggaggtggggaaggaatggctaagctaggtatcaaccaaccttggctgctgcaagtgtatgctgacaacacaaatacgtattaactactgtagaatccaatgaaataaaagca

SEQ ID NO: 3499 - DNA, 615 bp, Triticum aestivum
atgatgaggacgtcaaattgttgttggcaagagtctagatcaaatagttctggatgagtcaaaggatgttcttttggaggtatatgcaccatggtgtgggcattgtcagtcactggagcctatctacaacaagttgggcaagtatctccgtggcatcgactcccttgtaatagccaaaatggacggcacaaacaatgagcatcctcgtgccaagcctgatggattccccacgatactcttctacccagctgggaagaaaagctttgagcctataactttcgagggtgaccggacggtggtggagatgtacaagttcctcaagaagcacgccgccatcccgttcaagctgaagcgcccggactcgtcagcagcacggaccgacggctcaggctcaacgactgagggcgagaagagctccggctcgaacccgaaggacgagttgtaggggattagatacaccattgacaacaagtacgaggaggcgccgatgatgtcgaaatcgggagattgagaaggaatggctaagctaggtatcaatcaaccttggctgctgcaagtgtatgctgagaacacaaatacgtattaactactgtagaatccaatgaataaaagcaa

SEQ ID NO: 3500 - DNA, 900 bp, Triticum aestivum
ctcccacggcactgcgccgccgtctccccgaagctcagggatggaggggcgtaccctactcctcgaccaggcggcacccagcgcgtccgcccctactggccgctccgcctcgcaggcgacgggggacgaggccgcggctaaagtcgaattatcaaaaaggagctgtgtctcatgcaattcaaaggatttacaagccatgtcagaagattctgctaaaacgttgctagagcaggtggctggctgggaggtgaaaaatgagggcgacattctgaaattgcacagggcatggaaggtgaagaactttgccaaagggcttgagttctttcagcttgttgctgctgttgcggaggaagaaggtcaccacccagatcttcatcttgttggttggaataatgtgaaaattgatgtgtggactcactcagtcagtggtttaacatataatgatttcatccttgctgcaaagatcaatgaactcaagctaggaggccttttgagcaagaaaaaagctactgcccaggagtagctctcgttaatcaaaagatatccttttgtattttgtgaaaattgcatatgccgctccaaaagcaggattcgtccagtatatattctgggataaatgatggtttggcgatgctattggttcttcatgagaagttcaaggaggatttctgatattattttattgttaatgagtcatgccagtaagctttctgtatttgttcgccgtgaagagcaatggggcattgcacacttacctatgtatactgctacctgattatcgttggtctcttgtataaaggccttgctatcattatgtatggtccttcgtccccaatgtgtagtatgaacggtcttttgacctgtggaatgtattcctaatcctgatctatagaactgcct

SEQ ID NO: 3501 - DNA, 712 bp, Triticum aestivum
gccgcccgccgggtaccaccccctctttccaagatgtcgaaggcgagggcgcgaggatccgctggaaacaagttccggatgtcgctgggtctgccggtggcagccactgtcaactgcgctgacaacactggtgccaagaacctgtacatcatctccgtcaagggaatcaaggggcgcctgaacaggcttccttccgcctgtgttggtgacatggttatggccactgtcaagaagggaaagcctgacctgaggaagaaggtcatgccggctgtcatcgtcaggcagcgcaagccatggcgccgaaaggacggtgtcttcatgtactttgaagacaatgctggagtcattgtgaacccaaagggagagatgaaaggttctgccatcactggaccgatcgggaaggagtgtgccgacctgtggcccaggattgccagcgcagcgaacgccatcgtctgatctgatcgccggagcagctagatgatcaaagctttgatagcatgtccctcttttcttctagtttattacttgtggcccttgaggatgagtttcctggattatgtaatgctgctggattatggtctgttagctttaagattttgcactgtggtttggctactgagatttggtgagtctgaacctgaaaaagcttttgatcggatttatctctgttgtggcaagtattcacctgagatgtctggcttagatgttaatt

SEQ ID NO: 3502 - DNA, 1081 bp, Triticum aestivum
atgtaagtagtaagtactcagtttgtaaggataaaacggtagcatcaacagcttaagccagtcctactactcactgcatgggcaccgctcgcatcagttcttccccttggccgaagagcctggttctttgtcctgcttaaaggccttcttcaggaagaatgccatgtgccaagctgtgcgccgaggttagatcggcctttcgacagacaagacgatgcttccaacttcatgcacaagagtccacttgcaatcgtttcccgtgatgacttcttccctagctgcttgcagggagaagtcccggactgaaggtgtaggaggagcaacagccgcagcctgtattcactggagatcgattcactttcatccacagttagctctgcgaagtcctgggaccgccccctcttcttccaagatgtcgaagcgagggcgcggaggttccgctggaaacaagttccggatgtcgctgggtctgccggtggcagccactgtcaactgtgctgacaacactggtgccaagaacctgtacatcatctccgtgaagggaatcaaggggcgcctcaacaggcttccttctgcctgtgttggtgacatggttatggccactgtcaagaagggaaagcctgacctcaggaagaaggtcatgccggctgtcatcgtcaggcagcgcaagccgtggcgccgaaaggacggtgtcttcatgtacttcgaagacaatgctggagtcattgtgaacccaaagggagagatgaaaggttctgccatcactggaccgatcgggaaggagtgcgccgacctgtggcccaggattgccagcgcagcgaacgccatcgtctgatctgatcgccggagcagctagatgatcaaagcttttgatagcatgtccctcttttattctagtttacttgtggcccttgaggatgagtttcctggattatgtaatgctgctggattatggtctgttaggtttaagattttgcactgtggtttggctgctaagatttgttcagtttgaacctgaaagagcttttgatcggatttatctctgttgtgtcaagtattcacctgagaagtctggcttgaa

SEQ ID NO: 3503 - DNA, 701 bp, Triticum aestivum
gccctcgtcgccccgcaccgtcgcgcacctggaggtgaggggggagcagccgctgctgaagttgaattatcaaagaagagttgtatcccatgcaattcaaagtatctacatgccatgtcagaagattctgctaaaaagtcacttgaacaggtgactggttgggaactgaaaaatgaaggtgacatattgaaattacacagagcatggaaggtgaagaattttgtaaaagggcttgagttctttcagcttgttgctgctcttgctgaggaagaaggtcaccacccagatcttcatctcgtcagttggaacaatgtgaaaatcgatgtctggactcattcagtcagaggtttaacagataatgacttcatccttgctgcaaagatcaatgaactcaagctagaaggccttttgagcaagaaaaaggctacttcccaggagtagatttgggagatcaagcagataacttttaatgtgtagacgccaagaaatgcccttttatagtctgatgattgtacatgccgttccaaaatgagtacttccgatgtgaattccacttaccatttggtgagatctatccgttctgggcgatgcgtttctccgatgttgcgaatctaggatcatcctaatacttgtctgtatcttctgaatatataccgtagtttgaaggtgtcatgtatgcaatggcatagatatatgatcat

SEQ ID NO: 3504 - DNA, 874 bp, Triticum aestivum
ctgacgccgcaaccgcgcgcagcccgtaagaccggaccggtcacctcctccgctcccgtcagttccgccactttcactgcgagccccactgacctcaaaggcctcaacatggcaggtctgctgctgcgtagattcatcgggatccagccccgggcgccgatgaccgccgccggtggaccgcgctcttctacgcctcgtgtccctcgtcgccccgcaccgtcgcgcacctggaggtgaggggggaacaggccgctgctgaagctgaattatcaaagaagagttgtatcccatgcaattcaaaggatctgcacgccatgtcagaagattctgctaaaaagtcccttgaacaggtgactggttgggaactgaaaaatgaaggtgacattttgaaattacacagagcatggaaggtgaagaattttgtaaaaggacttgagttctttcagcttgttgctgctgttgctgaggaagaaggtcaccacccagatcttcatctcgtcagttggaacaatgtgaaaatcgatgtctggactcattcagtcagaggtttaacagataatgacttcatccttgctgcaaagatcaatgaactcaagctagaaggccttttgagcaagaaaaaggctacttcccatgagtagctttgggagatcaagcaaatgacccttgttttgcatgctctctgttttactaccttcgtcccataatataagagcgttttatacactagtgtagtgtcaaaaacgttcttatattatgagagtaacttttaatgtgtagaccccaagaaatgtccttttatattgtctgtgatgattgtacatgccgttccaaatgagtacttccgatgtgaattccacttaacctttggtga

SEQ ID NO: 3505 - DNA, 803 bp, Triticum aestivum
atgcagttctctctgcgtacattcatccggatccagccccggcgccgatgagcccgccggtggaccgcgcccttctacgcctcgtgtccctcgtcgccccgcaccgtcgcgcacctggaggtgaggggggagcagcccgctggctgaagttgaattatcaaagaagagttgtatcccatgcatttcaaaggatctgcatgccatgtcagaagattctgctaaaaagtcacttgaacaggtgactggttgggaactgaaaaatgaaggtgacattttgaaattacacagagcatggaaggtgaagaattttgtaaaaggtcttgagttctttcagcttgttgctgctgttgctgaggaagaaggtcaccacccagatcttcatctcgtcagttggaacaatgtgaaaatcgatgtctggactcattcagtcagaggtttaacagataatgacttcatccttgctgcaaagatcaatgaactcaagctagaaggccttttgagcaagaaaaaggctacttcccaggagtagctttgggagatcaagcagataacttttaatgtgtagatgccaagaaatgcccttttatattgtctgcgatgattgtacatgccgttccaaaatgagtacttccgatgtgaattccacttaacctttggtgagatctatctgttctgggcgatgcgtttctctgatgatacgaatctgggtcaccctaatacttgtttgtatcttctgaatatatacagtagaaggtgccatgtatgcaatggcatagatttttttttaagatcaagatgcaatg

SEQ ID NO: 3506 - DNA, 684 bp, Triticum aestivum
atcactggacaccattaaggaattgctcaagatttcctggaggacaagctcacaccatcctacaagtctgaccccagtacctgaatctaatgatgaggacgtcaaagttgttgttggtcaagagtctagatcaaatagttttggatgagtcaaaggatgtccttttggaggtatatgcgccatggtgtgggcattgtcagtcgctggagcctatctacaacaagctggccaagtatctccgtggcatcgactcccttgtaatagccaaaatggacggcacaaacaatgagcatcctcgtgccaagcccgatggattccccacgatactcttctatccagctgggaagaaaagctttgagcctataactttcgagggggaccggacggtggtggagatgtacaagttcctcaagaagcatgccgccatccctttcaagctgaagcgcccggactcgtcagcggcacggaccgacggcccaggctcgacggccgagggcgagaagagctccggttcgaacccgaaggacgagttgtagggggtttacatacgccattgacaagcacgaggtgctgctgtcgaaagcaggggatgcagaagggacagctaagctaggtatcaacttgggccgttggaggtgtatgctgagaacacaaatattgactagaatttcgataaataaaagc

SEQ ID NO: 3507 - DNA, 710 bp, Triticum aestivum
cttcttcagtggtgaaatatcactggacaccataaggaatttgctcaagatttctggagcacaagctcacaccatctacaagtctgacccagtacctgaatccaacgatgaggacgtcaaagttgttgttggcaagagtctagatcaaatagttttggatgagtcaaaggatgtccttttggaggtatatgcgccatggtgtgggcattgtcagtcactggagcctatctacaacaagctggccaagtatctccgtgggattgactcccttgtaatagccaaaatggacggcacaaacaatgagcatccccgtgccaagcccgatggattccccacgatactcttctatccagctgggaagaaaagcttcgagcctataactttcgagggggaccggacggtggtggagatgtacaagttcctcaagaagcacgccgccatcccattcaagctgaagcgcccggactcgtcagcggcacagaccgatggctcaagctcgacggccgagggcgagaagagctccggttcaaagcccaaggacgagttgtagggaattagttacgccattgacaagacaagttcgaggtgccgatggtgccgatgaagtccgaggtggagaagggatagctaagcttggctgctggaagtgtatgctgagaacacaaatacgtattaactactgtagaatccaacaaataaaagcaagatgt

SEQ ID NO: 3508 - DNA, 838 bp, Triticum aestivum
cccggagctcagggatggaggggcgcccctactccgcgaccaggcggcactcagcgcgtccgcccccactggccgctccgcctcgcaggcgacgggggacgaggccgggctaaagtcggtgagcgcgcgccgccgccgctgccccaattatcaaaaaggagttgtgtctcatgcaattcaaaggatttacaagccatgtcagaagattctgctaaaacgttgctagagcaggtggctggttgggaggtgaaaaatgagggtggcattctgaaattgcacagggcatggaaggtgaagaactttgccaaagggcttgagttctttcagcttgttgctgctgttgccgaggaagaaggtcaccacccagatcttcatcttgttggttggaataatgtgaaaattgatgtgtggactcactcagtcagtggtttaacagataatgatttcatccttgctgcaaagatcaatgaactcaagctaggagacctttttgagcaagaaaaaagctactgcccaggagtagctctcgtgaatcaaaagatatccttttgtattttgtcacaattgcatatgccgctccaaaagcaggattcgtccagtatatattctgggataaatgatggtttggcgatgctattggttcttcatgagaagttcaaggaggatttctgatattattttattgttaatgagtcatgccagtaagctttctgtatttgttcgccgtgaggagcaatggggcattgcacacttacctatgtatactgctacctgattatcgttggtcttttgtataaataaaggccttgctatcattatgtatggtccttcttcccca

SEQ ID NO: 3509 - DNA, 658 bp, Triticum aestivum
tccggtatcgacaatgtccagttgcttccaatcccgaaagcatcctagagatggtgacgaggaaagagataccaagggtaatggcaaggtgtgggtgcccaagacgatccggatcgatgacgtagatgaggtagccaggagttctatctggtcacttattgggatcaagggtgacaaggtggagaaggatgatggcaaagggtgtaagcttgcaagggtttttgatccaaaggatgaggcaaagatgtcaagccacagaggtaacaatagcctgccattcttgaaggggaacccagctgcactgtcgcgctcagtgaacttccaagagagatcttgagcaccatctggaaattcttcatgctgccttctgctactataaaaccatgtagcatgatacagctgaaattttgtacattagataattgcatactagataagagacatggagtgttcaacatagctataagcagatcctgtaactgtagctgtactaggtaacttgtagatagctatttgggttggggaagattgggagcagaagttcctgtatctgtagataaatatgatatattgattggaatgtttggcagggctacctttgcacgatagcaccgaaacaattggtagctgtctgatcccattgtataaccaagatgag

SEQ ID NO: 3510 - DNA, 586 bp, Triticum aestivum
ctgcttctccggtatcgtacaatgtccagttgcttccaatcccgaaagcaccctagagacggtgatgaggaaagagataccaagggtaatggcaaggtgtgggtgcccaagacaatccggatcgatgacgtagatgaggtggccaggagttctatctggtcacttattgggatcaagggcgacaaggaggagaaggatgatggcaaagggtgtaagcttgcaagggtttttgatccaaaggatgaggcaaagacgtcaagccacagaggtaacaatagcctgccattcttgaaggggaaccctgctgcactgtcacgctcagtcaacttccatgagagatcttgagcaccatctggaaattcttcatgctgccttctgctactataaaaccatgtagcatgatacagctgaaattttgtacattagataattgtatactactagataagagacatgaagtgttcaacatagctataatcagatcatgtaactgtagctgtactaggtaacttgtagatagctatttgggttggggaagattgggagcagaagttcctgtatctgtagataaatatcgatatattga

SEQ ID NO: 3511 - DNA, 693 bp, Triticum aestivum
cagcaatcccccaaatctcctcagcctcccgcgcatctcctccgacatggcccgcaccaagcagacggcgaggaagtccaccggcggcaaggcgccgaggaagcagctggccaccaaggccgcccgcaagtccgccccggccacaggcggcgtcaagaagccccaccgcttccgccccggcaccgtcgccctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaggcctacctggtgggcctcttcgaggacaccaacctctgcgccatccacgccaagcgcgtcaccatcatgcccaaggacatccagctcgcccgccgcatccgtggagagagggcctaagctctgttcgtcgtcgtctgttagtcgtcctcttagcctgatgtgttcatcggtggaaatgtgcgtgctagtgtttgttcgtgtcgtggtcgatgtagtgtgtctgttctgatgtcaccatcttgctgtcatcagtaactgaaatgaaaatgttgctatctgttctaagatctgtgccatttgatgcttgtttttcattgtctgcgagcccgttgttgaatgtgattcctcaactg

SEQ ID NO: 3512 - DNA, 740 bp, Triticum aestivum
tccgcatccagtttggtcgccttccgattcgaacctccccgaaatccgcagcagtcgacaggaggccaaaggcgccgccatggcccgtacgaagcagaccgcccgcaagtccaccggcggcaaggcgccccgcaagcagctcgccaccaaggcggcgaggaagtctgcgccgacgaccggcggagtgaagaagccccaccgctacaggcccgggaccgtggcgctccgggagatccgcaagtaccagaagagcacggagctgctgatccgcaagctgcctttccagcgcctggtccgcgagatcgcgcaggacttcaagacggacctcaggttccagagccacgccgtgctggccctccaggaggcggccgaggcgtacctggtggggctgttcgaggacaccaacctgtgcgccatccacgccaagcgcgtcaccatcatgcccaaggacatccagctcgcccgccgcatccgtggcgagagggcctaagctgccccctccgccgacgccgttagtgagtcggaatgtgttgattctggttgtagtttgttcctaattgctgtgctaggtctctctgcttttgtgtagaagaaatatggttgttggtacaagcaagacgaacttgttatgtgatgatgttacttttggtttgcgatgaagcaaacgtatgtcgaagacctcagaactgctgttgttgttggcaacgactcagctcttgtcgtgtccttaccccatcgtg

SEQ ID NO: 3513 - DNA, 578 bp, Triticum aestivum
atcccacgcaggcgaacacccactcaaaccctagcttcctccccactccatctccgatggccccgcacgaagcagacggcgcgcaagtccaccggcggcaaggcgccgaggaagcagctggcgaccaaggcggcgcgcaagtcggccccggccaccggcggcgtgaagaagccccaccgcttccgcccgggcaccgtggcgctccgggagatccgcaagtaccagaagagcacggagctgctcatccgcaagctccccttccagcgcctggtgagggagatagcgcaggacttcaagaccgacctcaggttccagtcctccgccgtctccgccctgcaggaggccgccgaggcgtatctggtggggctcttcgaggacaccaacctgtgcgccatccacgccaagcgcgtcaccatcatgcccaaggacatccagctcgcccgccgcatccgtggggagcgcgcctaggtttggccgtagcagttcgtgtcttgcgatctggttgtactaaggaaatgtgctgggtttctctgtagtgttgataagctttccagatgttctgacgctgaaatgaaatg

SEQ ID NO: 3514 - DNA, 661 bp, Triticum aestivum
ggctcaccaccgagccgcctacccgtaccgggccgccaacggcacctgcaaagccgccaagagctcccccgtggtggtgcgcatcgacggacaccaggacgtgccggccaacagcgaggaggcgctggccaaggccgtggcgaaccagcccgtctccgtggccatcgatgccagcgggaaggcgttcatgttctactccgagggggtgttcaccggtgactgtggaacagacctggaccacggcgtcgcggtggtcgggtacggggtggcggaggacggcaaggcgtactggacggtgaagaactcgtgggggccgtcatggggggagaaggggtacatcagggtggagaaggattccggtgccgaaggcgggctctgcggcatcgccatggaggcatcctaccccgtcaaggcggacagcaaacccaagcccaagcccaggcgcgcgctcggcgcatgggagtcgcagtgatcgacccgtctgcttgtctgaattatttctacgatcattcctagttaaattagggtgaaaataaattacagctgaatcaagtgcttctctgtccacacgcaagaattaggtgtgtgtagcgtgggaccaggacgatccacataatttgtttggatttatgaaaataatgtaaaatgtaataatgtaatg

SEQ ID NO: 3515 - DNA, 612 bp, Triticum aestivum
aagatctcaatctcagtctccatctccatcctccaaaccgcacgcagcagcccatccctcgccgccgcccgcctcccgcagctccgatggcccgcaccaagcagactgcccgcaagtccaccggcggcaaggcgcccaggaagcagctcgccaccaaggcggcgcgcaagtcggcgccggccaccggcggcgtcaagaagccccaccgcttccgcccgggaaccgtcgcgctccgtgagatccgcaagtaccagaagagcacggagctgctcatccgcaagctccccttccagcgcctcgtccgggagatcgcccaggacttcaagaccgacctccgcttccagtcctccgccgtctccgcgctccaggaggccgccgaggcgtacctggtcgggctgttcgaggacaccaacctgtgcgccatccacgccaagcgcgtcaccatcatgcccaaggacatccagctcgcccgccgcatccgcggggagcgcgcctaggctctgtatccgccctgtgtcagctgcccttgaatcccgctagatgtttatgactctgtagttgtctgctcctccttatgtttccctccttgtatttctaatggatgccatcaaa

SEQ ID NO: 3516 - DNA, 745 bp, Triticum aestivum
atcagccaccgtatagtatctggagccttcgtcgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagctgtcctctccgtgaacgacggtagtggatcgggatgagttgattccggttgtagtttgttcctaattgctgttctaggtcttaagcttttgtgtagaagaaatatggttgttaggtatgagtaagacgaaccaacttgatatgtgatgttccttttggtttgcgatgaagcaaacgtatgtctatgttgaagacctcagaaccattgttgttcgctgcaactctgttgttgtcgtgccgttgatcc

SEQ ID NO: 3517 - DNA, 912 bp, Triticum aestivum
gaagggcctggccgcggccgacaacagcgaggagctcctccggcggtaccagcttggcgaggagctggggcgcggcgagtttggggtgacgcgatggtgcatggacgtggcaacgggagagaagctcgcgtgcaagtcgatcagcaaagcggaagctccggagcagcgtcgacatcgaggacgtgcggcgcgaggtagccatcatgcggtcgctgccctcgcatgtaaacgtcgtgcggctccgtgaggcgttcgaggacggcgactccgtgcacctggtcatggaggttttccaaggggggccgagttctttgaccgcatcgtcgtgcgcggtcactacaccgagcgtgctgccgccgctgtcatgcgcactatcatggaggtcgtgcagcattgccaccagaacggtgttatgcaccgggaccttaagcctgagaatttcttgtacgccaatgcatctgagagctcccctctcaaggttatcgacttcggactctccgtgtgcttcaagccaggtgaaagattcagtgagatcgtcggatctccctattacatggcgcctgaagtcctgaagagaaactatggacaggaaatcgacatctggagtgcaggcgtcatattgtatatcttgctactgtggtgtccctccattctgggccaaaacggacgaagggattgcgcaggccatcatccgatcacgcgtcgacttcgagcgcgagccttggccgaaggtgtcagacaacgccaaggagcttgttagcaggatgcttgaaaacaacccttatgccagattgacggctcaacaagttttagagcatccatggatacagaattccaccgctgctccgttatcaccttctgttcttttctggagttctcttttacctgataaatgaggaagtgtatgttgtg

SEQ ID NO: 3518 - DNA, 1025 bp, Triticum aestivum
gtgagatcgtcggatctccctattacatggcgcctgaagtcctgaagagaaactatggacaggaaatcgacatctggagtgcaggcgtcatattgtatatcttgctatgtggtgtccctccattctgggccaaaacggacgaagggattgcgcaggccatcatccgatcacgcgtcgacttcgagcgcgagccttggccgaaggtgtcagacaacgccaaggagcttgttagcaggatgcttgaaaacaacccttatgccagattgacggctcaacaagttttagagcatccatggatacagaattccaccgctgctccaaacattcctcttggtgaagcagtaaggtcaaggctaaagcaattcactgtcatgaacaagttcaagaagaaggccttgcttgtggtggcggaatacttgcctgctgaagagctggaggcaatcacggaactgttccacatgctggacactaatcaaggatgggcacctgacaattgaggagctcaggaaaggtctacaaatgatagggaacaatgtccatgatacagatgtggatatgctcatggaagccgcggacttagatggaaatggcaccttggactgcaaggagtttgtcacggtctccattcacctgaagaaaatccgcagcgaggaacacctccccaaggtgttcaattacttcgacaagaacatgagcgggttcatcgagatggaagagctcaaggaagcgctatccccaagaggcgaccagaaggccatcgaggagatcatcttcgacgttgacattgacaagaagcttcaaccagttggggtctactacatggaaaacagagaaactactccattacatgacaaccacgaaggaaataaatctttgatgtgagcaaatcactaaagagaaaagcttgtggccacaagcaacctgtcactgatatgtctccgtcgtatctactttttcaaacactttttctctggtcttggactctaatttgcatgaccagggcaggcgctggttttagcagaatt

SEQ ID NO: 3519 - DNA, 1281 bp, Triticum aestivum
  misc_feature (873)..(875): n = any nucleotide
  misc_feature (896)..(896): n = any nucleotide
  misc_feature (909)..(909): n = any nucleotide
  misc_feature (919)..(919): n = any nucleotide
  misc_feature (928)..(928): n = any nucleotide
  misc_feature (947)..(948): n = any nucleotide
  misc_feature (969)..(969): n = any nucleotide
  misc_feature (974)..(975): n = any nucleotide
  misc_feature (994)..(994): n = any nucleotide
  misc_feature (1003)..(1003): n = any nucleotide
  misc_feature (1015)..(1015): n = any nucleotide
  misc_feature (1032)..(1032): n = any nucleotide
cgacaacgacggggcgagggcggctcatggaaacgccttgagtacatcaagaaaaaacggcgggctcaccaccgagccgcctacccgtaccgggctgccaacggcacctgcaaagccgcgaaggtggccaagagctcccccatggtggtgcacatcgacggacaccaggacgtgccggccaacagcgaggaggcgctggccaaggccgtggcgaaccagcccgtgtccgtgggcatcgatgccagcgggaaggcgttcatgttctactccgagggggtgttcaccggtgagtgtggaacagagctggaccacggcgtcgcggtggtcgggtacggcgtggcggaggacggcaaggcgtactggacggtgaagaactcgtggggcccgtcgtggggggagaaggggtacatcagggtggagaaggattccggtgccgaaggcgggctctgcggcatcgccatggaggcatcctacgccgtcaagacggacagcaaacccaagcccacgcccaggcgcgcgctcggcgcctgggagtctcagtgatcgtcccaatctctatgcgtgtctgaattatttctactatattcctagttaaattagggtgaaaaaataaattacagctgaatcaagtgcttctccgtccacacgcaagaattaggtgtgtagcgtgggaccaggacgatcgacataatttgtttggatttatacgaatgtaatgtaaaatgtaataatgcatgcaatgtactggtaatgtttgtaagtgtaatacccacgatgcggctatatctcctacgtgtcggagcacgacttagaggcataaccgcattgtaggcatgtgcaagaggggtaatctttacacatcccatgtactgnnnaataagaaagacggtacaccnagttggcttatanatcaacactntcacacagnatacattgaataaagcatnntacaatcatccagaatacaantcaannggtccgactacggaaccanaaataaaangaaggtcacccnctaatgctagatccccngatcgccccgactggctccactactgatcaactaaaacgaaacaacacaatgatcaatatcttcatcgagctcctccttgagctcggtagcgtcacctatacggtatcatcggcacctgcaaactggttttggaagtaatgtgtgagtcatggggactcagcaatctcacaccctcgcgatcaagactatttaagcttatgggtagggaaaaggtatgaggtggagctgcagcaagcactagcatatat

SEQ ID NO: 3520 - DNA, 710 bp, Triticum aestivum
gtttcgaagtcgccgccgaggagagcagtcgaccagacgccatggcccgtaccaagcagaccgcccgcaagtccaccggcggcaaggcgccccgcaagcagctcgccaccaaggcggccaggaagtcggcgccgaccaccggcggagtgaagaagccccaccgctacaggcccgggaccgtcgccctccgggagatccgcaagtaccagaagagcacggagctgctgatccgcaagctgcccttccagcgcctggtgagggagatcgcccaggacttcaagaccgacctccgcttccagagccacgccgtgctggccctccaggaggcggccgaggcgtacctggtgggactcttcgaggacaccaacctgtgcgccatccacgccaagcgcgtcaccatcatgcccaaggacatccagctcgcccgccgcatccgcggggagagggcctaggccagggaggccaatccagcccctgccgccgtcgtcgctgcattcggcattctggggcgcatgccaacgtgcgccagcatttgtactagtagttgattagcctcccttgtcgagatatgcatcttgtggatcgttgtagaaaaccatgttggttggttaccgtagttacaaaggctcttgtctgcttaattggttttggttttggtttgcggtgatgcaaaccgatgcttactgtaatgaaattgttggttaatacag

SEQ ID NO: 3521 - DNA, 620 bp, Triticum aestivum
ctcccgagcaatcctctctgggcgcccacgcagcaagccctccactcccgatggcccgcacgaagcagacggcgaggaagtccaccggcggcaaggcgccgcgcaacaagctggccaccaaggcggctcgcaagtccgccccggccaccggcggcgtgaagaagccgcaccgcttccgccccggcaccgtcgcgctccgggagatccgcaagtaccagaagagcaccgagctgctcatccgcaagctgcccttccagcgcctggtgcgggagatcgcgcaggacttcaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctagtatgcttcctagaatcctagtgtctgatctgttctcgaggtgtagagatgtgttagtttcttatcagcccgtgtctgtggtagtaaggttccttgatggttgcgttatggtgtggtgtatgtgatggtaccatcttgttatcatcatccatgagaagtt

SEQ ID NO: 3522 - DNA, 723 bp, Triticum aestivum
ccggcaccatcgacttcatccttcggcaactcgtccgccgtccttccagaactgcctcatcatcacgcgccggcccatgggacaaccagcagaactcggtgaccgcgcacggccgcacggaccccaacatgaagtccgggctggtcatccagaactgccgcctggtgccggaccagaagctgttcgcggaccgcttcaagatcccgtccttcctgggccggccgtggaaggagttctcgcggctggtcatcatggagagcatgatcgccgacttcatcaagcccgaggggtacatgccgtggaacggcgacttcgggctcaagacgctctactacgccgagttcggcaaccgcggccccggcgccggcaccagcaagagggtcacctggccagggttccgcgtcatcgggaacaaggaggccgagcagttcaccgcagggcccttcatcgacggggcgacatggctcaagttcaccggcatgcccaactacctcgggttcaaggtctaaacgcgcatgcatgcatatgcatgcaacgcctgccccctgtacatgagataccgatcgaggtaacgtaatgtgtgtacagaacgtgtgatgactgatacttgcaagatcagctaaaccttcgctgctccgttatcaccttctgttcttttctgtggtttgtttctggagttctcttttccttggtaaatgattaagtgtatgttgtgacaatgat

SEQ ID NO: 3523 - DNA, 673 bp, Triticum aestivum
catcatcagcgcgcggccccatggacaaccagcagatctcggtgaccgcgcacggccgcacggaccccaacatgaagtccggggctggtgatccagaactgccgcctggtgccggaccagaagctcttcgcggaccgcctcaagatcccgtcctacctgggccggccgtggaaggagttctcgcggctggtcatcatggagagcatgatcgccgacttcatcaagcccgaggggtacatgccgtggaacggcgacttcgggctcaagacgctctactacgccgagttcggcaaccgcggccccggcgccggcaccagcaagagggtcacctggccagggttccgcgtcatcgggaacaaggaggccgagcagttcaccgcagggcccttcatcgagcggggcgacatggctcaagttcaccggcatgcccaactacctcgggttcaaggtctaaatgcgcatgcatgcatatgcatgcaacgccctgcgccctgtacatgagataccgatcgaggtaaacgtaatgtgtgtacggaacgtgtgatgactgatgcatgcaagatcagctaaaccttcgctgctccgttatcaccttctgttcttttctgtggtttgtttctggagttctcttttaccttggtaaatgattaagtgtatgttgtgacattgatta

SEQ ID NO: 3524 - DNA, 729 bp, Triticum aestivum
actcgccgccgtgttccagaactgtctcatcatcacgcgccggcccatggacaaccagcagaactcggtgactgcgcacggccgcacggaccccaacatgaagtccgggctggtgatccagaactgccgcctggtgccggaccagaagctgttcgcggaccgcttcaagatcccgtcctacctgggcaggccgtggaaggagttctcgcggctggtcatcatggagagcatgatcgccgacttcatcaagcccgaggggtacatgccgtggaacggcgacttcgcgctcaagacgctctactacgccgagttcggcaaccgcggccccggcgccggcaccagcaagagggtcacctggccagggttccgcgtcatcgggaacaaggaggccgagcagttcagccgcagggcccttcatcgacggggcgacatggctcaagttcaccggcatgcccaactacctcggattcaaggtctaaacgcgcatgcatatgcatgcatgcaacgcctgccccctgtacatgagataccgatcgaggtaaacgtaatgtgtgtacggaacgtgtgatgactgatgcttgcaagatcagcaaaccttcgctgctccgttatcaccttctgttcttttctggagttctcttttccctggtaaatgattaagtgtatgttgtgagttgtgacattgattaactggaaaatgtatcattcagatgcccataactggtatgc

SEQ ID NO: 3525 - DNA, 657 bp, Triticum aestivum
cagcccccaaccaccagagcctcctcctcccctccggcgcatcgacgacatggcccgcaccaagcagacggcgaggaagtcgaccggcggcaaggcgccgaggaagcagctggcgaccaaggccgctcgcaagtccgccccggccaccggcggcgtgaagaagccccaccgcttccgccccggcaccgtggcgctccgcgagatccgcaagtaccagaagagcacggagctgctcatccgcaagctccccttccagcgcctagtgcgcgagatcgcccaggacttcaagaccgacctccgcttccagtcctccgccgtctccgccctgcaggaggccgccgaggcctacctcgtgggcctcttcgaggacaccaacctctgcgccatccacgccaagcgcgtcaccatcatgcccaaggacatccagctcgcccgccgcatccgtggcgagagggcctaggctgctgcacctgcaatccgtgttaggctgagttcatcggtggaaaatagtggtgtttcagaatgtgcgtcgtgttagatccatgttagatccctgttcctctcatggtgggtggatgtgttatgcctaatctgatggtaccttcttgttgccatcagcaatggaaatgaaaaaatgttggttgctgttgtcataca

SEQ ID NO: 3526 - DNA, 736 bp, Triticum aestivum
gacaaccagggcaacatgtgtgaccgcgcacgggcgcacggaccccaacatgcccaccggcatcgtgctccaggggtgcaagatcgtgccggaggacgcgctgttccccgtcaggcagacggtgcctagctacctcggacggccgtggaaggaatactcgaggacggtgatcatggagagcaccatcggcgacctcatcaagcccgaggggtggtcggagtggatgggtgacctcgggctcaagacgctctactacgccgagtacgccaacaccgggcccggcgccgggacaagcaagagggtgacctggccagggtaccgtgtcatcggacaggccgaggccacgcagttcacccccggcgtgttcatcgacggcatgagctggctcaagaacaccggcacgcctaacgtcatgggcttcatcaaatgatcgtgccagtttgccggccatttgactccggccgcgtgcatgcatgtgcatgcgcttgtccggtggatgcttgacgagacacgtggagttttaggaacaaattaaggaaggagacataaagcaagatctgtttgtgtattatttgtacagaagtgcaaaagcagttcaagcaaaagaatttctctgtgtaatgtaattgattagaacattttcgaaaaaggggtttcccctgctttgtattccaaagcaacggagccaattagaacactttcaacatggctacgatgtatcgttttcactgtccag

SEQ ID NO: 3527 - DNA, 712 bp, Triticum aestivum
tccagaactgcctcagacggtgcggaagcccatggacaaccagggcaacatgggaccgcgcacgggcgcacggaccccaacatgcccaccggcatcgtgctccaggggtgcaagatcgtgccggaggacgcgctgttccccgtcaggcagacggtccccagctacctcggacggccgtggaaggaatactcgaggacggtggtcatggagagcaccatcggcgacctcatcaagcccgagggatggtcggagtggatgggtgacctcgggctcaagacgctctactacgccgagtacgccaacaccgggcccggcgccgggacaagcaagagggtgacctggccggggtaccgtgtgatcggacaggccgaggccacgcagttcaccgccggcgtgttcatcgacggcatgagctggctcaagaacaccggcacgcccaacgttatgggcttcatcaaatgatcgagccaccagtttgccggccatttgactccggccgtgtgcatgcatgcatgcatgcgctcgtccggtggatgcttgacgagacacgtggagttttaggaagaaattaaggaaggaaacataaagcaagatctgtttgtatattatttgtacagaagtgcaaaagcagttcaagcaaaagaatttctctgtgtaatgtaattgattagaacatttcaacatggtcctgatgtggcttttcttttccaca

SEQ ID NO: 3528 - DNA, 652 bp, Triticum aestivum
ccaatctccctcccaaccaatccaccaaggaaaccccgatggcccgcacgaagcagacggcgaggaagtccaccggcggcaaggcgccgcggaagcagctggccaccaaggcggcgcgcaagtcggcgccggccaccggcggcgtcaagaagccgcaccgcttccgcccgggcaccgtggcgctccgggagatccgcaagtaccagaagagcacggagctgctcatccgcaagctgcccttccagcgcctcgtgcgggagatcgcgcaggacttcaagaccgacctccgcttccagagctccgccgtctccgcgctgcaggaggccgccgaggcctacctcgtggggctcttcgaggacaccaacctctgcgccatccacgccaagcgcgtcaccatcatgcccaaggacatccagctcgcccgccgcatccggggagagagggcctaagatcgtgtctgtcttatctgcaggtgtagagattagcatgtgttgcgtggtgatgtgatctggtattgtggtaggaagatccctcgttcgtgctatgttaggtgtgttgtgatgttaccatcttgttgtcatcagcaatctgaatgaaagctggctatcagatctctctccattttgtgttcttctgacgcattttgttgttt

SEQ ID NO: 3529 - DNA, 710 bp, Triticum aestivum
ttagacgcgtgggtcccaatcccccaaatctcctcagcctccctgccggcgcatctccgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcacggagctgctcatccgcaagctccccttccagcgcctcgtccgtgagatcgcccaggacttcaagaccgacctccgcttccagtcctccgccgtctccgccctgcaggaggccgccgaggcctacctggtgggcctcttcgaggacaccaacctctgcgccatccacgccaagcgcgtcaccatcatgcccaaggacatccagctcgcccgccgcatccgtggagagagggcctaggctgcagtctgcaatccatgcgtcgtctgttagatccctgttagcctgagttcgtcggtggaagtgtgtgtgtgctagcagtagggtttcagactgtgcctgtgttgttcttgtcatggtggatgtggtatgcctaatgtgatggtaccgtcttgttgcggttaagctgtgcaatgtagctagtttccggctctgttttgctctatcctggccatatgggaattctgaatttgcg

SEQ ID NO: 3530 - DNA, 647 bp, Triticum aestivum
attcctcccaatcccccaaatctcctcaacttcccggcgcatctccgacgacatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgagtcctacctcgtcgggctgttacgaggacaccaacctgtgcgccatccacgccaagcgcgtcaccatcatgcccaaggacatccagctcgcccgccgcatccgtggcgagagggcctaggccgcaatctgcaatcaatatgccgtctgtccttgttaggttgagttcgtccgtggaagtgtgtgtgctattagggtttacgaatgtgtctgtgttgttcttgtcatggtggatgcgttatgcctaatctgatggtaccgtcttgttgccatcagcacattttcagtggaaatgaaaatgttg

SEQ ID NO: 3531 - DNA, 637 bp, Triticum aestivum
agcagttcccctcctcaacccccgagagtccgccgcgcccacccgccagccccgatggcccgcacgaagcagacggcgaggaagtccaccggcggcaaggcgccgcggaagcagctggcgaccaaggcggcgcgcaagtcggccccggccaccggcggcgtgaagaagccgcaccgcttccgccccggcaccgtcgcgctccgggagatccgcaagtaccagaagagcaccgagctgctcatccgcaagctgcccttccagcgcctggtgcgggagatcgcgcaggacttcaagaccgacctccgcttccagagctccgccgtgtccgcgctccaggaggccgccgaggcctacctcgtggggctgttcgaggacaccaacctctgcgccatccacgccaagcgcgtcaccatcatgcccaaggacatccagctcgcccgccgcatccgtggcgagagggcctaggttgcctcgtggttgtctgatctggagactggtgtagagatgttagcttcgtctcgttagcatgtgtctgatcttgcatcgtggtaggaagatccctcgttcgtgccagtatggctgtgttatgttctagtgtgtactgtctgatgttaccctcttgttgccatcagcaatg

SEQ ID NO: 3532 - DNA, 598 bp, Triticum aestivum
aaatccccaagcgcgacaaccaactccgcctcgacctcccggcgcatctccgacgacatggcccgcaccaagcagacggcgaggaagtccaccggcggcaaggcgccgaggaagcagctggccaccaaggcggcccgcaagtccgccccggccaccggcggcgtcaagaagccccaccgcttccgccccggcaccgtcgcgctccgggagatccgcaagtaccagaagagcaccgagctgctcatccgcaagctacccttccagcgcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcaccatcatgcccaaggacatccagctcgcccgccgcatccgtggagagagggcctaagctctgtgcgtcgtcgtctgttagtcgtcgtcttagccagatgtgttcagcggtgaaattgtgcgtgtttgtagtgtctgttcgtgccatggtggatgtagtgttcctgatctgatgtcacctccttgct

SEQ ID NO: 3533 - DNA, 621 bp, Triticum aestivum
gtgaaatcccaatctccaaagccgcagcgcagcagcagccagatccccatcccctccaccacgatggcccgcacgaagcagacggcccgcaagtccaccggcggcaaggcgccgaggaagcagctcgccaccaaggcggcgcgcaagtcggcgccggccaccggcggcgtgaagaagccccaccgcttcaggccgggaacggtcgccctccgcgagatccgcaagtaccagaagagcacggagctgctcatccgcaagctccccttccagcgcctcgtccgtgagatcgcgcaggacttcaagaccgacctccgcttccagagctccgccgtctccgccctgcaggaggccgccgaggcctacctcgtcgggctgttcgaggacaccaacctctgcgccatccacgccaagcgcgtcaccatcatgcccaaggacatccagctcgcccgccgcatccgaggggagagggcctaggttctgggtcgccggtaatactggctagtagctgttcttgtcttgtgatccggatgtgtgtcgggtgcttctgtttgttggtgttgatatgatgtgtcgtcttatcctaatgtattgtgatgcttgaatgaaattgcaatggaaaag

SEQ ID NO: 3534 - DNA, 720 bp, Triticum aestivum
ttcaatttcgagttccaccgcccgctcccgcacagcaaaggcaaccgaagccggcgagaggagccatggcccgtaccaagcagaccgcccgcaagtccaccggcggcaaggcgccccgcaagcagctcgccaccaaggccgccaggaagtcggccccgaccaccggcggcgtgaagaagccgcaccgctacaggcccgggaccgtggcgctccgcgagatccgcaagtaccagaagagcacggagctgctgatccgcaagctgcccttccagcgcctggtccgagagatcgcgcaggacttcaagacggacctccgcttccagtcccacgccgtgctcgccctccaggaggccgccgaggcctacctcgtcggcctcttcgaggacaccaacctctgcgccatccacgccaagcgcgtcaccatcatgcccaaggacatccagctcgcccgccgcatccgcggggagcgcgcctgagcgggagccagaccaatccgaccccagacgtccccgccgccgccgcattcgagggcatgccgccgttcgttcgccagcagtagttgattcgccgcctgccgttttagatcgtgttaattttggtttgcgttgatgcaaacagatgcttactgtgaaactgttggttaatatactgttgatcgaccattatcgactgtatgcaattctgatgtgctgtggagttgttgccccctgttctctgaat

SEQ ID NO: 3535 - DNA, 511 bp, Triticum aestivum
caagaagacaccaccaccagccgcgccgatggcccgcacgaagcagacggcgcgcaagtccaccggcggcaaggcgccgaggaagcagctggccaccaaggcggcccgcaagtccgcgccggccaccggcggcgtcaagaagccccaccgtttccgccccggcaccgtcgcgctccgggagatccgcaagtaccagaagagcacggagctgctcatccgcaagctccccttccagcgcctggtgcgggaaatcgcgcaggactttaagaccgacctgcggttccagtcatccgccgtctccgccctgcaggaggccgccgaggcgtacctggtggggatgttcgaggacaccaacctgtgcgccatccacgccaagcgcgtcaccatcatgcccaaggacatccagctcgcacgccgcatccgcggcgagcgtgcctaggtctgggtcgccggtaatacctgctgggtagtagctgttcctgtctcgtgatctggatgtgtgtcggttgtg

SEQ ID NO: 3536 - DNA, 597 bp, Triticum aestivum
cgtgggcgaacgcgtgggcgccgcacccgatctcccaagaacacaccaccaccagagccgccgacccccaagtccccgatggcccgcacgaagcagacggcccgcaagtccaccggcggcaaggcgcccaggaagcagctcgccaccaaggctgctcgcaagtcggcgccggcgaccggcggcgtgaagaagccccacggcttcaggccgggaaccgtcgccctccgtgagatccgcaagtaccagaagagcacggagctgctcatccgcaagctccccttccagcgtctggtgcgggagatcgcgcaggacttcaagaccgacctccgcttccagtcctccgccgtctctgcgctgcaggaggccgccgaggcgtacctggtggggctgttcgaggacaccaacctgtgcgccatccacgccaagcgcgtcaccatcatgcccaaggacatccagctcgcccgccgcatccgtggggagcgcgcctaggttcgtcctggtcgccggtaatgcttgctagctgttcttgtcgtgtgatcctggtgtgtgtctggtgcttctgtttgtcggtgtcgatatgatgtgtcatctggtcct

SEQ ID NO: 3537 - DNA, 524 bp, Triticum aestivum
ccgatctcccaagaagacaccaccaccacccgcgccgatggcccgcacaaagcagacggcgcgcaagtccaccggcggcaaggcgccgaggaagcagctggcgaccaaggcggcccgcaagtccgcgccggccaccggcggcgtcaagaagccccaccgtttccgccccggcaccgtcgccctccgcgagatccgcaagtaccagaagagcacggagctgctcatccgcaagctccccttccagcgcctcgtccgggagatcgcgcaggacttcaagaccgacctccgcttccagagctccgccgtctccgcgctgcaggaggccgccgaggcgtacctggtgggcatgttcgaggacaccaacctgtgcgccatccacgccaagcgcgtcaccatcatgcccaaggacatacagctcgcccgccgcatccgcagggagcgcgcactagatttggggtcgccggtaataactgggcagtatctgttcattgtcacatgtgaattcgaaatgtgtgatgagatgc

SEQ ID NO: 3538 - DNA, 769 bp, Triticum aestivum
aaggggccaggcgggctcatggacaacgccttggagtacatcaagagcaacggcggggctcatcaccgagctgcctacccgtaccgcgccgcccaaggcacctgcaacgtcgcgagagcggcccagaattcccccgtggtggtgcacatcgacgggcaccaggacgtgccggccaacagcgaggaggcgctggcccaggcggtggcgaaccagcccgtgtccgtggccgtcgaggccagcgggaaggcgttcatgttctactccgagggggtcttcaccggcagctgcggcacggagctggaccacggtgtcgcggtggtcgggtacggcgtggcagaggacggcaaggcgtactggacggtgaagaactcgtgggggccgtcgtggggggagcagggctacatcagggtggagaaggattccggcgccgcgggcgggctctgcggcatcgccatggaggcgtcctaccccgtcaagaccgacagcaagcccaagcccacgcccaggcgcgcgctcggcgcctgggagtcgcagtgatcgactcgtctgcgtgtctgaattatttctactatcattcctactagttaaattagggtgaaaataaattacagctgagtcaagtgcttctccgtccacacgcaataattaggtgtgtgtagcgtggggccaggacgatacacataatttgtttggatttatgaaagtaatgtaacaatgtaacaatgtaatatactggtaatgttagttcaaaatttaaatttgaactaaa

SEQ ID NO: 3539 - DNA, 547 bp, Triticum aestivum
  misc_feature (150)..(150): n = any nucleotide
gcggcgtcgttgcaatggtcaacacggctgaagatcgccctgggcgccgccaaagggttggcgttcctccatgaggccgagaacccggtcatctaccgggacttcaagacctccaacatcctgctagactcggattacaaagcgaactgntcggatttcgggctagccaaagatggaccggaagaagacgagacgcacgtctccacccggatcatgggcacgcagggctacgccgcgccggagtacattatgacagggcatctgacggccaagagcgacgtgtacggcttcggcgtggtgctgctggagctgctgacggggcgcaagtcggtggacaagagccggccgccgcgggagcagaacctggtggactgggcgcgccctacctcaacgactcccgggcgctggaccgcgtcatggacccaaacctcgccgggcagtacggcggcggggccgcgcagagggccgccggcactggcctacaaagtgcgtcagcttcaatcccaaagtcccggcccgcacatggtccgccggtcgtcagcggcgt

SEQ ID NO: 3540 - DNA, 605 bp, Triticum aestivum
ctcgaaccttccaagctcctcccggcctcccctcgcttccaccgagtccctccgatggcccgcaccaagcagacggcgcgcaagtccaccggcgggaaggcgccgcggaagcagctggcgacgaaggcagcgcgcaagtcggcgccggccaccggcggcgtgaagaagccgcacaggttccgcccgggaaccgtcgccctgcgcgagatccgcaagtaccagaagagcacggagctgctgatcaggaagctgccgttccagcggctggtgcgggagatcgcgcaggacttcaagacggacctccggttccagtcgtctgctgtgtccgcgctgcaggaggccgcggaggcgtacctggtggggctcttcgaggacaccaacctctgcgccatccacgccaagagggtcaccatcatgcccaaggacatccagctcgcgcgccgcatcaggggcgagagggcctgatgaacgagctctctgtctctgttctcggccggctttgatgttctcggtgttgtcgtgtgttaggatttagaaaatgttgggctgtcgcctgttgcttgctatcttgtagggatggttcgcctctggattgttcaatggaa

SEQ ID NO: 3541 - DNA, 735 bp, Triticum aestivum
cggctcatcacagagccgcgtacccgtaccgcgccgccatagggcacctgcaacgtcgcgggagcggcccagaactcccccgtggtggtgcacatcgacgggcaccaggacgtgccggccaacagcgaggaggctctggcccaggccgtggcgaaccagcccgtgtccgtggccgtcgaggccagcgggaaggcgttcatgttctactccgagggggtcttcaccggcagctgcggcacggagctggaccacggcgtcgcggtggtcgggtacggggtggcggaggacggcaaggcgtactggacggtaaagaactcatgggggccgtcgtggggggagcaggggtacatcagggtggagaaggattccggtgctgcgggcgggctctgcggcatcgccatggaggcgtcctaccccgtcaagaccgacagcaagcccaagcccacgcccgcgcccaggcgcgccctcggagccagggagtcacagtgatgactgatcgatccttctgcggatctgaattattactactactatcgttcctagttaaattaagggtgaaataaattaaagattgaattaagtggttctgcgtgggcacgcggcaagaattaggcgtgtgtaacgtcggaccaggtcgatcgatatctatttggattctgaatgtactgtaaaatataatgtaatgtaatacactgccagtaatagtgtatgaaacacttgctaatatattgtgta

SEQ ID NO: 3542 - DNA, 723 bp, Triticum aestivum
catcaagacaacgcgggctcatcaccgagccgcctacccgtaccgcgccgccaacggaacctgcaacgtcgcgaccgccgccaagagctcccccgtggtggtgcgcatcgacgggcaccaggacgtgccggccaacagcgaggaggcgctggcccaggccgtggcgaaccagcccgtgtccgtggccgtcgaggccagtgggaaggcgttcatgttctactccgagggggtcttcaccggcagctgcggcacggagctggaccacggcgtggcggtggtcgggtacggcgtggcggaggacggcaaggcgtactggacggtgaagaactcgtgggggccgtcgtggggggagcagggctacatcagggtggagaaggattcgggtgccgcgggcgggctctgcggcatcgccatggaggcgtcctaccccgtcaagaccgacagcaagcccaagcccacgcccacgcccaggcgcgccctcggagccagggagtcacagtgatcactgatcgatccttctgcgtatctgaattattactactactatcgttcctagttaaattaagggtgaaataaattaagattgaattaaatggttctgcgtgggcatgcagcaaagaattaggcgtgtgtaacgtgggaccaggtcgatcgatatctatttggattctgaatgtaactaggaacgatagtagtagtaataattcgccatggcgacggcca

SEQ ID NO: 3543 - DNA, 678 bp, Triticum aestivum
gcgatcccgtttcctatggatacatcggctcccgagttacccttacactctcaaggtgaacgagaagagcgacgtgtacagcttcggtgtggtgctgctggagctcgtgaccggacgcaagccggtgggtgagttcggcgacggcgtggacatcgtgcagtgggtgcggatggccaccggatcgaccaaggaaggcgtgatgaagatcgccgacccgcgcctctcgacggtgcccgtccaggagctgacgcacgtcttctacgtcgccatgctctgcgtcgcggagcaaagcgtcgagcggcccacgatgcgggaggtggtgcagatcctggccgacatgccaggggcgacgtcgatgaccgccggcacgacacggtcggaggccaccgtcgaaggagaggaggaggagcatcaggacgggccacaggagtccccggcgcagcaggatctcctcagcatttagtggctgtacctttgtcgcggcctctgtaccttgtggtgtactcttcggaatgtggtagtgtgtccggatgcgtgtgcaagaggaagcaagcatgtgctagattagtgtatgatgataatgtcgtggattaattagacctgtgtaatctctgttgtagtaggagtactgtcttgtacaagtagttagtgggtctcgtctctccattgaatcgaagt

SEQ ID NO: 3544 - DNA, 564 bp, Triticum aestivum
tcgccggcgaagcacccacacccaaacccctccggctccaatggcccgcacgaagcagacggcgcgcaagtccaccggcggcaaggcgccgaggaagcagctggcgaccaaggcggcgcgcaagtcggccccggccaccggcggcgtgaagaagccccaccgcttccgcccggggaccgtggcgctccgggagatccgcaagtaccagaagagcacggagctgctcatccgcaagctccccttccagcggctggtgcgggagatcgcgcaggacttcaagaccgacctgaggttccagtcctccgccgtctccgcgctccaggaggccgccgaggcgtacctggtcgggcttttcgaggacaccaacctgtgcgccatccacgccaagcgcgtcaccatcatgcccaaggacatccagctcgcccgccgcatccgcggggagcgcgcctaggttttcggtcgccgccggtcaagctactgggttgtagcgcttcctgtctggtgtcttctgttcggtggtgttgatatgatgtgtcgtcttgtcccattcccatgtagcatgag

SEQ ID NO: 3545 - DNA, 583 bp, Triticum aestivum
gagagagctacagtctctgctgagctggagagacccaagggccaccgcgctgtttgtgaccttctgcttcatcgccgcgatcgtcctgtacgtcacaccattccgcgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctcttatcgctccgtgatgcggcgccttcctcgtttcggtggctcgatgctgagcatgttctatagctgcaactgagatgatgctggggtcgaagcgcggttgccaaaaaattgaactgaactatgtcgttgtttgtagtcttttcagttgcccgcgtgtctgttttggaacagttttgaacctttcctgttgacgactgaaacgcctgatgtgtgagtagttattatgcatgtatgccgcctgaagaaattgtgctatcacctgagcttctgctgtgccccatcatcttttgcatttgcatctagtaatggttcttcccattttttccataggaatgctgatcta

SEQ ID NO: 3546 - DNA, 846 bp, Triticum aestivum
atacgccacaatcttctctaccgagtccctgattggagtgtggtactaccggtggcggtcgaggcagcctccgcacatggacactcgcctctcacatgcggagaccgcccatcctgacgagcttgatgaagagtttgacaccttccctacatctcgcccacctgacatcgtcaggatgcggtatgaccgcctccggagcgttgctgggaggatccagactgttgttggtgatcttgcaacacaaggagaaagactgcagtctctgctgagctggagagacccaagggccaccgcgctgtttgtgaccttctgcttcatcgctgcgatcgtcctgtacgtcacaccattccgtgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctctctcgctccgtgatctggcgccttccttgtttcggtggctcgatgctgagcatgttctatagctgcaactgagatgatgctggggtcgaagcgcggttgccaaaaaattgaactgaactatgtcgttgtttgtagtcttttcagttgcttgtgtgtctgttttgggacggttttgaacctttcctgttgacgactgaaacgcctgatgtgtgactagttattatgcatgtatgccgcctgaagaaattgtgctatcacccgagcttctgctgtgtcctatcatcttttgcatttgcatctagcagtggtcggcctgcatgagaagattcagtgtgcgcctgggaccctgttaatgatatt

SEQ ID NO: 3547 - DNA, 557 bp, Triticum aestivum
gcccatcctgatgagcttgatgaagagtttgacaccttccctacatcacgcccacctgacatcgtaaggatgcggtatgaccgcctccggagcgttgctgggaggatccagactgttgttggtgatcttgcaacacaaggagagaggctacagtctctgctgagctggagagacccgagggccaccgcgctgtttgtgaccttctgcttcatcgcggcaatcgtcctgtacgtcacaccattccgcgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctctcgctccgcggtccggcgccttccttgtttcggtggctcgatgctgagcatgttctatagctgcaactgagatgaagctggggtcgaagcgcggttgccaaaaaattgaactgaactatgtcgttgtttgtagtcttttcagttacctgtgtctgttttgggacggttttgaacctt

SEQ ID NO: 3548 - DNA, 582 bp, Triticum aestivum
cgagaagagcgacgtgtacagcttcggcgttgtgctgctggagctggtcaccgggcgcaagccggtgggggagttcggcgacggcgtggacatcgtgcagtgggtgcggacggccaccgggtcgaccaaggaaggcgtgacgaagatcgccgacccgcgcctctcgacggtgcccatccaggagctgacgcacgtcttctacgtcgccatgctctgcgtcgcggagcaaagcgttgagcggcccacgatgcgggaggtggtgcagatcctggcggacatgccgggggcgacgtcgatgaccgccggcacaacgcgggtggaggccaccgtggaaggagaagatgaggagcatcaggacgggccacaggagtccccggcgcagcaggatctcctcagcatttagtggctgtacctttgtcgcggcccctgtaccttgtggtgtactcttcggaatgtggtggcgtgtccggatgcgtgtgcaggaggaggcaggcatgtggtagattagtggtagtgtatgatgataatgctgtggatgaattagaccggtgtaatctctgttgtggtagtactgtctagtac

SEQ ID NO: 3549 - DNA, 704 bp, Triticum aestivum
gtctcaacgcaacgccgcggctccgagtgcatgtccgcgatcgccggttcctacggatacatcgctcccgagtatgcctacacgctgaaggtcgacgagaagagcgacgtgtacagcttcggcgtggtgctgttggagcttgtcaccggacgcaagccggtgggcgagttcggcgacggcgtggacatcgtgcagtgggtgcggatggccaccgggtcgaccaaggaaggcgtgatgaagatcgtcgacccgcgcctctcgacggtgcccatccaggagctgacgcacgtcttctacgtcgccatgctctgcgtcgccgagcagagcgtcgagcggcccacgatgcgggaggtggtgcagatcctggccgacatgccaggggcgacgtcgatgaccgccggcacgacgcggtcggaggccaccgccgaaggagaagaggaggagcatcaggacgggccacaggactccccggcgcagcaggatctcctcagcatttagtggctgtacctttgtcgcggcccctgtaccttgtggtgtactcttcggaatgtggtggcgtgtccggatgcgtgtgcaggcatgtgctagattagtggtatgatgataatgttgtggattaattagaccggtgtaatctctgttgtagtggtggtactggcttgtacaaagcggttagtgggtctcgtctctcccattgaatcgaa

SEQ ID NO: 3550 - DNA, 596 bp, Triticum aestivum
gacttcgggctgtccaagtacgggccggagctggacaaggacgcacgtgagcaccaatgtgaagggcagcttcgggtacctggacccggagtacttccggcggcagatgctgacggagaagtcggacgtctactccttcggcgtggtcctgctggaggtgctgtgcgcccgcacggtcatcgacccgacgctgccccgggagatggtgagcctggccgagtgggcgacgccgtgtctcaggaacggtcggctcgaccagatcgtcgaccagaggatcgccgggacgatacggccggggtcgctcaagaagctcgcggacacggccgagaagtgcctcgccgagtacggggtggagcggcccaccatgggggacgtgctctggtgcctcgagttcgcgctgcagctgcaggtggggtcgtcagacggctcggacgtcgacaccatgttgccgccggcgccgcctgtgcccgtgaaaacgccagaggttcagcgtagcctgtccgccgctaccatggcgaccgacgctgctgccatgaccaccaacttgggtgatctagacggaatgtccctgagcggagtattctcgaagatgatca

SEQ ID NO: 3551 - DNA, 878 bp, Triticum aestivum
ccgccctccgctccattcgtttcgatctatttcggcttcttcctctccaagctacagccccggccatggcggcgacgatccagtccgtgaaggccgccagatcttcgacagccgcggcaaccccaccgtcgaggttgatgtgtgctgctcagatggaaccttcgccagggccgctgttcccagcggtgcatcaactggtgtttatgaagctttggaactgagggatggtggatctgactacttgggaaagggtgtatccaaggctgttgacaatgtgaactcgattatcgcgccagctttgattggcaaggaccctacagctcaaactgagctcgacaactttatggttcagcagcttgatggaaccaaaaacgaatggggttggtgcaagcagaagcttggtgctaatgcaatcctggctgtgtcactagctatttgcaaagctggagccagcatcaagaagattccgctgtaccagcacattgccaaccttgctggcaacaagcaattggttttgcctgttcctgcattcaatgtcatcaatggtggatcccatgctggaaacaagcttgctatgcaggagttcatgatccttcctactggagctgcctcattcaaggaggcaatgaagatgggcgttgaagtgtaccacaacttgaagtctgttatcaagaagaagtacgggcaagatgccaccaatgttggagatgaaggtggttttgctcctaacattcaggagaacaaggagggtcttgagctcttgaagactgcaattgaaaaggctggatacaccggcaaggttgtcattggaatggatgttgctgcttcagagttctacaatgacaaggacaaaacatatgacctcaacttcaaggaag

SEQ ID NO: 3552 - DNA, 595 bp, Triticum aestivum
tctgaatctccatctccatctcgatctccaaaccgcagcaacccacctccctccccgccgaccccgcagcagctccgatggcccgcaccaagcagactgcccgcaagtccaccggcggcaaggcgccgcggaagcagctcgccaccaaggcggcgcgcaagtcggccccggccaccggcggcgtcaagaagccccaccgtttccgccccggcaccgtcgcgctccgtgagatccgcaagtaccagaagagcacggagctgctcatccgcaagctccccttccagcgcctcgtccgggagatcgcccaggacttcaagaccgacctccgcttccagtcctccgccgtctccgcgctccaggaggccgccgaggcgtacctcgtcgggctcttcgaggacaccaacctgtgcgccatccacgccaagcgcgtcaccatcatgcccaaggacatccagctcgcccgccgcatccgcggcgagcgcgcctaggctctgtatgcgccctctgtcagctgcgcctgaatcctgctagatgtttatgactcctgtagttgttgtttgccctgcttgtatgttccaatgatgccatcaaatgt

SEQ ID NO: 3553 - DNA, 614 bp, Triticum aestivum
agaagtcggcgagcctgccctgaactacgaggattttgctgctagcctccccaccaatgaatgcagatacgcgatattcgactatgactttgtcaccgaggagaactgccagaagagcaagatattcttcgtcgcatggtctcctgacactgcacgcgtgaggagcaagatgatctacgcgagctccaaggagaggttcaagagggagctcgatggcatccaggtggagctccaggcgacagacccgaccgaggtcggctttgatgtgatccaaggccgtgccaactgagcaccatggctgtgctgctgcttaccttaagtatgagcctccgatgaggatttagcgcgctcgccgaggctggtcatgagctgtttaccatgaggcaattgtgatttgagttgccagtatgtaccacctaaggaagatgtaagccatgactggcgcgacgacaaatgtatcctttctggttgttgattcgtggatcctgagatcagttgcatcttcatggtagaattttggtagattctgtgttgtgagccttcatactaggatcactggttcttgaaactaatgatgccatgatgtccactgaggcttattatccaacacattt

SEQ ID NO: 3554 - DNA, 1088 bp, Triticum aestivum
tcctggtctatgaccacatggctcatggaactctgcgtgagcacctatacaagacccagaatgcaccgcttagctggaggcagcttttggagatctgcattggtgcagctcgtgggctgcactaccttcacaccggtgcaaagcacaccattatccaccgtgatgtgaagacaacaaacatcctactggatgagaaatgggtcgccaaggtttcagattttggtctgtccaagactgggccatcgatggatcatacacatgtgagcacagttgtcaagggcagtttgggttacctagatcctgaatacttccgcaggcagcagctcaccgagaaatctgatgtctattcgtttggtgtggtgctgttcgaggtcctctgtgctcggcctgccttgaacccgactcttgcaaaggaagaagttagcctggcagaatgggcattgcactgccagaagaagggaattcgggatcagattgttgatccctacctaaagggaaagattgttccgcagtgcttcaagaagtttgccgagacagctgagaagtgcgttgccgacaatggcatcgagcgccccttcgatgggagatgtgctttggaatttggagtttgctcttcagatgcaggaaagttcggaggagtatcggaagctttggctgtgggatgtcggatgagggcactcccctggtgatggctggaaagaaggatcccatgacccatcgtatcgattcaagcaccaccacgaccacgacaacttccctaagcatgggcgaccaaagtgtcgcgagcatcgactcggacgggctgacgccgagcgccgtgttctcacagatcatgaaccccaaggggcggtgaggtaaaaatctgggcctgcttgtcgcccttgaggcctaatttattcattgagtctattttcatcagtttgtgccatcttgcaagattaataggaattgggggtcagagtattgtttcacgttagacattttgcattgccttgtttttctcttgttcacgcagcttgtcctgactctgctttttagcatgtcgtaactaccgccgctgctacgtgctattgacccgacaagtcaag

SEQ ID NO: 3555 - DNA, 846 bp, Triticum aestivum
ccagcagccgccgcaagagagagcagggagcgaggaggaactcgacgagagagggcatcgaatccgcctccttcttcctcgcggggtcgtccccgactccgaggcctccgacatggcgaacgctgcgtcaggcatggctgtggacgacgaatgcaagctcaagttcctggagctgaaggcgaagcgaacccaccgcttcatcatctacaagatagacgataagaagaagatggttgttgtggagaaagtcggcgagcctgccctgaactatgaggacttcgccgccagcctccccaccaatgaatgcagatacgcgatattcgactacgactttgtcaccgaggagaactgccagaagagcaagatattcttcgtcgcatggtctcctgacacggcacgcgtgaggagcaagatgatctacgcgagctccaaggagaggttcaagagggagctcgacggcatccaggtggagctgcaggcgacagacccgaccgaggtcggctttgatgtgatccaaggccgtgccaactgagcaccatggccgtgctgctgcttaccttaagtatgagcctctgatgaggatttagcgcgctcgccgaggctggtcatgagctgtttaccatgaggcaattgtgattgagttgccagtatgtaccacctaaggaagatgtaagctgtgactggtgcgacgacaaatgtatcctttctggttgttgattcgtgggtcctgatatccccccttcttacctgctaagatcagttgcatcttcatggtaaaattttggtagattcttgttgtgagctttcatactaggatcactgggtcttgaaactaatgatgcccat

SEQ ID NO: 3556 - DNA, 475 bp, Triticum aestivum
  misc_feature (26)..(26): n = any nucleotide
  misc_feature (37)..(38): n = any nucleotide
  misc_feature (46)..(46): n = any nucleotide
  misc_feature (64)..(64): n = any nucleotide
cctcttgtgatactagtctgtatccngagctgatacnncctacaanctttctctacctattccngattggagtgtggtactaccggtggcggtcaaggcagcccccgcacatggacactcgcctctcacatgcggagaccgcccatcctgatgagcttgatgaagagtttgacactttccctacatctcgtccacccgacatcgtgaggatgcggtatgaccgcctccggagtgtcgctgggaggatccagactgttgttggtgatcttgcaacacaaggagagaggctgcagtctctgctgagctggagagacccaagggccaccgcgctgtttgtgaccttctgcttcctctagtactagatatatgaaacaccgttttcttaatcgacagtttgatcgttgtagcggtgaaaaaataaagtgtcatgcactatcatgtaagaacccgaactatactagttcaaacttgggaa

SEQ ID NO: 3557 - DNA, 1086 bp, Triticum aestivum
gggcacgatgcgggacgagacgctggtggccgtgaagcgcggcaaccggcggacgcagcaggggctgcacgagttccacacggagatcgagatgctgtcccggctgcgccaccggcacctggtctcgctcatcggctactgcgacgagcgcggcgagatgatcctcgtgtacgagtacatggccatgggcacgctgcggagccacctgtacggcgccggcctcccgcccctgtcgtgggagcagaggctggaggcctgcatcggcgccgcgcgggggctgcactatctccacaccagctccgccaaggcgatcatccaccgggacgtcaagtcggccaacatcctcctcgacgagagcttcatggccaaggtggccgacttcgggctgtccaagaacgggccggagctggacgagacgcacgtgagcaccaaggtgaagggcagcttcgggtacctggacccggagtacttccggcggcagatgctgacggagaagtcggacgtctactccttcggcgtggtcctgctggaggtgctctgcgcccgcaccgtcatcgaccccacgctgccgcgggagatggtgagcctggcagagtgggcgacgccgtgtctcagaaacggccagctcgaccagatcgtcgaccagaggatcgccgggacgatacggccggggtcgctcaagaagctcgcggacacggccgacaagtgcctcgccgagtacggggtggagcggcccaccatgggggacgtgctgtggtgcctcgagttcgcgctgcagctgcaggtggcgtcctcagacgtctcggacgccgacaccatgttgacgccgcccgtgcccgtgaaaacgcccgaggttcagcgtagcctgtccgccgctaccgtggcgactgacgctgccatgaccaccaacttgggtgatctagacggaatgtccctgagcggagtattctccaagatgatcaagagcgacgaggtcaggtgaagccaaaagatgcttcgtccacgttgtacaaactgaagcacatgtatatgtcaattttgtgtttataggatgtagtacatgacaaacaatgtacaaactttcat

SEQ ID NO: 3558 - DNA, 890 bp, Triticum aestivum
accccctccccctccccaagcagccgcgcaacagagagagcaggaagcgaggaggaactctacaagagagggcatcgaatccgcctccttcctcgcgcggtcgtctccgacatggccaacgcggcatcgggcatggctgtggacgacgaatgcaagctcaagttcctggagctgaaggctaagcgaacccaccgcttcatcatctacaagatagacgataagaagaagatggttgttgtggagaaagtcggcgagcctgccctgaactacgaggacttcgccgctagcctccccaccaatgaatgcagatacgcgatattcgactatgactttgtcaccgaggagaactgccagaagagcaagatattcttcgtcgcatggtctcctgacaccgcacgtgtgaggagcaagatgatctacgcgagctccaaggagaggttcaagagggagctcgacggcatccaggtggagctgcaggcgacagacccgaccgaggtcggcttcgatgtgatccaaggccgtgccaactgagcaccatggctgtgctgctgcttaccttaagtatgagcctctgatgaggatttagcgcgctcgccgaggctggtcatgagctgtttaccatgaggcaattgtgatttgagttgccagtatgtaccacctaaggaagatgtaagctgtgactgggcgcggcgacaaatgtatcctttctggttgttgattcgtggatcctgatatcccctttttgccctgctaagatcagttgcatcttgatggtaaaattttggtagattctgtgttgtgagcttccatactaggatcactggttcttgaaactaatgatgccatgatgtgcactgaggcttactatgcaacatattttgatgataaat

SEQ ID NO: 3559 - DNA, 556 bp, Triticum aestivum
caccggcgaacacccacaccctcacccacccctcttctccgatggcccgcacgaagcagacggcgcgcaagtccactggcggcaaggcgccgaggaagcagctggcgaccaaggcggcgcgcaagtcggccccggccaccggcggcgtgaagaagccccaccgcttccgcccgggcaccgtggcgctccgggagatccgcaagtaccagaagagcacggagctgctcatccgcaagctccccttccagcgcctggtgagggagatcgcccaggacttcaagaccgacctgaggttccagtcctccgccgtgtcggcgctgcaggaggccgccgaggcgtacctggttggcctgttcgaggacaccaacctctgcgccatccacgccaagcgcgtcaccatcatgcccaaggacatccagctcgcacgccgcatccgcggggagcgcgcctaggttttcattcgccgccgttgacaatactgggtagtagctgctcgtgtctggtgttttctgtctgtggtgttgatatgatgtgccgtcttgtcctatgtagcctg

SEQ ID NO: 3560 - DNA, 564 bp, Triticum aestivum
ctcaactccccggcgcatctccgacgacatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagtaccgagctgctcatccgcaagctccccttccagcgcctggtgagggagatcgcccaggacttcaagaccgacctccgcttccagtcctccgccgtctccgcgctgcaggaggccgccgaggcctacctggtggggctcttcgaggacaccaacctgtgcgccatccacgccaagcgcgtcaccatcatgcccaaggacatccagctcgcacgccgcatccgtggcgagagggcctaagctgctctgtgcgcgtcgtcgtcttagccagatgtgttcagcgctgaaagtgtttgttcgtgccatggtggatgtagtgtgcctgatctgatgtcaccatcttgctgtcatcagtaatttagatg

SEQ ID NO: 3561 - DNA, 703 bp, Triticum aestivum
cttccagttcaagttccccaaccggcagcgcgcgcaagccgaagcccagttagaattcgcgtaggaggaggagagatccgatggcgcgcacgaagcagacggcccggaagtccaccggcggcaaggcgccccgcaagcagctggccaccaaggcggcgaggaagtcggcgccgaccaccggcggcgtgaagaagccccaccgctacaggcctggcacggtggcgctgcgcgagatccgcaagtaccagaagagcacggagctgctcatccgcaagctgccgttccagcgcctggtgcgggagatcgcgcaggacttcaagacggatctccgcttccagagccacgcggtgctggcgctccaggaggccgccgaggcgtatctcgtcgggctcttcgaggacaccaacctctgcgccatccacgccaagcgcgtcaccatcatgcccaaggacatccagctggcgcgccgcatccgaggggagcgcgcctagatcaagcatctgccttagcaacttccatcgctggattgcagcaatgtagctgtctgttcgtcgcctctggtttcagatcgtgttggcaataggcgacttttattttgctgtaaaaaaaaattctggttggttacagagttacaacgactcattttcttatttcgtctaaggcttgtgctaaaatgcaaaacaagttactcgttgttttatag

SEQ ID NO: 3562 - DNA, 612 bp, Triticum aestivum
cccaaatctccaagcgcgagcgacaaccggccctgcctcaaccccccggcgcgtctccgactccatggcccgcaccaagcagacggcgaggaagtccaccggcggcaaggcgccgcggaagcagctggcgaccaaggccgcccgcaagtccgccccggccaccggcggcgtcaagaagccccaccgcttccgccccggcaccgtcgcgctccgcgagatccgcaagtaccagaagagcacggagctgctcatccgcaagctccccttccagcgcctcgtccgcgagatcgcccaggacttcaagaccgacctccgcttccagtcctccgccgtctccgccctgcaggaggccgccgaggcctacctcgtcggcctcttcgaggacaccaacctctgcgccatccacgccaagcgcgtcaccatcatgcccaaggacatccagctcgcccgccgcatccgtggcgagagggcctaggctgcaacccatgcgccgtctgttagatccctgttaggctgagttcgtcggtggaaatgtgtgtgcttgtagtgttcttgccatggtcgatgcgttgtgcctaatctgatggtaccctcttgttgccatcagcggtg

SEQ ID NO: 3563 - DNA, 647 bp, Triticum aestivum
gcgtccgcaaatccccaagcgcgagcgacagccagctccgcctcaacctcccggcgcatctccgacatggcccgcaccaagcagacggcgaggaagtccaccggcggcaaggcgccgcggaagcagctggcgaccaaggccgcccgcaagtccgccccggccaccggcggcgtcaagaagccccaccgcttccgccccggcaccgtcgcgctccgtgagatccgcaagtaccagaagagcacggagctgctcatccgcaagctccccttccagcgcctcgtccgcgagatcgcccaggacttcaagaccgacctccgcttccagtcctccgccgtctccgccctgcaggaggccgccgaggcctacctcgtcggcctcttcgaggacaccaacctctgcgccatccacgccaagcgcgtcaccatcatgcccaaggacatccagctcgcccgccggatccgtggcgagagggcctaggctgcaacccatgcgtcgtctgttagatccctgttaggctgagttcgtcggcggaaatgtgtgtgctactgtagtagtgttccagaatgtacctgtgttcttgtcatggttgatgcgttgtgccccatctgatggtaccctcttgttgccatcagcgatggaaatgaaaa

SEQ ID NO: 3564 - DNA, 620 bp, Triticum aestivum
gaaagatctcatcttcccctccgaccaccagagcgagcagccagatccgcagcccctccatcccaatggcccgcaccaagcagacggcccgcaagtccaccggcggcaaggcgccgaggaagcagctggccaccaaggcggcgcgcaagtcggcgccggcgaccggcggcgtcaagaagccgcacaggttcaggccgggaaccgtcgccctccgcgagatccgcaagtaccagaagagcacggagctgctcatccgcaagctccccttccagcgcctggtgcgggagatcgcgcaggacttcaagaccgacctccgcttccagtcctccgccgtctccgcgctccaggaggccgccgaggcctacctcgtcggactgttcgaggacaccaacctgtgcgccatccacgccaagcgcgtcaccatcatgcccaaggacatccagctcgcacgccgcatccgaggggagcgcgcctaggctgttcgtcgtggtcgccggtaatactggctagtagctgttcttgtcctgtgatccgggtgtgtgtccggtgcttctgtttgtcggtgttgatatgatgtgtcgtctggtcctatgtatcgtcatgctcgaatgaaatggcaa

SEQ ID NO: 3565 - DNA, 635 bp, Triticum aestivum
gtgaaatcccaatctccaaagccagatcccagcccctccatcccaatggcccgcacgaagcagacggcgcgcaagtccaccggcggcaaggcgccgcggaagcagctcgccaccaaggcggcccgcaagtcggcgccggcgaccggcggcgtgaagaagccccaccgcttcaggccgggaaccgtcgccctccgggagatccgcaagtaccagaagagcacggagctgctcatccgcaagctccccttccagcgcctcgtccgtgagatcgcgcaggacttcaagaccgacctccgcttccagtcctccgccgtctccgcgctccaggaggccgccgaggcctacctcgtcgggctcttcgaggacaccaacctgtgcgccatccacgccaagcgcgtcaccattatgcccaaggacatccagctcgcccgccgcatccgaggggagcgcgcctaggttcgtcttggtcgccggtaatactggccagtagctgttcttgtcctgtgatccgggtgtgtgtccggtgcttctgtttgtttgtgttgatatgatgtgtcgtctggtcctatgtatctcgatgctcgaatgaaatcgcatggcaacggaaagatcagttaatgatctaactgcaggtt

SEQ ID NO: 3566 - DNA, 593 bp, Triticum aestivum
atctcaatctccatctccaaaccgtagcagcagcagcacccctccttgccgacgaccccccagccccgatgcccgcacgaagcagacggcgcgcaagtccaccggcggcaaggcaccgaggaagcagctggcgaccaaggcggcgcgcaagtccgccccggccaccggcggcgtgaagaagccccaccgcttccgcccgggcaccgtcgccctccgtgagatccgcaagtaccagaagagcacggagctgctcatccgcaagctccccttccagcgcctcgtccgggaggtcgctcaggacttcaagaccgacctccgcttccagtcctccgccgtctccgccctgcaggaggccgccgaggcgtacctcgtcgggctcttcgaggacaccaacctctgcgccatccacgccaagcgcgtcaccatcatgcccaaggacatccagctcgcgcgccgcatccgcggagagcgcgcctaggctctgcacgcgccccgtccgccgcgcttggttgctagctgttttatgactctgtagttgtttgccctccttgtatgtcctgtggatgccatcgaatgttcaaatctctggtttg

SEQ ID NO: 3567 - DNA, 843 bp, Triticum aestivum
ccaatcctcaatcccccaaacaatccaccaagcaaacccgatggcccgcacgaagcagacggcgaggaagtccactggcggcaaggcgccgcggaagcagctggccaccaaggcggcgcgcaagtcggccccggccaccggcggcgtgaagaagccgcaccgcttccgccccggcaccgtggcgctccgggagatccgcaagtaccagaagagcacggagctgctcatccgcaagctgcccttccagcgcctcgtcagggagatcgcgcaggacttcaagaccgacctgaggttccagtcctccgctgtgtcggcgctgcaggaggccgccgaggcatacctggtggggctgttcgaggacaccaacctctgcgccatccacgccaagcgcgtcaccatcatgcccaaggacatccagctcgcaagacgcatcaggggcgagagggcctaagattcgtctgcttccttcccagttgctgctgcctactgaacttcactggcttctcaacatagagtcagtcctacagcatgtcttgggtgttattctgcaccattgcatttgctgcatttcatcatcagcattcattattcattggtggcttggtcagtaaccgttctgggcagtttctttttattggtatcacttgttgcatttctagttttctaccgagattgattatctttcagcttgcagaccttataccaggagacagtaggagtatttagcaaagctatgagtcgctggcttgcaactttgctagcaaggcctttgctaatatgtatgcttgccagttatgtcatcctcattttcctctcctgaatgaacaagtaatatcatgtcat

SEQ ID NO: 3568 - DNA, 1018 bp, Triticum aestivum
gcccgcagcaaccaaagccaagtttcgaagccgccgccgccgaggagcaggagaaggcgagaagccatggcccgtacgaagcagaccgcccgcaagtccaccggtggcaaggccccccgcaaacagctcgccaccaaggcggcgaggaagtcggcgccgacgaccggcggagtgaagaagccccaccgctacaggcccggtaccgtggcgctccgggagatccgcaagtaccagaagagcacggagctgctgatccgcaagctgccgttccagcgcctggtgagggagatcgcgcaggacttcaagacggacctccgcttccagtcccacgccgtgctggccctccaggaggcggccgaggcgtacctggtggggctgttcgaggacaccaacctgtgcgccatccacgccaagcgcgtcaccatcatgcccaaggacatccagctcgcccgccgcatccgcggggagcgcgcctaagcgagcgaggcaagtccagccccccgtcaccaccgtggcgacgttcgccggcattactagtactagttgattagcttcccctgtcgagataatgcatcttgtggtccgttgtagaaaacctggtgtgattagttatcctagttacggagactcttgtctgcttaattggttttagtttgcggtactattgcaaaagggatgcttactactgtgatgaaactgttggttaatatagtcttgattaacaattgctatcgatgtatatgcagacctgtggtgctgtgctagttgttacctcctgccctctgtatcctctcgtgatttcctcttctttgagtcgtttccgtgatctcctctggcgggacggaggtcccgttggatttggattctggcgcgctcgactcggaaccccgctttggttctcgcgcagaatgtagatacacagttaccagttccgacttgcgagtaattttaaaattgtgatcctttttgtcattttggctgctcggctgtgcagtgtgtgacggtccacagtttgatt

SEQ ID NO: 3569 - DNA, 820 bp, Triticum aestivum
ctgacgcgtgggcaatcccccaaatctcctcaacttcccggcgcatctccgacgacatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaagcgtacttggtggggctcttcgaggacaccaacctctgcgccatccacgccaagcgcgtcaccatcatgcccaaggacatccagctcgcccgccgcatccgtggcgagagggcctaggccgcaatctgtgcgccgtgagtgtttaggtccatcttagcctttgtccagccttggaaatgtatgcgtgctagtgtttgttcgttccatcgtggatgtagtgtgtctgatctgatgtcaccttcttgctgtcatcagtaactgaaatgacaatgttggctatctgttctaagatctgtgccttttggtgtgagcctgccattgaatgtgatgcacgaaacggtggatttgattatcccgatttgtgaaattttctgccggtgttagctactttgtcctaaataagttgcttccaagtatttagcttgaatgatgccttggctgtattaaatttcagtaaatcactagtaatc

SEQ ID NO: 3570 - DNA, 617 bp, Triticum aestivum
ccccaaccctcccagcgctcccccctcctcaacaacctcccggcgcatctccgactccatggcccgcaccaagcagacggcgaggaagtccaccggcggcaaggcgccgaggaagcagctggccaccaaggccgcccgcaagtccgccccggccaccggcggcgtcaagaagccgcaccgcttccgccccggcaccgtcgcgctccgcgagatccgcaagtaccagaagagcaccgagctgctcatccgcaagctccccttccagcgcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcaccatcatgcccaaggacatccagcttgcccgccgcatccgtggagagagggcctaggccgcaatctgtgcgccgtgagtgtttaggtccaccttagcctttgtccagcgttggaaatgtatgcgtgctagtgtgttgttcgttccatggtggatgtagtgtgtctgatctgatgtcaccgtcttgctgccatcagtaactgaaa

SEQ ID NO: 3571 - DNA, 607 bp, Triticum aestivum
tcccaatctccaaacgccacagcgcacagcagccagatccccagcccctccatcccaatggcccgcacgaagcagacggcccgcaagtccaccggcggcaaggcgccgaggaagcagctggccaccaaggctgctcgcaagtcggccccggccaccggcggcgtgaagaagccccaccgcttccgccccggcaccgtcgccctccgcgaaatccgcaagtaccagaagagcacggagctgctcatccgcaagctccccttccagcgcctcgtccgggagatcgcccaggacttcaagaccgacctccgcttccagtcctccgccgtctccgccctgcaggaggccgccgaggcgtacctcgtcgggctcttcgaggacaccaacctgtgcgccatccacgccaagcgcgtcaccatcatgcccaaggacatccagctcgcccgccgcatccgtggggagagggcctaggtcttggttcgccggcagtaccgggtagtagctgttcttgtcctgtgatccgggtgtgtgtctggttcttctgtttgttggtgttgatatgatgtatcgtgatgcttgactgaaatagcaatggaaaagttcagttatc

SEQ ID NO: 3572 - DNA, 594 bp, Triticum aestivum
aaatcccaatctccaaactcctcagcgcagcagcagccagatccttccccatccatcccaatggcccgcacgaagcagacggcgcgcaagtccaccggcggcaaggcgccgaggaagcagctcgccaccaaggcggctcgcaagtcggccccggccacaggcggcgtgaagaagccccaccgtttccgccccggcaccgtggcgctccgggagatccgcaagtaccagaagagcacggagctgctcatccgcaagctccccttccagcgcctcgtccgggagatcgcccaggacttcaagaccgacctccgcttccagtcctccgccgtctccgcgctccaggaggccgccgaggcgtacctcgtcgggctgttcgaggacaccaacctgtgcgccatccacgccaagcgcgtcaccatcatgcccaaggacatccagctcgcccgccgcatccgtggggagagggcctaggtttggggtcgctgctggctagtagctgttcttgtcctatgatctgaatgtgttcagggcgcttctgtttgttggtgttgatatgatgtatcgtgatgcttgaatgaaattgcaattaaaaag

SEQ ID NO: 3573 - DNA, 729 bp, Triticum aestivum
gtgaaatcccaatctccaaactcctcagcgcacagcagccagatccttccccatccatcccaatggcccgcacgaagcagacggcgcgcaagtccaccggcggcaaggcgccgaggaagcagctcgccaccaaggcggctcgcaagtcggccccggccacaggcggcgtgaagaagccccaccgtttccgccccggcaccgtggcgctccgggagatccgcaagtaccagaagagcacggagctgctcatccgcaagctccccttccagcgcctcgtccgggagatcgcccaggacttcaagaccgacctccgcttccagtcctccgccgtctccgcgctccaggaggccgccgaggcgtacctcgtcgggctcttcgaggacaccaacctctgcgccatccacgccaagcgcgtcaccatcatgcccaaggacatccagctcgcccgccgcatccgtggggagagggcctaggtcttggttcgccggcagtactgggtagtagctgctcttgtcctgtgatccgggtgtgtgtcgggtgcttctgtttgttggtgttgatatgatgtgtcgtctggtcctatgtatgctgatgctcgaatgaaattgcatggaaagttcagtgttatcgatctgatgctcgaatgaatttaattttgcttgtaaatcgctccgtgattctgcgatggtgttcttgtcacatgtagcaagttgttgcagtgatggaatt

SEQ ID NO: 3574 - DNA, 643 bp, Triticum aestivum
ctccagtcccagatcccccaagagctcgcactcccccaccccaccccagcctctcgtcccgatggcccgcacgaagcagacggcgaggaagtccaccggcggcaaggcgccgcggaagcagctggcgaccaaggcggcgcgcaagtccgcgccggccaccggcggcgtgaagaagccccaccgcttccgccccggcaccgtcgcgctccgcgagatccgcaagtaccagaagagcacggagctgctgatccgcaagctccccttccagcgcctggtgcgggagatcgcgcaggacttcaagaccgacctccgcttccagagctccgccgtctccgcgctgcaggaggcggccgaggcctacctcgtcgggctctttgaggacaccaacctctgcgccatccacgccaagcgcgtcaccatcatgcccaaggacatccagctcgcccgccgcatccgtggcgagagggcctagagcgcttcgagcttggttggaggtgtagaggtgttagcttctgaatctgtgttgcgtggtggaaatctggcgttgtggtagtaggattcctctgttcgtgccatcgtggctgtgttatgttcctgttctgtgtctgatgtaaccatcttgttaccatcagcaatgaaaagt

SEQ ID NO: 3575 - DNA, 631 bp, Triticum aestivum
cccagatcccccaagaactccctctctccgcccccaccctcccttcccgatggcccgcacgaagcagacggcgaggaagtccaccggcggcaaggcgccgcggaagcagctggcgaccaaggcggcgcgcaagtccgccccggccaccggcggcgtgaagaagccccaccgcttccgccccggcaccgtcgcgctccgcgagatccgcaagtaccagaagagcaccgagctgctcatccgcaagctccccttccagcgcctggtgagggagatcgcgcaggacttcaagaccgacctccgcttccagagctccgccgtctccgcgctgcaggaggccgccgagtcctacctcgtcgggctcttcgaggacaccaacctttgcgccatccacgccaagcgcgtcaccatcatgcccaaggacatccagctcgctcgccgcatccgtggtgagagggcctagagcgtgtcgagcttcttcggaggtgtagagaatgttagcttctgaacctgtgttgcgtggtggaaacctggtgtcgtggtagtaggattcctcgtttgtgccatggtggctgtgttgtgttcttgtgctgtgcctgatgtaaccatcttgttaccatcagcaatgaaaagt

SEQ ID NO: 3576 - DNA, 558 bp, Triticum aestivum
cgccgaacaactctcaccggaacgcagcaaattccccagccttccctcgacccagatccgcaaaatggcccgcacgaagcagaccgcgcgcaagtcgaccggcggcaaggccccgcggaagcagctggcgaccaaggcggcgcgcaagtctgcgccggcgaccggcggcgtgaagaagccccaccgcttccgccccggcaccgtcgcgctccgcgagatccgcaagtaccagaagagcaccgagctgctcatccgcaagctgcccttccagcgcctcgtccgggagatcgcgcaggacttcaagaccgacctccgcttccagagctccgccgtgtccgccctgcaggaggccgccgaggcctacctcgtggggctcttcgaggacaccaacctctgcgccatccacgccaagcgtgtcaccatcatgaccaaggacatccagctcgcccgccgcatccgcggggagcgcgcgtaggcgccctctcgctcctgcttgatctcttcatgcctcatcgtgccatgatctagccgtgctgtagtttttagtatgtgcaatgg

SEQ ID NO: 3577 - DNA, 692 bp, Triticum aestivum
ctcgagccccgctccacttcaaaacacccggagcagcctctccgatctcccatcccagcgcccccagcaccccccgcgatggcccgcacgaagcagacggcgcgcaagtccaccggcggcaaggccccgcggaagcagctggcgaccaaggcggcgcgcaagtcggccccggcgaccggcggcgtgaagaagccgcaccgcttccgcccgggcaccgtggcgctgcgcgagatccgcaagtaccagaagagcacggagctgctcatccgcaagctgcccttccagcgcctggtccgcgagatcgcgcaggacttcaagaccgacctccgcttccagagctccgccgtctccgccctgcaggaggccgccgaggcctacctcgtcggcctcttcgaggacaccaacctctgcgccatccacgccaagcgcgtcaccatcatgcccaaggacatccagctcgcccgccgcatccgcggggagcgcgcctaggcgcctcgctcgccgcactgctaggtgttttaggctccctgttcccgtcgtgttccatgtgtgcgtcgctcctatgtaactggcttgttgctgtgcttcgatgtactacttatatcgatgaaatatggctaccaggatgagataaaatccctctgaattattctcttatttctgtgcttgtctccaccctcttaattactggg

SEQ ID NO: 3578 - DNA, 512 bp, Triticum aestivum
gatctcccatccccgcgccccccgctcctcccgcgatggcccgcacgaagcagacggcgcgcaagtccaccggcggcaaggccccgcggaagcagctggcgaccaaggcggcgcgcaagtcggccccggcgaccggcggcgtgaagaagccgcaccgcttccgcccgggcaccgtcgcgctgcgcgagatccgcaagtaccagaagagcacggagctgctcatccgcaagctccccttccagcgcctggtccgggagatcgcgcaggacttcaagaccgacctccgcttccagagctccgccgtctccgccctgcaggaggccgccgaggcctacctcgtcggcctcttcgaggacaccaacctctgcgccatccacgccaagcgcgtcaccatcatgcccaaggacatccagcttgcccgccgcatccgcggggagcgcgcctaggcgcctcgcttgccattgctaggtgtttaggatctgttcccgtcgtgttccatatcttatcgctcg

SEQ ID NO: 3579 - DNA, 557 bp, Triticum aestivum
aaaatctcattctccatccccaaaccgcagcagcagcaacccatccctccccgccaaccccgcagcagctccgatggcccgcaccaagcagacggcccgcaagtccaccggcggcaaggcgcccaggaagcagctggcgaccaaggcggcgcgcaagtccgccccggccaccggcggcgtcaagaagccgcaccgcttccgcccgggaaccgtcgcgctccgggagatccgcaagtaccagaagagcacggagctgctcatccgcaagctccccttccagcgcctcgtccgggagatcgcccaggacttcaagaccgacctccgcttccagtcgtccgccgtgtccgcgctccaggaggccgccgaggcgtacctcgtcgggctgttcgaggacaccaacctgtgcgccatccacgccaagcgcgtcaccatcatgcccaaggacatccagctcgcacgccgcatccgcggggagcgcgcctaggctctgtatgcgccctgtgccagctgcacctgaatcctgctagatgtttaatactctacagtagtctgctcct

SEQ ID NO: 3580 - DNA, 791 bp, Triticum aestivum
gggcggcccgctcgcgatctaggtgaaaatctcattctccaaacaccagagcgtcgcagcagccagatccgcagccagcccagctccgatggcccgcaccaagcagactgcccgcaagtccaccggcggcaaggcgccgaggaagcagctggcgaccaaggcggcccgcaagtccgccccggccaccggcggcgtcaagaagccgcaccgcttccgcccgggaaccgtcgccctccgggagatccgcaagtaccagaagagcacggagctgctcatccgcaagctccccttccagcgcctcgtccgggagatcgcccaggacttcaagacggacctccgcttccagtcctccgccgtctccgcgctccaggaggccgccgaggcgtacctcgtcggcctcttcgaggacaccaacctctgcgccatccacgccaagcgcgtcaccatcatgcccaaggacatccagctcgcacgccgtatccgcggggagcgcgcctaggctgttcgtccggccgccaccgccacggttccatcctggttgatcctgattggattcgatccgtcctgttattctagtccacccgtgcttcgaattgttactactaggttctagttcaagtaacggtcgtttgctgttgattaccagttggaaaaattggaaaggaagtgatctattttatccccatttctgagatcttatggatggacttttgtgcttggatgctttgtatggtgtatgatgatgccatcataggaatgattctcgtgctgagtttttttgctctgtacat

SEQ ID NO: 3581 - DNA, 749 bp, Triticum aestivum
ttccgcacccacttcggtcgccttccgattcgaacctcccccaaatccgcagcagtcgacaggaggccaagccaccgcgatggcccgtaccaagcagaccgcccgcaagtccaccggcggcaaggcgccccgcaagcagctcgccaccaaggcggcgaggaagtcggcgccgaccaccggcggagtgaagaagccccaccgctacaggcccgggaccgtcgccctccgggagatccgcaagtaccagaagagcacggagctgctgatccgcaagctgccgttccagcgcctggtccgcgagatcgcgcaggacttcaagaccgacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagccgtcctccccgtcaacgccgttagtggatcggaagtggaatgtgttgcttccggttgtagtttgttcctaattgccgtgctaggtctatcttcttctgtgtagaagaaatatggttgttggagtaagacgaacttgatatgtgatgatgttccttctggtttgcgatgaagcaaacgtatgtttatgatgcagacctcagaaccattgttgtaggcagcatcactgctgtcgtcgtgtgtgaatgtttgctgttcga

SEQ ID NO: 3582 - DNA, 627 bp, Triticum aestivum
ctccccagcaatcctctctccgcgcccacgaagcaagctccacactcccgatggcccgcacgaagcagacggcgaggaagtccaccggcggcaaggcgccgcgcaagcagctggcgaccaaggcggcgcgcaagtccgccccggccaccggcggcgtgaagaagccccaccgcttccgccccggcaccgtcgcgctccgggagatccgcaagtaccagaagagcaccgagctgctcatccgcaagctccccttccagcgcctggtgcgggagatcgcgcaggactttaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctaggctgcttcctagaatcctagtgtctgatctggtctcgaggtgtagagatgcgttactagtttcttattagcccttgtctgtggtagtaaggttcctcgacagttgtgttatggtgtgatgtactgtatgtgatggtaccatcttgttatcatcatcaatgagaagt

SEQ ID NO: 3583 - DNA, 658 bp, Triticum aestivum
ttctagatcgcgagcggccgtcccccaacccctcccagcgctcctccctccccaacctaccggcgcatctccgacgacatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgggagatccgcaagtaccagaagagcaccgagctgctcatccgcaagctccccttccagcgcctcgtccgcgagatcgcccaggacttcaagaccgacctccgcttccagtcctccgccgtctccgcgctgcaggaggccgccgaggcctacctcgtcggcctcttcgaggacaccaacctctgcgccatccacgccaagcgcgtcaccatcatgcccaaggacatccagctcgcccgccgcatccgtggcgagagggcctaggccgcgatctgcaatccatgcgtcgtctgttagatcgttgttaggaagtgtgtgtgctcgtagtgtttcagaatgtgcctgtgttgttcttgtcatggtgggtctgttatgcctaatctgatggtaccttcttgttgccatcagctatggaaatgaaaaatgttggctt

SEQ ID NO: 3584 - DNA, 754 bp, Triticum aestivum
aggcgaaataatttagtagtagctacagtactatttattcatccatccactccaatccccaatctccctcccaaccaatccaccaagcaaaccccgatggcccgcacgaagcagacggcgaggaagtccaccggcggcaaggcgccgcggaagcagctggccaccaatgcggcgcgcaagtcggcgccggccaccggcggcgtgaagaagccgcaccgcttccgcccgggcaccgtggcgctccgggagatccgtaagtaccagaagagcacggagctgctcatccgcaagctgcccttccagcgcctcgtcagggagatcgcgcaggacttcaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcaagacgcatccggggcgagagggcctaggatagtgtctgtctcttctgcaggtgtagagattagcatgtgttttgcgtggtggagtgatcccgtgttcgtgctatgttgggtgtgtgtgatgttctagtgcagtgtctgatgttaccatcttgttgtcatcagcaatctgaatgaaagttggctgtcagatctctctccactttgtgttcttctgacgcattttgttgttcgtaatcctgaaatgtcaatgaatggtttctttgctgaaaaaaaa

SEQ ID NO: 3585 - DNA, 892 bp, Triticum aestivum
  misc_feature (8)..(8): n = any nucleotide
  misc_feature (37)..(37): n = any nucleotide
  misc_feature (78)..(78): n = any nucleotide
  misc_feature (107)..(107): n = any nucleotide
  misc_feature (179)..(179): n = any nucleotide
  misc_feature (181)..(181): n = any nucleotide
  misc_feature (239)..(239): n = any nucleotide
  misc_feature (274)..(274): n = any nucleotide
  misc_feature (287)..(287): n = any nucleotide
agatttanttaggtgatacaagtaccagttcctgaantgagaacacctacgtacagtaaccatgagcacctgcggcanaagtggactcaaatggagggtttattcanagttcagcacatctgaactttcagatgacctcgttaagctggatgagcatcttgtagagacccggtgcgttnantgaggattcggcgggcggttatttgcggcgaaaagcctagctccccacacaaggagcnccttactggtgtcatccttgtgcacaattacctcnataaagcacaggntgtccttgtgaggtcctagggatgcctcaattgcttcccccaatccctcctcctcaagcaccagaacctcctccccccggcgcatcgccatggcccgcaccaagcagacggcgaggaagtccaccggcggcaaggcgccgaggaagcagctggcgaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaggcgtacctggtggggctcttcgaggacaccaacctctgcgccatccacgccaagcgcgtcaccatcatgcccaaggacatccagctcgcacgccgcatccgtggcgagagggcctaagctctgttcgtcgtcgtcttagccagatgtgttcatcggtggaaatgtagtgtgcctgatctgatgtcaccatcttgttgtcatcagtaatttaaatgaaaaatg

SEQ ID NO: 3586 - DNA, 710 bp, Triticum aestivum
caatgggggctacaccatcgagtgaagatccatgacggtccttacaacgtcatcaagaactggaactacaccagcttggtggaagcattccataatggcgagggcaaatgctatactgcaaaggttcgaacggaggaggaactggaggaagcaattgaggcatccctaggacctcacaaggacagcctgtgctttatagaggtaattgtgcacaaggatgacaccagtaaggagctccttgtgtggggagctaggcttttcgccgcaaataaccgcccgccgaatcctcagtgaacgcaccgggtctctacaagatgctcatccagcttaacgaggtcatctgaaagttcagatgtgctgaactctgaataaaccctccatttgagtccattgctgccgcaggtgctcatggttactgtacgtaggtgttctcagttcaggaactggtacttgtatcacctaaataaatctgaaatcgatgctgtggccagctaaagacgctcttggtttcggcatctttcttggttattccaactgacggaagtttcagacttgctgtgcttttcaaaggcacacgttaggcattaaagaagaagaaagctgtgcttatagaatctgaagatgattgaattatgtggtgaagcagcagcgtagttcaatggtgcacctggtggacaaatctctaagatggacaatttccttctttgata

SEQ ID NO: 3587 - DNA, 628 bp, Triticum aestivum
aaatcccccaagcaagcaagcaagcagccaccgaagcagcctccgctcccctccccgaccccgaagcaatggcgcgcacgaagcagacggcgaggaagtcgaccggaggcaaggcgccgaggaagcagctggcgaccaaggccgcccgcaagtcggccccggccaccggcggcgtgaagaagccccaccgcttccgccccggcaccgtcgcgctccgtgagatccgcaagtaccagaagagcacggagctgctgatccgcaagctgccgttccagcggctggtgcgggagatcgcgcaggacttcaagaccgacctccgcttccagagctccgccgtgtccgcgctgcaggaggccgccgaggcgtacctcgtcgggctcttcgaggacaccaacctctgcgctatccacgccaagcgcgtcaccatcatgcccaaggacatccagctcgcccgccgcatccgcggggagagggcctgagcagcggtcgccgtgtgcgtgcgttgtcagagagtcgtgctgtgatgttccggtcttagagcttggtggtgtagctaacatgttcctgtccgctctcgtcgttgccttgccatatgtagccccttgctgcgatgaattatcaatgaaga

SEQ ID NO: 3588 - DNA, 641 bp, Triticum aestivum
cccaaatctcccaagcagttcatctcctcaaccctgagcccgccgcgcccgcctgcccgccccgatggcccgcacgaagcagacggcgaggaagtccaccggcggcaaggcgccgcggaagcagctggcgaccaaggcggcgcgcaagtccgccccggccaccggcggcgtgaagaagccgcaccgcttccgccccggcaccgtcgcgctccgcgagatccgcaagtaccagaagagcacggagctgctcatccgcaagctgcccttccagcgcctggtgcgggagatcgcgcaggacttcaagaccgacctccgcttccagagctccgccgtgtccgcgctccaggaggccgccgaggcctacctcgtggggctgttcgaggacaccaacctctgcgccatccacgccaagcgcgtcaccatcatgcccaaggacatccagctcgcccgccgcatccgtggcgagagggcctagattttgcttcgtggtgcctgatctgacgtgtagagatggtagcttcgtcttagcatgtgttgagtggtggaatgatcttgtatcgtggtaggaggaatcctcgttcgtgctagcatggctttgttatgttcttgtgtactgtttgatgttaccctcttgttgccat

SEQ ID NO: 3589 - DNA, 644 bp, Triticum aestivum
gatggcccgcacgaagcagacggcgcgcaagtccaccggcggcaaggcgccgcggaagcagctggcgaccaaggcggcgcgcaagtcggccccggccaccggcggcgtgaagaagccgcaccgcttccgcccgggcaccgtcgcgctgcgggagatccgcaagtaccagaagagcacggatctgctcatccgcaagctccccttccagcgcctggtgagggagatcgcgcaggacttcaagacggacctccgcttccagagctccgccgtgtccgcgctgcaggaggccgccgaggcgtacctcgtcgggctcttcgaggacaccaacctctgcgccatccacgccaagcgcgtcaccatcatgcccaaggacatccagctcgcccgccgcatccgcggggagcgcgcctaggttttgggtcgccgccggtgacactgggtggttgctgttcctgtctggtgatcctgatccggatgtgtgctgggtgcttctgtttgttcgtgttgatatgatgtgtgtcctcttgtctgtcccgatgctggaatgaaatggcaatgcaaagttcagttatcatctggtgcctcatgtttgctgcatgattgcatttgtgatttttcaagtgttatagttgtgaaatgaagta

SEQ ID NO: 3590 - DNA, 476 bp, Triticum aestivum
tggagaactacgcctacaacatgaggaacaccgtcaaggacgacaagatcgcgtccaagctccccgccgacgacaagaagaagatcgaggacgccatcgacggcgccatcagctggctcgacaccaaccagctcgcggaggcggacgagttcgaggacaagatgaaggaactggagggcgtctgcaaccccatcatcgccaagatgtaccagggcgctggcgccgacatgggaggcatgggcggtgccgccggcatggatgaggatgcgccggccgggggaagcggtgcggggcccaagatcgaggaggtcgattaagctgctggccgtggtgatttggcggctgggagagtacaaatgtgtgaactctggagtgttaagtttgtgaagtgtcgtcgtttttagattttggagaagggggaactttggatggatgtcagtgttgatgtaatcctgaacttgtatcgatttaggtag

SEQ ID NO: 3591 - DNA, 656 bp, Triticum aestivum
ctcgcgccacgtcagctgcccgatttgccgttccgtcgtcgtcgtgccatccagcctcccggctgcggcgactgatgccgaggcagagggcggccaagtggaagagcaccaggtgtttgacgaaatgtccccgtcggaatcactgcccgagggttccgaggattccgatgcctcgtcggacactcaaagtgaggatgcccaagttgtagcagaggagaatggaagtgcggcgcccaagccaatacggcgctctgcctccatggactcgccgctgttccttgtggttgtgcctgaaggtcagggtggtgctctgcaggctaatcgcaaattgccgagtggtcgacagatgagcatcttcagggcgaaggagaaggaggcagcagggacatcttcatcctcttgtcaaacaggcgggttcaggattgccaggtctatgtcaagcagtggtcggggattgttcttctcaaggaatgggcgctccactggcaacgtgctgccactttgagttggtgtaatgttactgtcaagaggatacagcctcagcaaagccgggagctggtagtgtactcacgtgtctgttaatagagagtttacatgggtagcagtggctcggagagaaaatctcatctgaattcacgaaatctgtgagtgaccag

SEQ ID NO: 3592 - DNA, 598 bp, Triticum aestivum
  misc_feature (332)..(355): n = any nucleotide
gcatggtgcaggaggcggagaagtacaagtcggaggacgagcaggtgcggcacaaggtggaggcccgcaacgcgctggagaactacgcgtacaacatgcgcaacacggtgcgggacgagaagatcgcgtccaagctccccgccgacgacaagaagaagatcgaggactccatcgaggacgccatcaagtggctcgacggcaaccagctcgccgaggccgacgagttcgaggacaagatgaaggagctggagagcatctgcaaccccatcatctccaagatgtaccagggtgctggcccgggcggcgcggccggcatggacgaggacatgccnnnnnnnnnnnnnnnnnnnnnnnntgggagcggtgccgggcccaagatcgaagaagtggactgagtgagtcgtgacaggtcctggagtggtagtgtgttctgttgcctgtggtcgtgtgtggttctgtcgaataacgaggacgcttgtatgagtgtagttattaatgatgtagtactaggttagtagaggaaatgataaataatgtgtaaacgcaagaacgacatacacatgtggttcattgtactagtatgttgttttgcctggtt

SEQ ID NO: 3593 - DNA, 626 bp, Triticum aestivum
  misc_feature (5)..(5): n = any nucleotide
  misc_feature (15)..(15): n = any nucleotide
  misc_feature (68)..(68): n = any nucleotide
  misc_feature (72)..(72): n = any nucleotide
actgncagaagaacnagatcaccatcaccaacgacaagggcaggctgagcaaggaggagatcgagaanatgntccagcaagctgagaagtacaagtccgaggacgaggagcacaagaagaaggtggagtccaagaacgccctggagaactactcgtacaacatgcgcaacaccatcaaggacgagaagatcgcctccaagctgccggcggacgacaagaagaagatcgaggatgccatcgatgctgccatccagtggctggacacgaaccagctcgctgaggcggacgagttcgaggacaagatgaaggagctggaggccctgtgcaaccccatcatcgccaagatgtaccagggtgctggtgctgacatggagggcggcatggacgacgacaccccagctgcgtccggcggccccggccccaagattgaggaggtggactaaacagtcgatgttatgtggtggaggcgacgaagcctgctgctagttattattatgtcgtctcttatccgagacttgaggttgtgatggttattgtttcgctccgagtggtccgagttattccgtgcgggttggaacattcgtggattaaatgggccacgatgtcacgtcttagtcaatatatta

SEQ ID NO: 3594 - DNA, 632 bp, Triticum aestivum
tcgagcgcatggtgcaggaggcggagaagtactagtctgaggacgagcaggtgcggcacaaggtggaggcccgcttacgcgctggagaactacgcgtacaacatgcgcaacacggtgcgggacgagaagatcgcgtccaagctccccgccgaagacaagaagaagatcgaggactccatcgaggacgccatcaagtggctcgacggcaaccagctggccgaggccgacgagttcgaggacaagatgaaggagctggagaacatctgcaaccccatcatctccaagatgtaccagggcgccggcccgggcggcgcggccggcatggacgaggacatgcccggcggcggcgcgggcaccggcggtgggagcggtgccgggcccaagatcgaagaagtggactgagtgagtcgtgacaggtcatggagtggacgcggctatgccgcacttaaaatgttctgatgcctgtgttcgtgtgcttctgtcgaataacgagggtgcttgtatgagtttggttaatgacctagtagtactaggttagtagaggaaatgataaataatctgtaaaagcaagaacgacaatacacacgtctggttcctgtactatgttgtttttgcctgagcttcccaggagc

SEQ ID NO: 3595 - DNA, 923 bp, Triticum aestivum
  misc_feature (651)..(673): n = any nucleotide
gcttgtttttgctgaaggcgcagaaaatggccttgaattcacgattgtgagacctttcaattggattgggccaaggatggacttcattcctggcgttgatggtcctagcgagggtgttcctcgggttttggcttgcttcagcaacaatctcctgcgcagagagcccctgaagcttgtcgatggcggcgagtcccagagaacttttgtttacatcaaggatgccattgaagctgttcttttgatgattgaaaaccctgctcgagccaatggtcatatcttcaatgttgggaatcctgacaatgaagtcactgttagggagttggccgaaatgatgacagaggtctacgctaaggtctcaggagagcccccgctggaggagcctgtgatcgacgtgagcgcgaaagaattctatggggaagggtacgacgacagcgacaagaggatccccgacatgaccctgatcaacaagcagctagggtggaaccccaagacccctctcaaggacctgctggagacgacgctgacctaccagcacaagacctacaaggaggccgtcaagacgcagatgtgcctggccacggcgacgccttcaagctagacgggctcttgatcttttggaagccagatacttatatcgtagtgaaacaaacnnnnnnnnnnnnnnnnnnnnnnncgcctctagatcccaccccacccacctatcttcttacctacctagattcgtcgtcattgtgtaaccctatatcgggcaaagggaactgagtatctgagtatctattatatacctgtggtggcagtgtttgttacattttgttggttggttgcacctcccgtgctattcttttgctgttagtgagagagatatattcttgttcggcatagctgattatgatgatgtgagattacggtctggaagtttacaa

SEQ ID NO: 3596 - DNA, 732 bp, Triticum aestivum
tggcaagttcgagcttcggcatcctctgcaccaggggttcccagatcactgtcgcttggacatgacgccaatggtatcctgaacgtgtctgctgaggacaagacgaccgggcagaagaacaagatcaccatcaccaacgacaagggcaggctgagcaaggaggagattgagaagatggtccaggaggctgagaagtacaagtctgaggatgaggagcacaagaagaaggtggagtcgaagaacgccctggagaactactcgtacaacatgcgcaacaccatcaaggatgagaagatcgcctccaagctgccggcggacgacaagaagaagatcgaggacgccattgacgctgccatccagtggctggacacaaaccagctcgctgaggcggatgagttcgaggacaagatgaaggagctggaggctctgtgcaaccccatcatcgccaagatgtaccagggtgctggtgccgacatggagggcggcatggacgatgacaccccggctgcttccggcggtgctggccccaagatcgaggaagttgactaaacgagttgatgttctgttgcagaggcggtgaagcctgcttcttagttattatgtgtgttctatcgttatcttagactgggttgtggtggttattgttttggtacgagtggtcggggttattctgtgcgagttaacattcgtggaacatcagtggattatgggtcgtcacgtctaagtaatata

SEQ ID NO: 3597 - DNA, 751 bp, Triticum aestivum
cccaggggagttccccagatcacgtgtctgccttgacatcgacgccaatggtatccgtgaacgtgtctgccgaggacaagacgactgggcagaagaacaagatcaccgatcaccaacgacaagggtaggctgagcaaggaggagatcgagaagatggtccaggaggctgagaagtacaagtctgaggacgaggagcacaagaagaaggtggagtctaagaacgccctggagaactactcgtacaacatgcgcaacaccatcaaggacgagaagatcgcctccaagctgccggcagacgacaagaagaagatcgaggacgccatcgatgctgccatccagtggctggacacgaaccagctcgctgaggcggacgagttcgaggacaagatgaaggagctggaggccctgtgcaaccccatcatcgccaagatgtaccagggtgctggcgccgacatggagggcggcatggatgacgacaccccggctgcatccggcggcgctggccccaagattgaggaggtcgactaagctagtcgatgttctgtggcagagacctgctgcttagttattattatgtcgtgccctatcgttatctgagactgggttgtggtggttattgttttggtccgagtggtcagggttattccgtggagtaaacattcgtggaacatcagtggattatgggtcacgtcacgtctaagtaatatattaatctaaatcatccagtggattatgctgcttgtagcaatca

SEQ ID NO: 3598 - DNA, 836 bp, Triticum aestivum
gagaggacaaggaccagggacaacaacctgctcggcaagtttgagctctccggcatcccgcctgcactcaggggtgtccccagatcactgtctgcttcgacattgatgccaacggtatcctgaatgtctctgctgaggacaagaccactggccagaagaacaagatcaccatcaccaacgacaagggcaggctgagcaaggacgacattgagaagatggtccaggacgcagagaagtacaagtctgaggacgaggagcacaagaagaaggttgacgccaagaactccctggagaactacgcctacaacatgaggaacaccatccaggacgagaagatcgcctccaagctgcccgctgacgacaagaagaagatcgaggacgctgtcgacgctgcgatccagtggcttgacgccaaccagcttggtgaggttgacgagttcgaggacaagatgaaggagctggagggcctctgcaaccccatcatcgccaagatgtaccagggcgctggtgctgacatgccgggaggcatggacgaggacgcgccggctgccagcggcggtgctggccccaagatcgaggaggtcgactaagttagtcgctttcatatacgccatttgattcagtcctgggtgccaatcatatcacctgggctggaagttttgttgtacttttggtctgtagcatcagtgtcgtaaacaatgcaatgatgcatgttttggctcattgttgatttcagcttaatgcttattgtttgtactacctacacctgtgatttcattctgaattcttagagcttaaatttggctgttgtctctgtattcgagttcagagttaag

SEQ ID NO: 3599 - DNA, 766 bp, Triticum aestivum
agtcgtccaggagctggatcgtcgtgtcccgccggtcgtgaaagaggtgccgacctatgctcgctctgcagcagctgaggtgcagaagacaggcataatggggcacagcaactggcctggccaagtcggccattgctcgtgctgagccaaaggcccgtgacttgtatacccgctatgagcctgtggcggagcgcaaggctgctgaagcctgggccgccctgaaccgcctcccgctcgtcccctcggtgacccgtgctgtcctccccacggcagcacagctctcagccaagtacaactctgccgtgcttgatggcgcgaagcgtggcaactccgtcgccacctacctcccgctcgtcccaactgagcgcattgcaagggttttcgccaacccggccgccgacactgcgcctgccacagctcctgagatgcagcccatcccgacgcagtaacaataagagctacccggagttctattattacctaatagctgtaggagtcagtatctcgttgtagtgtcttgtttggcttgtggtggacagtggtattatgtgtggatggtcactgtggtatccgcctgtgtatggaggcgagaatgctgctgctgtgcggcaacacctgctttgcgttttagtttgtgctgcatgaaccactgtgtgtaatgctttgaatcaaagttacatgaaacaccatctgtaaattcataactctttttatatgagtgtgtatttgactgtcattggcattgttttatttgctattactcgag

SEQ ID NO: 3600 - DNA, 757 bp, Triticum aestivum
gaacgtgtctgctgaggacaagacgaccgggcagaagaacaagatcaccatcaccaacgacaagggcaggctgagcaaggaggagattgagaagatggtccaggaggctgagaagtacaagtcagaggatgaggagcacaagaagaaggtggagtccaagaacgccctggagaactactcgtacaacatgcgcaacaccatcaaggacgagaagatagcctccaagctgccggcggatgacaagaagaagatcgaggaggccatcgactctgccatccagtggctggacacgaaccagctcgctgaggccgatgagtttgaggacaagatgaaggagctggaggccctgtgcaaccccatcatcgccaagatgtaccagggtgctggcgccgacatggagggcggaatggatgacgacaccccagctgcatctggcggtgctggacccaagatcgaggaggtcgactaaacgggtcgatgttctctggcagaggcggcgaagcctgctgcttggttattatggtgtcctattgttatctgagactagttgtggtggttattgttttggtccgagtggtcgggggttatgctgtgcgagttaaacattcggtggaacatcaggattatgggtcacgtcacgtcgaagtaatatagtattattctaaatcatccggtgcttttgggcagttcactatccttttcttttcatgggagtgtgttaatcattccattttttctatgcgcctaataagctggt

SEQ ID NO: 3601 - DNA, 906 bp, Triticum aestivum
caggttttcaccacctaccaggaccagcagaccccgtctccatccaggtctttgagggtgagcgtagcatgaccaaggactgccgtcttctcggcaagttcgacctttctggcattcccccagctccaaggggcactcctcagatcgaggtcaccttcgaggttgacgccaacggtatcctgaacgtgaaggccgaggacaagggcacgggcaagtcggagaagatcaccatcacgaacgagaagggccgcctgagccaggaggagatcgaccggatggtcaaggaggcggaggagtttgccgaggaggacaagaaggtgaaggagcggatcgacgcccggaaccagctggagacctatgtctacaacatgaagaacacggtgggcgacaaggacaagctggcggacaagctggagagcgaggagaaggagaaggtggaggaggccctcaaggaggcgctcgagtggctggacgagaaccagacggccgagaaggaggactacgaggagaagctcaaggaggtggaggccgtgtgcaaccccatcgtgtcggccgtgtaccagaggtccggcggcgcgcccgggggcgagggcgccgacggcggcgtcgacgacgaggaccatgacgagctgtagatggtttgtgaaccaatttttgtaatggtagggtggagaggacatggataattggtactgctgcttactaaggtctggggttgttgggggtggtcgggtttattcgcagacaccggtactgttgttagtctgttggccgagctgtagagaactctttgctgctgctgttacttccttctgatgttttttcgttttgttattatatagccggatggattcgcatcggaactttatgtgaagaatagatgatgcagtttatctatacctcctg

SEQ ID NO: 3602 - DNA, 786 bp, Triticum aestivum
cttgcagttcgactttctgcatcctcccgcacccaggggagttccccagatcacgtctgctttgacatcgatgccaatggtatcctgaacgtgtctgctgaggaacaagacgactgggcagaagcacaagatcaccatcaccaatgacaagggcaggctgagcaaggaggagatcgagaagatggtccaggaggctgagaagtacaagtcggaggacgaggagcacaagaagaaggcggagtccaagaatgccctggagaactactcgtacaacatgcgcaataccatcaaggacgagaagatcgcctccaagctgccggccgacgacaagaagaagatcgaggatgccatcgatgctgccatccaatggctggacacgaaccagctcgctgaggcggatgagttcgaggacaagatgaaggagctggaggccctgtgcaaccccatcatcgccaagatgtaccagggtgctggtgccgacatggagggcggcatggacgacgacaccccagctgcatccggcggccctggccccaagatcgaggaggtcgactaaacagtcagttgttctgttgcagaggcggcgaagcctgctgcttattataccgtgtctgtgttatctgagacttgaggttgtggtggttattgttttgcttccgagtggtcggagttattccgtgcgagttgcaacattcgtggtagtggatcaagggttatgatgtctcacgtctaagtatattattagtttgttggtatttctactgtacctttatattactttgattc

SEQ ID NO: 3603 - DNA, 591 bp, Triticum aestivum
aatacggcgctctgcctccatggactcgccgctgttccttgtggttgtgcctgaaggtcagggtggtgctctgccggctaatcgcaaattgccgactggtcgacagatgagcatcttcaaggcgaaggagaaggaggcagcagggacatcttcatcctcttgtcaagcaggcgggttcaggattggcaggtccatgtcaagcagtggtcggggattgttcttctcacggaatgggcgctccactggcaacgtgctgccactttgagttggtgtaatgttactgtcaagaggatacagcctcagcaaagccgggagctggtagtgtatcagtgtctgttgataggaagtgtataccggatacctgcagtggctcggagagaaagtctcattctcatctgaaatctgtgagttgaccagagtaattattgtgtgataagtatttctcgagtggatgtgctcgtgttaacttgcatgcctaagtttcctttatcacatgtccacttcaagctctgctcaagtgaattttggggaagaagctgaaggttggcttcttcatgtaatatttatgtatagcaatcttgcaaagagtgg

SEQ ID NO: 3604 - DNA, 508 bp, Triticum aestivum
agaacatgatgtgcgccgccgacccgcgccacgccggtacctgacggcctcggccatgttccgcggcaagatgagcaccaaggaggtggacgagcagatgatcaacgtgcagaacaagaactcgagctacttcgtggagtggatccccatcaacgtcaagtcgagcgtgtgcgacatcgcgcccaggggcctgtccatggcgtccaccttcatcggcaactcgacgtccatccaggagatgttccggcgcaaggccttcctccactggtacacgggcgagggcatggacgagatggagttcaccgaggccgagagcaacatgaacgacctggtcgccgagtaccagcagtaccaggacgccaccgccgacgaggaggaggagctgtacgaggacgaggacgacgccgacctccaggagtaggggcgtgcgaggtctgggttcttctgtgatcgcgtgcgtgctcagtcgggggctatttctgatggctccatgttgctgctactagta

SEQ ID NO: 3605 - DNA, 681 bp, Triticum aestivum
  misc_feature (355)..(383): n = any nucleotide
ccgcctgcttccgagggaagatgagcaccaaggaggtggacgagcagatgctcaacgtccagtacaagaactcgtcgtacttcgttgagtggatccccaacaacgtcaagtcaagcgtgtgcgacatgccgcccaggggcctgaagatggcgggcacctttgtcggcaactccacgtccatccaggagatgttccgcagggtgagcgagcagttcacggccatgttcaggaggaaggccttcttgcactggtacacgggcgagggcatggacgagatggagttcaccgaggccgagagcaacatgaacgacctcgtcgcagagtaccagcagtaccaggacgcgaccgctgaggnnnnnnnnnnnnnnnnnnnnnnnnnnnnncgtgacgcgtagtagtggcgatcgcgctccgccagctatatgtcccccgcttcaggtctgtcgctgtgtccagtgagagtttgtggtttcctcctgtggcttggatgagtcgaggttgcgtcttgtactccgttttgtaatttgctacggctagtagtgcgttgcagtgtgtcttgttccgcatccatcctttggtcggtcggtcggtccatagctgacggtggcctgaactgtcgagtgctctccctgagctggtcgtcgtcgccttgtaagttctgacaattattattgttagtcg

SEQ ID NO: 3606 - DNA, 676 bp, Triticum aestivum
acgggcgctacctgacggcctcggccatgttccggggcaagatgagcaccaaggaggtggacgagcagatgctgaacgtgcagaacaagaactcgagctacttcgtggagtggatccccaacaacgtcaagtcgacggtgtgcgacatcccgcccacaggcctcaagatggcctccaccttcatcggcaactcgacgtccatccaggagatgttccggcgcgtgagcgagcagttcacggccatgttccggcgcaaggccttcctgcactggtacacgggggagggcatggacgagatggagttcaccgaggccgagagcaacatgaacgacctcgtgtccgagtaccagcagtaccaggacgccaccgccgacgaggagggcgagtacgaggacgaggaggacgatgccgacctccaggactagagatcaaccgagtaccgcgtatgattattggttttcttatgttaatttgatgattgctttaggcttgtgtagtgctgtttctgtctttcttggtgggtgctgttgttgaggagcagaaaactcatggaagggtggttgctggtgagatagcttggtataacctctggcacaattgctgtgtgcaagcaacgccttgttgcgttctactggtagtggtgtgtgttgtctggtgtccagtgtctaactatcat

SEQ ID NO: 3607 - DNA, 688 bp, Triticum aestivum
  misc_feature (380)..(406): n = any nucleotide
cgctacctcacagcctctgccatgttccgtgggaagatgagcaccaaggaggttgacgagcagatgctgaacgtccagaacaagaactcatcatactttgtggagtggataccccacaatgtgaagtcaagcgtgtgtgacatccctcccacaggcctgtcaatgtcgtccacctttgtcggcaactccacctccatccaggagatgttccgccgtgtgagcgagcagttcactgccatgttcaggaggaaggctttcttgcactggtacaccggggagggcatggatgagatggagttcaccgaggcggagagcaacatgaacgatctggtcgctgagtaccagcagtaccaggatgccacagccgacgaggaggaagnnnnnnnnnnnnnnnnnnnnnnnnnnnctgcctaagccacctgacctcatatggtcatcctgctgtctgttagatatgccttgtgtttactattgctgtcgatttggtggtgcttgtggtgcggatagatctttaggtggttggtaacacttatagatgcttttgctgcttcggcgaatcgatattttttgaactgttttttttttgtatgttgatggtggttttatgcgaactgtgatattagcgtaactgtgggcttgatacccgtaaatttggcaactatattttgtgtctgttttctgtgcattt

SEQ ID NO: 3608 - DNA, 668 bp, Triticum aestivum
  misc_feature (436)..(461): n = any nucleotide
cggagctcacacagcagatgtggacggccaagaacatgatgtgccgcggcggacccgcggcatggccgctacctctcggcgatccgcccatgttccggggcaagatgagcaccaaggaggtggacgagcagatgatgaacgtgcagaacaagaactcctcctacttcgtggagtggatccccaacaacgtcaagtccagcgtctgcgacatcccgcccgtggggctcgccatgtcctccaccttcgtcggcaactccacctccatccaggagatgttccgcagggtcagcgagcagttcaccgccatgttccgccgcaaggccttcctccactggtacaccagcgagggcatggacgagatggagttcaccgaggccgagagcaacatgaacgacctcgtcgccgagtaccagcagtaccaggacgccaccgccgnnnnnnnnnnnnnnnnnnnnnnnnnncccgccgccgaccaagcctgatcctttccgttcatccattccttgcgtagcgtcggtttatgctgccaatcgagttcagggtcgccatatatacatatatctactcttcatcatgccgttagtatgtagtattataccgtaatatcttgtcgtcgtgtttgcctgtatttgtatgtatgcttttttcgtgctacctacatatatggt

SEQ ID NO: 3609 - DNA, 674 bp, Triticum aestivum
tcacggtgccggagctcacacagcagatgtgggacgccaagaacatgatgtgtgcggccgacccgcgccatggccgctacctcacggcgtccgccatgttcaggggcaagatgagcacaaaggaggtggatgagcagatgatgaacgtgcagaacaagaactcctcctacttcgtggagtggatccccaacaacgtcaagtccagcgtctgcgacatcccccctgtcggcctcgccatgtcctccaccttcgtcggcaactccacctccatccaggagatgttccgcagggtcagcgagcagttcaccgccatgttccgccgcaaggccttcctccactggtacaccagcgagggcatggacgagatggagttcaccgaggccgagagcaacatgaacgacctcgtcgccgagtaccagcagtaccaggacgccaccgccgaggaggagtacgacgacgaggaggagcccgccgccgaccaagcctgatcccttccatgcattcgtccattcctcgcgtacttgggtttgtgctgccaatcgagtttgagtagccatatatacatatatctactcttcatcatgtcgttagtacgtagtattataccgtaatatcttgtcgtcgtgttggcctgtatttgtatgtatgcttgtttcgtgctacctttatatact

SEQ ID NO: 3610 - DNA, 607 bp, Triticum aestivum
  misc_feature (398)..(423): n = any nucleotide
atgatgtgcgcggccgactcgcgccacggccgctacctcacggcgtccgccatgttcagaggcaagatgagcaccaaggaggtggacgagcagatgatgaacgtgcagaacaagaactcctcctacttcgtcgagtggatccccaacaacgtcaagtccagcgtctgcgacatcccgcccgtggggctcgccatgtcctccaccttcgtcggcaactccacctccatccaggagatgttccgcagggtcagcgaacagttcaccgccatgttccgccgcaaggccttcctccactggtacaccagcgagggcatggacgagatggagttcaccgaggccgagagcaacatgaacgacctcgtcgcagagtaccagcagtaccaggacgccaccgccgnnnnnnnnnnnnnnnnnnnnnnnnnnccagccgccgaccaaccatgatcatcccttctcttcgttcgtctccctttccatgcgtgcgtacgtcggtttgatttgtgcagctgccaatccagttcaggagggtcgccatatatacatatatctactcttcaccatgtcaagttagtacctagtagtattatgtaccgtaatatcttgtcgt

SEQ ID NO: 3611 - DNA, 625 bp, Triticum aestivum
caacgtcaagtcgagcgtgtgcgacatgccgcccagggggctgaagatggcgggcaccttcgtcggcaactccacgtccatccaggagatgttccgcagggtgagcgagcagttcacggccatgttcaggaggaaggccttcctgcactggtacacgggcgagggcatggacgagatggagttcaccgaggccgagagcaacatgaacgacctcgtcgccgagtaccagcagtaccaggacgcgaccgccgacgatggagtacgacgaggaggagtgatgaggtacgcgacgcggagtagtggcgccgtgccctgctccaccccagctatatgtcccccggttcaggtctgtcgccatgtccaggtcgcgtttcctccggtgagggtttgtgtggtttcctcctgtggcttggatgagtcgaggttgcgtcttgtgctccgttttgtaatttgctacggctagtagtgcgttgcagtctgtcgtgttcagcatcatttggtcagtcggtccatagctgacgatggcctgaactgtcgagtgctctccttgagctagtcgtcgccttgtaagttctgacaagtattattgttagtcgttcgcttctagcttaccaatataatgagt

SEQ ID NO: 3612 - DNA, 742 bp, Triticum aestivum
gtcccggactgacccagcagattgtgggactccaagcacatgatgtgcgccgccgactcccggcacgccggtacctgacgcctcgccatgttccgcggcaagatgagcaccaaggaggtggacgacagatgatcaacgtgccagaacaagaactcgtcctacttcgtggagtggatccccaacaacgtcaagtcgagcgtgtgcgacatcgcgcccaggggcctgtccatggcgtccaccttcatcggcaactcgacgtccatccaggagatgttccggcgcgtgagcgagcagttcacggccatgttccggcgcaaggccttcctgcactggtacacgggcgagggcatggacgagatggagttcaccgaggccgagagcaacatgaacgacctggtcgccgagtaccagcagtaccaggacgccaccgccgacgaggaggaggagctgtacgaggacgaggacgacgccgacctccaggagtaggggccagcgaggtctgttccgtggatcttccttgatcgttgcccggggctatttctgatggctccatgttgctactagtagtgtgtgtgtttcgcgcttgctggcccccgtcgtcttcggggtgtcgtggactggttgcttgtgtagtttgtctgtgtcgggttaatccggtagtcagtttgttggtgaacttgagatcttagtagcaggtttgtaatatgtctggctctgaatcctaatgccatgtttgctgttt

SEQ ID NO: 3613 - DNA, 662 bp, Triticum aestivum
agcaccaaggaggttgacgagcagatgatcaacgtgcagaacaagaactcttcctacttcgtggagtggatccccaacaacgtcaagtcgagcgtgtgcgacatcgctcccaggggcctgtcgatggcgtccaccttcatcggcaactcgacgtccatccaggagatgttccggcgggtgagcgagcagttcacggccatgttcaggaggaaggctttccttcactggtacacgggcgagggcatggacgagatggagttcaccgaggccgagagcaacatgaacgacctggtcgccgagtaccagcagtaccaggacgccaccgccgacgaggaggaggagctgtacgaggacgaggacgacgccgacctccaggagtaggggcgagcgagcgaggtctgtgttcctccgtgatcgtgtgcgtgctcggtcaggggctatttctgatggctccatgtcgctactagtagtgtgtgtttcgcgcttgctggccccaatcttcggggggttgtggacttgttgctggttgtgtagttggtctgtgtcgggttaattcggtagtcagtttgttgcgccttacggtggacttgagatcttagtagcaggtttgtaatatggctctgaatcctaatgcaacgtttgctgtttcttcacaatgaaca

SEQ ID NO: 3614 - DNA, 912 bp, Triticum aestivum
  misc_feature (418)..(445): n = any nucleotide
aaatgtgggatccaagaacatgatgtggccgcagacccccgccacgccgctacctcaccgcctcgccctgcttccgagggaagatgagcaccaaggaggtggacgagcagatgctcaacgtccagaacaagaactcgtcctactttgtggagtggatccccaacaacgtcaagtcgagcgtgtgcgacatgccgcccagggggctgaagatggcgggcaccttcgtcggcaactccacgtccatccaggagatgttccgcagggtgagcgagcagttcacggccatgttcaggaggaaggccttcttgcactggtacacgggtgagggcatggacgagatggagttcaccgaggccgagagcaacatgaacgacctcgtcgccgagtaccagcagtaccaggacgcgaccgccgacgnnnnnnnnnnnnnnnnnnnnnnnnnnnnacgcgacgcggagtagaggcgccggatgtgccctgctccccaacccagctatatgtcccccggttcaggtctgtcgccatgtccaggtcgcgtttcctccggtgagggtttgtgtggtttcctcgtgtggcttggacgagtcgaggttgcgtcgtcttgtgctccgttttgtaatttgctacggctagtagtgcgttgggagtctctcttgttccgcgtccatcctttggtcggtcggtcggtccatagctgacggcggcctcaactgtcgagtgctctccttgagctggtcgtcgtcgtcgcctttgtaagttctgacaagtattattgttagtcgttcgcttcatcagcaaccaaaaaatcagtattggtagtggtttctcattatctttgtgaatattgtacttatgtcggaatgtttttgcctcgttatttgtgtatatttacgtatgctcgctcaaaaaaaa

SEQ ID NO: 3615 - DNA, 668 bp, Triticum aestivum
  misc_feature (426)..(443): n = any nucleotide
gaactcgaggctacttcgtggagtggatccccaacaacgtcaagtcgagcgtgtgcgacatcgcgcccaggggcctgtccatggcgtccaccttcatcggcaactcgacgtccatccaggagatgttccggcgggtgagcgagcagttcacggccatgttccggcgcaaggccttcctccactggtacacgggcgagggcatggacgagatggagttcaccgaggccgagagcaacatgaacgacctggtcgccgagtaccagcagtaccaggacgccaccgccgacgaggaggaggagctgtacgaggacgaggacgacgccgacctccaggagtaggggcgtgcgaggtctgggttcttctgtgatcgcgtgcgtgctcagtcgggggctatttctgatggctccatgttgctgctactagtannnnnnnnnnnnnnnnnncgcgcttgctggcccccatcttcggggtgtcgtggacttgttgcttgtgtagtttgtctgtgtcgggttaattcggtagtcagtttgttgcgcgtgcgttacggtgaactagaggtcttagtagcaggtttgcaatatggctggctcattgtttcttcacatagtttgtgatgattgtcgttgtcaagtgctccaccacctcgagggcaatattggctttaccag

SEQ ID NO: 3616 - DNA, 743 bp, Triticum aestivum
cccaaggcacggccgctacctcactgcctcagccatgttccgtgggaagatgagcaccaaggaggttgacgagcagatgctgaacgtgcagaacaagaactcgtcatactttgtggagtggattcccaacaacgtcaagtcgagcgtgtgtgacatcccgcccacgggcctgaagatgtcttccacattcgtcggcaactccacatcgatccaggagatgttccgccgtgtgagcgagcagttcaccgccatgttcaggaggaaggccttcttgcactggtacacgggcgagggcatggacgagatggagttcaccgaggccgagagcaacatgaacgacctggtggccgagtaccagcagtaccaggacgcgacggtcgaggaggaagaggactacgaggatgagcaggaggacgaggaggccgcctaagccatatctcctcccattcttcctatggatatgccttatatcgctcgccaagtcgttggagtgctcgtggtgctgttaggtgatgatagctagatgctattttttttccgttataaatgttggtcgttttgcctcgacagacttattttttcgttatgtggacctgtggttgtcgtgtatgctcatgtcgtgatgagcatttggtgtaaggtttgactgtgactgctaccagtgttattcagtagtgctactagactgcaaaatctctattctgtgtccaatatttttgggccaagttgccaaatatgcttct

SEQ ID NO: 3617 - DNA, 560 bp, Triticum aestivum
gacatcccgcccattggcctgaagatgtcttccacatttgtcggctactccacatcgatccaggagatgttccggcgcgtcagcgagcagttcaccgccatgttcaggaggaaggccttcttgcactggtacacgggcgagggcatggacgagatggagttcaccgaggccgagagcaacatgaacgacctggtggccgagtaccagcagtaccaggacgcgacggtcgaggaggaagaggactatgaggatgagcaggaggacgaggaggccgcctaagccatatctcctcccattcttcctatggatatgccttatatcgctcgtgctcgtggtgctgttagctgatgatagctagatgctatttttttttccattctgaatgtccgtcgtgttgcctagacagacttattttttcgttatgtggacctgtggtcgtcgtgtatgctcatgtcgtgatgagcatttggtgtaaggtttgactgtgactgcttggtgtgttattcagtagtgctactagattgaaaacctctattctgtgtccagtatttttaggtcaa

SEQ ID NO: 3618 - DNA, 884 bp, Triticum aestivum
  misc_feature (610)..(632): n = any nucleotide
agtggcgtcacttgttgcctccgcttccccggccagctgaactctgacctccggaaactcgcagtcaacttgatcccgttccctcgcctccatttcttcatggttggctttgcaccactgacctcaaggggttctcagcagtaccgtgccctcactgttcctgagttgacccagcagatgtgggactcaaagaacatgatgtgtgctgctgacccgcggcacggccggtacctcacagcctctgccatgttccgtgggaagatgagcacaaaggaggttgatgagcagatgctgaacgtccagaacaagaactcgtcgtacttcgttgagtggatacccaacaatgtgaagtcaagcgtgtgtgacatccctcccacaggcctgtcaatgtcgtccacctttgttggcaactccacctccatccaggagatgttccgccgtgtgagtgagcagttcacggccatgttcaggaggaaggctttcttgcactggtacaccggtgagggcatggatgagatggagttcaccgaggcagaaagcaacatgaacgatcttgtcgctgagtaccagcagtaccaggatgccactgccgatgaggaggaagagtatnnnnnnnnnnnnnnnnnnnnnnncctaagccacctgacctcatccggtcgtcctgctgtctgctagatatgccttgtgtttactattgctgtcgatttggtggtgcttgtggtgcggatagatctttaggtggttgataacacttatagatgcttttgctgcttcggcgaatcgatattttttgaactgtcttttgtatgttgatggtggttttatgcgaattgtgatattagcgtaactgtggacttgatactcgtaaattctggaattatatt

SEQ ID NO: 3619 - DNA, 916 bp, Triticum aestivum
  misc_feature (553)..(579): n = any nucleotide
ggaaactcgcagtcaacttgatcccgtccttcgcctccatttcttcatggttggcttcggcaccactgacctcgaggggttctcagcagtaccgtgccctcactgttcctgagttgacccagcagatgtgggactcaaagaacatgatgtgtgctgctgacccgcgtcacggccggtacctcacagcctctgccatgttccgtgggaagatgagcacaaaggaagttgatgagcagatgctgaacgtccagaacaagaactcgtcatactttgttgagtggatacccaacaatgtgaagtcaagcgtgtgtgacatccctcccacaggcctgtcaatgtcgtccacctttgttggcaactccacctccatccaggagatgttccgccgtgtgagcgagcagttcactgccatgttcaggaggaaggctttcttgcactggtacaccggtgagggcatggatgagatggagttcaccgaggccgagagcaacatgaacgatctggtcgctgagtaccagcagtaccaggatgccacagccgacgaagaggaagnnnnnnnnnnnnnnnnnnnnnnnnnnnctgcctaagccaccagacctcatacggtcgtcctgctgtctgctagatatgccttgtgtttactattgctgtcgatttggtggtgcttgtggtgcggatagatctttaggtggttgataacacttatagatgcttttgctgcttcggcgaatcgatattttttgaactgttttttggatgctgatggtggttttatgcgaattgtgatattagcgtaactgtgggcggacttgatactcgtaaattcggtaactatattttgtgtctgtttactgtgcgttttcgctcacgatttctgaaatttggtctattgttgctccaacattttgaaaagttg

SEQ ID NO: 3620 - DNA, 760 bp, Triticum aestivum
gccccccgacccaggcacgtcgctacctcaccgcctcagccatgttccgtgggaagatgagcaccaaggagtggatgagcagatgttgaacgtgcagaacaagaactcgtcctacttcgtcgagtggatccccaacaacgtcaagtcgagcgtgtgtgacatcccgcccactggcctgaagatgtcttcgacgttcgtcggcaactccacatcgatccaggagatgttccgccgtgtgagcgagcagttcaccgccatgttcaggaggaaggccttcttgcactggtacacgggcgagggcatggacgagatggagttcaccgaggccgagagcaacatgaacgacctggtggccgagtaccagcagtaccaggatgcgacggtcgaggaggaagaggactatgaggatgagcaggaggatgaggaggccgcctaagcgggcttccccctttcttcccagggatatgccttatatatcgctcgttatgtcgttggagtgctcgtggtgctgttaggtgatgatagctagatgctatttttttccgttctaaatgtcggtcgtgttgccttgacagacttattttttcgttatgtggacctgtggttgtcgtgtatgctcatgtcgtgatgagcgtttggtgtaaggtttgactgtgactgcttggtgtgttattcagtagtgttgctagactgcaaaatctctgtttcgtgtccagtatttttgggccaagttgccaaatatgcttctgtcatcttggga

SEQ ID NO: 3621 - DNA, 584 bp, Triticum aestivum
ctgtgtctctcgaatgttcagcacgcgttgcggctgttgcattccttagcaaggagaaaatcgccgccaaagtggagcacttgaagaagacgttcaggtggtctgatgccgaggtgggcattgctttgtccaagcttccaattgtgctggtgaggtctaaccagatgctggagagcaggtcagagttcctaatctctgaggtggggtttgagccagcatacattgctcatcatccggcattgctcacgtacagcctggagggccggatcataccccggtactatgttgtaaagtttcttaaggaaaatggactgctggatcacaaccggagctactattctgcagtcatggtgatggagaaagtattcgtggacaagtacatatgccctcacaaggaagttgcaccataccttgctgaagactatgatgccgcttgcagaggggaggtgtcaactagattcaaatttacatgaaaaatggtaacagtacggcacaacaaatttcttacattctgcgttatgctattcattcctgatttggtgttattggcctaactgaattgtagctgtctgctattgataatc

SEQ ID NO: 3622 - DNA, 719 bp, Triticum aestivum
ggcgtgcttcgaagtctggtgtaccccgtggatctcggatgttcaagcatgcgctacagttgttgcattcctcaggcgaggagaagaatcgccacccaagtggagcacttgaagaaacgttcaagtggtcgggatgccgagtgggcatgctgtttctaaggctccaaagctgctgacgatgtccatcgaatcgctgcagcgcaggtccgagttcctcatctccgaggtggggttggaaatgacatacattgtttatcgcccagcaatgctcatgtacagcttggagggcaggatcagaccccgatactatgttgtcaaatttctcaaggaaaatggattgctagatcacgaccgggactactatgctgtagtcatgatcagcgagaaggtattcgtcgagaagttcatatgccctcataaggatgctgcaccgcacctcgctaatgactatggagcagcttgcagaggagaggttccagctagattcagtttcacatgaaccaagactaataagaaaattggtatgttcattatgtcattcagtagagaagaaagcattgcgctgctatgaacttgtccttcctcgtgttgtcatattgcacacatcttggaactaggagagtatgaggtcagggcattctgccaatttctttgaagtatcaatgagtagtatttctgcacactctgtatctttgtgttctaaaatgcccattgcagtt

SEQ ID NO: 3623 - DNA, 607 bp, Triticum aestivum
cctctcgccagccctcgagaggtcgtcaagccaatgtggcgtttactgccaggagtgcaccgctaggtgcttgcgatattgccacaggtgtgtgccactgtaccaaggatgctcaccgccagcgcggaacaaatacgggcggcggcggcgaaggtcttggtgtgccccgtggctccgtgatgttcaggaaaattctgctgtgtgttgaattgctcggcgaggagaagattgccgccaaagtgaagtacttgaagagcaccttgggctggtcggatgctgaggtgggcattgccttgtccaaggatccgtctgtgctgaggaggtcaaagaacatgctgcagcgcagatccgagttccttctctctgagttggggttggagccggcctacattgctcatcgaccggcaatcctcacttacagcctggagtgccggcccagaccccgctactatgtcgtgaaatttcttaaggaaaatgggttgctagcacacagccatagctactatacagcactgctgcggactgagaaggtatttatggagaagtacatatgccctcacatggaagctgcaccacagcttgctgaagactacgctgccgcctgctg

SEQ ID NO: 3624 - DNA, 661 bp, Triticum aestivum
acattgccaagttgtgcatcgctgagccatggctgctcgcctcaaacgtagagtgcgtccaggcaatggcagcacgcgcccaagctattggtgtgccctgtggctctcggatgttcaggcacgcgctgaaggctgttgcattcctcagcaatgagaagatcgccgccaaagtggagcagttgaagaagatgttcaggtggtcagatgccgaggtgcgcattgctttgtccacgcttccatctgtgctgatgaggtctaaccatatgctggagagcaagtcagagttcctaatctccaaggtggggtttgaaccagcatacattgctcatcatccggcattgctcacatacagcctggagggccggatcataccccgctactatgttgtaaagtttctcaaggaaaatggactgctggatcacaaccggagctactattctgcagtcattgtgatggagaaagtattcgtggacaagtacatatcccctcacaaggaagttgcaccataccttgctgaagactatgatgccgcttgcagaggggaagtgccgactagattcaaattaacatgaaaattggtaacagtacggcacaacgatattttttacattccgtgttatgctattcattcctgatttggtgttcttggcctaactgaatg

SEQ ID NO: 3625 - DNA, 698 bp, Triticum aestivum
cacaaccaaaccaagtccggtttaggaagacgcaaagggatggagttcaaagggcagcacgacaaccccgccaaccgcgtggacgagtacggcaaacccgttcccgctggccggcggcgtggggggggagcgcacgccgctcctggcaccggcgggcagttccaggcccgcaggggggagcacaagaccggtgggatactgcatcgctccggcagctccagctcaagctcgtcttccgaggacgacggcatgggcgggaggaggaagaagggcatgaaagagaagatcaaggagaagctccccggcggcaacaaggacaaccagcagcacatggcgactggtacggggactggaggagcctacgggccggggactggaactggtggagcctacgggcagcaaggccacgcagggatggccggcgccggcactggcaccggcaccggcgagaagaagggaatcatggacaagatcaaggagaagctgccgggacagcactgagctgccggctccggctggctgcttgactgcttcctttgcatagctacgcgtcaaagccttccacttccacgtgatctttttgttcaataataagatgaagctgaacgagaagttgtctctgatcgcatccgtgtcagggacacttctctgtatacagcgtgcgttgtgtttgttatgtttgtgtgctcgggcttcat

SEQ ID NO: 3626 - DNA, 673 bp, Triticum aestivum
ctggaggtgcatctggtcgacgccaagggcctctccggcaccgatttcctcgggaagatcgacccgtacgtgatcgtcagtaccggagccaggagcgcaagacagcaccgcccgagatgcggggaggaacccgagctggaacgaggtgttgaggttccagatcaactcctccgctgccaacgtgcaggataagctggtcttccggatcatggaccacgacaccttctcccgcgacgatttcctcggccaagcaacgatcaatgtgaccgatctgatcagcataggcatggagagcggcacatcgcggctgaacccggccaagtacagggtggtcaccgccgacaactcgtaccacggcgagatcaaatcggcatcaccttcaccgccgcaaaggttgatgcccatggcaaggttgaagaagatggagcacaggttggaggctggatgcagagctttcgtgagcacaaggtctgagggtccgctcggatccttcggtcgtgcataattagtgttgttgccgtgttggatgtggccaaccgtatcatatgcctatggttgaatgatgtgactccaagtgtgtatgctgcattttgtagcacttaagtcagaaactgtccattcttgatatctccaacgagaacagcttaggatcgccaaattcgtttatgattaa

SEQ ID NO: 3627 - DNA, 665 bp, Triticum aestivum
gtcattcttcgtcgacgccaaggccctcttcgcagcgatttcctagggaagatcgacccgtatgtggtggtcagtaccggagccaggagcgcaagagcagcacctccagagatgaggggaggaacccgagctggaacgaggtgttccggttccagatcaactcctccgcggccaacgggcagcacaagctcttcctccggatcatggaccacgataacttctccagcgacgacttcctcggccaagcaacgatcaatgtgactgatctgatcacccttggcatggagagcggctcgtcgcagcaaaacccggccaagtacagcgtcgtctccgccgacaactcgtaccacggcgagatcagagtgggcatctcgttcacggccaccaaggtcgaagaagacggcgcgcaggtcggaggctggatgcacagctctcgcgagtagagcatgatgccaaggacttcgctcgtagcgcattagcgttggaagttatgcccgtggttgaacgatgtggttccaattgtatgtacgttgcaactgtagctttttagaagatgtatagtaccagtagccagaagtcagaacagtttagagatgtcgggtccgataattgtcgatttgtggttcttattctaggggaaattgtgattctgaatgcgaacgaca

SEQ ID NO: 3628 - DNA, 606 bp, Triticum aestivum
  misc_feature (592)..(592): n = any nucleotide
aaggagcttggaaccgtgatggcgctcccttggccagaacccgaccgaggcagaggtgcaggacatgatcaacgaggtggatgcggacggcaacggcaccatcgacttcccagagttcctgaacctgatggcccgcaagatgaaggacaccgactcagaggaggagctcaaggaggcgttccgtgtgttcgacaaggaccagaacggtttcatctctgcagcggagctccgccaggtgatgaccaacctcggggagaagctttccgaggaggaggtggaggagatggtccgcgaggccgacgtggatggcgacggccagatcaactacgacgagttcgtcaaggtcatgatggccaagagaagggagaagaggatagaggagaggagagcgccgtcggccaagaagagcgctgcaggggcgtctggtgcaaagggcaacaaatgcataatcctctagctgaaaccatcgagcgtgcatagtgtgtgtggtgcgctcggagcgctggtccccgaccgacgcatctgagctgttgtatgtatcaatgtatgttcatgtgtatcccggtgtatgatggccatcagcctacgactntaaccattctcaag

SEQ ID NO: 3629 - DNA, 768 bp, Triticum aestivum
ccccacgccatcatcgccccatcaacgcgcactcgcgtaacatttgcaggccctcatcgtcccctcgaggtctccgtttgccatggcggaccagctcagcgaggagcagattggcgagttcaaggaggccttcagcctcttcgacaaggacggcgatggcagcatcaccaccaaggagcttggaaccgtgatgcgctcccttggccagaacccgaccgaggcagagctgcaggacatgatcaacgaggtggatgcggacggcaacggcaccatcgacttcccagagttcctgaacctgatggcccgcaagatgaaggacaccgactcagaggaggagctcaaggaggcgttccgtgtgttcgacaaggaccagaacggtttcatctctgcagcggagctccgccaggtgatgaccaacctcggggagaagctttccgaggaggaggtggaggagatggtccgcgaggccgacgtggatggcgacggccagatcaactacgacgagttcgtcaaggtcatgatggccaagtgaggaacaaccaccctctgaaataaccctttctattttcgtcgaataacgaaccgtctggcactactacttcataacaatttttaccttattattattacgtgcacgctgctggtactgacacttgttggctaggtgtagtcactgaggggagaagggccagatactattttttttgttctcttggtcacggacttctcctgtactttgctggatttggtgtttttctcggctgggtt

SEQ ID NO: 3630 - DNA, 740 bp, Triticum aestivum
ggcgacggttgcatcacaactcaaggagctgggaacagtgatgcgttcgctgggacagaacccaacggaggcagagctccaggacatgatcaacgaggtggacgcggacggcaacggcaccatcgacttcccggagttcctcaacctgatggctcgcaagatgaaggacacggactcggaggaagagctcaaggaggccttccgggtgttcgacaaggaccagaacggcttcatctcggccgcggagctccgccacgtcatgaccaaccttggcgagaagctaacagacgaggaggtcgacgagatgatccgcgaggccgatgtcgatggcgacggccagatcaactacgaggagttcgttaaggtcatgatggccaagtgatcccgccgatgtcccggtggacggtggtattattattttaccggggaggaggaaattgtgctatgcatattagtagtaaggaatgcggctctcgtttccttgtctttgccccaaaccagaagaagcgtactagtagacgtagttgctgaagagcattcatggaatcctcctcccctgctgctaccttgtctctctcccgtgtgtcattgaaacatctttctttctgtgtgaatctgcaagacttggccccttcgttatgaaccctcattgcagctgaatccgttcgatccaagttccgttctacttctattttgtacgtatcaatcctcggccagcggctacttcagttggcagatgc

SEQ ID NO: 3631 - DNA, 787 bp, Triticum aestivum
accgcgcccgtttattattccccttcgcgcagccgcccccgtgtctcccgtgcgcaccttctcgaagcctcccccatggcggaccagctcaccgacgagcagatcgccgagttcaaggaggccttcagcctcttcgacaaggatggcgacggttgcatcaccaccaaggagcttggaaccgtgatgcggtccctcgggcagaaccccacggaggcggagctgcaggacatgatcaacgaggttgacgcggacggcaacggcaccatcgacttccccgagttcctgaacctgatggcgaggaagatgaaggacacggactcggaggaggagctcaaggaggcgttccgcgtgttcgacaaggaccagaacggcttcatctcggcggcggagctgcgccacgtgatgaccaacctcggggagaagctgacggacgaggaggtggacgagatgatccgggaggcggacgtggacggcgacggccagatcaactacgaggagttcgtcaaggtcatgatggccaagtgaggtggcggcgggacaggggtcttccctcccacgaaataagcttaaaattcaagtggattggaatgccagacagactcgcgtggttgtattttgtgctatgttttttaaggatactgttgcctgttgggtagttggtcgggttatctatcttgtagcggtgtagtcttgggggagcagcatcggaattactacctggtttcttttggttgtggcacttatcttgttcgtcttatcatggaatttaggggcgtcgtgcaaatct

SEQ ID NO: 3632 - DNA, 868 bp, Triticum aestivum
cagaacgctcccggcgtctctctgtttgctctcgcgtccgccgcgcccatcctcgtccgcgcctgcgcccggcccgtgctcgctcgctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaacggcaccattgacttcccagagttcctcaacctgatggcccgcaagatgaaggacactgactcagaggaggagctcaaggaggccttcagggtgttcgacagggaccaaaacggcttcatctctgctgctgagctccgccacgtcatgacgaacctcggcgagaagctcaccgacgaggaggtggacgagatgatccgtgaagccgacgtcgacggtgatggccagatcaactatgaggagtttgtcaaggtcatgatggccaaatgagcaccgtgctccgtgctcccaagacaggaggagaattgtgcattgcatattagtttaagatgcaactcttatttgatcgatttccagttaagcatcctacctagctgtagctgctaaaacggatcggacgacgcaattcctgctatgttctccagtgtgtttccagacctcttgtgttttatgtgaacttgtgtcctccctggtgtatcctgattgctgttgggccccgtttgtagtatattttttcatcaacttctgcttcactcttctagtatcaatggaaagccggtgtt

SEQ ID NO: 3633 - DNA, 800 bp, Triticum aestivum
cctccctcgcctcgatccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgatgctgatggcaacggcaccattgacttcccagagttcctcaacctgatggcccgcaagatgaaggacactgactcagaggaggagctcaaggaggccttcagggtgttcgacaaggaccaaaacggtttcatctctgctgctgagctccgccacgtcatgacgaacctcggtgagaagctcaccgacgaggaggtggacgagatgatccgtgaagccgacgtcgacggtgatggccagatcaactacgaggagtttgtcaaggtcatgatggccaaatgagctccgacccaaatgctccgaagacaggaggagaattgtgcattgcatattagtttaagatgcaactcttatttgatcgatttccagttaagcatcctacctagctgtagctgctaaaacggatcggacgacgcaattcctgctatgttctccagtgtgtttccagacctcttgtgttttatgcgaacttgtgtcctccctggtgtatcctgattgctgtttggcccgtttgtagtatattttttcatcaacttctgcttgactcttctagcatcaatggaaagccggtgtttcgtatttcttcgactctctattaat

SEQ ID NO: 3634 - DNA, 541 bp, Triticum aestivum
  misc_feature (34)..(34): n = any nucleotide
  misc_feature (47)..(47): n = any nucleotide
caccaccaagagcttggaaccgtgatgcgctccntcggccagaaccntaccgaggcagaacttcaggacatgatcaacgaggtggatgcggacggcaacggcaccatcgacttcccagagttcctgaacctgatggcccgcaagatgaaggacacggactccgaggaggagctcaaggaggcgttccgcgtgtttgacaaggaccagaacggtttcatctccgcggcggagctccgccaggtgatgaccaacctcggggagaagctgtctgaggaggaggtggaggagatggtccgcgaggccgatgtggacggcgatggccagatcaactacgacgagttcgtcaaggtcatgatggccaagagaagggagaagaggatagaggagaggagagcgccgtcggccaagaagagcgtggcaggggcatccggtgcaaagagtggcagcaaatgcacaatcctctagctgaaaccatcggacgtgcatagtgtgcgtgtggtgcgctcggagcgctggtccccgaccgacgcatctgagctgt

SEQ ID NO: 3635 - DNA, 820 bp, Triticum aestivum
ctgagacccccccacgtcatcatcgccccatcaacgcgcagctcgcgtaacatttgcaggtcctcgtcgccccttcgaggtttcggtttgccatggcggaccagctgagcgaggagcagattggcgagttcaaggaggccttcagcctcttcgacaaggacggcgatggcagcatcaccaccaaggagcttggaaccgtgatgcgctccctcggccagaaccctaccgaggcagagctgcaggacatgatcaacgaggtggatgcggacggcaacggcaccatcgacttcccagagttcctgaacctgatggcccgcaagatgaaggacacggactccgaggaggagctcaaggaggcgttccgcgtgtttgacaaggaccagaacggtttcatctccgcggcggagctccgccaggtgatgaccaacctcggggagaagctgtctgaggaggaggtggaggagatggtccgcgaggccgatgtggacggcgatggccagatcaactacgacgagttcgtcaaggtcatgatggccaagtgaggaacaacccccctctgaaataacccttttctattttcgccgaataacgaaccacctggcttcgtaacaacaatttttaccctattattacgtgcacgctgctggtactgacacttgttggctaggtgtagtcactgaggggagaagggccagatactattttttttgttctcttggccacggacttctcctgtactactttgctggatttggtgttttttcttggttgggttgcttcttggttcatgcttgtcgttcggtttgttgaaagttatata

SEQ ID NO: 3636 - DNA, 802 bp, Triticum aestivum
ctgagacccccacgccatcatcgcccatcaacgcgcagctcgcgtaacatttgcaggccctcgtcgccccttggaggtttcggtttgccatggcggaccagctcagcgaggagcagattggcgagttcaaggaggccttcagcctcttcgacaaggacggcgatggtagcatcaccaccaaggagcttggaaccgtgatgcgctccctcggccagaaccctaccgaggcggagctgcaggacatgatcaacgaggtggatgcggacggcaatggcaccatcgacttcccagagttcctgaacctgatggcccgcaagatgaaggacaccgactctgaggaggagctcaaggaggcgttccgcgtgtttgacaaggaccagaacggtttcatctctgcagcggagctccgccaggtgatgaccaacctcggggagaagctgttcggtaggtagtgtaggtggtaggtagtatggtccgcgaggccgatgtggacggcgatggccagatcaactacgacgagttcgtcaaggtcatgatggccaagagaagggagaagaggatagaggagaggagagcgccgtcggccaagaagagcgcggcaggggcatccggtgcaaagagtggcagcaaatgcataatcctctagctgaaaccatcgaacgtgaatagtgtgtgtggtgcgctggtccccgcccgacgcatctgagctgttgtatgtatcaatgtatgttcatgtgtatcccggtgtatgatggccatcggcctacgactgtaaccattctcaaggtaaacgaataaaagt

SEQ ID NO: 3637 - DNA, 747 bp, Triticum aestivum
tcgccgcgagaagccgagaaggaagagcctgagaaggtagcatggcggacaactcaccgacgaccagatcgccgagttcaaggaagccttcagcctattcgacaaggacggcgacggttgcatcacaaccaaggagctgggaacagttatgcgctcgctggggcagaacccaaccgaggcagagctccaggacatgatcaacgaggtcgatgccgatggcaacggcaccatcgacttcccggagttcctcaacctgatggctcgcaagatgaaggacaccgactcggaggaagagctcaaggaggccttccgggtgttcgacaaggaccagaacggtttcatctcggccgcggagctccgccacgtcatgaccaacctcggcgagaagctaacggatgacgaggtcgacgagatgatccgcgaggctgacgtcgacggggacggccagatcaactacgaggagttcgtcaaggtgatgatggccaagtgatccagccgatgttcatgtccggtggtattattatttttaccggggaggaggaaattgtgctatgcatattagtagtaaggaatgcggctctcgtttccttgtctttgcccccgaaccagaagaagcgtactagtagacgtagttgctcaagagcattcatggaatcctcctcccctgctgctaccctgtctctctcccgtgtgtcattgaaacatctttctttctgtgtgaatctgcaagacttggccaattccgcg

SEQ ID NO: 3638 - DNA, 662 bp, Triticum aestivum
atggcggacaactcaccgacgaccagatcgccgagttcaaggaagccttcagcctattcgacaaggacggcgacggttgcatcacaaccaaggagctgggaacagttatgcgttcgctggggcagaacccaaccgaggcagagctccaggacatgatcaacgaggtcgatgccgatggcaacggcaccatcgacttcccagagttcctcaacctgatggcccgcaagatgaaggacaccgactcggaggaagagctcaaggaggccttccgggtgttcgacaaggaccagaacggcttcatctcggctgcagagctccgccacgtcatgaccaacctcggggagaagctaacggacgatgaggtcgacgagatgatccgcgaggccgacgtcgacggggacggccagatcaactacgaggagttcgtcaaggtgatgatggccaagtgatccagccgatgttcatgtccggtggtattattatttttaccggggaggaggaaattgtgcattgcatattagtagtaaggaattcggctctcgtttccttgtctttgccccgaaccagaagaagcgtactagtagacgtagttgctgaagagcactcatggaatcctcctccctgctgctacctgtctctctcccgtgtgtcattgaaacatc

SEQ ID NO: 3639 - DNA, 841 bp, Triticum aestivum
caaccaccgcgccccgtttattattccccttcccgcagccgccccccgtgtcccgcgcgcaccttctcgaagcctcctccctccctccctcatggcggaccagctgaccgacgagcagatcgccgagttcaaggaggccttcagcctcttcgacaaggatggcgacggttgcatcaccaccaaggagctcggaaccgtgatgcggtccctcgggcagaaccccacggaggcggagctgcaggacatgatcaacgaggttgacgcggacggcaacggcaccatcgacttcccggagttcctgaacctgatggcgaggaagatgaaggacactgactcggaggaggagctcaaggaggcgttccgcgtgtttgacaaggaccagaacggcttcatctcggcggcggagctgcgccacgtgatgaccaacctcggggagaagctgacggacgaggaggtggacgagatgatccgggaggcggacgtggacggcgacggccagatcaactacgaggagttcgtcaaggtcatgatggccaagtgaggtggcgggacagggggtgtcctcccacgaaataagcttaaaatttgctctcaagtggattggaatggaatgccagacagactcgcaaggttgtattttgtgctatgttttttaagtactgttgcctgttgggtagctggtcgggttatcttgtagcggtgtagtcgtggggagcagcatcggatttacctggtttctagtcttatcatggaatttaggggctttgtgcaaatctcgttttgccctgcggtttgcttgtatgcttgggttgtgttcagctccaaatgctggccggaagta

SEQ ID NO: 3640 - DNA, 727 bp, Triticum aestivum
cccccatgcggacagctcaccgacgagcagatcgccgagttcaaggaggccttcagcctctttcgacaaggatggcgacggttgcatcaccaccaaggagctcggaaccgtgatgcggtcccttgggcagaaccccacggaggcggagctgcaggacatgatcaacgaggttgacgcggacggcaacggcaccatcgacttccccgagttcctgaacctgatggcgaggaagatgaaggacacggactcggaggaggagctcaaggaggcgttccgcgtgtttgacaaggaccagaacggcttcatctcggcggcggagctgcgccacgtgatgaccaacctcggggagaagctgacggacgaggaggtggacgagatgatccgggaggcggacgtggacggcgacggccagatcaactacgaggagttcgtcaaggtcatgatggccaagtgaggtggcgaggacaggggtccctcccacgaaataagcttgaaatttgctctcaagtggattggaatggaatgccagacagactcgcaaagttgtattttgtgctatgcgcctgtttttttaagtactgttgcctgttgggtagttggtcgggttatcttgtagcggtgtagtcgtggggagcagcatcggaattacctggtttcttttggttgtggcacttatcttgcctgttaggcttcgtcttatcatggaatttaggggctttgtgcaaat

SEQ ID NO: 3641 - DNA, 623 bp, Triticum aestivum
gcctccaacatcctcctcgacggctgcttccgcgcgcacctctccgactttggcctcgccaaggtcggccccgtcggcgacaagacccatgtctccaccagggtcatgggcacctacggctactgcgcccccgagtacgcgctcacgggcaagcttaccaccatgtccgacgtctatagcttcggcgtcgtcttcctcgagatcatcacggggcggcgcgtcatcgacacgtccaggccccgcgatgagcacaaccttgtgcagtgggcggcaccgcgcttcaagagcaagaagcgcttcagggagatggccgacccgctcctccgcggcgcatacccaaccaaggggctctaccaggcgctcgccatctccgccatgtgtctgcaggaggatgccacaatgcgcccctccatcgccgacgttgtcacggcgctcgactacctcaccggcgccgcaaagccttcccctagccctacccctcaacaacagtcgccttcccctagccctagccctacccctactcaacaacagtcgccacccaaggccaaggaggacgatgatgccactgactagtagttataacaacacaaacatgtatctgtctgtatatatgcaagtcttct

SEQ ID NO: 3642 - DNA, 732 bp, Triticum aestivum
cgccgccgtctggagtggaacacgcgcgtgaagatcgcgcacggcgcggcgagggcgctgcggtacctgcacgaggcggtgtcgccgccggtgatctaccgcgacctgaagccgtccaacatcctcctcgccgacgacttcagcgccaagctgtccgacctggggctggcccggatcgggccctccggcgacgacacccacgtgtccacgcgcgtgatgggcaccttgggctactgcgcgcccgactacgcgctcaccggccgcctcaccgtcaagtcggacgtctacagctttggcgtggtgctcctggagctcatcaccggccgcagggccttcgacgctgacgccggcgacgagaggcggctcctggactgggccaggccctacctcgcggacgtgcgcaagatgtacggccggctggccgacccggcgctgcgcgggcgattccctcggcgcgcgctctaccagctcgccgtggtcgcctcgctctgcctccacgacaggcccaacctccggccgactatgtcggacgtcacccgggccatcgaccacgtggcctcgcagccgtggcaacccgcctccgccggcgccggcggcggtgcagcccatcagcgtgccaaatcgtgccaaatatgaaattaaatcttgttgtagaagtatactccatatgatacaaaaatcccttgagttgtactaaaccagcaccaacgacaagcattattggagggagta

SEQ ID NO: 3643 - DNA, 951 bp, Triticum aestivum
ctccaagctctccgacttcgggctcgccaagctcggccccctcggcgacgagagccacgtcagcaccagggtgatgggcacctacggctactgcgcccccgagtacgccatgaccggcaagctcaccaagatgtccgacatctacagcttcggcgtcgtgctgctcgagctcatcaccggcaggcgggccatcgaccccaccaagcccacggaggagcaggttctcatccactgggcggcgcctctgatcagggacaggaaaatgttcgtgaggctggcggatccgttgctggggaaggacttcccggtgaagggggctgtaccaggcgctcgccatcgcctccatgtgcatgcaggaggatcccagcaagaggcccaagatcggcgacgtcgtggacgcgctcaccttcctcgctgaacagaagtactatcctcaacgagaccgggaagctgctcaggcgaagggcggggactgcagcactgcctcgcaaaaaggacatggtttctgagatcaaagccgatgatgacatgaagcagcgatgagccagacgaccatagaatataatataatataagagatgcataaaggaggagatgcagcagaactatatctctgcgactctgcccccctcacatttcttgtgtaccgtacaccacataggcaggatgtaagagcagcaacgaatcatcttgactgatgatgctgatttgttagtcaaggcctcaaattccagcagcaaaagccaagagctgagccgtctattcctgagctgttccaaggactgccaccttcattattagcttctagatcaacatgcaaacattaccattttccatcattctggtctgcatgtaatctaaaatctatcccgccaaggatttgtggaattgataactctagtagaacgtactcaaaaacaaaaggtgatcgaagttgcaaataattattgg

SEQ ID NO: 3644 - DNA, 701 bp, Triticum aestivum
aacatgcgtggtatctgctatgaggtctgtgatgttgttctccacacggatgctattcacaggggtggtggtcaggttatcccaacggcgaggagggtcatttacgcttctcagctcactgccaagccaaggctgctggagcccgtgtacctggttgagatccaggccccggagaacgcacttggtggtatctatggtgtgctgaatcagaagagaggccacgtgttcgaggagatgcagaggcaaggtaccccactctacaacatcaaggcctacctgcctgttatcgagtccttcgggttctcgagcaccctgagggccgcgacgtccggccaggccttcccccagtgtgtgtttgaccactgggacgtcatggcctccgatcctttggaaccctggcacccagtcggcgacgctcgtgacggagatccgcaagaggaagggtctcaaggagcagatgacccccctatccgacttcgaggacaagctctaaattttggggcttcgaggacaagctctaaattttggggccatgttttggtactggctcttgctgtgaagggaggcgcggtatttttctccctatgtgtcttccttactatgttgttgtttgtatgtggtgctactgagactatggttttgatgatggttgtggtgatgtaacagatgttaaacttagatcatacatttctggcatccca

SEQ ID NO: 3645 - DNA, 621 bp, Triticum aestivum
gacaaggacttcaactccaagctctccgacttcgggctcgccaagctcggccccctcggcgacgagagccacgtcagcaccagggtgatgggcacctacggctactgcgctcccgagtacgccatgaccggcaagctcaccaagatgtccgacatctacagcttcggcgtcgtgctgctcgagctcatcaccggcaggcgggccatcgaccccaccaagcccacggaggagcaggttctcatccactgggcggcacctctgatcagggacaggaaaatgttcgtgaggctggctgatccgttgctggggaaggacttcccggtgaaggggctgtaccaggcgctcgccatcgcatccatgtgcatgcaggaggatcccagcaagaggcccaagatcggcgacgtcgtggacgcgctcaccttcctcgccgaacagaaatactatcctcccaaaaaggacatggtttctgagatcaaagccgatgatgacatgaagcagagatgagccagacaaccataggatataatattataagagatgcataagggaggagatgcagcagaactatatctctgccccctcacatttcttgtgtaccgtacaccacataggcaggatgta

SEQ ID NO: 3646 - DNA, 1811 bp, Triticum aestivum
cacacgagctgggtcattcaaattcaaatcatatatctgagttgagcccgagggtgtcctcggccactctcgcgtcgatctgctatggggttagttagtcgtccgccgtgaggaaatgtaacagcaagatgctcctcggcggcggctcttcatctccgtgtggtgtgcgcggcaaggaacaaccattgacccccggcaagcacaacgcggtcgaggaagaagcgcttctaggaggaagaagaagtccagcaagaagttcagctgcgtcccctgcgtcagcctcaccgagctcaccaggcgcgccgagtgcgaggccatcgccgacctcgtcaacaacatctcggccaagtcagacattaccagtcacatgtacgcggccgaggagatcctgcggatcaccaaccagaacatccccagcagggtgctcaccttccgtgagttgtccgcggcgaccaacaacttcagccccaacaaccttgtgggcgagggcggcttcgggatggtgtacaaggggcacttcaaggacaccaaggaggatatcgccgtgaagcggctggacaaggaagggttccaggggaaccgcgagttcctggtggaggtgctgatgctgagcctcctgagccaccccaacctcgtgaatctgatcggctacagcaccgacctcgaccagcggatcctcgtctacgagtacatgcccaacggctcgctggaggatcatctcctagatctcccggagaacgccaaggcgctcccctggcagacgcggatgaggatcgcggtgggcgcggccaagggcatcgaatacctgcacgaggtggccaaccctccggtcatctaccgggacctcaaggcctccaacatcctcctggacaaggacttcaactccaagctctccgacttcgggctcgccaagctcggccccctcggcgacgagagccacgtcagcaccagggtgatgggcacctacggctactgcgcccccgagtacgccatgaccggcaagctcaccaagatgtccgacatctacagcttcggcgtcgtgctgctcgagctcatcaccggcaggcgggccatcgaccccaccaagcccacggaggagcaggttctcatccactgggcggcacctctgatcagggacaggaaaatgttcgtgaggctggcggatccgttgctggggaaggacttcccggtgaagggggctgtaccaggcgctcgccatcgcatccatgtgcatgcaggaggatcccagcaagaggcccaagatcggcgacgtcgtggacgcgctcaccttcctcgccgaacagaaatactatcctcaacgagaccgggaagctgctcaggcgaagggcggggactgcagcactcctcccaaaaaggacatggtttctgagatcaaagccgatgatgacatgaagcagagatgagccagacaaccataggatataatattataagagatgcataagggaggagatgcagcagaactatatctctgccccctcacatttcttgtgtaccgtacaccacataggcaggatgtaagagcagcaacgaatcatcttgacttgatgatgctgatttgttagtcaaggcctcaaattccagcagcaaaagccaagagctgagccgtctattcctgagctgttccaaggactgccacgttcaatattagcttctagatcaacatatatgcaaccgccatccttttccatcattctggtcttcatgtaatctaaaatctatgtgaggaggatttgcggaattgataaccctagtagaacactcaaaaaataaaaggtatttgaagttgc

SEQ ID NO: 3647 - DNA, 706 bp, Triticum aestivum
  misc_feature (35)..(35): n = any nucleotide
gggttccagtgggcgtcaaaggaaggcgcgttgcntgaggagaacatgctggcatttgcttgaggtctgtgatgttgttctccacactgatgctattcacaggggtggtggtcaggtcattcccacggccaggagggtcatttatgcttcccagctcactgccaagccaaggctgctggagcctgtgtacctggttgagatccaggccccggagaatgcacttggtggcatctatggtgttctgaatcagaagagagggcacgtgttcgaggagatgcagaggcaaggtaccccgctctacaacatcaaggcctacctccctgtcatcgagtcctttgggttctcaagcaccctgagggccgcgacgtccggccaggcattcccccagtgtgtgtttgaccactgggacatcatggcttctgatcctttggaccctggcacccagtcggcgacgctcgtcacggacatccgcaagaggaagggcctcaaggagcagatgacccctctgtccgatttcgaggacaagctctaaatttttggtgctgttatcccatacctgctattgtgttgttaaagagagctgcactattttgtatcgatgagtctatcttactgtcttgctgttaatgacctatttgtcgtgatactgggaactatgttttgatgtctggtgatgtaacggatgttttacttagattatgtatct

SEQ ID NO: 3648 - DNA, 1220 bp, Triticum aestivum
aggggattgactatgtgcctgaagtgaccgatgacggcactcccccgttctctccggggcgcctgggagcaccccccatcttcatcatctgtaataactgggcgaccggaatcgcgaggataccggagacgggggtggtagacgccatgcaggcttttgcctcccaggttctgcacctgtgggagaagcagaggttagagtggaggcagggcatgatggccaacagagaaatggacagggagcttagagtgatggagagggatcaagtgtcgatgcgcaaggccctcgaagcacagaataagaagctcgtgcttgtttcgaatcagggcggcgtgtccttatctgcgcaggctgtgcaggatggtgatccgccctctgaagtgggtctgcaatcatgcatgaacaagtttttcgaagcgatggagagcttcgccgccgcctgcgcaaatgcgtacaaggatctccatcttcgttgcgaagaagagagaactcgacctgcccaggagaccgacagagtttcctagtggcattttcagacattgcttgtacagtgagaagcaacggacctgtggtttggatgagcagcaaaggtgcacatagcagcagtatcacagattcaaattgcactgtctttctccctctgttgggttttgggatcgtcactgggttttaagcagcccatgtgaaagcttgtcctaaagatgagctctgatgatcagattcccactgctcttaccaaaccttttgagaactaggctgtagcctagtggcaagagagcgcagtgacgtctccagcaaccagggttcgagccacgtcggggacgaatttctggtttctcacaaggaatgcttctcctatatcaataaaccatgggtgctagtgcccatgagtttcatcttaccaaaccttttgatgatcgtctgctcctcctcatcaatcgttgtaccaatgccggccggaagactgcgttatcgccagaaggaagaaagcatcagagacaaaggagaaacagaaggcaaacagaaggcgcggatcggaatagagatcttttatcattcatgatgaaaaccctacaattgtcggtgtaagagcttggttctctagccaatgcatgatcctgatagatgtttggtgctcattctggagctctgctacagcttcgtccccaagttatccggggattgagctttttagtatagacaaaggtcctggcaccgct

SEQ ID NO: 3649 - DNA, 1180 bp, Triticum aestivum
gtgaccgacgacggcactcccccgttctccccggggcgcctgggagcacccccatcttcatcatctgtaataactgggcgaccggaatcgcgaggataccggagacgaaggtggtagacgccatgcaggctcttgcctcccaggttctgcacctgtgggagaagcacaggctagagtggaggcagggcatgatggccaacggagacatggacagggagcttagggtgatggagagggatgaagcgtcgatgcgcaaggcccttgaggcacagaataagaagctcgtgctcgtttcgaatcagggcggcgtgtccttgtctgcgcaggccgtgcgggatggtgatccgccctctgaagtgggtttgcaatcatgcatgaacaggttcttcgaagcgatggagagcttcgccgccgcctgcgcaaacgcgtacaaggatctccatcttcgttgcgaagaagagagaactcgacctgcccaggagaccgacagagtttcctagtggcattttcagacattgcttgtacagtgagaagcaaccgaccctgtggtttggatgagcagcaaaggtgcacatagcagcagtatcacagattcaaattgcactgtctttctccctctgttgggtttcgggatcgtcactgggatttaagcagccgatgtgaaagcttgtcctaagatgacctctgatgatcagattgccactgctcttatcaaaccaatctctcaagatttgatgatcttctgctcctcctcttcgtcaatcgtcataccgatgccgaccggaggaagatggttctttagacaagtgaatggtcaccggtgttatcgccggaaagaagaaagcatcagagacaaggagagacacaaggcgctgatcggtatcggaatagagatcttttatcattcatgaaaaccctacaattgtcagtgtaggaagtatgaactcggtcttctctagccaatgcatgatcctgatacatgtttgcttgttcattgtggggctctgctacagctttgtgcccaagttatccggggattgacctttttagcgtagacaaaggtcctggcaccgcttgcagactctgatttttcaaccactgtcgaaattcacattttatttattcctatatatacatatgattcagttgtaatcatgacttttgtacagctatggtataa

SEQ ID NO: 3650 - DNA, 648 bp, Triticum aestivum
tgcttgagtctgtgatgtgttctgcacaactgatgctattcacagggtgttgccaggtcatcccaacagccaggagggtcatttatgcttctcagctcactgctaagccaaggctgctggagcctgtgtacctggttgagatccaggccccggagaatgcacttggcggtatctatggtgttctgaatcagaagagagggcacgtgtttgaggagatgcagaggcctggtaccccgctgtacaacatcaaggcttacctcccggtcatcgagtcgttcgggttctcaagtaccctcagggctgcgacatctggccaggctttcccccagtgtgtgttcgatcactgggacatcatgtcttcggatcctttggaggccggctcccagtctgccacccttgtcacggagatccgcaagcgcaagggtctgaaggaacagatgacccctctgtctgatttcgaggacaagctctaaacttttggttctgttatctcctatatagtgtagttggttttgctgctaagagagctgcactattattttgtgtctactgagtcgtggctgtattgctattggaatgtactcctatctgtcgtgatactggcactttgttttgatgtctatcgatgttaaaacttagattatatat

SEQ ID NO: 3651 - DNA, 647 bp, Triticum aestivum
agggtgttgtcaggtcatcccaacaagcccggaggtcatttatgcttctcagctcactgctaagccaaggctactggagcctgtgtacctggttgagatccaggccccggagaatgcactcggcggtatctatggtgttctgaatcagaagagagggcacgtgtttgaggagatgcagaggcctggtaccccgctgtacaacatcaaggcttacctcccggtcatcgagtcgttcgggttctcaagtaccctcagggctgcgacatctggccaggctttcccccagtgtgtgttcgaccactgggacatcatgtcttcggatcctttggaggccggctcccagtctgcgacccttgtcacggagatccgcaagcgcaagggtctgaaggaacagatgacccctctatctgatttcgaggacaagctctaaacttttagttctgttatcatatgggtctagtttgcttttgctgctaagagagctgcactattattttctgtctgttgagtcgtggctgtattgctattgggatgtcctatcactttgttttgatgtctatcgatgttaaaacttagattatatatctgttatccactggtagttcgttgtttgtgttagatcctgctctgcctgattatttattgct

SEQ ID NO: 3652 - DNA, 749 bp, Triticum aestivum
gagggagcatgtgtgaggagtacatgcgtggcatctgctacgaggtctgtgatgttgttctccacactgatgctattcacaggggtggtggtcaggttatcccaacggcgaggagggtcattttacgcttctcagctcaccgccaagccaaggctgctggagcccgtgtacctggttgagatccaggcccccgagaacgcacttggtggtatctatggtgtgctgaatcagaagagaggccacgtgttcgaggagatgcagaggcaaggtaccccactgtacaacatcaaggcctacctgcctgtcatcgagtccttcgggttctcgagcaccctgagggctgcgacgtccggccaggccttcccccagtgtgtgtttgaccactgggacatcatggcctccgatcctttggaccctggcacccagtcggcgacgctcgtgacggagatccgcaagaggaagggtctcaaggagcagatgactcccctatccgatttcgaggacaagctctaaatcttggggtcatgttttggtactggctcttgctgtgaagggaggcgcggtatttttctccctatgtgtcttccttactatcttgttgtttgtatgtggtgctactgagactatggttttgatgacggttgtggtgatgtaacagatgttaaaactttgatgatctatccgtcgtcagctggtggttatttttactgtgctgtgtttgcttttgtgctacatcttgctttcattta

SEQ ID NO: 3653 - DNA, 627 bp, Triticum aestivum
acaggttgtgtcagtcatcccaacggcgaggagggtcatttacgcttctcagctcactgccaagccaaggctgctggagcccgtgtacctggttgagatccaggccccggagaacgcacttggtggtatctatggtgtgctgaatcagaagagagggcacgtgttcgaggagatgcagaggcaaggtaccccactctacaacatcaaggcctacctgcccgtcatcgagtccttcgggttctcgagcaccctgagggccgcgacgtccggccaggccttcccccagtgcgtgtttgaccactgggacatcatggcctccgatcctttggaccccggcacccagtcggcgacgctcgtgacggagatccgcaagaggaagggtctcaaggagcagatgacccccctatccgatttcgaggacaagctctaaactttgggtcatgttttgctgctggctgttgctgtgaagggaggcgcggtatttttctccctatgtgtcttccttactatcttgttgtttgtatgtggtgctactgagactgtggttttgatgatggttgtggtgatgtaacagatgttaaacttagatgatatatttctggcatcccacggtggttatttttactg

SEQ ID NO: 3654 - DNA, 896 bp, Triticum aestivum
ctgaggagtttgggtgggacaaggatctcgccaagaagatttggtgctttggacctgagacgactggccccaacatggttgttgacatgtgtaagggagtgcagtatctgaatgaaatcaaggactctgttgtggctgggttccaatgggcatcgaaagaaggtgctctggctgaggagaacatgcgtggcatttgctttgaggtctgtgatgttgttctgcacactgatgctattcacaggggtggtggtcaggtcatcccaacagccaggagggtcatttacgcttctcagctcactgccaagccaaggctgctggagcctgtgtacctggttgagatccaggccccggagaatgcacttggcggtatctatggtgttttgaatcagaagagagggcacgtgtttgaggagatgcagaggactggtaccccgctgtacaacatcaaggcttacctcccggtcatcgagtcgtttgggttctcaagtaccctcagggcggcgacatctggccaggctttcccccagtgtgtgttcgaccattgggacatcatgtcttctgatcctttggaggccggctcccagtccgcgacccttgtcacagagatccgcaagcgcaagggtctcaaggaacagatgacccctctatctgatttcgaggacaagctctaaacttttgcttctgttacatggtctagtttgcttttgctgctaagagagctgcactattatctgtctattgagtcgtcgtcgctgtattgctattggaatgtactcctatctgtcgtgatactggcactttgttttgatgtctgtcgatgttaaaacttagattatatatctgtcgcgatacttttgatgtctatcaatgttaaaacttagactatatatctgtta

SEQ ID NO: 3655 - DNA, 614 bp, Triticum aestivum
gctcactgctaagccaaggctgctggagcctgtgtacctggttgagatccaggccccggagaatgcactcggtggtatctatggtgttctgaatcagaagagagggcatgtgtttgaggagatgcagaggcctggtaccccgctgtacaacatcaaggcttacctcccggtcatcgagtcgttcgggttctcaagtaccctcagggcggcgacatccggccaggctttcccccagtgtgtgttcgaccattgggacatcatgtcttctgatcctttggaggccggctcccagtctgccacacttgtcacggagatccgcaagcgcaagggcctgaaggaacagatgacccctctatctgatttcgaggacaagctctgaacttttgcttctgttacatggtctagtttgcttttgctgctaagagagctgcactattatctgtctattgagtcgtcgctgtactgctattgggattcctatcggtcgtgatactggcactttgttttgatgtctgtcgatgttaaaacttagattatatatctgtcgtgatactggcacttcgttttgatgtctgtcgatgttaaagcttagattatacaagtatctgttatcc

SEQ ID NO: 3656 - DNA, 924 bp, Triticum aestivum
gctgaggccattgatgacgggcgcattggcccgcgtgacgatcctaaggtgcgttccaagatcctgtctgaggagtttggctgggacaaggatcttgccaagaagatttggtgctttggacctgagacgactggacccaacatggtcgttgacatgtgtaagggagtgcagtatcttaatgaaatcaaggactctgttgtggctgggttccagtgggcgtcgaaggaaggtgcactggctgaggagaacatgcgtggcatctgcttcgaggtctgtgatgttgttctccacactgatgctattcacaggggtggtggtcaggtcattcccacggccaggagggtcatttatgcttctcagctgactgccaagccaaggctgctggagcctgtgtacctggttgaaatccaggccccggagaatgcgcttggtggcatctatggtgttctgaatcagaagagagggcacgtgttcgaggagatgcagaggcaaggtaccccgctctacaacatcaaggcctacctccccgtcatcgagtcctttgggttctcaagcaccctgagggctgcgacgtccggccaggccttcccccagtgtgtgtttgaccactgggacatcatggcttccgatcctttggaccccggcacccagtctgcgacgctcgtcacggagatccgcaagaggaaggggctcaaggagcagatgacccctctatccgatttcgaagacaagctctaaatttttggtgctgttatcccttacctggtcttgtgttgttaaagagagccgcactattttgtatcgatgagtcttgctgttaatgacctatttgtcgtgatactgggaactatgttttgagatgtctggtgatgtaacggatgttttacttagattatgtatctgttgtccactggttcttttgct

SEQ ID NO: 3657 - DNA, 1807 bp, Triticum aestivum
gtagtcttggtgtgacctatgtaagaatgatgagaaggacttgatgggcaaggctctcatgaagcgtgtgatgcaaacttggctgcctgccagtcgtgctctgcttgagatgatgatatttcacctcccctctccttcaaaggcccagaggtaccgtgtggagaacttatacgagggcccccttgatgacatatatgcaaatgctatcagaaactgtgaccctgatggtcctcttatgctgtacgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcctctgatcttcctaagcttgttgagggtttgaagcgtctggccaagtcagatcctatggttctctgtaccattgaagagtctggtgagcatatcattgctggagctggagagcttcaccttgaaatctgtttgaaggatcttcaggatgacttcatgggtggtgctgaaatcattgtttcccctcccgttgtctccttccgtgagactgttctggagaagtcctgccgtactgtcatgagcaagtccccgaacaagcacaaccgtctttacatggaagctcgccccttggaggagggactggctgaggccattgatgatggtcgcattggcccacgtgatgatcctaaggtgcggtccaagatcctgtctgaggagtttgggtgggacaaggatcttgccaagaagatttggtgctttggacctgagacgactggccccatcatggtcgtcgacatgtgtaagggagtgcagtatcttgaatgagaatcaaggactctgttgtggctggtttccagtgggcgtcaaaaggaaggcgcgttggctgaggagaacatgcgtggcatttgctttgaggtctgtgatgttgttctccacactgatgctatccacaggggtggtggtcaggtcattcccacggcccaggagggtcatttatgcttctcagctgactgccaagccaaggctgctggagcctgtgtacctggttgagatccaggccccggagaatgcgcttggtggtatctatggtgttctgaatcagaagagagggcacgtgttcgaggagatgcagaggcaaggtaccccgctctacaacatcaaggcctacctccccgtcattgaatcctttgggttctcaagcaccctgagggccgcgacgtccggccaggccttcccccagtgtgtgtttgaccactgggacatcatggcttctgatcctttggacccaggcacccagtcggcgacgctcgtcacggatatccgcaagaggaagggcctcaaggagcagatgacccctctatccgatttcgaggacaagctctaaatttttggtgctgttatcccttacctggtcttgtgttgttaaagagagctgcactattttgtatcgatgagtcttgctgttatgacctacttgtcgtgatactgggaactatgttttgatgtctggtgatgtaacggatgttttacttagattatctatctgtt

SEQ ID NO: 3658 - DNA, 691 bp, Triticum aestivum
ttcgtcttcgtcgcgacagcaacgccacgtcgggctcggctcaagtgcgccaaggagttggcaacggccatccgcggcgccatcatcctcgccaagctctccatcgtgcccgtcaggaggggctactgggggaacaagatcggcctgccccacaccgtgccctgcaaggtcaccggcaagtgcggctctgtcaccgtgcgcatggtgcctgccccgaggggttctggaatcgtcgccgctcgtgtccccaagaaggtgctccagttcgctggtattgatgatgtcttcacttcctcgcgtggatccaccaagacacttggcaacttcgtcaaggcaaccttcgactgcctgatgaagacctatggattcctcacccctgacttctggagggagacgaccttcaccaaggggccgtaccaggagttcaccgacatcttggcgaagccgacaaaggccttgatgcttgatgcaccagttgagaagatagaagcttaggatgttggcgtaaatggtttttgctagctgggagctgtgtaatgcactatgctttatttagttattaagactttgaatcgtgctgcttcaggatgtctctctgccgtcaagtgttggtttgtggaactatgctactctcttttatcgtcaatggatgctacataattatagataaaaaatgactgattgccataat

SEQ ID NO: 3659 - DNA, 646 bp, Triticum aestivum
cgcgcgcacctgtcgcgactttggcctcgccaaggtcggccccgtcggcgacaagacccatgtctccaccagggtcatgggcacctacggctactgcgcccccgagtacgcgctcacgggcaagctcaccaccatgtccgacgtctatagcttcggcgtcgtcttcctcgagatcatcacggggcggcgcgtcatcgacacgtccaggccccgtgatgagcacaaccttgtgcagtgggcggcaccgcgcttcaagagcaagaagcgcttcagggagatggccgacccgctcctccgcggcgcatacccaaccaaggggctctaccaggcgctcgccatctccgccatgtgtctgcaggaggatgccaccatgcgcccctccatcgccgacgttgtcacggcgctcgactacctcaccggcgtcgccaagccttcccctccctctcaacaacagtcgccttcccctagccctagccctacccatcctcaacaacagtcgccttcccctagccctagccctacccatcctcaacaacagtcgccgcccaaggaggaggaggatgatgccactgactagctattaacaacaaacatgcatatctgtccgtgcaacatgtatacatatataccaaagcagagtcttgtt

SEQ ID NO: 3660 - DNA, 697 bp, Triticum aestivum
atgcgcatcgcgcagggcgccgcccgggcctcgagtaccgtccacgacgcctcccgccgccccggcccgcccgtcatctaccgcgacttcaaggcctccaacatcctcctcgacggctgcttccgcgcgcacctctccgactttggcctcgccaaggtcggccccgtcggcgacaagacccatgtgtccaccagggtcatgggcacctacggctactgcgcccccgagtacgcgctcaccgggaagctcaccaccatgtccgacgtctatagcttcggcgtcgtcttcctcgagatcatcacggggcggcgcgtcatcgacacgtccaggccccgtgatgagcacaaccttgtgcagtgggcggcgccgcgcttcaagagcaagaagcgcttcagggagatggccgacccgctcctccgcggcgcataccccaccaaggggctctaccaggcgctcgccatctccgccatgtgcctccaggaggatgccaccatgcgcccctccatcgccgacgttgtcatggcgctcgactacctcaccggcgtcgccaagccttcccctacccctacccctcaacaacagtcgccttcccctagccctagccctacccctacccctcaacaacagtcgccgcccaaggaggaggatgatgccactgactagttataagttataacaacaaacatgatatctgtct

SEQ ID NO: 3661 - DNA, 931 bp, Triticum aestivum
cggcggccgtcgtggccctcgccaggaggaggagaagtgggtgcccgtcaccaaactcggccgcctcgtcaaggagggccgcttcaccaagatggaggagctctacctccactcgctacccatcaaggagcaccagatcgtggagcactctgcccggggctcaaggacgaggtgatgaagatcacccccgtgcagaagcagacccgcgccggccagcggacccgcttcaaggcgttcgtcgtcgtcggcgacagcaacggccacgtcgggctcggcgtcaagtgcgccaaggaggtggccacggccatccgcggcgccatcatcctcgcaaagctctccatcgtgcccgttaggaggggctactgggggaacaagatcggcctgccccacaccgtgccctgcaaggtcaccggcaagtgcggctctgtcaccgtgcgcatggtgcccgccccgaggggttctggaatcgtcgccgcgcgcgtccccaagaaggtgctccagttcgctggtattgatgacgtcttcacttcctcgcgtggatccaccaagaccctcggcaacttcgtcaaggcaaccttcgactgcctgatgaagacctatggattcctcacccctgacttctggagggagacgaccttcaccaaggcaccgtaccaggagttcactgacattttggcgaagccgacgaaggccctgatgcttgatgcaccagccgagaagatagaagcttaggatgtccgtgtaaagggtttttactagctgggagctgtctaatgcactttgctttattcagttattaatactttgaatcgtgctgtttcaggatgtctctgtttgccgtcaagtgttggtttgtggaactatgctactctcttttatcgtcaatggacgctacataattatggcaatcgatcttttttatctatagatg

SEQ ID NO: 3662 - DNA, 836 bp, Triticum aestivum
gaggagctctacctccactcgctccccatcaaggagcaccagatcgtggagcagctctgcccggggctcaaggacgaggtgatgaagatcacccccgtgcagaagcagacccgcgccggccagcggacccgcttcaaggcgttcgtcgtcgtcggcgacagcaacggccacgtcgggctcggcgtcaagtgcgccaaggaggtggccacggccatccgcggcgccatcatcctcgccaagctctccatcgtgcccgtcaggaggggctactgggggaacaagatcggcctgccccacaccgtgccctgcaaggtcaccggcaagtgcggctctgtcaccgtgcgcatggtgcccgccccgaggggttccgggatcgtcgccgcgcgcgtccccaagaaggtgctccagttcgctggtattgatgatgtcttcacttcctcgcgtggatccaccaagacccttggcaacttcgtcaaggcaaccttcgactgcctgatgaagacctatggattcctcacccctgacttctggagggagacgaccttcaccaaggcgccataccaggagttcaccgacattttggtgaagccgaccaaggccctgatgcttgatgcaccagccgagaagatcgaagcttaggatgtcggtgtaaagggtttttacaagctgagagctgtctaatgcactttgctttatttagttattaatactttgaatcgtgctgtttcaggatgtctctttttgccgtcaagtgttggtttgtggaactatgctactctcttttatcgtcaatggaagctacataattatggcaatcagtcttttttatctataga

SEQ ID NO: 3663 - DNA, 587 bp, Triticum aestivum
catggccaagatctacgtcgaccacagcaagccggcgttcgtcgttggcgagctctacgaacagggaccgacagctgctcgcgaactgggtgcagggcgtcggcgggccggccacggcgtttgactttcccaccaagggcgttctccaggaggccgtgcagggcgatctggggaggatgcgtggcagcgacggcaaggcgcccggtctgattgggtggatgccggagaagaccgtcacgttcatcgacaaccacgacactgggtcgacgcagaggttgtggccattcccctcggataaggtcatgcagggctatgcgtacatcctcacacacccgggcataccatgcatcttctacgaccatgtgttcgactggaagctgaagcaggagatcaccgcactggctagagtcaggtcaaggaacgggatccatccgggtagcaaactggatatcctcaaagccgaaggcgatctctatgttgcaaagattggggacaaggttataaccaagatcggggcaagatacaatattggcaaaaacgtgatcccctcgggtttcaagattgcagctaaaggcaacaactactgt

SEQ ID NO: 3664 - DNA, 680 bp, Triticum aestivum
cggcgtgcgtctgcgggcatggtgttcgacttcacgaccaaagggattctgaacgccgccgtggaggcgagctgtggcggctgatcgacccgcaggggaaggctcccggcgtgatggggtggtggccggccaaggccgtcaccttcgtcgacaaccacgacaccggctccacccaggccaagtggccattcccctacgacaaggtcatgcagggctacgcgtacatcctcacccatcccggcatcccatgcatcttctacgaccatttcttcaacctggggttcaaggaccagatcgcggccctggtggcgatcaggaagcgcaacggcatcacggcgacgagcgccctgaagatcctcatgcacgaaggggacgcctacgtcgccgagatcgacggcaaggtggtggtgaagatcgggtccaggtacgacgtcggggcggtgatcccagccgggttcgtgaccacggcgcacggcaacgactacgccgtctgggagaagaccgcagccgcggccacactacaacggagctgaagcctccactgaagcgcggcggcaacatgatttgaactacattgtccgttctgctatacacacgcagatattgttattgtagtatatacttgtacccagaaatgagctttacgaataggctcacacagactatagtaaataaagtat

SEQ ID NO: 3665 - DNA, 889 bp, Triticum aestivum
caagtactccaacgccgcgccacagggacaccgcgcggcttcgatccgcgcccgacatcgaccatctcacccgcgggtgcagagggagctctccgcctggctcaactggctcaaactgacctcggcttcgtcggatggcgcctcgactttgccaagggatactctgcggccatggccaagatctatgtcgacaacagcaagccgtctttcgtggttggtgagctctacgatagggaccgacagctgctcgcgaactgggtgcatggcgtcagcgggccggccacggcgtttgacttccccaccaagggcgttctccaggaggccgtgcagggcaacctggggaggatgcgcggcagcgacggcaaggcgcccggtccgattgggtggatgccggagagaaccgtcacgttcatcgacaaccatgacactgggtcgacacagaggttgtggccattcccctcagacaaggtcatgcagggctacgcctacatcctcacacacccaggcataccatgcctcttctacgaccatgtgttcgactggaagctgaagcaggagatcaccgcactggctagggtcaggtcaaggaacgggatccatccgggtagcacactggatatcctcaaggccgagggcgatctctatgttgccaagattgggggcaaggttataaccaagatcgggtcaagatacaatattggcaacaacgtgatcccctcgggtttcaagattgcggctaaaggcaacaactactgtgtttgggagaagagtggcctctgaattcatgctggtgaatggaattagttctagttttcaaactggatatctacgactaggcatgatttatgagattaaatattccgaatttggttttaaatgtacggtccta

SEQ ID NO: 3666 - DNA, 397 bp, Triticum aestivum
ctagccaatcattcatccagagaagaagagtgcagtgaacagtgtgagatcgacggtagcgcgcgcgatggggaagaatggcaaccacctgtgctgcttctctctgctgctgctgcttgtcgccgggttggcgtccggccatcaagtcctctttcaggggttcaactgggagtcgtggaagcagagtggcgggtggtacaacatgatgatgggcaaggtcgacgacatcgccgccgccggagtcacgcacgtctggctgccgccaccatcgcactccgtctccacccaaggttacatgcctggtcggttgtacgacatcgacgcgtccaagtacggcaacgcggcggagctcaagtcgctcatccgcgcgctccacggcaagggcgtccaggcgatc

SEQ ID NO: 3667 - DNA, 580 bp, Triticum aestivum
tgcccagatctacgtcgactcagctaccgccgttcgtcttggcgagctctacgaccggaccgacagctgtctcgcgaactgggtgcggggcgtcggcgcgccggccacggcgtttgacttccccaccaagggcgttctccaggaggccgtccagggcgatctggggaggatgcgcggcagcgacggcaaggcgcccggtatgattgggtggatgccggagaagaccgtcacgttcatcgacaaccacgacactgggtcgacgcagaggctgtggccattcccctcggacaaggtcatgcagggctacgcctacatcctcacacacccgggcataccatgcatcttctacgaccatgtgttcgactggaaactgaagcaggagatcaccgcactggctacggtcaggtcaaggaacgggatccatccgggtagcacactggatatcctcaaagccgagggcgatctctatgttgccaagattgggggcaaggttataaccaagatcgggtcaagatacaatattggcgacaatgtgatcccctcgggtttcaagattgcagctaaaggcaacaactattgt

SEQ ID NO: 3668 - DNA, 583 bp, Triticum aestivum
  misc_feature (130)..(149): n = any nucleotide
cttcctaatcgtagttcgtcctcgcccaattcgagcagtcatgtcgctgattccccgcggcaacgccttcgaccccttctccctcgacctctggaaccccttcgacggcttccccttcggctccggctannnnnnnnnnnnnnnnnnnnctcttcccctcgttcccgcgcatcagctccgagaccgcggccttcgccggcgcgcggatcgactggaaggagacgcccgaggcgcacgtgttcaaggcggacgtgccggggctgaagaaggaggaagtggaggacggcaacgtgctccagatcagcggcgagcgcaacaaagagaaggaggagaagaccgacacgtggcacagggtggagcgcagcagcggcaagttcctgcgcaggttcaggctcccggaggacgccaaggtggagcagatcaaggcggccatggagaacggcgtgctcaccgtcaccgtggccaaggaggaggccaagaagcccgaggtcaagtccatcctgatctccggatagaccccttctccctcgacttcaactcgctcttgttagtgcctaactgctcagagcctgtaataagtgtg

SEQ ID NO: 3669 - DNA, 731 bp, Triticum aestivum
gaccgcgccgggcagcgcacccgcttcaaggccttcgtcttcgtcggcgacagcacacgccacgtcggcctcggcgtcaagtgcgccaaggaggtggccacggccatccgcggcgccatcatcctcgccaagctctcgatcgtgcccgtcaggaggggctactgggggaacaagatcggcctgcccccacaccgtgccctgcaaggtcaccggcaagtgcggctccgtcaccgtgcgcatggtgcccgcccccaggggttccggaatcgtcgccgcccgcgtccccaagaaggtgctgcagttcgccgggatcgatgatgtcttcacttcctcgcgtggatccaccaagacccttggcaacttcgtcaaggctacctttgactgcctgatgaagacctatggattcctcactcctgacttctggagggagacaaccttcaccaaggcgccgtaccaggagttcaccgacatcttggcgaagccgaccaaggccctgatgcttgatgcaccagctgagaagatagaagcttaggatgaagggtttttactagctgggagctgtctgttgcactttgctttattatagtcgagaaccaggtgtctttgaattgtgctacttgtggaagtctctgtttgctgtcaaagttttggattatggtgcaatgctactctgttattggcaatggatgctacataattatgccaatcgcagtgttatttctctagatgtt

SEQ ID NO: 3670 - DNA, 806 bp, Triticum aestivum
cagatcgtggagacgctctgccccggggtcaaggacgagtgatgaagatcacccggtccagaagcagacccgcgccggacagcgcacccgcttcaaggccttcgtcgtcgtcggcgacagcaacggccacgtcggcctcggcgtcaagtgcgccaaggaggtggccacggccatccgcggcgccatcatcctcgccaagctctcaatcgtgcccgtcaggcggggctactgggggaacaagatcggccagccccacaccgtgccctgcaaggtcaccggcaagtgcggctccgtcaccgtgcgcatggtgcccgcccccaggggttctggaatcgtcgccgcccgcgtccccaagaaggtgctgcagttcgccgggatcgatgatgtcttcacttcctcgcgtggatccaccaagacccttggcaacttcgtcaaggcaaccttcgactgcctgatgaagacctatggattcctcacccctgacttctggagggagacaaccttcaccaaggcgccgtaccaggagttcaccgacatcttggcgaagccgaccaaggccctgatgcttgatgcaccagccgagaagatagaagcttaggatgtttgccatgaaagggtttttactagctgggagctgtctgttgcactttgctttattatagtcgagaacaaggtgtctttgaattgtgctacttgtggaagtctctgtttgctgtcaaagttttggattatggtgcaatgctactctctgttatcggcaaaggatgctacataattatgccatccagtgttatttgtctagatgt

SEQ ID NO: 3671 - DNA, 892 bp, Triticum aestivum
cccgtcaccaagctcggccgcctcgtcaaggagggccgcttcaccaagatggaggagatctacctccactcgctccccgtcaaggagcaccagatcgtggagacgctctgcccggggctcaaggacgaggtgatgaagatcaccccggtccagaagcagacccgcgccggacaacgcacccgcttcaaggccttcgtcgtcgtcggcgacagcaacggccacgtcggcctcggcgtcaagtgcgccaaggaggtggccacggccatccgtggcgccatcatcctcgccaagctctctatcgtgcccgtcaggaggggctactgggggaacaagatcggcctgccccacaccgtgccctgcaaggtcaccggcaagtgcggctccgtcaccgtgcgcatggtgcccgcccccaggggttccggaatcgtcgccgcccgcgtccccaagaaggtcctgcagttcgccgggattgatgatgtcttcacttcctcgcgtggatccaccaagacccttggcaacttcgtcaaggcaaccttcgactgcctgatgaagacctatggattcctcacccctgacttctggagggagacaaccttcaccaaggcgccgtaccaggagttcaccgacatcttggcgaagccgaccaaggccctgatgcttgatgcaccagccgagaaggtagaagcttaggatgttgccataaaagggtttttactagctgggagctgtctgttgcacttccctttattatagtcgagaaccaggtgtctttgaattgtgctacttgtggaagtctctgtttgctgtcaagttttggattatggtgcaatgctactctctgttatcggcaacatttttggtctgtgctttgtgttgatcgtatccatttgcc

SEQ ID NO: 3672 - DNA, 714 bp, Triticum aestivum
aggtgggcgcgcgcgtcagcaggcatggtgttcgatttcacgaccaagggatactgaacgcggccgtggagggcgagctgtggcggctgatcgacccgcaggggaaggcccccggcgtgatggggtggtggccggccaaggccgtcaccttcgtcgacaaccacgacaccggctccacgcaggccatgtggccattcccctccgacaaggtcatgcagggctacgcgtacatcctcacccaccccggcatcccatgcatcttctacgaccatttcttcacctgggggttcaaggacgagatcgcggcgctggtggcgatcaggaagcgcaacggcatcacgccgacgagcgctctgaagatcctcatgcacgaaggggacgcctacgtcgccgagatcgacggcaaggtggtggtgaagatcgggtccaggtacaacgtcggggcggtgatcccggccgggttcgtgacctcggcgcacggcaacgactacgccgtctgggagaagcccggcgccgcggggagactgcagcggagctgaagtctccactgatccaccattcgatcgagcatgaattttctgaagtaggagtacatgattcacttctgctatattcacgcagatactatgattaactatgtatacttgtacccaaaattgatgagctatacgaattgctcacacgactgtactaaataaagtaatgaggatacga

SEQ ID NO: 3673 - DNA, 1365 bp, Triticum aestivum
ctcctcttcgagagcacagctagatagagctgaagaacatggcgagcaaacactcgtccctctccctcttcctcgtcctccttggcctgtcggccagcttggcctccgggcaagtcctgtttcaggggttcaactgggagtcgtggaagcagagcggtgggtggtacaacatgatgatgggcaaggtcgatgacatcgccgccgccggagtcacccacgtctggctcccgccgccgtcgcactctgtcgccaacgaaggttacatgccaggtcggctgtacgacatcgacgcatccaagtacggcaacgcggcggagctcaagtcgctcatcgcggcgctccacggcaagggcgtgcaggcgatcgccgacatcgtcatcaaccaccggtgcgccgactacaaggacagccgcggcatctactgcatcttcgagggcggcacctccgacgccgcctcgactggggcccccacatgatctgccgcgacgacaccacctactccgacggcacagccaacctcgacaccggcgacggcaagcctaactacgaccaggacgcgcaccggcagaatctggtgaactgggtggacaaggtgggcggcgcggcctcggccggcatggtgttcgacttcacgaccaaagggattctgaacgccgcggtggagggcgagctgtggcggctgatcgacccacaggggaaggcccccggcgtgatggggtggtggccggccaaggccgtcaccttcgtcgacaaccacgacacgggctccacgcaggccatgtggccattcccctccgacaaggtcatgcagggctacgcgtacatcctcacccaccccggcatcccatgcatcttctacgaccatttcttcacctgggggttcaaggacgagatcgcggcgctggtggcgatcaggaagcgcaacggcatcacggcgacgagtgcactcaagatcctcatgcacgaaggggacgcctacgtcgccgagatcgacggcaaggtggtggtgaagatcgggtccaggtacgacgtcggggcggtgatcccggcagggttcgtgacctcggcacacggcaacgactacgccgtctgggagaagcccggggccgcggcgacactgcagcggagctgaagtctccactgaccggagatgatctgatctacattgtccattctgctacacacacgcagatattgttgtggtttaacttatgtatacttgtacccaaaattgatgagctctacgaatggctcagcacgaatgtagtaaataattattgaggatatgaagaggtataagaggcgattgcgccatttggatgcttcagcatatataaataaatgaaaaggaaaagacagttgcac

SEQ ID NO: 3674 - DNA, 797 bp, Triticum aestivum
gggggcggcgcggcgtcggcaggcatgggttcgacttcacgaccaaggggatattgaacgccgcggtggagggcgagctgtggcggctgatcgacccgcaggggaaggctcccggcgtgatggggtggtggccggccaaggccgtgcaccttcgtcgacaaccacgacacaggctccacgcaggccatgtggccattcccctccgacaaggtcatgcagggctacgcatacatcctcacccaccccggcatcccatgcatcttctacgaccatttcttcacctgggggttcaaggaccagatcgcggcgctggtggcgatcaggaagcgcaacggcatcacggcgacaagcgcactcaagatcctcatgcacgaaggggacgcctacgtcgccgagatcgacagcaaggtgctggtgaagatcgggtccaggtacgacgtcggggcggtgatcccggccgggttcgtgacctcagctcacggcaacgactacgccgtctgggagaagccaggcgccgcggcaacacggcagcggagctgaagtctccactgatccaccattcgatcgagcatgaattttctgaagtaggagtcatgattcacttctgctgtattcacgcagatactatgattaactatgtatacttgtacccaaaattgatgagccatacgaattgctcacacgactgtactaaataaagtactgaggatacgaagagatttaataaattcgagtttgtaccatctgtgttggtgcatctgggagggtgactatcagatggaatgatagcatgtttt

SEQ ID NO: 3675 - DNA, 588 bp, Triticum aestivum
atcccgcgcacctcctccgaccgcggcccttcgcgggcgcgcgcatcgactggaaggagacgcccgaggcgcacgtgttcaaggcggacgtgccggggctgaagaaggaggaggtgaaggtggaggtggaggacggcaacatcctccagatcagcggcgagcggaacaaggagcaggaggagaagaccgacacctggcaccgcgtggagcgcagcagcggcaagttcctccgcaggttccggctgccggagaacgccaaggcggagcaggtgaaggcgtccatggagaacggcgtgctcaccgtcaccgtgcccaaggaggaggccaagaagcccgaggtcaagtccatccagatctccggctagagcgatgaagtggagtgcagagcagtggcgtggagtctcgccccggtcgtcgtgataaaataaaatcaagaagagtccggccgtctgtgcgtgcgaatggtccaatgttgcagtcagtgttttgagtctctcgtgtcagtgttttgagtccggtttgttgtttgttcttcagtctgtactggctctgtactccatcagcaactgagtaaattcattaccttct

SEQ ID NO: 3676 - DNA, 635 bp, Triticum aestivum
gcagcaacagcacgcagcctcatcccgcgcacctcctccgacacgcgtccttcccgggcgcgcgcatcgactggaaggagacgcccgaggcgcacgtgttcaaggcggacgtgccggggctgaagaaggaggaggtgaaggtggaggtggaggacggcaacatcctccagatcagcggcgagcggaacaaggagcaggaggagaagaccgacacctggcaccgcgtggagcgcagcagcggcaagttcctccgcaggttccggctgccggagaacgccaaggcggagcaggtgaaggcgtccatggagaacggcgtgctcaccgtcaccgtgcccaaggaggaggcccagaagcccgaggtcaagtccatccagatctccggctaggcgtctgcgcgctcgctgcgcgatgaggtggactgcagagcagaggtgtggagtttcgccccggtcgtcgtgatgaaataaaatcagagtttggttgtgcgcggtgtgttagtactcagtgttgtgagaatggtccaatgttgcagccagtgttttgagtctctcgcgtctgtgttttgagtctagtttgttcgtcaatctgtaattcatcagcaactgagtaaatccattaccatctccgtctcggat

SEQ ID NO: 3677 - DNA, 779 bp, Triticum aestivum
cacaaatcaatcgctcacccttccgcttccaacactaatcaaatcgtcgattccttccaccagcagctcgaatccccatcaacaatgtcgctgatccgccgcagcaacgtgttcgaccccttctccctcgacttcttcgacccttttgacggcttccccttcggctccggcagcagcaacagcggcggcagcctcgtcccgcgcacctcctccgacacggcggccttcgcgggcgcgcgcatcgactggaaggagacgcccgaggcgcacgtgttcaaggcggacgtccccgggctgaagaaggaggaggtgaaggtggaggtggaggacggcaacatcctccagatcagcggcgagcggaacaaggagcaggaggagaagaccgacacctggcacagggtggagcgcagcagcggcaagttcctccgcaggttccggctcccggagaacgccaaggcggagcaggtgaaggcgtcgatggagaacggcgtgctcaccgtcaccgtgcccaaggaggaggccaagaagcccgacgtcaagtccatccagatctccggctaggcgtctgcgtgctcgctgcgcgatgaggtggactgcagagcagaggtgtggagtttcgccccggtggtagtgatgaaattaaaaaaaaccagagtccggctgtccgtgcgtgcgctgtgtgtctagtactctagcgttgtgtgcgaataaatctcgtctgtgtttcgagtccagtttgctcatccatctgtatttcatcagcaactgagtaaatccat

SEQ ID NO: 3678 - DNA, 681 bp, Triticum aestivum
actcgacaccatgtcctgattcccccgcaagctttcgacccttctccctgacctctcggaccccttcgatggcttccccttcgctccgcggcatcaccagcttcttcccctcgttcccgcgcgcatcctccgagaccgcggccttcgccggcgcgcggatcgactggaaggagactcccgaggcgcacgtgttcaaggcggacgtgccggggctgaaaaaggaggaagtgaaggtggaggtcgaggacggcaacgtgctccagatcagcggcgagcgcaacaaagagcaggaggagaagacgggcacgtggcacagggtggagcgcagcagcggcaagttcctgcgcaggttccgcctcccggacaacgccaaggcggaccagatcaaggcggccatggagaacggcgtgctcacagtcaccgtgcccaagaaggaggtcaaggagccggaggtcaagtccatccagatttctggctaggctgcttcgggattgaggttcgattcgctgctctgaggttggactcgctcctttcgtgacttctgctcaaaggcctgtaataagtgtggatttgggtccgtgttgggtgtgagtgtgcccttgtcagtactgtgttcaacgtccgcgtccagagttatagtcatgtaatgcaagcatccagtccgtaccgctgtgatcaact

SEQ ID NO: 3679 - DNA, 793 bp, Triticum aestivum
gaaaagaaaagcatccatcgcctgaatttgagagcttcctaatcgcagttcgtcctcgcccaaatcgagcagccatgtcgctgattccccgcggcaacgccttcgaccccttctcccctgacctctgggaccccttcgacggcttgccccttcggctccggcggcagcagcagcctcttcccctcgttcccgcgcatcagctccgagaccgcggccttcgccggcgcgcggatcgactggaaggagacgcccgaggcgcacgtgttcaaggcggacgtgccggggctgaagaaggaggaagtgaaggtggaggtggaggacggcaacgtgctccagatcagcggcgagcggaacaaggagcaggaggagaagactgacacctggcaccgcgtggagcgcagcagcggcaagttcctgcgccggttcaggctcccggaggacgccaaggcggaccagatcaaggcgaccatggacaacggcgtgctcaccgtcaccgtgcccaaggagggggccaagaagcccgaggttaagtccatccagatctccggctaggctgcttgagattaaggttcaggttcagttcgctgctgtgagtttcaactcgctcttttgtgccttttgctcgtgtggatggatttgggtgcgtgttcaacgtccgtgtccagagttatagtcatgtaatgcaagcatcgagtccaaagtgtgatgtactgctgtgatcaacttctgtgctgatttgaacgagcgagtcacagttctctcttaactgcttttggaacttcgattttacttc

SEQ ID NO: 3680 - DNA, 795 bp, Triticum aestivum
cgacttcacgaccaaagggatactgaacgccgccgtggagggcgaactgtggcggctgatcgacccgcaggggaaggcccccggcgtgatggggtggtggccggccaaggccgtcaccttcgtcgacaaccacgacacaggctccacgcaggccctgtggccattcccctccgacaaggtcatgcagggctacgcatacatcctcacccaccccggcaccccatgcatcttctacgaccatttcttcacctggggtttcaaggatgagatcgcggcgctggtggcgatcaggaagcgcaacggcatcacggcgacgagcgcactcaagatcctcatgcacgaaggtgatgcctacgtcgccgagatcgacggcaaggtggtggtgaagatcgggtccagatatgacgtcggggcggtgatcccggctgggttcgcaacgtcggcgcacgggcaacggctacgccgtctgggagaagaccgctgccgcggcaacagcacaacggagctaaagcctccagcgatccaccattcgatcgagcatgaattttctgaagtaaataattcacttctgcagttctgctatagacacgcagatattatcaatcaactatgtatacgtctgtccaaaattgatgagctctacaaattgctcacacgactgtagtaaataaagcaccgagtatatgaagagttataagaggcaattacgccatttgccatgtgcatgataagacgccgagttggatatggctactcaagtgacataacatgtactccctccataccaaaatataa

SEQ ID NO: 3681 - DNA, 522 bp, Triticum aestivum
cattccccctcccgaacaaggtcatgcaggggtacgcatacatcctcacccaccccggcaccccatgcatcttctacgaccatttcttcacctggggtttcaaggatgagatcgcggcgctggtggcgatcaggaagcgcaacggcatcacggcgacgagcgcactcaagatcctcatgcacgaaggagatgcctacgttgccgagatcgacggcaaggtggtggtgaaaatcgggtccagatacgacgtcggggcggtgatcccggctgggttcgcaacgtcggcgcacgggcaaagctacgccgtctgggaaaagatcggtgccgcggcgacaccacgacggagctgaagcctccaccgatccaccattcaatcgagcatgaattttctgaagcaaatgattcacttctgcagttctgctatagacacgcagatattttattaactatgtatacgtctacccaaaattgatgagctctacgaaccgctcacacggctgtggtaaataaagcattgaggat

SEQ ID NO: 3682 - DNA, 660 bp, Triticum aestivum
cgtggagggcgaactgtgcggcttgatcgacccgcaggggaaggctcctggcgtgatggggtggtgccggccaaggccgtcaccttcgtcgacaaccacgacacgggctccacgcaggccctgtggccattcccctccgacaaggtcatgcagggctacgcatacatcctcacccaccccggcacaccatgcatcttctacgaccatttcttcacctggggtttcaaggatgagatcgcggcgctggtggcgatcaggaagcgcaacggcatcacggcgacgagcgcactcaagatactcatgcacgaaggagatgcctacgttgccgagatcgacggcaaggtggtggtgaaaatcgggtccagatatgacgtcggggcggtgatactggctgggttcgcaacgtcggcgcacgggcaacggctacgccgtctgggagaagaccgctgccgcggcaacagtacaacggagctgaagcctccactgatccaccactcgatcgagcatgaattttctgaagcaaatgattcacttctgcagttctgctatagacacgcagatattattaactatgtatacgtctacccaaaattgatgagctctacgaattgctcacacgactgtagtaaataaagcactgaggatatgaagaggtataag

SEQ ID NO: 3683 - DNA, 705 bp, Triticum aestivum
  misc_feature (156)..(176): n = any nucleotide
caaatgtgaagcttggctcttccgaggatgaatgacgctacgggcgtgaaaatgaccgccagagatagacccacgcgctgaggacaaggagctcaagtaccagcttctgaagaagtacagtggctatttgacagcctccggccaagagttctcccnnnnnnnnnnnnnnnnnnnnnctcccaaaggaggccaggcagaagctacttcactggtgggagctgcactacaagtggccttacccctcggagacagaaaagattgcgcttgcggaatcgacagggctagaccagaaacagatcaacaactggttcattaaccagaggaaacggcattggaaaccgtctgaggacatgccgtttgtcatgatggaaggattccacccacagaatgccgctgccctctacatggacggtcaattcatggctgacggcatgtaccgccttggttcgtaaacctactttgaacaatcgatctggcgaaaggtgattgtcacattggaaaagatatttgtattcaggactggttaaaaatacatggacattgttattgaatttttgggtcgttcccggattcacaggctcgctctagtttcagtgatggcatatagttctcccgtaatgttgtaaatttcgattcgatgggttgcagtttagatgtatttggatctcctatttgatatgattgtatgtttcagatttgtgaaac

SEQ ID NO: 3684 - DNA, 600 bp, Triticum aestivum
ttcactgtgggactgcactacagtgcccttacccctcggagacagaaaagatcgcgcttgcggaatcggacagggctagaccagaaacagatcaacaactggttcattaaccagaggaaacggcattggaaaccgtctgaggacatgccgtttgtcatgatggaaggattccacccacagaatgccgctgccctctacatggacggtcagttcatggctgacggcatgtaccgccttggttcgtgaacctacttgaacaattgatctggcgaaaggtgattgtcacattggaaaagatatctgtattcagcactggttaaaatacatggacattgttattgaatttttgggaccttcccggattcacaggctcgctctagtttcagtgatggcatatagttctcccgtaatgttgtaaatttcgattcgatgggttgcagtttagatgtatttggatctcctgtttgatatgattgtatgtttcagatttgtgaaacatgttcaaagttgcctatctgaatcacttatgtacattggtttttctgttaacagttgaggtggatatggtcacgataacgtgtatattgtatgaaaatttca

SEQ ID NO: 3685 - DNA, 584 bp, Triticum aestivum
ctcccaaaggaggccaggcagaagctacttcactggtgggagctgcactacaagtggccttacccctcggagacagaaaagatcgcgcttgcggaatcgacagggctagaccagaaacagatcaacaactggttcattaaccagaggaaacggcattggaaaccgtctgaggacatgccatttgtcatgatggaaggattccacccacagaatgccgctgccctctacatggacggtcagttcatggctgacggcatgtacagccttggttcgtgaacctacttgaacaattgatctggcgaaaggtgattggcacgttggaaagatatctgtattcagcaactggttaaaatacatggacattgttattgaatttttgggaccttcccggattcacaggctcgctctagtttcagtgatggcatatagttctcccgtaatgttgtaaatttcgattcgatgggttgcagtttagatgtatttggatctcctatttgatatgattgtatgtttcagatttgtgaaacatgttcaaagttgcctatctggaatcacttatgtacattggtttttcttttaacagt

SEQ ID NO: 3686 - DNA, 634 bp, Triticum aestivum
cggggtcgtccgaggatgagctggacacgagctgcgaagaggagatcgaccccagcgcggaggacaaggagctgaagcaccagctgctgaggaaatacggcggctacgtggggagcctccgccaggagttctgcaagcggcgcaagaaggggaagctccccaaggaggcccgccagaagctgctgcactggtgggagctgcactccaagtggccctacccctctgagacggagaagatcgcgctggcggagtcgacggggctggaccagaagcagatcaacaactggttcatcaaccagaggaagcggcactggaagccggcgccggaggacatgcccttctccgtgatggacggcggcgtgggcgtgagcttcctccccgccccgcagggcccggcgctgtacatggacagggcgccgttcatggtggacggcatgtaccgcctcgggtcgtgaggcctctctccctttctccatcggacggggactgccggccggtgccgtcggcgtggtacgtaagctccatgcatggcaacggcatgcggccggtacgtaacgtacttagtctgacgacgactactcaatattatgttccttcggtaaatactccatatatatctgccgttcacgtgaac

SEQ ID NO: 3687 - DNA, 720 bp, Triticum aestivum
aggggagacaagagcttcgctgagattgatgcccacggcgtggaccaggagctgaagcaccatctcctgaagaagtacagtgggtacctgagctcccttgaagccaagagctgtcaaaagaagaagaagaaaggaaagctcccgaaggatgctcgccagcagctcctcagctggtgggagatgcactacaagtggccttatccctcggagagccagaaggtggcgctggcagagtcgacgggcctggacctgaagcagatcaacaactggttcatcaaccagaggaagcgccactggaagccgtcggacgagatgcagttcgtgatgatggacgcgtaccacccacctaacgccgccttctacatggacggccacttcgtcaacgacagcgggctctacaggttcggctagctcggccaggcctcgtctcttaccgttaccggtgaccttggtcggcgccaatggcggcgaccgagtgccttatgctgaagcacttggggaccgacgaccgaagctagttaagttagcgtttgtgtgccgcatgcgagctggaaggaggccgcatgcttattttgtttatcatcactacttatacctacgtacctatcatttatgcatggactcgatcgcctttgtgtggttttgtagcgattgacgcgaccatatggacaaccgcctgtttgctgcgacatgccttgctacgcgcatgcttgaataatt

SEQ ID NO: 3688 - DNA, 664 bp, Triticum aestivum
tctcgccagagcaccaccagaaccatcgccctcaaccaactcatcaatggcgtcgccggcgctgggggcggggacgccgccgttcctcaccaagacgtacgcgatggtggacgacccggagaccgacgacaccatctcctggaacgagtccggcacggcgttcgtggtgtggcgccgcgccgagttcgagcgcgacctcctccccaagaacttcaagcacagcaactttgcctccttcgtccgccagctcaacacctacggattcaggaagataggccttgacaggtgggagttcgccaacgagtgcttcaggaaaggggagaagcgcctgctcggcacgatacagaggcggaagggatctggcgccggggcgccgccgcccgcgatgatggcgacgccgatggcgacggcgattccgatctcgcccacgccgacgagctccggcggggacgccgcggtctcgtcgtcgccgccgcccgggctggcgctggtggccaccggcgcgatggccgagctggaggaggagaacgcgcggttgcggcgcgagaacgcgaggctggcgcggaagctcgagcgcgcgcggcggctctgcgacggcgtgcggcacctcgtgtggcggatgaccacgggggcctcactgggcccgcggctcaaagccgggcca

SEQ ID NO: 3689 - DNA, 733 bp, Triticum aestivum
cgtcgtgtcgcggtcgagaaaatttatttttatcaaaaaggcttcttccgtacgttcctttctttggtgaggtggccctctaccgcatctggaagctactacggggttccccgggccagatccggccgggaggggcagaggaggcgccggcgtgatgtcggccgagcatggcgctgcggcggcggacggggctggggcggagcctcctctcccggcgccgatgccggggctggcgacgtcggcggacgcggcggggcagaggtccctgccgacgccgttcctgaccaagacgtaccagctcgtcgaggacccggcggtggacgacgtgatctcgtggggcgaggacgggtcgacgttcgtggtgtggcggccggcggagttcgcccgggacctgctccccaagtacttcaagcacaacaacttctctagcttcgtgcggcagctcaacacctacggatttaggaagatcgtgccggaccggtgggagttcgccaacgactgcttccggcgaggcgagaagcgcctgctctgcgacatacaccgccggaaggtggtccagtcggccgggcttgctgctgcggctggcgccgccgcggctggggcggtcacgtttggcactgcggcgatccctatggagctgcgcgggacgcgctccggctcgccggagccgaggtctcctcgagggagcggtttgtcgtcactcggctccgggggggaccggtggggccgccgg

SEQ ID NO: 3690 - DNA, 1135 bp, Triticum aestivum
ggagttggagcatgggggcctggcgccgcggcgatggaggggctgcacgagactggcccgccgccgttcctgaccaagacgttcgacctggtggccgacccggccaccgacggcgtcgtctcctggggccgcgccgggaacagcttcgtcgtctgggacccgcacctcttcgccgccgtgctgctcccgcgcttcttcaagcacagcaacttctccagctttgtccgccagctcaacacctacggttttagaaagatcgatccagacagatgggaattcgcaaacgagggtttcattcggggccagagacagcttctaaagatgataaagagaaggaggtcattgtcctatctcccttcatcacagcagcaggcccttggctcttgcctcgaggtcggccagttcggattcgacgaagaaatcgaagtgctaaagcgtgacaagaacgccttactcgcagaggtggtgaaactgaggcaggagcagcagagcagcagagctgacatgcgagccatggaagagaggttacaccacgtcgagcagaagtcagctccagatgatgggtttcctggcaagagctattacagaaccctgacttctttctccagctgatccagcaacaaaataaactgaaggacctcgaggacggttacccgacgaagaggaggaggcccatcgacgtaatgccgttccttggtccctgaggggaccagtcagagtgagccactcgagtccacattcatttttgaggacagggaattttcagagctggagaatttagccatgaacattcagggcatcaggaagggcatggaggatgacagaggtggtcggaatcagggctgtggtgaggccgagctgactgacgacttctgggaggagctgctgagtgaaggaatgagggatgaagctgagatgctagagctggagaggaggagatctagatgtttcgacgcgtagcgcaaaatatgggtcatctaagtaacaacgatccaaactctaccagaattcataaccatttaatctatatacagttgtatagatagctgtattgcatattgtagtgctaattcatagtcaaagactgattgtattgcggttccacaccgattatgtggtatatatctagtggtat

SEQ ID NO: 3691 - DNA, 615 bp, Triticum aestivum
  misc_feature (480)..(499): n = any nucleotide
cgcggctacacccagttcgcgccgcactacatcacctggtactgcccggaggccttcgtcctgagcgcgcagtgccggtcgcagtgcatcaaccacggccgctactgcgccccggacccggagcaggactttaccaccgggtatgatgggaaggacgtcgtggtgcagaacctgatccagatctgcctcttcaaggtcgccaacgagagccgcaagccgtggctgtggtgggactatgtgcacgacttcgccatccggtgccccatgaaggagaagaagtacaccaccgattgcgctcatggtgtcatcaagtcccttggaatggacattgacaagattacccagtgcgtcggagaccccgatgccgacgaggacaatccagtgctcaaagcagagcaagatgctcaaattggtcatggtgctcgaggggatgttaccatactgccgactttcgtcgtcaataacagacagtacagaggnnnnnnnnnnnnnnnnnnnnccgtccaaaaggacccagccttagaaaggcgtgattgcgacgtaaagctctctatagtgtccctaattaattcctggcccgcgttacacctctgcctggaaacccgcttcccattt

SEQ ID NO: 3692 - DNA, 937 bp, Triticum aestivum
tcgcttcctccctgccctgccctgccctgctctagcaccggcctgagctcgcgcgtggtgttactgctgagtttggccggaatggggcggtcgccgtgctgcgagaaggagcacaccaacaagggggcctggaccaaggaggaggaccagcggctggtcgcctacatcagggccaacggcgagggctgctggcgctcgctgcccaaggcggccggcctgctccgctgcggcaagagctgccgcctgcgctggatgaactacctccgtcccgacctcaagcgcggcaacttcaccgacgacgaggacgagctcatcatccgcctccacagcctcctcggcaacaagtggtctctgatcgccgggcagctgccgggcaggacggacaacgagatcaagaactactggaacacgcacatcaagcgcaagctcctgtcccgcggcatggacccccacacgcaccgcccgctcacggccgtcgacggcggcgcggcatcccgccctgcacacatagcagtgccggcgagggcagcgccacccacgatgttcgccctgccgacaaagcagccgccggtcgtggagtcgtcgtccgacgacggcagcagcggcgcgacgagcacgggggaaccacggtgccccgacctaaacctcgacctgtcggtgggcccgccggcggccgacacgccgacctcgcacccggtctgcctctgccgccacctcggcttccgcggcggggaggcatgcagctgccgtcaggccgacagcccgggctcccaggggggcgggttcagatatttcaggccgttggaggaaggccagtacatatgagacgagacgagacggctaggccctaggctccacagcaatttgcaagacggtgaatttttccacctccacagcaccaccgtctcacaaaacggtgaaaaaaacggtgaaagaa

SEQ ID NO: 3693 - DNA, 848 bp, Triticum aestivum
  misc_feature (298)..(325): n = any nucleotide
gcgtcgtccccaagctcgcagggctgctgaggtgcgggaagagctgcaggctgaggtggaccaactacctgaggcccgacctcaagcgggggctcctctccgacgaggagcagcagctcttcatcgacctgcacgcgcagctcggcaacaggtggtccaagatcgcggcgcagctgcccgggaggacggacaacgagatcaagaaccactggaacacccacatcaagaagaagctccgcaagatgggcatcgaccccgtcacccaccgcccgctggatcaagtgccccctcgtcccgnnnnnnnnnnnnnnnnnnnnnnnnnnnncaccaccgcgtggcagcagcaggacggcgccgagcactgccagcaagtggaggatgaggacgtgaaggcggtcccgctgatccagccgcacgaggtcacggcgccaccgcccaccgcaagcagcaattgctctgtttcccctgcctcggtcgtctcgccgtcctgctcctcgtccgcggcgtccggtctggaggcggcggagtggccggagccaatgtacctcctcggcatggatggcatcatggacgttggctcgggctgggacgccggcttcgtcgtccccggcggcctcagcgtcgacccgttcgaccactactacccggaccctgcaggcttcgatcaagaagcctggctgtaacgccatccttgcagcagcaatgcacatagacggatcatagatccgcttctttcgccagttcgatctcccctcccctcccctcccctagctagtaggttagcttccatgtcgaaatgttaccgccatacccacctcagcttttcttggaacttggaagaaatgcat

SEQ ID NO: 3694 - DNA, 1245 bp, Triticum aestivum
ctcgctgccgcactgctctgctctagtagaaggtcgatcggcatggggaggtcgccgtgctgcgagaaggagcacaccaacaagggggcgtggaccaaggaggaggaccagcggctgatcgcctacatcagggtcaacggcgagggctgctggcgctcgctgctcaaggcggccggcctgctgcggtgcggcaagagctgccgcctccgctggatgaactacctccggcccgacctcaagcgcggcaacttcaccgacgacgaggacgagctcatcatccgcctccacagcctcctcggcaacaagtggtctctgatcgccgggcagctgccgggcaggacggacaacgagatcaagaactactggaacacgcacatcaagcgcaagctcctctcccgcggcatggacccccatactcaccgcccgctcacgcccgtcgacggcgccgcggcgtcccgcccggcacacatagctgtgccagcgagggcagcgccacccacgatgttcgcccccctgacgacgaagcagcctcccatggagtcgtcgtccgacgacggcagcagcggcgcgacgagcacgggggagccgcggtgccccgacctgaacctcgacctgtcagtgggcccgccggctgccgacacgccgacctcgcacccggtctgcctctgccgccacctcggcctccgcggcggggcggtgtgcagctgccgtcaggccgacagcccgggctcccaggggggcgggttcagatatttcaggccgctggaggaaggccagtacatatgagacgagacaggacggctaggccctaggctccacagcaatttgtaagacggtgaatttttccacctccacagcaccaccgtctcacaaaacggtgaaagaatatctaatctgttcataatatttcaaccatgaatatttgtcctctctgtccctaattttgtatcgttggttggtgctgctgtgctgtgaaaaaaacgaggggataatgtgacaaaggttggtgtgtgttttttgtggaaaaagggagtagctgatgtgaggtagcgggcacattattgtttcgggcatcagattccggtgttcctttcctgtgcagttttggtcgtgtggatggatgttgcgcagggcaatcatgtggtgtgtttttctggtaggtatttcggcttgtctgtgtttgcactccacgaattcttcagttggcagggagttaggcagtggagaaactcgtatggccaaact

SEQ ID NO: 3695 - DNA, 659 bp, Triticum aestivum
gcaagcccaacctcaaccaggacccgcaccggcaggagctggtgaactgggtgaacaaggtgggcggctccggccccggcaccacgttcgacttcaccaccaagggcatcctcaatgtggccgtggagggcgagctgtggcggctgcgcggcactgacggcaaggcgccgggcatgatcgggtggtggccagccaaggcagtgaccttcgtggacaaccacgacaccggctccacgcaacacatgtggcccttcccttctgacagggtcatgcagggatatgcctacatcctcacgcacccagggaccccatgcatcttctacgatcatttcttcgactggggcctgaaggaggagatcgatcgcctggtgtcaatcaggacccgacaggggatacacagtgagagcaagctacaaatcatagaggctgacgccgacctttacctagccgagatcgacagcaaggtcatcgtcaaactcgggccaagatacgatgtcgggcacctcattcccggaggcttcaaggtggtcgcgcacggcaaagattatgccgtatgggagaaaatataagcaaaattaccggagctcatgatgtccacgtagtacgatttagtacttcctccgtgtaaaagtgaggatgagggacatccattgtatttt

SEQ ID NO: 3696 - DNA, 809 bp, Triticum aestivum
cgttgccgccgccgcggcgagagccccggcggcgcaggcgtggggcaaggaggggcactacatgacctgcaagattgccgacggtttcctgacgagcgaggcgtcggcggcggtgaaggagctcctgccgtcgtgggccaacggagagctcgcagaggtatgcgcgtgggcggacaagcagcgcttccggtaccggtggtccagccccctccacttcgccgacacccccggcgactgcaacttcagctacgccagtacgggactgccacgacaccaaggggaacaaggacgtgtgcgtggtaggagctatcaacaactacaccgccgcgctggaggacccctccagcccgtatgaccgggacggagagcctgatgttcctggcgcacttcgtgggcgacgtgcaccagccgctccactgcggccacgtcgacgacctcggcggcaacaccatcaaactccgctggtacaggaggaagagcaacctgcaccacgtgtgggactctgacgtgatcacacaggccatgaaggacttttacaacagggaccaggacaccatgatcgatgccatccagcgcaacatcaccgacgactggtccagcgaggagaagcagtgggaggcgtgcggcagcaaaaccaagatcacctgcgccgaaaagtgagctctcggatcacgatgatgatgagccaatccaaccgcaaaactgaacatgtatatattcagaggctagatctgacggctgagaacggtcgaatgtaggtacgccaaggagagcgcattgctggcctgcgacgacaacgagggcgtcga

SEQ ID NO: 3697 - DNA, 645 bp, Triticum aestivum
gccccgctaccacggtcgacttcaccagcaagggcatcctgaacgtggtccgtggagggcgagctgtggcggctgcgcggcaccgacggcaaggcgccaggcatgatcgggtggtggcccgccaaggcggtgacctttgtggacaaccacgacaccggctccacgcagcacatgtggcccttcccgtctgacagggtcatgcagggatatgcctacatcctcacgcacccaggcaccccatgcatcttctacgatcatttcttcgactggggtctgaaggacgagatcgatcgcctggtgtcaatcaggagcccggcatgggatacacagtgaaagcaagctgcaaatcatagaggccgacgccgacctttatctcgccgagatcgacggcaaggtcatcgtcaagctcgggccaagatatgatgtgggacacctcattccgggaggcttcaaggtggccgcgcatggcaatgactatgcggtatgggagaaaatatgagcaaaattgccgaaggagctctacaattttttccctatgtgtacgtgatacatattggtccgagctcacgttgtccacatagtacgatttagtacttcctccatgtaaaagtgaggacgaggggcatccattgtattctcaaaaaa

SEQ ID NO: 3698 - DNA, 721 bp, Triticum aestivum
gcccaacctcaaccaggaccagcaccgcaggagctggtgaacgggtggacaaggttggcggcaaaggccccgctaccaccgttcgacttcaccaccaagggcatcctgaacgtggccgtggagggcgagctgtggcggctgcgcggcaccgacggcaaggcgcccaggcatgatcgggtggtggcccgccaaggcggtgacctttgtggacaaccacgacaccggctccacgcagcacatgtggcccttcccgtctgacagggtcatgcagggatatgcctacatcctcacgcacccaggcaccccatgcatcttctacgatcatttcttcgactggggcctgaaggacgagatcgatcgcctgatgtcaatcaggacccgacatgggatacacagtaaaagcaagctgcaaatcatagaggccgacgccgatctttatctcgccgagatcgacggcaaggtcatcgtcaagctcgggccaagatacgatgtgggacacctcattccgggaggcttcaaggtgaccgcacacggcaatgactatgccgtatgggagaaaatatgagcaaaattgccgaaggagctctacaattttttccctatgtgtacgtgatacatattggtccgagctcatgttgtccacatagtatttatttagtacttcatccatgtaaaagtgaggacgaggggcatccattgtattctcaataaataataaccg

SEQ ID NO: 3699 - DNA, 641 bp, Triticum aestivum
  misc_feature (30)..(30): n = any nucleotide
  misc_feature (64)..(64): n = any nucleotide
cacgttcgatttcaccaccaaagggcatcntgaacgtggccgtggagggcgagctgttggccgntgcgcggcaccgacggcaaggcgccaggcatgatcgggtggtggcccgccaaggcggtgacctttgtggacaaccacgacaccggctccacgcagcacatgtggcccttcccgtctgacatggtcatgcagggatatgcctacatcctcacgcatccaggcaccccatgcatcttctacgatcatttcttcgactggggcctgaaggacgagatcgatcgcctggtgtcaatcaggacccgacatgggatacacagtgaaagcaagctgcaaatcatagaggccgacgccgatctttatctcgccgagatcgatggcaaggtcatcgtcaagctcgggccaagatacaatgtgggacacctcattccgggaggcttcaaggtggccgcacacggcaatgactatgccgtatgggagaaaatatgagcaaaattgccgaaggagctctacaattttttctctatgtgtacgtgatacatattggtccgagctcacgttgtccacatagtacgattagtacttcctccatgtaaaagtgaggatgagggacatccattgtatttttgctaaaataataa

SEQ ID NO: 3700 - DNA, 671 bp, Triticum aestivum
caaggtgggcggctccggccccggcaccacgttcgacttcaccaccaagggcatcctcaacgtggccgtggagggcgagctctggcggctgcgcggcaccgacggcaaggcgccaggcatgatcgggtggtggccagccaaggcggtgaccttcgtggacaaccatgacaccggctccacgcagcacatgtggcccttcccttctgacagggtcatgcagggatacgcctacatcctcacgcaccctgggaccccatgcatcttctacgatcatttcttcgactggggcctgaaggaggagatcgatcgcctggtgtcaatcaggacccggcaggggatacacagtgagagcaagctgcaaatcatagaggctgacgccgacctttacctggctgagatcgacggcaaggtcatcgtcaagctcgggccaagatacgatgtcgggcacctcattccccaaggcttcaaggtggtcgcgcacggcaatgactatgccgtatgggagaaaatataagcaaaattatccaagcagctccacaattttttttcctatatatgaatgccacacctattagtccgagctcgtgttgtccacatagtacgattttagtacttcctccatgtaaaagtgaggatgagggacatccattgtatttttcataaataataat

SEQ ID NO: 3701 - DNA, 704 bp, Triticum aestivum
ccaggaccagcaccggcaggagctggtgaactgggtgaacaaggtgggcggctccggccccggcaccacgttcgacttcaccaccaaaggcatcctcaacgtggctgtggagggcgagctgtggcggctgcgcggcaccgacggcaaggcgccaggcatgatcgggtggtggccagccaaggcggtgaccttcgtggacaaccatgacaccggctccacgcagcacatgtggcccttcccttccgacaaggtcatgcagggatacgcctacatcctcacgcaccctgggaccccatgcatcttctacgatcatttcttcgactgggggctgaaggaggagatcgatcgcctggtgtcaatcaggacccggcaggggatacacagtgagagcaagctgcaaatcatagaggccgacgccgacctttacctggccgagatcgatggcaaggtcatcgtcaagctcgggccaagatacgatgtcgggcacctcattcctcaaggcttcaaggtggtcgcgcacggcaatgactatgccgtatgggagaaaatataagcaaaattatccgagctgctccacaatttttcttccctatatatgaatgtcacacctattagtccgagctcgtgttgtccacatagtacgattttagtacttcctccatgtaaaagtgaggatgagggacatccattgtatttttcataaa

SEQ ID NO: 3702 - DNA, 711 bp, Triticum aestivum
gtcgctggcgtacggcggggacggcaagccgaacctcaaccaggacccgcaccggcaggagctggtgaactgggtgaacaaggtgggcggctccggcccgggcaccacgttcgacttcaccaccaagggcatcctcaacgtcgccgtggagggcgagctgtggcggctgcgcggcaccgacggcaaggcgccgggcatgatcggatggtggccagccaaggcggtgaccttcgtcgacaaccacgacaccggctccacgcagcacatgtggcccttcccttctgacagggtcatgcagggatacgcctacatcctcacgcacccagggaccccatgcatcttctacgatcatttcttcgactggggcctgaaggaggagatcgatcgcctagtgtcaatcaggacccggcagggcatacacagtgagagcaagctgcaaatcatagaggctgacgccgacctttaccttgccgagatcgacggcaaggtcatcgtcaagctcgggccaagatacgatgtggggcacctcattcccggaggcttcaaggtggccgcacacggcaaagactatgccgtatgggagaaaatataagaaaattaccagagcaactctgcaaattagtcatgttgtccacatagtacgattttagtacttcctccatgtaaaagtgaggatgagggacatcaattgtatttttcataaatgagaat

SEQ ID NO: 3703 - DNA, 743 bp, Triticum aestivum
  misc_feature (709)..(709): n = any nucleotide
caaccaggaccgcaccggcaggagctggtgaactgggtgaacaatgtgggcggctccggcacgggcaccacgttcgacttcaccaccaagggcatcctcaacgtcgccgtggagggcgagctgtggcggctgcgcggcaccgacggcaaggcgccgggcatgatcgggtggtggccagccaaggcggtgaccttcgtcgacaaccatgacaccggctccacgcagcatatgtggcccttcccttccgacagtgtcatgcagggatacgcgtacatcctcacgcacccagggaccccgtgcatcttctacgatcatttcttcgactggggcatgaaggacgagatctatcgcctagtgtcaatcaggacccggcaggggatacacagtgagagcaagctacaaatcatggaggctgacgccgacctttaccttgccgagatcgacggcaagatcatcgtcaagctcgggccacgattcgatgtggggcacctcattcccggaggcttcaaggtggccgcacacggcaaagactatgccgtatgggagaaaatataagaaaattaccagagcagctctgcaaattagtcatgttgtccacatagtacgattttagtacttcctccatgtaaaagtgaggatgagggacgtccattgcatttttcataaataataatcaataagcgttttgctattcatggtttactcaatnttcgttgaccaaaagttgcatagagcatgaccgt

SEQ ID NO: 3704 - DNA, 722 bp, Triticum aestivum
acctgaaccaggaccagcaccggcaggagctggtgaactgggtggacaaggtcggcggcaaaggccccgctaccacgttcgacttcaccaccaagggcatcctgaacgtcgccgtggagggcgagctgtggcggctgcgcggcaccgacggcaaggcgccaggcatgatcgggtggtggccagccaaggcggtgaccttcgtggacaaccacgacaccggatccacgcagcacatgtggcccttcccttctgacagggtcatgcagggatatgcctacatcctcacgcacccagggaccccatgcatcttctacgatcatttcttcgattggggccttaaggaggagatcgatcgcctggtgtcaatcaggacccggcatgggatacacagtgagagcaagctgcaaatcatagaggccgacgccgacctttatctcgccgagatcgacggcaaggtcatcgtcaagctcgggccaagatacgatgtggggcacctcattccgggaggcttcaaggtgggcgcgcacggcaatgactatgccgtatgggagaaaatatgagcaaaattaccaaagcagctctacgagttttttacaatatgaatgacatacatattagtccgagctcacgttgtccacatagtacgatttagtacttcctccatgtaaaagtgaggatgagggacattcattgtatttttgataaaataataaacaataagg

SEQ ID NO: 3705 - DNA, 673 bp, Triticum aestivum
actgggtggacaaggttggcggcaaaggccccgctaccacctttgacttcaccaccaagggcatcctgaacgtcgccgtggagggcgagctgtggcggctgcgcggcaccgacggcaaggcgccaggcatgatcgggtggtggccagccaaggcggtgaccttcgtggacaaccacgacaccggctccacgcagcacatgtggcccttcccgtctgacagggtcatgcagggatatgcctacatcctgacgcacccagggaccccatgcatcttctacgatcatttcttcgactggggccttaaggaggagatcgatcgtctggtgtcaatcaggacccgacatgggatacacagtgagagcaagctgcaaatcatagaggctgactctgacctttatctcgctgagatcgacggcaaggtcatcgtcaagctcgggccaagatacgatgtgggacacctcattccgggaggcttcaaggtggccgcgcatggcaatgactatgcggtgtgggagaaaatatgagcaaaattaccagagcagctctacgagttttttacaatatgaatgacatacatattagtccgagctcatgttgtccacatagtacgatttagtacttcctccatgtaaaagtgaggatgagggacatccattgtatttttaataaaata

SEQ ID NO: 3706 - DNA, 807 bp, Triticum aestivum
cgggggcgaacgtgaacgccggcgtcgacccggggcgatcgagaagctgtacgaggacgtgccgccgatgccgctgatggcgctgaaccacatctcgcgcctctgcaagtccgtcgacgcctccgtccggttctacgtcaaggcgctcggcttcgtcctcatccaccgccctcccgcgctcgacttctccggcgcctggctgttcaactacggcatcgggatccatctcgtccagagagacgacgcgcgacgggccgccgacgtcaaccccggcaagctcgaccccatggacaaccacatatcgttccagtgcgaggacatgggcgcgatggagaagaggctgaaggagatggggatcaggtacatgaagaggaccatcaacgaggaggagggttcgccgatcgaccagctcttcttcaaggaccccgacggcttcatgatcgagatctgcaactgcgagaacctcgagctcgtccccgccggcgcgctcggccgcctcaggctcccccgcgaccgccacaacccgcctctccggatggacggcgccgacgagtagcaccaagccagacgtagcaaggggcctgcgcgcgcgtgcgtagctaagtaagttagctagtggtgtaacgaactgctgttacgttttaattctgggcagtactcccaggttcctctttactagtatgttgcgtcgtgtgtgtttcccaatcagctggtagctgcaccctgattttttgctggccagtgctcggtcccgcttcgcctactgtattatgctaagagagcttttatagtgctccggctaaaata

SEQ ID NO: 3707 - DNA, 537 bp, Triticum aestivum
gagatggcaactacattcgcggcaccaattctctgcaacttgagagcgaacccacgcctgaaccacagcaccagacaacagccacggcacttgcacctgagctcggcgagaatggcgccaacgctgacaggctcaagagcacggagcgacttccgcgcggcggccgtgtacaaggtgaagctgatcgggccggaggggaaggagagcgtgatcgaggtggcggaggacagctacatcctggacgcggcggaggaggccggcgtggagctgccctactcgtgccgcgccggcgcgtgctccacctgcgccggcaaggtcctggagggcggcgtggaccagtcggaccagtcattcctcgacgacgcgcaggtcagcgccggtacgcgctcacctgcgtcgcttaccccacctccgacctcgtcatccagacgcacaaggagtccgacctctactagcatgtagcagcagcactagtttcattcaatctttgacactctgtctgatctgatctgcctgcatatgtagtgtcacctgaat

SEQ ID NO: 3708 - DNA, 625 bp, Triticum aestivum
taaagtcgaacaacatcatcctctcgcgggactgaacgcgtgcgttttcggacttcggccttcgcagttcatggccacccctcacttcgacccgcggctcgtcgggtaccgcgcgccggaggtcctggaggccaagaagccgacgcaaaagtccgacgtgtacagcttcggcgtgctgctcctggagatgctgaccgggaaggcccccttgaggtcccccggccgcgacgactccatcgagcacctcccgaggtgggtgcagtccgtggtccgggaggagtggacgtcggaggtcttcgacgtcgacctgcagaggcaccccaacaccgaggacgagatggtgcagctgctccaagtcgccatggcgtgcgtcgccgttcatccggaccagcggccgaggatggagcaggtcgtcaggaggatcgaggagatccggagctccggctccgggacgacgacgaggacgtctcccgaggacaagccgagggaagagcacatccagatcacctgaggcgaagacaataggtctgatactgatagcgtccccgtctgcctgcaaactaagttgacggccgttttgtttactgataccattcttttactagcagtaagtaaatttgcttcc

SEQ ID NO: 3709 - DNA, 445 bp, Triticum aestivum
cgagaaccaacggtacagatgatgatgggaaggagagcgtgatcgaggtggcggaggacagctacatcctggacgcggcggaggaggccggcgtggagctgccctactcgtgccgcgccggcgcgtgctccacctgcgccggcaaggtcctggagggcggcgtggaccagtcggaccagtcgttcctggacgacgcgcaggtcggcgccggctacgcgctcacctgcgtcgcctaccccacctccgacctcgtcatcgagacgcacaaggagtccgacctctactagcatgtagcagcactagtttcgttcaatctttggcagtctgtctgatctgatccgcctgcatatgtaagctgtcgcctgaatcttagctaaattttattcttgcttcatcgccgtcgactttaaaccttggaggcaaaggttggcaccttttttttttt

SEQ ID NO: 3710 - DNA, 696 bp, Triticum aestivum
ccccttgcctcgctccggattgctagcgcggcggccgcacacttccttcccttccctaccagttaccagaccccaagcacccgagatggcaactacattcacggcaccaattctgtgcaacttgagagcgaacccacgcctgaaccacagcaccagacaacaacaggcggacttgcacctgagctcggcgagaatggcgcccacgctgacaggctcaagagcacggagcgacttgcgcgcggcggcggtgtacaaggtgaagctgatcgggccggaggggaaggagagcgtgatcgaggtggcggaggacagctacatcctggacgcggcggaggaggccggcgtggagctgccctactcgtgccgcgccggcgcgtgctccacctgcgccggcaaggtcctggagggcggcgtggaccagtcggaccagtccttcctggacgacgcgcaggtcggcgccggctacgcgctcacctgcgtcgcctaccccacctccgacctcatcatccagacgcacaaggagtccgacctctactagcagcactagtttcattcaatctttggcactgtgagtgtgatctgatccgcctgcataatgtagctgtcgcctgaatcttagctaaattttattctcacccccccttcatcgccgtcgacttttacctgagcaagtgcactttgtattttccaaaaaaa

SEQ ID NO: 3711 - DNA, 594 bp, Triticum aestivum
gtacgagttccagatgcagtacggctccatcgggtgttcggtcggggcgctgctcggctacgcgcagggcgccactgacaagcgtgtcatcgcttgcatcggcgacggcagcttccaggtgacggcgcaggacgtgtccaccatgctccgctgcgggcagaacagcatcatcttcctcatcaactacggcggctacaccatcgaggtcgagatccacgacgggccctacaacgtcatcaagaactggaactacaccggcctcatcgacgccatccacaacggcgagggcaactgctggaccgccaaggtgacctgcgaggaggagctgacggcggccatcgagacggcgacgggggacaagaaggactgcctgtgcttcatcgaggtggtggcgcacaaggacgacaccagcaaggagctcctcgagtggggatcaagggtctccgccgccaactccaggccacccaacccgcagtagacgacactagtagatcttgattttgatgatttgagcgaggcattttcgatttagagtccaacgtacgtttgattactagcatgcgtgcatgcatgcaagcttagcatactgtttag

SEQ ID NO: 3712 - DNA, 615 bp, Triticum aestivum
ccaccttcccctgcacacaacccaccaccggaatccccacccgccctctcgaagcagcagctagcgatggcccccaaggcggcggagaagaagccggcggcgaagaagcccgcggaggaggagccggcgacggagaaggccccggccgggaagaagcccaaggccgagaagcggctgccggcggccaagacggcggccaaggagggcgaaggcaagacgaggggccggaagaagggcggcaaggccaagaagggcgtggagacgtacaagatctacatcttcaaggtgctgaagcaggtgcacccggacgtcggcatctcctccaaggccatgtccatcatgaactccttcatcaacgacatcttcgagaagctcgccggcgaggccgccaagctcgcccgctacaacaagaagcccaccatcacctcccgggaggtccagacctccgtccgcctcgtcctccccggcgagctcgccaagcacgccgtctccgagggcaccaaggccgtcaccaagttcacctcctcgtagattctattctttgtagaaatgtagatggttctgttacttttagtggttgttgactctggttatctgcaaatcgttcaagtaata

SEQ ID NO: 3713 - DNA, 755 bp, Triticum aestivum
ggcgacgactcggcgcgcgcggcggttggttcggagccgacgagggccactcggggcacgcgaagggagcgcggcgccggcctccgccgtgggtgctcgcggcatcggcgaggacgacctcctcgaggggtttcgcagcccaggtaagccggaatcaaacagttcatcctcagacgaacttcccttgttgcaatggaatccaagttctttcggttcctgaagcttgtcggagttggtttcaaagcaaggacagagcatgaggccgtgagttgtttctgaaacttggctacagccacgaggtgcagttcaccgctccacccgccgtccgtgtcttctgcttcaaacccaacataatatgctgcactggcatcgacaagcacagggtgcaccatttcgcgggagccgtccgaagcagtaaacctccggaagtgtacaaggggaagggcatactgtacatcgatgaggtcataaagctgaagccggggaagaagcagcagaagaagtaacacatgggtgagcttccccatttgacttctagcctgttgttaagacgccgcgctgcatttgtggttccgcagatttcatgtggttttctctgtgccggattttggcaggccccggtaccaggctggacctagtaataatactctgtatgcgacgtatgtgaaacgtctgatgaatttgttgtatatgacttgcataccgtggggtggatcggcggattccaacttttttgttttgttttgagctggcta

SEQ ID NO: 3714 - DNA, 458 bp, Triticum aestivum
cacaaagacaagtcaacctcaccggagagaaaggagaagcgaagatgtcggggcgcggcaagggaggcaagggtctgggcaagggcggcgccaagcgccaccggaaggtgctgcgggacaacatccagggcatcaccaagccggcgatccggcgcctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcgggggctaggctccggcgaggcgaatcgagctcgcaccacttgatcagatgttcagattagcagtagctaggcgttgttcagtgttaccggtgatcgatgtaatttatgat

SEQ ID NO: 3715 - DNA, 641 bp, Triticum aestivum
gatatgagcagccttgtgatccgtgcgtgcaggtacgagttccagatgcagtacggctccatcggctggtcggtcggggcgctgctcgggtacgcgcagggcgccacggacaagcgcgtcatcgcctgcatcggcgacggcagcttccaggtaacggcgcaggacgtgtccaccatgctccgctgcggccacaacagcatcatcttcctcatcaacaacggcggctacaccatcgaggtcgagatccacgacgggccctacaacgtcatcaagaattggaactacaccggcctcatcgacgccatccacaacggcgagggaaactgctggaccgccaaggtgacgtgcgaggaggagctgacggcggccatcgagacggcgaccagggacaagaaggactgcctgtgcttcatcgaggtggtggcgcaacaaggatgacaccagcaaggagctcctcgagtggggatccagggtctccgccgccaactccaggccacccaacccgcagtagacaccagtagcagatctagatttttgatgatttgagccaggcattttcgatttactagaatccgacgtacgtttgattttactagcatgcttgcatgcatgcaaacttcgaatatattagtatttctagg

SEQ ID NO: 3716 - DNA, 607 bp, Triticum aestivum
  misc_feature (42)..(42): n = any nucleotide
tattcagattgatcccaaaggacatgagaaagaagccaagcngaagattaagcgctacatgacgattatggattccatgacagcagcagagctcgacagtacaaacccgaagctgatgacagagtcgcgaatcatccggatcgctcgagggtctggcaggcaaatcagagacgtgacggacatgctggaagagtacaagaggctagccaagatgtggagcaagatgaaggggctaaagatgccgaagaacggaaagatgagtgacctgtcccagaaccttaacatccagcagatgaccaaggcgctcccgccgcaagtgctgaagcagatgggtggcatgggtggcctgcaggctcttatgaaacaaatgggcggcaaggacatgagcaaaatgctcggtggcatggggctgggcggtgattagcctggcaaatgtaggtagagtttcctctgggcataggtggtgtgcttgctgcgttgtggagtttgttatatttatatagatctcaaaagatttccatcctgacaaatatagtccccaactcctgacaaatttatttgaaatttctctgcaactaacatctaccaggtcatcaaatttacagct

SEQ ID NO: 3717 - DNA, 806 bp, Triticum aestivum
  misc_feature (754)..(754): n = any nucleotide
ccacttcgctagtttactgcagcgtggggagtggatctccggcgagcacgagacgagctccgatggcgagcggaggcggatacgcctgggccctcgcggcgggcctcaacgccgcgctcgccgccatctccgccaagttcttcgctcccatgttgctcaaatacggcatggtgatacttttcaacgtgacaatgtgggggtgctacgtgaacagcctcaaagctttgtcctccctccaggcaacagtcaccaacttcgctgccaacttcatctcgtcgggtcttgcagggtatttcctgtttcaggagcctctgccttccaagtggtttgcaggtgccagtgtgatcattcttggtgtgttcatcctcagcaaatcaagcattgaggagaaagtgaactctgattgattgggagttgctagccgtctgatagctgggacataaattttgcgagcttatacctctatttccagtgcgtgtttgctcgtcctgatacaatgttaaacatccgaaattaatgtgtacatttggtctcagctcatccactaacatgtacactagtatggtttgagatacacgacccagtttgtaatttgtactccatccgtccgaaaaaacttgtccctcaaatggatgtatgtagcaccaagttagtgctagatacatccattcgagggacaagcttgggacaagttttatcggacggagggagtaagtaagaagtgagcacatgatctaagagttgcttgctttcnttcacggatagggcattcaaactgttttagcattatcaatgatcttaggtat

SEQ ID NO: 3718 - DNA, 837 bp, Triticum aestivum
  misc_feature (522)..(552): n = any nucleotide
ccgcgcttctacctccaggacgcctcgctccggcagctgacgtgctcaccgccaacgcctccgccgcggcggcgtgctctccaccgtgctccaggtcaccgtcgcctcccgcaaccccaacgaccgcgtcggcgtctacctacgaccgcctcgacgtctacgcctcctacaagtaccagcagatcacgctggcctccgcgctcccgccggtgtaccagggccacggcgacgtcgaggtgtggtccccggtgctctccggcccgaacgtccccttcgcgccctacctcgccgacgcgctcgccaaggacgtccaggccaggtacctcatcctccaggtgaagatcgacggccgcgtccggtggaaggtgggcagctggatctccggccactaccacatcttcgtgacctgccccgccttcctcatcggcaccggcggcaacggcgcgcccggggccaacgggctcaggttccagaccgccacctactgccacgtcgaggtctagccgtccgtccgtacgtgcnnnnnnnnnnnnnnnnnnnnnnnnnnnnnnnctgctccgtcggcggcggcgaggtaggtttcttgcgggtggcgcgcgcgcgtgcgcgtagccaagaagatcatcaaggctgaaggccaagggggtggtacatggtggtaataagtgttagcgtcgaggggtataggtgtaaaaaggaaaagagaatttagtgttggttactcctactaaattgtgttttgctcgtttttaattgttggtaaggtatttattccacgtttaattgtcgatatatataaacctgttgttacgacggaattaaagtgaaatggttaat

SEQ ID NO: 3719 - DNA, 687 bp, Triticum aestivum
tccacgtgaaggaagggaggcctgtttgagttcctgtatgaaaggataaagaagaagggacatgctgtcgtcgtcgttgctgaaggcgctggtcaggaggtggattccccggactgatgaccagaagcgcgagcaggatgagtctggcaacatgctgttccttgatgttggcccctggctgaaatctgagctgggtagatggtggaagagagaacaccccactgagttgttcactgtgaagtatatcgatcctacctacatgattcgagcagtcccagcaaatgctactgataatctatattgtaccctgttggcgcattcagccatccatgggatcatggctgggttcactggcttcgtacctggcccgataaatgggaattacagctacataccactggaagatattgccgtggccaagaacccagtggatgtgaatgatcacaaatgggcatgggttagatcagtcacagaccagcctgatttcctaaagccctaagattaaggcccaagttctgcggtgccaggaagtagtaagttgatctacccctctctggatgacagtcaaaattattttcttttaatctaggtttccgttcttcaataaagcatcagtgagcgtgttctctggtttgtgtgtttgtgtgtatgtctgcaaagttgttgtaattctgttgtaagtatgat

SEQ ID NO: 3720 - DNA, 613 bp, Triticum aestivum
ccggccgccgagagcaaggtcgagaaggcggcggagaagaccccggcgggcaagaagcccaaggccgagaagcgggtgccggcgggcaagacggcggccaaggagggcggcgagggcaagacgaggggccggaagaagggcagcaaggccaagaagagcgtggagacgtacaagatctacatcttcaaggtgctgaagcaggtgcacccggacgtgggcatctcctccaaggccatgtccatcatgaactccttcatcaacgacatcttcgagaagctcgccggggagtcggccaagctggcgcgctacaacaagaagcccaccatcacctcccgggagatccagacctccgtccgcctcgtcctccccggcgagctcgccaagcacgccgtctccgagggcaccaaggccgtcaccaagttcacctcctcctagactgaatctctgattgcgtcgccttgttgttccaaatgtagtagttggctgctgctgactctgcttatctctctgcaagtagtggtagtggtggatgattgccaacgctctgttggctccttggttgttagaggtgaacttgttgcttttgcaaactgatatcagtatccagaaaacg

SEQ ID NO: 3721 - DNA, 798 bp, Triticum aestivum
agttccagagccggaagagctgaaaagcatttgctcggtacgatgtcgcaactgtcctaaagaagttctactcccttcaattagatgaccttgctgcccctcctggagtagaggtcatagatttttttgaggcatcatcatccccacttccttggatgtcggaggaagaactgggacagtatgccgagaagtttcagaagtctggcttcacaggacccctcaactactaccgcgccatggacacgaactggaagcttagtgcgccctggcatggtgcaaagatcatggtgcctgcgaagttcatcgggggtgagaaggacatcggtgtcgagtcctttggagtcaagcgctacatcgagagcgggggtttcaagtccaatgttcctgatcttgaggtttccatcattgaaggacaccatttcctccagcaagagcaggccgagagggtgaactctgagatactgtccttcctggacaagctttctggagaggaagcacataataagaacgaagttggcgaggaggtgggtaactaagaaccgagtaaaaactaaaaagatagtgtatgagcttgttttagattgtgaaagttgtcttttctaaactgaaatataagctggtggaccgacatactcaaataaatgtcagagataggcttcaataaagtgtactcctggttaacagaatacaaaggggaccttcgaaggtgaactcctttctaatgtggtactccctccgttcgaaaaaacttgtcccaagcttgtcccttaaatggatgtatctagcactaatttgatg

SEQ ID NO: 3722 - DNA, 700 bp, Triticum aestivum
cccacccgaagcggcagcccatggccccccaaggcagacaagaagccggccgccgagaacaaggtcgagaaggcggcggagaagacccccgcgggcaagaagcccaaggccgagaagcggctgccggcggggcaagacggcgtccaaggaggccggcggcgagggcaagacccggggccgcaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcccgctacaacaagaagcccaccatcacctcccgggagatccagacctccgtccgcctcgtcctccccggggagctcgccaagcacgccgtctccgagggcaccaaggccgtcaccaagttcacctcctcctagactgaagatgcgccgcttgttgtgccagatgtggctgtctgatgtatctctgctgttgactctgcttacctgcaagtagaagtagtggtagtagttcgtgtggtagaagattgccaacgctttgttggcttcttggttgtgagaactgaacgtgttgcttttgcaaaatgaaatctatctagaaaatgttgcggttgtggtactactacatctatg

SEQ ID NO: 3723 - DNA, 600 bp, Triticum aestivum
  misc_feature (176)..(199): n = any nucleotide
gcaagtctcccacctcgcgcgttgcaaccttccccaatccgatctcttgtcgcctccgccgaagccgccatggcgcccaaggccgagaagaagcccgctgcggagaagaagccggtggagacagagaagaagcccaaggccgagaagcgcgtgcccggcaaggacggcggcgccgnnnnnnnnnnnnnnnnnnnnnnnngcgtcgagacctacaagatctacatcttcaaggtgctcaagcaggtccaccccgacatcggcatctcctccaaggccatgtccatcatgaactccttcatcaacgacatcttcgagaagctcgccggcgagtcggccaagctcgcgcgctacaacaagaagcccaccatcacctcccgggagatccagaccgccgtgcgcctcgtcctccccggcgagctcgccaagcacgccgtctccgagggcaccaaggccgtcaccaagttcacctcctcttagattaccgtcgcctgaatctcttattggctttgttccgaatgttcctatgtcgtcaatcatagggggttatattcccctttacagacagtgtaaaaatgagtcagatttgctaaactcaatgaa

SEQ ID NO: 3724 - DNA, 945 bp, Triticum aestivum
gcgacacaaactgcaaagcatgatgttatggattggacttctgcgagagggtggttgaatttgcctattggattaacattggaacatgagatatacaaggcagcagtatcccttaggagctacagtcaggtttcaaggataaacccgggaaaatctattccgcatgcagtccttagtggagcaagtggacttgctatcttgacagttgtaaaagctggtgcatttcttacatacaaacttggaactggcttagtagttgctcgtagatcagatggatcatggtctccaccctctgctatagcttcagctggattaggatggggagcacagcttggtggtgagttgatggatttcatcatagtgcttcatggccttgaagctgtgaaaaccttcagcagccgaatgcatttttcactcggtgcaggtttaagtgctgcagcaggacctgttggtagagtattagaagctgatgtgagagctggtaataaaggttctggagtttgctatacatatagtcacagcaaaggcgcatttatcggggtttctctagaagggaacattgttaccaccaggatggatgcccatctgcggttctacggcgacccgtatctgacgaccagtgatatacttatggggaatctggagcaaccaaatgctgctaaatttctgtacccagcgttggatgacctatactcgggtctggattgttagcacgaccaaaaaaaaaatcacatctgtacatatttgattttattccaactgtagctagttgtgttgattctcaaaatgcttctgtcagtttggcgggcagggtttgcttcagataaacagctgcaacctgttgccctaggatggaagtctgtaaagtcaatgtcttgctatgaatttgatcagcagaatgaaatacactataaacagtactgtatgtattttggagtaattttt

SEQ ID NO: 3725 - DNA, 483 bp, Triticum aestivum
ctcgaaccaaggagggatcgtcagccatgtccgggcgcggcaagggaggcaaggggctcggcaagggcggcgccaagcggcacaggaaggtgctgcgcgacaacatccagggcatcaccaagccggcgatccggcgcctggcgaggaggggcggcgtgaagcgcatctcggggctcatctacgaggagacccgcggcgtgctcaagatcttcctcgagaacgtcatccgcgacgccgtcacctacaccgagcacgcccgacgcaagaccgtcaccgccatggacgtcgtctacgcgctcaagcgccagggccgcaccctctacggcttcggcggctaggcttttcctcgcccccctcccctgcagatatcccaaagcttgatggaaccgcggcttgtttagctctctatttgctctgtagttcgaactgaatcgtggaacaagtgcttcgcatatgttgctggaaatcaacttgtctcagtga

SEQ ID NO: 3726 - DNA, 593 bp, Triticum aestivum
ggcggcccccgctcgaacttaacctccccacacgctcgaaccagcggcacccatggcacccaagcggcggagaagaagccggtggcggcggcggagaagaccccggccgggaagaagcccaaggcggagaagcgggcgccggcgtccaaggaggccggcggcgaggggaagacgaggggcaggaagaagggcagcaaggccaagaagggcgtggagacgtacaagatctacatcttcaaggtgctcaagcaggtgcaccccgacatcggcatctcctccaaggccatgtccatcatgaactccttcatcaacgacatcttcgagaagctcgccggggagtccgccaagctcgcccgctacaacaagaagcccaccatcacgtcccgggagatccagacctccgtccgcctcgtcctccccggcgagctcgccaagcacgccgtctcagagggcaccaaggccgtcaccaagttcacctcatcctaggcttcgtcgtcgtttcatgagttgatggcatcgtgtaggtagttggcagtatgatgttacaatctctgtaagaattgtgctgcttgcggccttgaagaaatagtaat

SEQ ID NO: 3727 - DNA, 566 bp, Triticum aestivum
  misc_feature (88)..(88): n = any nucleotide
cgcatccatgcccccaagcggagaagaaccgtgctggagaagctcgagaagacgacggcggcgaagaagaccaaggccgagaagcgcncgccggcgtccaaggagggcggcgagaagaagggcaagaagaagtccaagaagagcgtggagacttacaagatctacatcttcaaggtgctgaagcaggtgcacccggacatcggcatctcctccaaggccatgtccatcatgaactccttcatcaacgacatcttcgagaagctcgccggcgagtcggccaagctcgccaggtacaacaagaagcccactatcacgtccagggagatccagacctccgtccgcctcgtcctccccggcgagctcgccaagcacgccgtctctgagggtacaaaggccgtcaccaagttcacatccgcttagataccctgctcttgtgttttctctgaatgtgttgatttctcctggctgttgatgaatccattgttcgttgtagttagatgttcagagtgcatcatcttgtaatttgtgacgacacaaatgtttcaggatccggaggaaatagtaat

SEQ ID NO: 3728 - DNA, 667 bp, Triticum aestivum
gccgccaccacagctcctcctccatttgcatctcactcagctccaaggaagaagccgtcagccatgtccggccgcggcaagggagggaaggggctgggcaagggaggcgccaagcgccaccggaaggtgctgcgcgacaacatccagggcatcaccaagccggccatccgtcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacaggggcgcaccctctacggcttcggcggctgatctgctgatgctgctccgtccagtatcgtccagctgctgttccatctgccggagtgcgcgtgttgttccgtcgttctgtgtagcagggtcagccatgaatacgaatgcaatgaaatcagagttcttgcggtgttaattatcttggatgcatctctcgacatgtttctgtaagcttgttaaattcttcccagcaagaaaagcttaggagataatgtactagctgaggtaaatattggaaattcacgaaccaatctctgagcaaacattacactaaacggctaaaggtgtgaat

SEQ ID NO: 3729 - DNA, 722 bp, Triticum aestivum
agtggatctccggcgagcgcgagacgagctccgatggcgagcggaggcggatacgctgggccctcgcggcgggcctcaacgccgcgctcgccgccatctccgccaagttcttcgctcccacgttgctgaaatacggcatggtgatacttttcaacgtgacaatgtgggggtgctacgtgaacagcctcaaagctttgtcgtccctccaggcaacggtcaccaacttcgccgccaacttcatctcgtcaggtcttgcagggtagtttcctgtttcaggagcctctgccttccgagtggtttgcaggtgccagtctgatcattcttggtgtgttcatcctcagcgaatcaagcattgaggagaaagtgaactctgattgattgggagttgctacaagtctgttagctggggcataaatttttgagcttatgccactatttccagtggatgtttgctcgtcctgatgcaatgctaaacatccgaaaataatgtgtgcatttggtctcagctcatccactatcatgtacactagtacggtttgagatccagcacccaatttgtaatttgtaggtaagtgagcacacgatgtaggagttgcttgctttgcttttttccacggggagggcatttcaaactgctgtagcattgtcggtggatctatattttgcatttctcttgttgtaattttgtgacatcacattaagctgatcacatactatgtgta

SEQ ID NO: 3730 - DNA, 770 bp, Triticum aestivum
cggcgaccacttcgctagtttgctgcagcgtggggagtggatctccggcgagagcaagactagctccgatggcgagccgaggcggatacgcctgggccctcgcggcgggcctcaacgccgcgctcgccgccatctccgccaagttcttcgcgcccatgttgctcaaatacggaatggtgatacttttcaacgtgacaatgtgggggtgctacgtgaacagcctcaaagctttgtcgtccctccaggcaacggtcaccaacttcgccgccaacttcatctcgtcaggtcttgcagggtatttcctgtttcaggaacctctgccttctaagtggtttgcaggtgccagtctgatcattcttggtgtgttcatcctcagcaaatcaagtattgaggagaaagtgaactctgattgattgggagttgctaccagtctgttagctgggacataaattttgcaagcttattcctatatttccagtggctgtgtgctcgtcctgatgcaattctaagtatccgaaaataatgtgtgcatttggtctcagctcatccactaacatgtacactagtacagtttaagatacaccacccaatttgtaacggtttaagatacaccacccaatttgtaatttgtaagtaagaagtgagcacatgatctaagagttgcttgctttggtttcaacgggagggcattcaaactgttgtagcattatcggtggatcttttttgttctttgcatttctcctgttgtaaatttgtgacatcacagttaa

SEQ ID NO: 3731 - DNA, 1221 bp, Triticum aestivum
gattaatttcctactcatggtcgtgcgatactctaccacaccaacttaattatatatacacagctagctatctcctcttcaacaccaacacatagcacaactagattactactagagttcagttcagaccttggatcacacgcgcaaacacaagctagtagtagagtactacaagatggccggaggcggagaagaagaggcgaagctgctgggcacgtgggcgagcccgttcgtcctgcgagcgcagcttgcgctcagcttcaagggcgtgagcttcgagaacgtcaacgaggacctctgcaacaagagcgacctcctcctgcgctccaaccccgtgcacaaggcggtgcccgtgctcatccacaacggcaggcccgtctgcgagtcgctggtcatcctgcagtacgtcgacgaggcctttggcgggacgcccctcctccccgccgacccctacgaccgcgccatcgcccgcttctgggccacctacgtcaacgacacgttcttcccgtcgtggaggccgctgttcaggcgacgacggcggagcagagagcggaggcgttcgagaacgtgctgcctcaggtggagacgctggagcgggctctcacggagtgctccaaggggaaggccttcttcggcggcgacgccgtcgggatcgtcgacctcgcgctcggaagcttcgtggtgtggatccgggcggtggacgaattgggcggcaccaacctgctggacgaggccagggtcccgggcctggcggcgtgggccgagcggttcatggccgtagacgccgtggaggaggtgatgcccgaggccgggaggatcatggagcactacaaagggtttctcgcgaaactggctgcacctgctggttctagctaattgcgatgctcgcctactttttcgtcagtgatatgtgagaaatatttaagctctgcttggaagtgtgcgtgttgaataaagagagcaaaatgtgttgtcagtgtgttcagatgtaattgtgttcaataaagagatctgtatagtggaacaattctagtgggtattaatctatcgtcttgatggttatgatttttttttatttttatgaaggggagcaggatggcatgatttataccccggtaatatcagtagaagcacgagtatcacgtatgatctaaccatgttaactgtaaactgatagtctcatcttcagataagcatcttttatactgatttataacagag

SEQ ID NO: 3732 - DNA, 782 bp, Triticum aestivum
gggacccgtccctgtccgccaccgcgcagttcacgctcgcctcccgcaacccccacgaccgcgtcggcgtcctctaccggcgcctcgacgtcttcgtcacctaccgcgacgagcccgtgaccgtgccggtgtctctgccgcccgcgtaccagggccaccgggacgtcaccatctggtcccccgtgctgtccggggagtccgtgcccgtggccgggttcgtcgccgacgccatgaagcaggacatcgccgccgggtacgtggcgctgcaggtcaaggtcgacggccgcgtccggtggaaggtcggcagctgggtctccggcagctaccacctcttcgtcagctgccctgcggtgcttgccgccggccccggcggtgtcccgcccggggctggtggccccacggcaccgccggccgcgccgtcgcgtcgctgaagttcacgcagcccacagggtgcaccgtcggcacgtgaaggaaattacgtactaacgtgcctacgtggaagaaattatgtactaagtagcggtttaattttctgcttatgtctcgtgtaacgggagaataaaatgtacttcaattttggaactaacgattgcatttgtatttctttgccgtcgcatcatgatctatctatgggccgttaagagcgggcatatataagttcttccgaatatttaaaatgtaaatggtgcagcatatataagttctcccgaatggtttagttttcgtgtcatgtctcatgtaacgtgagaataaaatttaattcatttttaaacctaacattg

SEQ ID NO: 3733 - DNA, 763 bp, Triticum aestivum
tgccaccaaggagggtctgaagctcgatgagagcgaggatgagaagaagaagcaggaggagctcaaggagaagttcgaggggctgtgcaaggtcatcaaggaggtgctgggcgacaaggtggagaaggtcatcgtctctgaccgtgttgtggactccccttgctgtctggtgactggcgagtatgggtggaccgccaacatggagaggatcatgaaggcccaggccttgagggactcgagcatggctggctacatgtcaagcaagaagaccatggagatcaaccctgagaacgccatcatggacgagctccgcaagcgcgccgacgccgacaagaacgacaagtcagtcaaggacctggtgatgctgctcttcgagacctccctgctcacctccggcttcagccttgaggaccccaacacctttggcaccaggatccaccgcatgctcaagcttggcctgagcattgacgaggacgatgaggcgcctgagaacgacaccgacatgccgcccctggaggacgacgctggtgagagcaagatggaggaggtcgactaagcgccaagtctgcctgtcgtcggatgttcatgccctgcaccgcctagttgtttttatctttagtgtcgacgttggatggttttggcacgtttagctgtatcggttttgtcttttggctggccaaacattaagcgcggctagctgtttgtggtactcgtggaacagttcgttattgttggttctattatatgttagctatatttctat

SEQ ID NO: 3734 - DNA, 737 bp, Triticum aestivum
ccttccaacgcgcggcacaagcgtccatgcgccccaagcggagaagaacccgcgcgaagaagcccgcgaaggaggaccgcgcaggagaaggccccggtcccgccgggaagaagcccaagccgagaagcggctgccgcggggaagaccgccgccggcaaggagggtggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcgctacaacaagaagcccaccatcacgtcccgggagatccagacctccgtccgcctcgtcctgcccggcgagctcgccaagcacgccgtgtcagagggcaccaaggccgtcaccaagttcacctcctcctaggctcctgccttcttctctgcgagtccccctctttcctggttcctcgtggtgtgatgaattgatgttaccctgtagttagattatgttccgactgtcatcctgtaagaaattgcgcactcagcactgttaattggatctgaagtaacactgttcagcactgttattccgtcggaaatatctgaagaaatgctatcgttgctgcttcagtctgattcgtacgtgtgtatgttcgcaatttaattcaggaagcactcgattat

SEQ ID NO: 3735 - DNA, 673 bp, Triticum aestivum
ccgtgcgcccgcctcggctcccacagaaaatccccaattccttcgtcttcctcttcgcggacgcacacagcagagcacacagcgagaagatgtccgggcgcggcaagggcggcaaggggctgggcaagggcggggcgaagcggcacaggaaggtgctgcgggacaacatccaggggatcaccaagccggcgatccggcggctggcgcggaggggcggcgtgaagcgcatctccgggctcatctatgaggagacccgcggcgtgctcaagatcttcctcgagaacgtcatccgcgacgccgtcacctacaccgagcacgcgcgccgcaagaccgtcactgccatggacgtcgtgtacgcgctcaagcgccagggccgcaccctgtacggcttcggcggttaggggatagctagcttcagtgtgtctaccaggtcgctgctccgcgaatgcttgtgcctgtggtttaatttaatgcttgttgtgaggaagtgctatctggatttgtttctctgttcaatatcgtcagtccagccattgcttctgatttgacaccgtttgagtttgtgaaattcttttcattcggtcctgcaaatctaacttggcaaatttgtcatctggatttgtttaccatttgcgttttttgcatctctagattgtaatatgaatttctgaaa

SEQ ID NO: 3736 - DNA, 742 bp, Triticum aestivum
atctccaagtcccaacaccttccggcggcgaacaacccacccacttttctccccctcccgaagcagcgatggcccccaaggcggagaagaaaccggcggcgaagaagcccgcagaggagagcccgcggcggagaaggccgagaaggccccggcggcgaagaagcccaaggccgagaagcggctgccggcgggcaagaccgcctccaaggaaggcggtgagaagaagggcaagaagaagagcaagaagagcgtcgagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccaccatcacctcccgggagatccagacctccgtccgcctcgtcctccccggggaactcgccaagcacgccgtctctgagggcaccaaggccgtcaccaagttcacctcctcttagactgcgtcgcctgtatctagtagcaaatgtagttctatactgttggcttagtgcttgtccgtggactctggttatctgcaagtaatagtagtcctacttttggatgaaaattgccgaatcattgtaaatgctttgttggctcgtcggccacctgcaagaactgaattatgtccgcttcaattggcaaatgaagatttcggaaacgttgttggttct

SEQ ID NO: 3737 - DNA, 646 bp, Triticum aestivum
cggcggcgccgagaaagccgaagaaggggcggtctcatcgccgctgaacaccgacgacatcttcctcctcctggtgctactgctgggatcggggtctgctcgctcgtccacccaagcaagagctcgagctcgagcttttctgttgtcgctttgggatttcaccgctactccaaccccacattcgcttgccagcagctcgaagaggatcgtcggcgaccatgtccgggcgcggcaagggaggcaaggggctcggcaagggcggcgccaagcgccaccggaaggtgctgcgcgacaacatccagggcatcaccaagccggcgatccggaggctcgctcggaggggtggcgtgaagcgcatctcggggctcatctacgaggaaacccgcggcgtgctgaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggcgcttcctcgcccctcccctgcagatcccaaaagcttgatgataccgcgacttgtgtggtttgctacttcctctgtagttccaagtgaatcgtgaaacaaactactcgcatctgg

SEQ ID NO: 3738 - DNA, 553 bp, Triticum aestivum
cttctctctcgccttcgaagcagccgccgcagcatccatggcccccaaggcagccgagaagaagccggtggagaagacccccgcggggaagaagcccaaggcggagaagaaggtgccggcgtccaaggagggcggggacaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgact

SEQ ID NO: 3739 - DNA, 606 bp, Triticum aestivum
  misc_feature (440)..(440): n = any nucleotide
  misc_feature (576)..(576): n = any nucleotide
caccacaccgccgcaacaaccaccaccagcaacacacacacacagagaagcgaagatgtctggccgcggcaagggagggaagggtctcggcaagggcggcgccaagcgccaccggaaggtgctccgcgacaacatccagggcatcaccaagccggccatccgtcgtctcgctcggaggggcggcgtgaagcgcatctcggggctcatctacgaggagacccgcggagtgctcaagatcttcctggagaacgtcatccgcgacgccgtcacctacaccgagcacgcccgccgcaagaccgtcaccgccatggacgtcgtctacgcgctcaagcgccaggggcgaaccctctacggcttcggcggctaggcctgcgcccgctgctccagtctccgtcgactctgactctgctagctgctgttctggtgctatgcgtttcgtntctgaatgcgtgcgtgcgtgcgttgctgttccatcggtctgtgtagttagtggatggcgatggatctgaatgcagtaagttcgtcagagtgcgtgtgttgttctatcggtctctgtagtcagttcctctgtggaangcgatggatatgaatgcaatgggattgttg

SEQ ID NO: 3740 - DNA, 845 bp, Triticum aestivum
ttgtaatgggcacaactggcggggatcagcagttactgtacaaatcagtgcaagattcaaataactatgcactaatatctccgcaaatgggcaaacaggttgttgcatttcttgctgcaatggaaacaatcgcggagcagtttcctggggccttttcaggctatcgtttggaggtactggaatcccatcaagcaggaaagctggatacatctggtacagctaaagctgtaattgcttgtttcgagaagttaggcgcggtctttgacatggaccggatggttaagatcagggatcctgagcaacagctttatatggtgggtgtccccgaagaacacattgaagggcatgcattccatctgtaccatctgacttctcccgatgacagcgtttcatttgagttccagcacaatgtttgtggccgttcaatctacgccgaagggtcagttgatgccgccgtatttctgtacaagaaggtacaatcaatggatcctaagagaatttacgacatgattgatgtcttgcaagaaggcgatatgtggtgaagttattgtttagctcttcatgcatccgagcgaaattttgaaacaatcttcttgtatcctcctaaatataagtcgttttagagatttcaacaagtgactacatacgagcaaaatgagtgaatctaaactctaaaatatgtctatacatccgtatattgtagttcatttgaaatgtctaaaaagacttgtatttagaaacggagggagtagtgagtagtggtctgaaacagtggagttttttcagggttgatgatatatgtactgaaccgcatgcacccgaatagtttactccagaaccttaaa

SEQ ID NO: 3741 - DNA, 864 bp, Triticum aestivum
cgagcagagtccttcccgagcgcggacagcggggtcttacgagcagcgcctccctctctagagcagccgctcccgctcagcaacgccgccgcccggatctacgccggcgaccattccataggcagggcatcaacactgtcaattgcagaggcttggagctgcttcggcatccagtagagcaaacaagaagtaaagtcggaaacaaatatttcatcctcggacggacttctcatctcgcaatggaacccaagttctttcggttcctgaagcttgttggagttggcttcaaagccaggacagagcgtgaagccgcgagttgtttttgaaactaggctacagccatgaggtgcagttcacggctccacctgccgtccgcgtcttctgcttcaagcccaacataatatgctgtactggcattgacaagcatagagtgcaccatttcgctggagctgtccgatgcagtaagcctccagaagtgtacaaggggaagggcatactgtacatcgacgaggtcataaagctgaagccggggaagaagcagcagaagaagtaacacatggtgggtaaacatccccattcgacttctagcttgttaagacgtcgcatcgcatttgtggtgccgcggatttcacgcggttttctcgtgccggattatgcctagccccagtaccgggatggatttcgtaataatactccgtatgctatgtgagttatctggtgagcatgtgctgtatgacgtgcataccgtgggggcggatcagcacattcaaacatttgtgtttttgttttgggctggctagatgcatgtaacctacttcaatagcctaatgtgtttgttgatgtcactactgtcttcatattgtg

SEQ ID NO: 3742 - DNA, 500 bp, Triticum aestivum
gcaacaagcaccaccagcaagccacacagagcagccaagcgaagctcgccggagagagaagcgaagatgtcgggccgcggcaagggagggaaggggctgggcaagggcggagccaagcgccaccggaaggtgctccgggacaacatccagggcatcaccaagccggccatccgtcgtctggctcgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggccgcaccctctacggcttcggcggctaggccgcgcccgtccggtcgaatccgcctcgcgccgccagattcgtagctagccatcggttgttcagtgttcattgtcttcgctgtaatggaatggccgcatctcgctgctgtctgttgtttcg

SEQ ID NO: 3743 - DNA, 536 bp, Triticum aestivum
  misc_feature (16)..(17): n = any nucleotide
tacacaggccgattgnncagcaacgcacgcacgcacagcagccaagcgaagctcgccggagagggaagcgtcgaggatgtcgggccgcggcaagggagggaaggggctcggcaagggcggcgccaagcgccaccggaaggtgctgcgcgacaacatccagggcatcaccaagccggcgatccggcggctggcgcggaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggacgcaccctctacggattcggcggctaggccgcgccggtccagtcgaatccgcctcgcgccgccagattcgtatttagctagccatcggttgttcagtgttcatggtcttcggtgtaatggaatggccgcatctcgctgctgtctgttgtttcgatgtactactagcatggaatgg

SEQ ID NO: 3744 - DNA, 703 bp, Triticum aestivum
attccccactggttctcctacctaccagcgaaaccccacctccccgcacctccgaccttcgtagcggcagcagaatccatggcgcccaaggcggagaagaagccggcggcaaagaagcccgcggaggaggagcccgcggcggagaaggccccggcggcgaagaagcccaaggctgagaagcggctgccggcggggaagtccgccgctggcaaggacggcgacaagaagggcaagaagaaggcgaagaagagcgtggagacgtacaagatctacatcttcaaggtgctgaagcaggtgcacccggacatctgcatctcctccaaggccatgtccatcatgaactccttcatcaacgacatcttcgagaagctcgccggcgaggccgccaagctcgcccgctacaacaagaagcccaccatcacctcccgggagatccagacgtccgtccgcctcgtcctccctggcgagctcgccaagcacgccgtctccgagggcaccaaggccgtcaccaagttcacctcctcctaggctccggtcttcttctctgagagtttccctcttttctggttcctggcggtgtgtggtgaattgatgttaccctgtagttagattatgttccgactgtcatcctgtaagaaatcgtgcactgttaattggatctgaagtaaaactgttattccctcggaaatatctgaagaaatgc

SEQ ID NO: 3745 - DNA, 791 bp, Triticum aestivum
gcatcctaaccctagttcggcgacgactcggcgcgcggcggcggttggttcggagccgacgagggccactcggggcacgcgaagggagcgcagccgccggcctccgccgtggttgctcgcggcatcggcgaggacgatctcctcgagggtttcgcagcccaggtaacccggaatcaaacatttcatcctcagacaaacttcccttgttgctatggaatccaagttctttcagttcctgaagcttgtcggagttggtttcaaagcaaggacagagcaaggaggccgcgagttgtttctgaaactaggttacagccatgaggtgcagttcactgctccacccgccgtccgtgtcttctgcttcaaacccaacataatatgctgcactggcatcgacaagcatagagtgcaccatttcgccggagccgtgcgaagcagtaaacctccggaagtgtacaaggggaagggcatactgtacatcgacgaggtcataaagctgaagccggggaagaagcagcagaagaagtaacacatgggtgagcctccccatttgacttctagcctgttgttaaggcgccgcgacgcgtttgttgccgcagaattcatgtggttttctctgtgctgggctagtatggctagccccggtaccaggctggactttgtaataaatactccgtatgcgacgtatgtgaatcgtctgatgaacatgcatatcgttgggtgggggtggatcagcggattcacaaacatttttgttttgttttgagctggctggatgtgacgtatcttcaata

SEQ ID NO: 3746 - DNA, 959 bp, Triticum aestivum
atttgagggatcacttttcctcgtatggcaacatggtgaacatcagataatggtggatcacagcactgggcgttcaagaggttttggttttgtcacttttgaaagtgaggattctgtcgaaagggtcatatctgagggaagaatgcgtgatcttggtgggaagcaggttgaaataaagaaggctgaaccaaagaaacatggaggtgatcaccagtagccaccaccgttcctccgattccacaaccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaagcgcatctcagggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggcggctagggcctgcagattcgaaaagcttgatggaaccccgacttgtctagttcgctgtttcctgagtagctccaattgaatcgtggaacaaagttaatcgcatgtgtttgttggaaatcaaacttctctctgcaaataccgcgtttctgaatttgtttcgctgtttggtctctgccgggtcgatattgaggtggcgatgagttgatttgccataatttactaggagccccggattagccgtacttgtttgcagtataatttgaaatgttaaacaacgccgcagtgactgtacaattgtgtatgtcgattcagcaacatcatttgctctgcttctgtatctatctggcgattatacagctctgtgttttgtttgtctgtttgttt

SEQ ID NO: 3747 - DNA, 580 bp, Triticum aestivum
  misc_feature (21)..(21): n = any nucleotide
cccaatgaccgcgtcggcatnttctacaggcgcctcgacgtcttcgtcacctaccgcgacgagcccgtcaccgtgccgatctccctgccgcccatgtaccagggccaccgggacgtcaccatttggtcgcccgtgctgtccggggagtccgtgcccgtcgccggatacgtcgccgaggccatgaagcaggacatcgcctccgggtacgtgtcgctgcaggtcaagatcgacggccgcgtcaagtggaaggtcgggacctgggtctccggcagctaccacctcttcgtcagctgccccgccatgctcgccgccggccccggcggcatgccgctcggaggtggccccaatggcaccgggggcgccgtcgcgtcactgaaattcacgcagccgacagggtgcaccgtcggcacatgatagaatggaccgctcatacggccgcacgtccgtactgtaagtggaaggaactacgtagccggctagttcttctcttcgtgtctctaaacaatttctgtttgttgttagtaataaattgtctaaagctctcttaatttttgtatgtcacgtgtaatgggagaataaa

SEQ ID NO: 3748 - DNA, 543 bp, Triticum aestivum
acactcagaagcgaagatgtccggccgcggcaagggagggaagggcctcggcaagggcggcgccaagcgccaccggaaggtgctgcgcgacaacatccagggcatcaccaagccggcgatccgccgtcttgcccgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgtcaggggcgcaccctctacggattcggcggctgacctgcgcccgctgctccaatctccaatctccatcgactctgactctgctagctgctgttctggtgctatggtttcgtttctgagtgcgtgcgttgttggtccatcggtctgtgtagttagtggaaggcgatggatctgaatgcagtcagttcgtcagagtgcgtctgttgatctatcggtctctgtagtcagttcctcagtggaaggcgatgaat

SEQ ID NO: 3749 - DNA, 659 bp, Triticum aestivum
cgccgtcgaagcacccatggcgcccaaggccgcagagaagaagccggtggagaagaccccggcgggcaagaagcccaaggcggagaagaaggtgccggcgtccaaggagggcggaggcgagaagaaggggaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcgcggtacaacaagaagcccaccatcacgtcgagggagatccagacctccgttcgcctcgtcctccccggcgagcttgccaagcacgccgtctctgagggcaccaaggccgtcaccaagttcacctcctcctaggcgtcttccgatggcagcgttttgtgtgtagttagcagtgcgatggtacaatctctgtaggaattgtgctgcttgttggtctgaagaaatagtaatgtcgctgtctgaattattgctcaacgtgtgcttgtattattcagtttcggttggaaggttcttctgtacgccttgctacttctcatttttgtgcagtttgaatctggtactgtagttcggaaatctgcaggtacaa

SEQ ID NO: 3750 - DNA, 892 bp, Triticum aestivum
ttgcatgaaccaacaattccattacattcagacccatcgccttccacaaaggcacagactacacagaccgacagaacaccaactcacgcactcagaaacgaaaccgtagcacgagaacaggagcagcatccagcagagtcgactcgatggagcagcagcaggcgcaggtcagccgccgaagccgtagagggtgcgtccctgtcgcttgagcgcgtagacgacgtccatggcggtgacggtcttgcggcgggcgtgctcggtgtaggtgacggcgtcgcggatgacgttctcgaggaagatcttgagcacgcctcgggtctcctcgtagatgagccccgagatgcgcttcacgccgccacggcgagccagacgacggatcgccggcttggtgatgccctggatgttgtcccgcagcaccttccgatgacgcttcgcgccgcccttgccgaggcccttcccgcccttgccgcggccggacatggttgactgcttggagctgactgagatggaaacggatgaggagccacctattccattctcgtgtacttgcttttgtgatttttcattcctgaagaaatgggcgacatcaaggtgccaagactgttatgcgttctattactcatgccacttcttttagttccttgctcagaagccaagacctgcgaggtagctagcagtacctatcggaaaatagcatgcagggtggatccatgtgctaaagcctgccacaaggagggctttaccaaggggttatgttacatatacccaccatttatatttctttgtatctgcaaaaaagagtgttgaacaaagaaaacattgcaattcgcgtaggatgtgtgatgtaacaaataataaggttgggtagtatgatgaattaataatgagcaat

SEQ ID NO: 3751 - DNA, 1318 bp, Triticum aestivum
gaaaggcgcggctgctggtctctctagggttcgtcggcccggcgcgggggtgcggcgggggacccgtgcttctgcttccgcaccgagagtatggctggaaggcacaccattgttctcgtgcaaccatctccaaacaaagcgtccagaacttttatggacttcagttcactcaaccaagcactggatggtatctgtgcccgttatgaaaagaaaatcatggatatcaacccgatggccaggaacttcacttatgacatcaccgacctctacaatttcatcgatggcctagcggacatcagcgcgctagtgtatgatcatcaactccaagcttttttgccgtatgacaggcagtggataaaacagaagatgttccagcacctcaagaaccaggcacggcagtagccagccgctggttctgattaacaaaagcaagtgtacaaggtggtatgtctgttgtctgtagtttcagatggtgtgagagacctagggttcatgtgctaattgtaagagaagatgatcgatttgcttggctatctgccatttctgatgcgacaccgacacaccgtagtactccctccgttcctaaatacttgtctttctaggcatttcaacaagtgactacatacggagtaaaatgagtgaatctacactctaaaatatgtctacatacatccgtatgtgatattcatttgaaatgcctagaaagacaagtattttggaacggagggagtagtagtaatcaaacgtacgctggattctagtaaatcgaaaatgcctcgctcaaatcatcaaaatcgagatctagtataatgtctactgcgggttgggtggcctagagttggcggcggagaccctggatccccactcgaggagctccttgctggtgtcgtccttgtgcgccaccacctcgatgaagcacaggcagtccttcttctcctcggtcgctgtcgcgatggccgccgtcagctcctcctcgcacgtcaccttggcggtccagcagttgccctcgccgttgtggatggcgtcgatgaggccggtgtagttccagttcttgatgacgttgtatggcccgtcgtggatctcgacttcgatggtgtagccaccgttgttgatgaggaagatgatgctgttctggccgcagcggagcatggtggacacgtcctgcgccgtcacctggaagctgccgtcgccgatgcaggcgatgacgcgcttgtcggtggcgccctgcgcatagccgagcagcgccccgacggaccacccgatggagccgtactgcatctggaactcgtacccgcagccgtcggggagcttgagcttc

SEQ ID NO: 3752 - DNA, 518 bp, Triticum aestivum
tggaaatctcagcagcaaaaacacacacactcagaagccaatctcgccggagagggaagcgtcgaggatgtcgggccgcggcaagggagggaaggggctgggcaagggcggcgccaagcgccaccggaaggtgctgcgggacaacatccagggcatcaccaagccggccatccgccgtctggctcggcgtggcggcgtgaagcgcatctcggggctcatctacgaggagacccgtggcgtgctcaagatcttcctggagaacgtcatccgcgacgccgtcacctacacggagcacgcccgccgcaagaccgtcaccgccatggacgtcgtctacgccctcaagcgacagggccgcaccctctacggattcggcggctaggtcgcgccggtccagtcgagtccacaacgcgccgccatactcgtactactagctagccatggttgtcttcggtgtaatggaatggccgcatctcgctgctgtctgttgtttcgctgtattactagcccggaatggaaat

SEQ ID NO: 3753 - DNA, 544 bp, Triticum aestivum
ccgccgcaacaaccaccagcagcaacacacacacagcagcgaagatgtccggccgcggcaagggagggaaggggctgggcaagggcggcgccaagcgccaccggaaggtgctccgcgacaacatccagggcatcaccaagccggccatccggcggctggcgcgacggggcggcgtgaagcgcatctcggggctcatctacgaggagacccggggcgtgctcaagatcttcctggagaacgtcatccgcgacgccgtcacctacaccgagcacgcccgccgcaagaccgtcaccgccatggacgtcgtctacgcgctcaagcgccagggccgcactctctacggattcggcggctgacctgcgccctctgctccaatctccatcgactctgactctgctagctgctgctgctgttctggtgctgtggtttcgtttctgaattcagagtgcgtgcgttgttgttccgtcggtctgtgtagttagtggatggcgatggatctgaatgcagttagttcgtcagagtgcgtgtgttgtctgtggaagga

SEQ ID NO: 3754 - DNA, 720 bp, Triticum aestivum
cgtccgtcccactcccagcgaaacaccccgctccctctctcaagcagccgccatggcccccaagggcagacaagaagccggccgcggagagcaaggtggagaaggcggcggagaaggcccccgcgggcaagaagcccaaggccgagaagcggcttccggcgtccaaggaggccgccggcggcgagggcaagacgaggggccggaagaagggcagcaaggcgaagaagggcgtggagacgtacaagatctacatcttcaaggtgctgaagcaggtgcacccggacatcggcatctcctccaaggccatgtccatcatgaactccttcatcaacgacatcttcgagaagctcgccggggagtcggccaagctcgcccgctacaacaagaagcccaccatcacgtccagggagatccagacctccgtccgcctcgtcctccccggcgagctcgccaagcacgccgtctccgagggcaccaaggccgtcaccaagttcacctcctcatagactgaagatgcgtccgtcgcctgtagttggtctctgtatctgcacctgtactgtcgactctgcttgtctctctgcaagtagtgctggtagtctgctgggtgatcgccaacgctttgttggctaattaattggttgtaagaactgaagttgttgtgtttggcagactgatatatctatctagaactgaacttgtggtggtactatatctgtatca

SEQ ID NO: 3755 - DNA, 769 bp, Triticum aestivum
accagtccatagaactggagttgaaatagggcatcaacactgtcaattgcagaggcttggagctgcttcggcatccagtagagcaacaagaaggtaaagtcggaaacaaatatttcatccttggaaggacttctcatcttgcaatggaagccaagttctttcggtttctgaagcttgttggagttggcttcaaagcaaggaccgagcgtgaaggccgcgagttgtttctgaaactgggctacagtcatgaggtgcagttcaccgctccacctgccgtccgcgtcttctgcttcaaacccaacataatatgctgtactggcattgacaagcatagagtgcaccattttgctggagctgtccgatgcagcaaacctccagaagtgtacaaagggaagggcatactgtacatcgacgaggtcataaagctgaaaccggggaagaagcagcagaagaagtaacacatgggtaacctccccatttgacttctagcttgtttagataccgcatcacatttgtggtgccgatttcatgtggttttctcgtgccggattgtggctagccccagtgccatgctggacttcgtaataatactctgtatgctatgtgaatcatctggtgagcatgtactgtatgacttgcataccttgggggcggatcagcacattcaaacatttgtgtttttgttttgggctggctagatgcatgtaacctactttcaatagcccagtgtgtttgttgatgtcactactttcttcatattttctctata

SEQ ID NO: 3756 - DNA, 563 bp, Triticum aestivum
ctcctcgacccccatcctctcgcggcgtcgaaccaagaagagatcttcagccatgtcggggcgcggcaagggaggcaaggggctcggcaagggcggcgccaagcgccacaggaaggtgctgcgcgacaacatccagggcatcaccaagcccgccatccggcgcctggcgaggaggggcggcgtgaagcgcatctccggcctcatctacgaggagacccgcggcgtgctcaagatcttcctcgagaacgtcatccgcgacgccgtcacctacaccgagcacgcccgccgcaagactgtcaccgccatggacgtcgtctacgccctcaagcgccagggtcgcaccctctacggcttcggcggctaggctcttccttgcccccttgcagatcccaaaagtttgatgataccgcgacttgtgtagttctctacttcctctgtagttcgctatttcctctgtatttcgaactgaatcgtggagcaaacctattcgcagtttgttagaattcaaacttgtctaagtgagataccgtgcctctgattttgtcctgctgcatctctgttaa

SEQ ID NO: 3757 - DNA, 687 bp, Triticum aestivum
ccaccgccgtccctcagattccactacatccgctcgcagcttgagatcgtcagccatgtccgggcgcggcaagggcgggaagggactcggcaaggggggcgccaagcgccaccggaaggtgctgcgggacaacatccagggcatcaccaagccggcgatccggcggctggcgcggaggggtggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtccggccgactgtcgcctgtcttcgtcgcagcctgcagattccaaaagcttgatggaaccctgacttgttcagttcgctatttcctctgtctgtagttcgttggaaatgaaacttgtctctgtcagtctgtcgtaaatctgattttgttcgctggttggtcttctgcatctctgttcggtacgattgtggtctcctttgtacacaacacccaaaacaaaaaaagacaaacgaagataaaacaggggggcgagacacaagaggaccaacacacaagcggacgcgcaggaaaagaccagagaggcacagatataccgccgg

SEQ ID NO: 3758 - DNA, 602 bp, Triticum aestivum
gcaccacacctctccccgtccaagtagcagcaaccaacggcatccatggcccccaaggcggagaagaagccggtggcggagaaggccgagaagaccacggcggggaagaagaccaaggccgagaagcggccaccagcgtccaaggagggcggcgagaagaaggggaataagaagaacaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctggcgcgctacaacaagaagcccaccatcacgtccagggagatccagacctccgtccgcctcgtcctccccggcgagctcgccaagcacgccgtctctgaggggaccaaggccgtcaccaagttcacctcctcttagatagcctgctcttgtgtcttctctgaatgtgttgacttctcgtggctgtttgatgaatccattgtactctgtagttagatgttcagaacgcaccattttgtaatttgcgaggacacaaatgtttcaggatttggaggaaa

SEQ ID NO: 3759 - DNA, 507 bp, Triticum aestivum
caccgttcctccgattccacatctgctcgcagctcgaagaggatcgtcagccatgtccgggcgcggcaaaggaggcaagggactgggcaagggcggcgccaagcgccaccggaaggtgctgcgcgacaacatccagggcatcaccaagccggcgatccggcgcctggcgcggaggggcggcgtgaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgtaccctctacggcttcggcggctaggtccggccgacggtcctcggtctttgtcgcttccggcagattccaagagcttgatgaaaccctgacttgtctagttcgttgtttcctctgtctatgtagttcgaactgaatcgtggaacaaagttaatcgcacatcatgttgg

SEQ ID NO: 3760 - DNA, 706 bp, Triticum aestivum
cgccccagtcatctcagctgagaaggcttaccatgagcagctctctgtcgctgagatcaccaacagcgccttcgagccatcctccatgatggccaagtgtgacccccgccacggcaagtacatggcctgctgtctcatgtaccgtggtgatgttgtgcccaaggatgtcaacgccgctgtggccaccatcaagacgaagcgcaccatccagtttgtggactggtgccccactggtttcaagtgtggtatcaactaccagccacccagcgtcgtcccaggcggtgaccttgccaaggtccagagggctgtctgcatgatctccaactccaccagcgttgtcgaggtcttctcccgcattgaccacaagttcgacctcatgtacgccaagcgtgcctttgtccactggtacgtgggtgagggcatggaggagggagagttctctgaggcccgtgaggatctcgctgccctggagaaggactatgaagaagttggcgctgagttcgacgagggtgaggatggtgatgagggtgatgagtactagagctgctgagttcaacgacctgatgtacgccaagcgttccttcgtgtgatctgcccgagtggctttatctgctgtctgtctgtttgaatgtttgctgtgtggtgtttggtttacaacctgtggtatgtttgaacctggcttcgcaccttggtcaatatgcatgtt

SEQ ID NO: 3761 - DNA, 548 bp, Triticum aestivum
caccactcccaacacagctcaatcccaccggagagacaggcagaagcagctgcggcggcggagatgtcgggccgcggcaagggcggcaaggggctggggaagggcggcgccaagcgccaccggaaggtgctccgcgacaacattcagggcatcacgaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggccaccaacgccgggctgctccagccagcaacgagataaattatttctataaggctagtagtatttgtctatggttcgtggtctcttcggtgttgtttgctctgctctgttcctgcttgatgttgggatcgatgtactagtaccaagactgaatgaaaatcgaatttggaaat

SEQ ID NO: 3762 - DNA, 1196 bp, Triticum aestivum
  misc_feature (96)..(119): n = any nucleotide
agcaacactgcaacaagaggcacagaaggagagaaggcgaagcttgagctgagttaggatgggtttgctgctgctgcttcacgtcctgctcgtcgnnnnnnnnnnnnnnnnnnnnnnnncgcaggcgtggggcaaggagggccactacatgacctgcaagatcgccgacggtttcctgacgagcgaggcgttgacgggggtgaaggcgctcctgccgtcgtgggccaacggcgagctcgcggaggtgtgctcgtgggcggacagccagcgcttccgctaccggtggtcgagccccctccacttcgccgacacccccggcgactgcgagttcagctacgccagggactgccacgacaccaaggggaacaagaacgtgtgcgtggtcggggccatcaacaactacaccggcgcgctccaagactcgtccagcccatttgacccgacggagagcctgatgttcctggcgcacttcgtgggcgatgtgcaccagccgctgcactgcggccacgtcgacgacctcggcggcaacaccatcaaactccgctggtacaggaggaagagcaacctgcacaaggtgtgggattcggacgtgatcacagaggccatgaaggacttcttcaacaaagaccaggacgccatgatcgagtccatccagcgcaacatcaccgacgactggtccagcgaggagaagcagtgggaggcgtgccgcagcaaaaccacgacctgcgctgagaagtacgcccaggagagcgcgttgctggcatgcgacgcgtacgagggcgtcgagcaggacgacaccctaggagacgagtactacttcaaggcgctgccggtcgttcagaagaggctcgcccagggaggcgtgaggctggcggcgatcctcaaccggattttcagcgggaacggcaggctgcagagcatctgatcgatacaatttgctcgaaaataaagaagaataagaagattttcctgtctgaccacattatagcttcaccaaaatcactgaattcacgattatatttgttatccacccaccaaggcggcttagagtcgttgtatctgttaactccattgtatcctccacctcggagcggcttagagtttctgcagcgaatcattgtatccgtatgtgtgtgtactcatcttcatttcctctttacggtagcaatctactcccatgtgattgtgaccttttc

SEQ ID NO: 3763 - DNA, 590 bp, Triticum aestivum
ctccgagccaaacacctcctccctcactcccacctccgaagcttcagcggcagccatggcccccaaggcagacaagaagcccgcggccgagaacaaggtcgagaaggcggcggagaagacgccgcgggcaagaagcccaaggccgagaagcggctgccggcgggcaagacggcgtccaaggaggccggcggcgaggggaagacccgggccggaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggctgtcaccaagttcacctcctcctagattgactatgcgtcgcttgttgtgatagatgtagttggctgctgttagtcgctgactctgcttatgtatctgcaa

SEQ ID NO: 3764 - DNA, 944 bp, Triticum aestivum
ttttggctgctgcctgcattgtaaaaaagatcacatagctccgaagaatcccttcgtgacaagacgctttcagtatggtatacccgtccacctttcaggatgcatcactctgcgaagcgtttgatggaatttgagttagatgaagaacttgaggggttgagtgatgagctccttaaattattggttacatatggatctgatggaggctacttcattgagactgaagatggctcttctcctggttttgatgtcaaagtagatggtaggagcgaacatgatttccgggttgaagttggtggtgtgcaaacagacgtgacattagcattttattcaaaggacaatagcaaacatatacacatctggcatgggaagcatcaccatcattacaggcagacgatgagagctgagcatttacttgatgatagttctcaacctagccaggcttccgagggaagatcacatccaaaaggaagtgttttggcaccaatggctggtttggtcgttaaggttttgcttaaggatggggtacacgtggaaaatggtcagcctgtcatggttatcgaagcaatgaagatggagcatgttgtgaaggcgcctcgggcaggttatatagaaggactgaaggctaccgctggacaacaagtttttgactccagtgtccttttcactgtcaaggataagagcacaagctgatgaacccagaaattggagccacatatcagaattctagtggcggctccgcccttgggaaagaagaataagcaaacaagcagctggagatcattctgtgactaaataatgctaggtgatctctctagtatagctggagatcatatcttccggcacccatttcctgtatagcgtgtacatcaatgtcagtggcattgtgcgatgtaaaaaatcatgtgagtatgtaacgcaacttgcctgccttgcaatgtcca

SEQ ID NO: 3765 - DNA, 518 bp, Triticum aestivum
ggacgcgtggagcagccaccacctacctcacaaagaaagacaggtcaacctcacccaggagaagaagagagagaagcgagaagatgtcggggcgcggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggtttcgggggctaggctccggcgaggcgaatccagcttgcaccacttgatcagattagcagtagctaggcgttgtcagtgttcatggtaattgatgtaatttatgatgtgtggtgcctgttcgctggaatggattaa

SEQ ID NO: 3766 - DNA, 872 bp, Triticum aestivum
aaaaaaacaaaaaaaacagagtccttcccgagcgcggacagcgggctcctaccagcagcgtctccctccgacctccctggagcagccgctcacgcccagtaacgtcgccgcccggatctacgccgtcgaccattccataggcaggcatcaacactgtcaattgcagaggcttggacctgcttcggcatccagtagagcaaacaagaaggtcaagccggaaacaaatatttcatcctcgttcggacttctcatctcgcaatggaagccaagttctttcggttcctgaagcttgttggagttggcttcaaagccaggacagagcgcgaaggccgcgagttgtttctgaaactgggctacagccatgaggtgcagttcaccgctccacctgccgtccgcgtcttctgcttcaagcccaacataatatgctgtactggcattgacaagcatagagtgcaccatttcgctggagctgtccgatgcagtaaacctccagaagtgtacaaggggaagggcatactgtacatcgacgaggtcataaagctgaagccggggaagaaacagcagaagaagtaacacatgggtaaacctccccatttgacttctagcttgtttagacgccccatcacatttgtggtgccgcggatttcatgtggtttttctcgtgccgggttttggctagccctagtaccatgctggacttcgtaataatactctgtatgctatgggaatcatctggtgagcatgtactgtatgacttgcataccgtgggggcggatcagcacatttgaacatttgtgtttttgttttgggctggctagatgcatgtaaacagcccaatgtgtttgttgatgtcactactttcttcatattct

SEQ ID NO: 3767 - DNA, 673 bp, Triticum aestivum
  misc_feature (4)..(4): n = any nucleotide
cccnacacacacaccacagcacctctccccgccgaagcgtccgcatccgcatccatggccccgaaggcagccgagaagaagccggtggagaagaccccggcgggcaagaagcccaaggcggagaagaaggtgccggcgtccaaggagggcggggacaagaagggcaagaagaaggccaagaagagcgtggagacctacaagatctacatcttcaaggtgctgaagcaggtgcacccggacatcggcatctcctccaaggccatgtccatcatgaactccttcatcaacgacatcttcgagaagctggccggcgagtccgccaagctggcgcgctacaacaagaagcccaccatcacgtcccgggagatccagacctccgtccgcctcgtcctccccggcgagctcgccaagcacgccgtctccgagggcaccaaggccgtcaccaagttcacctccgcctgattccgccgtccacgtgtcttctttgatgtatccatcgatcgatgttgttgctctgtagtagttagctgctcgtgctctgtcgtgttgtaacttgtgctggttgtgtgggatcacatttcatgatccggagaaatagtaacagtgcttatttcagttcttgccatgatcctgtgtgggctactttggtcttggttcgatttgttgtgcgagc

SEQ ID NO: 3768 - DNA, 700 bp, Triticum aestivum
cagcctcgggacccgtccctgtccgccaccgctcaggtcacgcctcgcctcccgcaaccccaacgaccgcgtcggcgtgctctaccggcgcctcgacgtcttcgtcacctaccgcgacgagcccgtggccgtgccggtgtccttgccgcccgcgtaccagggccaccgggacgtcaccatctggtcccccgtgctgtccggtgagtccgtgccggtggccgggttcgtcgccgacgccatgaagcaggacatcgccgccgggtacgtggcgctgcaggtcaaggtcgacggccgcgtccggtggaaggtcggcagctgggtctccggcagctaccacctcttcgtcagctgccctgccgtgcttgccgccggccccggcggtgtcccgcccggcgctggtggccccaacggcaccgccggccgagccgtcgcgtcgctgaagttcacgcagcccacagggtgcaccgtcggcacctgaaggaaattacgtactaagtagcggtttaattttatgcttatgtctcgtgtagtcgtgtaacggggagaataaaatgtacttcaattttggcattaacaattgcaatttgtatttctttgccgtcgcatcatttgatctatctatgtgtcgttaagaacgggcatatataagttcttccgaacgtttaaaatgtaaatggtgcagcacatataaattctcccg

SEQ ID NO: 3769 - DNA, 814 bp, Triticum aestivum
cgacgcgtgggcgaacgcgtgggcggacgcgtgggcggacgcgtgggttcaagcgcatccacacacacacacaccacagaccacctctccccgcccaagcatccccatccgcatcctcatccatggcccccaaggcagccgagaagaagccggtggagaagaccccggcggggaagaagcccaaggcggagaagaaggtgccggcgtccaaggagggcggcggggacaagaagggcaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctggccggcgagtcggccaagctggcgcgctacaacaagaagcccaccatcacgtcccgcgagatccagacctccgtccgcctcgtcctccccggcgagctcgccaagcacgccgtctccgagggcaccaaggccgtcaccaagttcacctccgcctgattcggtcctgtccctgtgtgtgtcttcctggtggatggatcgatgtcgccctgtagtttcctgctcggactttgtcctcttgtaacttgtgctggctgtgtcttgtgtgggatcatatttcatgatctggagaaatagtagcggtgcttatttcagttcttgccatgatcctgttcgtgctactttgtcttggttcgatctgtggtgcaagctcgcttttctctgtaaatctctgtggacgacgactgtgaacttgcagagatgtttccctgtctcaattc

SEQ ID NO: 3770 - DNA, 1189 bp, Triticum aestivum
gacaaagcacgctcggccggcgaggcgagtgagagagtcaactcgaccatggagtccggcggtgcaggcgaggtgcggcactggaacgccgacgtcaacggcgtctccctccacgtcgccgagcagggccccgccgccggcccggcggtgctcctcctccacggcttcccggagctctggctctcctggcgccaccagatggccgctctcgccgcccgcggcttccgcgccctcgcccccgacctccgcggctacggcgactccgacgcccccgcggaccccgccgcctacaccatgctccacgtcgtcggcgacgtggtcgcgctcctcgaccacctccgcctccccaaggtggtggtggtgggtcacgactggggtgcgcaggtggcgtggcatttctgcctgttccggccggaccgggtgcgcgccgtcgtcgcgctggggatcccgttcttcccccgctcccctcgtccgatggcggagatgtccgcggcgcgcggcgacgggttctacatcacgcagttccaggagcctggaagagctgaaaaggcatttgctcggtacgacgtcgcgactgtcctaaagaagttctactcccttcaattagatgaccttgctgctcctcctggagtagagatcatagattttttcgaggcgtcatcatccccacttccttggatgaccgaggaagaactggggcagtatgccgagaagtttcagaagtctggcttcaccggacccctcaactactaccgcgccatggacacgaactggaggcttactgcgccctggcacggtgcaaagatcacggtgcctgcgaagttcatcgggggtgagaaggacgtcggtgtcgagtcctttggagtcaagcgctacatcgagagcgggggtttcaagtccaatgttccagaccttgaggtttccatcattgaaggccaccatttcctccagcaagagcaggccgagagggtgaactctgagatactgtccttcctggacaagctttctggcgaggaagcacataattaagaaccaagtctgcgaggaggcgcataactaagaaccgagtaaaagggtagtgtatgagctggttttagatgtgaaagttgtcttttctaaactgaaatataaagctggtggacctatccactcaaataaatgtcagagataggcttcaataaagtgcact

SEQ ID NO: 3771 - DNA, 744 bp, Triticum aestivum
cccaccttcccgtctcccgtgcccccaatccccaccgtagcccccaatccccacccatcttcccggagcagcgatggcccccaaggcggagaagaagccggcggcgtagaagcccgcggaggaggagcccgcggcggagaaggccgagaagacccctgccgggaagaagcccaaggccgagaagcggctgccggcgggcaagaagaccgcctccaaggagggcggcggcgagaagaggggccggaagaagggcaagaagagcgtggagacctacaagatctacatcttcaaggtgctgaagcaggtgcaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctctgtccgcctcgtcctccccggggagctcgccaagcacgccgtctccgagggcaccaaggccgtcaccaagttcacctcctcttagattccgttgcctgtatctagtaccagatgtggttgttcactctggttatcgccaagtagaagtagtgctagtgctggatgggagttgctgaatgcttacgcgatgcttcgttcgctgtaagaacagaattatgaaccttatggtgccgcttttgcaagctgagatttagcagcgttgcttatgatctgactgttgtttgcttttct

SEQ ID NO: 3772 - DNA, 671 bp, Triticum aestivum
cctccttcaatcctccagcgaaaccccgccccaccccaccgtcagcatccatggcgcccaaggccgagaagaagccggcggcgaagaagccagtggaggaggagcccgcggcggagaaggccgagaagaccccggccgggaagaagcccaaggccgagaagcggctgccggcgggcaagtcgtcggcggcggccaaggagggcggcaaggcgaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgctaagctggcgaggtacaacaagaagcccaccatcacgtcccgggagatccagacctccgtccgcctcgtcctccccggcgagctcgccaagcacgccgtctccgagggcaccaaggctgtcaccaagttcacctcgtcctgagtctcgtagttagctgtttgggtgtgtttgtggccgtgttatcgtgtaagaatcgcatcgctatgtttctggatctcgagaaatagtaacggtgcctgcctcaatgttcagtacatgctcgtgttattttgttctggtcttcaattcttcatctctaatcaa

SEQ ID NO: 3773 - DNA, 927 bp, Triticum aestivum
  misc_feature (527)..(527): n = any nucleotide
  misc_feature (529)..(546): n = any nucleotide
cccgcaatcccccactctccgaaccggcgatggcccccaaggcggagaagaagccggcggcgaagaagcccgcggaggaggagccggtgacggagaaggccgccgagaaggccccggcggcgaagaagcccaaggccgagaagcggctgccggcgggcaagacggcgtccaaggaggccggcggcgaggcgaagacgaggggccggaagaagggcagcaaggcgaagaagggcgtggagacgtacaagatctacatcttcaaggtgctgaagcaggtgcaccccgacatcggcatctcttccaaggccatgtccatcatgaactccttcatcaacgacatcttcgagaagctcgccgccgaggccgccaagctcgcccgctacaacaagaagcccaccatcacctcccgggagatccagacctccgtccgcctcgtcctccccggggagctcgccaagcacgccgtctccgagggcaccaaggccgtcaccaagttcacctcctcctagattgcatctgcattgctngnnnnnnnnnnnnnnnnnngtagcgactgtagctggttctgttgctttagttggtgcttgccgactctggttatctggaactctcaagtgctcttattgctggatggggaattgattgatggatgactgccaatgctctgttgcctcttttggcaaactgatatatcaaaagcagtagttcatttcagcagcttctgattaccatctctgccacacgattgtgctttttgtaatgtaagtttttaggttgatgatgcgctcacagtaagttacatttatgcgttaggcacagaaccaactgtattgttgaacgtgttgggtttaactgagcacgcagagcttgactctggttatctgcaagtagttgtactactattgttactttgttagtgattgcttc

SEQ ID NO: 3774 - DNA, 516 bp, Triticum aestivum
ccaacacaagccaatcccaccggagagacaacagagaagcgaatcagcggcggcgaagatgtccgggaggggcaagggcggcaaggggctggggaagggcggcgccaagcgccaccggaaggtcctccgcgacaacatccaggggatcacgaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgaaccctctacggcttcggcggctaggccaccgacgccgggatcttcaagcaagcaaagagattagcagtatttgtctagggtacgtggtctcttcggtgttgtttgctctgctctgttcctgcttgatgtatcgggaccgatgtactagtaccaagactgaatgacatgga

SEQ ID NO: 3775 - DNA, 723 bp, Triticum aestivum
ttccccaccagttctcccaccgtccaccgtacccccacctcccctccgaagcggcggcggcagcagcgtccatggcgcccaaggcggagaagaagccggcggcgaagaagcccgcggaggaggagccggcggcggagaaggcccccgcggcgaagaagcccaaggccgagaagcggctgccggcggggaagacctccgccggcaaggagggcggcgagaagaagggcgggaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggcggccaagcttgcccgctacaacaagaagcccaccatcacgtcccgggagatccagacctccgtccgcctcgtcctccccggcgagctcgccaagcacgccgtctccgagggcaccaaggccgtcaccaagttcacctcctcttaggctctttgtcaaatctcttctggcgtgtgatggatccatgttgacctgtagttagatcatgttccgtctgtcatcttgtaagaaaacgtgctctcggtactgttattcagacccgaagtaacaacactgttcaaccctgctgttccctcggaaatatctgaagaaatgctaagcttgccgcttcaatctgataaaa

SEQ ID NO: 3776 - DNA, 606 bp, Triticum aestivum
ccaccaccgttcctcccatcccacactcgctcgcagctcgagatcgtcggccatgtccgggcgcggcaagggaggcaagggcctaggcaagggcggcgccaagcgccaccggaaggtcctccgcgataacatccagggcatcaccaagccggcgatccggcggctggcgcggcggggcggcgtgaagcgcatctcggggctcatctacgaggagacccgcggcgtgctcaagatcttcctcgagaacgtcatccgcgatgccgtcacctacaccgagcacgcccgccgcaagaccgtcaccgccatggacgtcgtctacgcgctcaagcgccagggccgcaccctctacggcttcggcggctaagggccggccggccgacgggagtcactctttgtcgccgcctgcagattccagaagcctgatgaagccccgacttgtttagttcgctatttcctctgtagtttgaactcaatcgtggaacaaagttattcgcatatattgttggaaatgaagcttgtctgttgtctctgtgctgataccctgtttctgattttgtctcgctggttggtctctgttgggtacgatattgaggcggcgatcagttg

SEQ ID NO: 3777 - DNA, 720 bp, Triticum aestivum
  misc_feature (575)..(595): n = any nucleotide
agcgaaacacccccgctccctctcccacctccgaagcagcagcagccatggcccccaaggcagacaagaagccggccgccgagagcaaggtcgagaaggcggcggagaagaccccggcaggcaagaagcccaaggccgagaagcgggtgccggcgggcaagacggcggccaaggagggcgccggcggcgagggcaagactcggggccggaagaagggcagcaaggccaagaagggcgtggagacgtacaagatctacatcttcaaggtgctgaagcaggtgcacccggacgtgggcatctcctccaaggccatgtccatcatgaactccttcatcaacgacatcttcgagaagctcgccggggagtcggccaagctggcgaggtacaacaagaagcccaccatcacctcccgggagatccagacctccgtccgcctcgtcctccccggcgagctcgccaagcacgccgtctccgagggcaccaaggccgtcaccaagttcacctcctcctaggctgaatctgaatgcgtcgccttgttgtagttggctgctgttgactctgcttatctctctcannnnnnnnnnnnnnnnnnnnngcactagatgattgccaacgctttgttggatccttggttgttgcttttgcaagctgatatctatgtagaatgtggaagttgtggttgtgtatccgtatccacagtgatgatttgacagatgttgg

SEQ ID NO: 3778 - DNA, 694 bp, Triticum aestivum
cgaccgcctcgacgtctacgcctcctacaagtaccagcagatcacgctggcctccgcgctcccgccggtgtaccagggccacggcgacgtcgaggtgtggtcgccggtgctctccggcccgaacgtccccttcgcgccctacctcgccgacgcgctcgccaaggacgtccaggccgggtacctcatcctccaggtaaagatcgacggccgcgtccggtggaaggtgggcagctggatctccggccactaccacatcttcgcgacctgccccgccttcctcgtcggcgccggcggcaacggcgcgccgggggccagcgggctcaggttccagaccgccacctactgccacgtcgaggtctagccgccgaaccgtacgcgctctggcttgcttgctgtgcgtgcctgcttgcctcctctgctccgtcgacggcgacgaggtaggtttcttgcgggtggcgcgcgcgcgtgcgcgtcgccaagaaggatcgtcaaggctgaaggccagggggtggtacatggtggtaataagtgttagcgtcgaggggtatatgtgtaaaaaaggaaaagagaatttagtgttggttactcctactaaattgtgttttgctcatgtttaactgttggtgaggtatttattccgcgtttaattgtcaatatatataaacctgttgttacgatggaattaaagaaaatg

SEQ ID NO: 3779 - DNA, 473 bp, Triticum aestivum
ccaccgtgttcggaacgcatgggcgatcagcagggacccaaagcactgggatgacccggagaagttcaagccagagcgatttgagaccaccacgattgacttcaagggcacagactttgagtttcttccgtttggtgctgggcggaggatatgcccgggcatcacgtttgcgcaggccaatatggagattgtgctcgccacactgttgtaccactttgactggaaactccccggcaaggccatgcccggcgagctggatatggcggaggagatgggcatctcggtccgaaggaagaacgatcttcacctgtgtcctgttgttcgtgttaacccatgtgcccttgtgtagctgctttacttgtcacaccatgtagctaccagtctatgctatgtgatcatgtaagaagtcacccatttggactgtaaaaggaaccggtgtgattatgtatgaaaaaatgtccattaattaatga

SEQ ID NO: 3780 - DNA, 1150 bp, Triticum aestivum
cggagatcatcaaggtcggcgcggggttcagcctggacgacatgttcccgtcgtggaggctcgcgagcgccgtcggcggcatggcgcgccgcgcggagcttaaccaccgcaagacgtacgagctcatggactgcgtcttccggcagcaccggcagctgagagaggccgtagctgaaggcgccatcaacgaagaggaggaagaccttgtggacgtgctccttggatacagaaggaaggcggcctcgaggtgcctctcaccacgggaaacatcaaagccgtcatccttgacctcttcaacgccgggagcgagacgtcagcgaatacactccaatgggccatgtcagagctaatgaggaacccaatgcacaaggcacaagtcgagctgcggaatagcctccaagggaaatcaacggtgaccgaggatgacctggctggcctaaagtacctaaagctcgtcatcaaggaaaccctgaggctgcacacggtgttgccactgcttctcccgagggagtgccgggagacgtgcaatgtcatggggtacgacgtgcccaagggcaccaccgtgttcgtgaacgcatgggcgatcagcagggacccaaagcactgggatcacccggagaagttcaagccggagcgatttgagagcaccacggttgacttcaagggcaccgactttgagtttcttccgtttggtgctgggcggaggatatgcccgggcatcacgtttgcgcaggccaatatggagattgtgctcgccgcactattgtaccacttcgactggaaactccctggcaaggccatgcccggcgagctggatacggcggaggagatgggcatctcggtccgaaggaagaacgatctttacctgtgtccggttgtccgtgttaatccatgtgctcttgcatagctgctttacttatcgcaccagtagctaccggtctatgctatgcttatgtaagaagtcacccatttggactataaatggatgtaagcaaccggtgtgactatgtatgaaaaaatgtccattaatttggggacttaataaaggagtggaaagttggagctggagcaaatctccctttgttttctttttttctcaaccatgtttgtaaaaatgtccattaatgtagcgacttaataaaggagaaag

SEQ ID NO: 3781 - DNA, 697 bp, Triticum aestivum
gatgacttgctggcctgaagtacctaaagctcgtcatcaaggaaaccctgaggctgcacacggtgttgccactgcttctcccgagggagtgccgggagacgtgcaatgtcatggggtacgacgtgcccaagggcaccaccgtgttcgtcaacgcatgggcgatcagcagggacccgaagcactgggatgacccggagaagttcaagccggagcgatttgagagcaccacgattgacttcaagggcaccgacttcgagtttgttccgtttggtgccgggcggaggatatgcccgggcatcacgtttgcgcaggccaatatggagattgtggctcgctgcactgttgtaccacttcgactggaaactccctggcaaggccttgcgcagcgagctggatatggcggaggagatgggcatctcggtccgaaggaagaacgatctttacctgtgtcccgtggtccgtgttagcccatgtgctcttgtgtagccgctttacttgtcacaccatgtagctaccagtctatgctatgtgattatgtaagaagtcacccatttggactgtaaaaggaaccggtgtgactatgtatggaaaaatgtccattaatttggtgacttaaaggagtggaaagttggagctggagcaaatctccctttgttttcctttttttcaaccatgtttgtaaaaatgtccaaatcaa

SEQ ID NO: 3782 - DNA, 732 bp, Triticum aestivum
tgtgtgtgttctttgtgttgtgtaagacaaacccaaaagagagttgtgtcagataaaggcagagttgtgcgagacagctcaagaaggaagaagaggtgggcgctgcgagagggcggcgccaacactggggaggcacggcgtgcgcgtgaacgccatctcgccgcatggcatcgcgacgccgttcgggctgcgcgggctggcggagctgctcccggaggcgagcgaggaggagctgaggcggctggtggagtcgggcatgagcgagatgggtgggatggtgctggaggtggaagacatcgcgcgggcggccctgtacctggcgtccgacgaggcaacgtatgtcaacgggcacaacctcgttgtcgacggcgggtttaccgtggggaagctgattcacacgccggatccggtgaggagtgagtaacaggcatggcatggcatgacagtgataaagatgaggcctaggccaaaacttgattatccgtgaagaagatggtgtctcctgttgtgattgtattgatcacttgggcagctacttgaagtgttgtagcttctgcttggagaggcgacgcaatttgctcctcggataaacgaatactgatattgacttcttgatgttttccagccatctgtatgaaaattcctatgcatgtggtgttttgtgtatcaggtttccatgctgcatccgtaaagactttgcaatttgggccagtagcttgcattataacctgc

SEQ ID NO: 3783 - DNA, 710 bp, Triticum aestivum
ccgccggcttgacgttccggcacaaccacgcccgggtcaccgggaggatgagtttggagtccgtcgcatcgctcgacctgccgacttcgaccgcaccatggcagccaacgtccggtctgccgtcgccggcatcaagcacgcggcgcgggtgatggtgccgcgccggagcgggtgcatcatctgcaccgcgggcacggcgggggtgctcggaagcggcgtaaaccccgcgtactgcatctccaaggccgccgtgattggcgccgtccgggcgttggccggggagctggggaggcagggcgtgcgcgtgaacgccatatcgccgcacgccatcgcgacgccgttcgggctgcgcgggatggcagagctgctgccggagacgagcgaggaggagctgaggcggatggtggcgacggccatgaacgagatgggcgggagtgttctggaggtggaggacatcgcgcgggcggccgtgtacctggcgtccgacgaggccaagtatgtcaacgggcacaacctcgtcgtcgatggcgggtttaccgtggggaagctgattcacatgccggatccggtgagcagtgcgtgacaggcatggcaatgacagcgatggagatgacgcaacatgcactagttcccctagctacaagtattgtggtacagagggagtagtattgagatacccatcgtccacagcatgcgccataaataaggga

SEQ ID NO: 3784 - DNA, 859 bp, Triticum aestivum
cacgcgttgcgacgtgaccgacgaggcgcaggtcgccgcggcggtggacctcgccgtggcacgccacggcaagctggacatcatgctcaacaacgccggcatcgtgggctccctggcgcgtcctcggctgagcgatctcgacctcgccgacttcgacgccgtcatggcaatcaacgcccggggcgtcatggccggggtgaagcacgcggcccgcgtcatggcgccgcgccgcagcggcagcatcatctgcatggccagcgtcgccggcgtgctgggcagcgtgacgccgcacccgtacagcgtgtccaagacggcggtgctggggatcgtgcgcgccgtggctggggagatggcgcgctccggcgtgcgggtgaatgccatctcgccaaactacatcccgacgccgctggtgatgcgcatcctggagcagtggtacccgaaggccagcgccgaggagcaccggcggatcgtggagggggacatcaacgagatgaagggcgcggtgctggagccggacgacatcgcgagggcggcgctgtacctggcatccgacgaggccaagtatgtcaacggccacaacctcgtcgtggacggcgggttcacggtggggaaggcgcccaacatgccggcaccggcgctgtaaaacgaagcgagttcctgaaataaatttacttcctacagtactatatacatactactagtacgtagtattgtattgcgccggaagtagaatcaccgagcattacgtttttgtttcaggattgaaacaacgaattgtcctcgatgccgagtagtacgtgcacacgttgaccccatgcggaaatactccctagatgagagcagcccgattgtttttgtt

SEQ ID NO: 3785 - DNA, 1330 bp, Triticum aestivum
gtcgcacttcgccaagatccgcaaagatgatccgagcggtgcaggtcgtcaccaggtaacgccggggttggtttcggaagagaacgccgtgcatgtgcgtgctaatcttggtcttggtgtgtctgcgcgtttgtgttgcaggggggagagccgccgggctgcgctggcgtcggtggccggctacgtcagccaccgcggctactccacggcctcgagctcgcagaggctggccgggaaggtggccgtgatcaccggcggggccagcggcatcggcaaggcgacggccgcggagttcgtcaggaacggcgccaaggtcgtcctcgccgacgtccaggacgacctgggccgcgccctggcggccgacctcggcccggacgcggcatgctacacgcgctgcgacgtgaccgacgaggcgcaggtcgccgcggccgtggacctcgcgggggcccgccacggcaagttggacatcatgctcaataacgccggcatcgtgggctccctggcgcgtccccggctgagcgatctcgacctcgcggacttcgacgccgtcatggcgatcaacgcccggggcgtgattgccggggtgaagcacgcggcccgcgtcatggcgccgcgccgcagcggcagcatcatctgcatggccagcgtcgccggcgtgctgggcagcgtgacgccgcacccgtacagcgtgtccaaggcggcggtggtcgggatcgtgcgcgccgtggcgggggagatggcgcgctccggggtgcgcgtcaacgccgtctcgcccaactacatcccgacgccgctggtgatgcgcatcctggaggagtggtacccgaaggccagcgcggaggagcaccggcggatcgtggagggggacatcaacgagatggagggcgcggtgctggagccggacgacatcgcaagggcggcgctgtacctggcgtccgacgaggccaagtacgtcaacgggcacaacctcgtcgtcgacggcgggttcacggtggggaagccgcccaacatgccggcaccggcgctgtaaaacgaagcgagctcctgaaataaatttacttcctatatacgtactactagtacgtagtagtattgtattgcaccaccctcaaaaaaaagagtattgtattgcaccggaagtagaatcaccgagcattacatttttgtttcacgattgaaacaacgaattgtcctcgatgccgagtacatgcatacgttgaccccatgcggagtactagatgacagcagccggattgttgtatctttgtggctagacctgtgcgttcggtttattcggtttacatggttcggttatacgttttgtgtatgt

SEQ ID NO: 3786 - DNA, 527 bp, Triticum aestivum
tcatgctcaacaacgccggcatcgtgggctccctggcgcgtccccggctgagcgatctggacctcgccgacttcgacgccgtcatggcgatcaacgcccggggcgtgctggccggggtcaagcacgcggcccgcgtcatggcgccgcgccgcagcggcagcatcatctgcatggccagcgtcgccggcgtgctgggcagcgtgacgccgcacccgtacagcgtgtccaaggcggcggtgctggggatcgtgcgcgccgcggccggggagatggcgcgctccggcgtgcgcgtcaacgccgtctcgcccaactacatcccgacgccgctggtgatgcgcatcctggagcagtggtacccgaaggccagcgcggaggagcaccggcgtatcgtggagggggacatcaacgagatggagggcgcggtgctggagccggacgacatcgcgagggcggcgctgtacctggcgtccgacgaggccaagtacgtcaacggccacaacctcgtcgtcgacggcgggttcacggtg

SEQ ID NO: 3787 - DNA, 580 bp, Triticum aestivum
tcgcacttcgccaagatccgcaaagatgatccgagcggtgcaggtcgtcaccagggggagagccgccgggctgcgctggcgtcggtggccggctacgtcagccaccgcggctactccacggcctcgagctcgcagaggctggccgggaaggtggccgtgatcaccggcggggccagcggcatcggcaaggcgacggccgcggagttcgtcaggaacggcgccaaggtcgtcctcgccgacgtccaggacgacctgggccgcgccctggcggccgacctcggcccggacgcggcattctacacgcgctgcgacgtgaccgacgaggcgcaggtcgccgcggccgtggacctcgcggtggcccgccacggcaagttggacatcatgctcaataacgccggcatcgtgggctccctggcgcgtccccggctgagcgatctcgacctcgcggacttcgacgccgtcatggcgatcaacgcccggggcgtgattgccggggtgaagcacgcggcccgcgtcatggcgccgcgccgcagcggcagcatcatctgcatggccagcgtcgccggcgtgctgggcagcg

SEQ ID NO: 3788 - DNA, 568 bp, Triticum aestivum
cagcgtgtccaagcgccgtgctggggatcgtgcgcccccgccggggagatggcgcgctccggcgtgcgcgtcaacgccgtctcgcccactacatcccgacgccgctggtgatgcgcatcctggagcagtggtacccgaaggccagcgcggaggagcaccggcgtatcgtggagggggacatcaacgagatggagggcgcggtgctggagccggacgacatcgcgagggcggcgctgtacctggcgtccgacgaggccaagtacgtcaacggccacaacctcgtcgtcgacggcgggttcacggtggggaaggcgcccaacatgccggcaccggcgctgtgaaacgaagcgagctctttgaaataaatttacgtcgtgttgcattgcaccagaagtagaaccaccgagcattacgtttttgtttcagaattgaaacaacgaattgtcctcaatgtcgaggacgtgcatacgctgaccccatgcggaaatagatgagagcagcccggttgttgttatctttctggctactaaccggatccgtatgtggtgcttactacaccacatgaaga

SEQ ID NO: 3789 - DNA, 1300 bp, Triticum aestivum
agaagcccaaggagggggaggaggacaatgcccaatggactgacaagcccaaggagggggagggcgagggggagaagcccaaggaggaggaggcggctgcccccgccgcctgccgccgccgccggaggaggtcgtgatgcgcgtctacatgcactgcgagggctgcgccaggaaggtcaagaagatcctcaagagattcgatggggtagaggacgtcattgccgactccaaggcacacaaggtggttgtgaagggaaagaaggcggctgccgacccgatgaaggtggtggagcgcgttcagaagaagacgggccgcaaggtggagctcctctcgccgttaccgccgccgccggaggagaagaaggaagaggaaaagaaggaggaaccagagccgccgaaacctgaagagaaaaaggagccaacggtgatctccgtggtgctgaaggtgcacatgcactgcgaggcctgcgcccaggcgataaagaagaggatcgaaaagatgaaaggagtgcaatctgcagacccagacctgaaggcgtcggaagtgacggtgaagggcgtgtttgaggaggtcaagctggccgagtacgtgcacaagcgcaccggcaggcatgcggccattatcaagtccgagccggtcgccccggccgagaaagccggcgaaggcgacgccaaggatgagaagaaggcagccgaaggcggcgaagagaagaaagacgacaaggaggagaagaaggacgacaaggatggcgccccagaggaaaagaaagaggagaaagacaaggaggatggcggcgccggcggcgaggagaaggagaaggagaaagaccccggcgccatcgccgcagccaacctctacatgcactacccgcagttcgccttcccgggagggtactacccgccgaggccggggtacgccgcctaccctccgccgccggcctacccgccgtacccgccgcagatcttcagcgacgagaacccgaacgcctgctccgtcatgtaaaaaaggttagaaccttggtggtctagagtggaaaacaaataagaaggggagaagggactgcatgagttgaggggtgccatggcagcaaaaatgccgtcgagcaaagcaaatggcagcagcttgaagaaagtaccaggcttttttgcggtcaggttttccttttttttgaaccttttatgtttttaccgtctggtataaagtaagtctggacttccttgtcagttgatggatgttttcatcttatgtagatttttctttttgccttgtactgaacttatgtaaaaactgttattatag

SEQ ID NO: 3790 - DNA, 1354 bp, Triticum aestivum
caaaaaatcgttaaagatgttccccagagacgagttgagaaaagacttctgccagatgtataccccgaatgatatggagtcaccttgatgatattggtgcgttggagaatgtaaagggaaacattgaaggatttggtgatgctcccattcaaagccggaattgttctgcaaagggccagttaacgaagccttgcaagggaatattgctcttcgggcctcctggcactgggaaaactatgcttgctaaagcagtagcaactgaagcaggcgccaacttcatcaatatatcaatgtcaagcattacatcgaagtggtttggcgaaggggagaaatatgtgaaggctgttttttcattagcaagtaaaatatcccccagtgttatttttattgatgaggtcgatagtatgttaggaaggagagaaaatcctggggagcatgaagccatgcgcaagatgaaaaatgaatttatggtaaattgggacgggttgcgaacgaaagataaagaacgtgtactggttcttggtgccacaaatagaccttttgacctggacgaggctgtgattaggaggttcccccgcaggctaatggtaaatttacctgacgcatcaaatagagagaaaattttgaaagttattttagcaaaagaagagttgggacaagatactgatctggagtcacttgctaatatgactgatggatattcaggaagtgacctgaagaatctatgtgtaactgcagcgcactaccccattcgagaaatcctagagaaggaaaagaaggagaagaatgttgcaaagtcagaaggtaggcctgagcctgccttgcatggaagcgaggacatccgtcctcttagtttggatgacttcaaatctgcccatgagcaggtttgcgcgagcgtgtcatctgattcggcaaacatgaatgagcttgtccaatggaacgacctctacggcgaaggaggttcaaggaagaagaaagcactgagctacttcatgtgagagctctcacaagaatgtgccatattgtacagtcgctatactacccctccctcctcggcaggtgcatcttggcgacttgtccggcctaaaccagtcgggtttttcctgcctctccccttcaggagcagcggccgcctaccatcctgatcctcctccctcccgtgtaattaaaattgtgcaccgagtctgggttatttatcagcttctgtttgttcctattaacttcaaaaaagagaatcctccatcctcctctcttgatcacctgcctgtttgcagccattgtcgttgagcttggctgtaggccccttgtgtgcacctatgtacatgtttaatgaaagggcatggaataagaacct

SEQ ID NO: 3791 - DNA, 350 bp, Triticum aestivum
gaagattgccgccttcgttcccaatgatggttgcctgaacttcatcgaggagaatgacgaggtgctgatcgctggattcggtcgtaagggacatgctgtgggagatattcccggtgtccggttcaaggtcgtcaaggtgtcaggtgtttctctgcttgccctcttcaaagagaagaaggagaagcccaggtcttagattgccgttgcatggagtagacagtatgtcgggcctttagatgttgaaggaggatggtacctttgtgtttacagcacttttaagttgataacttatgatcgtgttggtgaaaactatgccttgtcacattttgctcctgttatgggaaagtgct

SEQ ID NO: 3792 - DNA, 635 bp, Triticum aestivum
caacaagaacagcttggattggagaagaacactctgtatgactacttgcttaatcctaagaagtacatccctggaaccaagatggtcttacctgggctgaagaagccacaggaccgtgctgatctcattgcgtacctgaagaaagccacctcctcttgaaagggcatgatgatgctgtgatcttgtcatggcgagtaaattcattttgcagtaaaataagaagatcgctgcctttgtgcccaatgatggttgcctgaacttcatcgaggaaaatgacgaggtactgattgctggattcggtcgtaagggtcatgccgtgggagatattcccggtgtcaggttcaaggttgtcaaggtatctggtgtgtcgcttctcgctctcttcaaggagaaaaaggagaagcccaggtcttagattgcatttttgttaggcaaggatggaatggactgtaaggctctggtcgtttgaggaggaaagttgcctgctatgtttacaatgtcctatataacctgaagttgtactagcgagatttgttccttctctgctgttgctttctcttaacagttgctattaagagtattgtttccatgatctggatatatattgttgcttttatctcatgtgctatgattgt

SEQ ID NO: 3793 - DNA, 432 bp, Triticum aestivum
gaagatcgctgcctttgtgcccaatgatggttgcctgaacttcatcgaggagaacgacgaggtgctgattgctggattcggtcgtaagggtcatgccgtgggagatattcccggtgtcaggttcaaggttgtcaaggtatctggtgtgtcgcttctcgctctcttcaaggagaagaaggagaagcccaggtcttaggttgcatttttgttaggcaaggatggaatggactgtaaggctctggtcgtttgaggaggaaagttgcctgctatgtttacaatgtcctatataacctgaagttgtactagcgagatttgttccttctctgctgttgctttctcttaacagttgctattaagagtattgtttccatgatctggatatatattgttgctgtgttactctgctggctagtgggttttatctcatgtgct

SEQ ID NO: 3794 - DNA, 712 bp, Triticum aestivum
gtgcgccggccagcctgctgatggctccaagcttttcgttgcggtcttgcctgggctactgatgatcattcgctgaaggaggcgtttcaaagctttggtgaggtcgttgaagcacgtgttatcactgacagggagactggaaggtctagagggtttggttttgtgagcttcgccagtggcgaggatgcaaagagtgctgcagaaaacatggacggcaaggagcttgctgggaggaacgtccgtgtgaactttgccaacgagcgaccttcgggtggtggcggcggtggcttctctcgtggcggcggtggctatggaggtggtggcggcggatacggcggcggtggctacggtggtggcggtggatacggcggcggccgtggtgctgctggaggtggctatggtggtgaccatgagtcctactaagaagagcactggctatcaaatttaaaataatgaagtttttaggacagtgtcttgattatgtggaacctaatgttacgtcgttctatgttctttttggttttggtttgtttcttgatagtgcaagagttaatttgtgtatgctgcttcgaggctcggatgagtctcaaggaagttcatgcattttgccgtatattgcactgtacttgtagagaatgatcgcgtatgttagtgtgatcataaattctcttcgcattacattcaaatatattgagatcttcgctagaaattt

SEQ ID NO: 3795 - DNA, 962 bp, Triticum aestivum
ctcccctcttaaaccccagcccccactccccattccccattcccccctcccccgccgtctcgtcccagctcgccctccagaggttttagtcttcctccatggcggccctcatcaagctcggaagccttcttaggcagagtgctgtggctagcagtgcctccaccggctcggctcctgccctgttcaacgctgcccgcttcatgtgcgccggccagcctgctgatggctccaagcttttcgtcggtggtctcgcctgggctactgatgatcattcgctgaaggaggcgtttcaatgctttggtgaggtcgttgaagctcgtgttatcactgacagagagactggaaggtctagagggtttggttttgtgagcttcgccagcggcgaggatgcaaagagtgctgcagaaaacatggacggcaaggagcttgcggggaggaacgtccgtgtgaacttcgccaacgagcgaccttcgggtggtggcggcggcggcggcttctctcgtggcggcggtggctatggaggtggtggcggcggctatggtggcggtggctttggtggtggcggcggatacggtggtggccgtggtggtgtggcggcggctatggtggtgaccgtgagtcctactaagaagagcactggctatcaaatttaaaataatgagtttttaggacagtgtcttgattatgtggaacctaatgttacgtctgtctgttatctgcgatagttgaactcaataggggcagagatgtggttctatgttatttttggttttgcttttttcttgatgatgcaagagttaatttgtgtatgctgcttcgaggcttggatgagtctcaaggaagtttcatgcattttgccgtatgttgcgctgtgtacttgtagagaatgattgcgtatgttagtgtgatcataaattctcttcgcattacattcaaatattaagatcttagctataaatttg

SEQ ID NO: 3796 - DNA, 508 bp, Triticum aestivum
gccaaaccagcgcgtgtcctggagatggttgcgtgcgccgaaggtataggtgtgccccgtggctccggaatgttcaggcgcgctctgcagtctgttgcattcctcagcaaggagaagatcgccaccagaatggactacttgaagaagacggttaggtggtcggatgcggaggttggcattgctgtgtccaagggtccatctgtgctcgtgacgtcaaaggacatgctgaagcgcaggtctgaattccttatctctgaggtggggttggagccggcgtacattgcccgccgcccatcattgctcaattatagcttggagggccggctcaggccccggtactatgttatgaagtttcttacggaaaacagattgctcaagcgtgccatgtgctactatacatttgtcaaggccaccgagatggaattcttggacaagttcatatgcccttacaaggaagctgcaccacaccttgctgaagactatgcagctgcttgcaaaggggaagtgc

SEQ ID NO: 3797 - DNA, 693 bp, Triticum aestivum
gtcgattgaggaccgttgaccaggatgactggtgcactatgctaagatgactgaagaatgtggagtggaagttcagattgttggtgatgaccttctagtcaccaacccaactagagttgcaaaggcaatccaggagaagtcatgcaatgctcttctgctcaaggttaaccaaattggatccgtcactgagagtatcgaggccgtgaagatgtcaaaacatgccggctggggtgtgatgaccagtcacaggagtggtgagaccgaggacacattcattgctgatttggctgttggtctgtccacgggtcagattaagaccggggctccgtgccgctcagagcgtcttgccaagtacaaccagcttctgaggatcgaggaggagctggcgcgatgaccgcggtgtagcgctggcctcaagttccgtgcaccggtggagccctaactagatgggatctgcacgagtttttgtgaaaatgggtgtgtttaacctccggaatgaactctggttgaagctcttaggattgagcaataatgaatgccgcgcatgttttatgtgaacggaacggatatgtacccccaaacttgctccaattttggtccttgtggatatgtacctgattccggccctgaacctattatggatgctcgtaatatctatgtttttggcgcatcatctattgccgattattctgt

SEQ ID NO: 3798 - DNA, 646 bp, Triticum aestivum
agctcttgaagactgcaattgaaaagctgaatacaccggcaaggttgtcatggaatggatgttctgcttcagagttctacaatgacaaggacaaacctatgacctcaacttcaaggaagagaacaacgatggttcccagaagatatctggagatagcctgaagaacgtatacaagtcattcgtgagcgagtaccccattgtgtcgattgaggacccgtttgaccaggatgactgggtgcactatgctaagatgactgaagaatgtggagtggaagttcagattgttggtgatgaccttctagtcaccaacccaactagagttgcaaaggcaatccaggagaagtcatgcaatgctcttctgctcaaggttaaccaaattggatccgtcactgagagtatcgaggacacattcattgctgattaagaccggggctccgtgccgctcagagcgtcttgccaagtacaaccagcttctgaggatcgaggaggagctgggcgatgccgcggtgtacgctggcctcaagttccgtgcaccggtggagccctactagatgggatctgcacgagtttttgtgaaaatgggtgtgtttaacctccggaatgaactctggttgaagctcttaggattgagcaataatgaatgccg

SEQ ID NO: 3799 - DNA, 768 bp, Triticum aestivum
gccgcccatggcagtgacgaacgccgtgtcatggcggagcgaggggattcggtacaagaagaatgaagtgttcttggatgtggttgagagtgttaacattcttgtcaatagcaacgggcagatcgtgagatctgacatcatcggcgcgctgaagatgcggacctttctgagtggaatgcccgagtgtaaacttgggttgaatgatagagttcttttggaagcgcaaggccgagcaactaaaggaaaagcaatagatctggatgatatcaaatttcatcagtgtgttcggttgaccagatttgagaatgataggactatatcattcgtccctccagatggagcttttgatctaatgacttacagactcaccacacaggtgaagcctctgatctgggtagaagcacaagttgagaagcattcaagaagccggatagagatcatggtgaaggcaaggagccagttcaaggaaagaagcaccggaacaaatgtagaaattgaagtacctgtaccctatgatgcgacaaacccaaatataaggacttcaatgggttctgcggcatatgcacctgagagagacgcaatggtctggaaaattaaatcatttcctggtggcaaggaatatatgtgtagagcagagtttagccttcccagcattacctcggaagaagcccactgaacaatctttaatttcctttctaccgaaaaaaacatggataaaaacatgaagagaggtcatggaaagtttttaattcaagtgtttgtaatttt

SEQ ID NO: 3800 - DNA, 1148 bp, Triticum aestivum
gaagaatgaagtgttcttggatgtggttgagagcgtcaacattcttgtcaatagcaatgggcagatcgtgaggtctgacatcatcggcgcgctgaagatgcggacctttctgagtggaatgcccgagtgtaaacttggtttgaatgatagagttcttttggaagctcaaggccgagcaactaaaggaaaagcaatagatctggatgatatcaaatttcaccagtgtgttcggttgaccagatttgagaatgataggactatatcattcgtccctccagatggagcttttgatctaatgacttacagactcaccacacaggtgaagcctctgatctgggtagaagcacaagttgagaagcattcaaggagccggatagagatcatggtgaaggcaaggagccagttcaaggaaagaagcaccggaacaaatgtagaaattgaagtacctgtgccctatgatgccacaaacccaaatataaggacttcaatgggttctgcggcatatgcgcctgagagagacgcaatggtctggaaaatcaaatcatttcctggtggcaaggaatatatgtgtagagcagaatttagtcttcccagcataacctcggaagaagcaacccctgaaaagaaagctccagtacgtgtgaaatttgagataccatattttactgtttcaggcattcaggttcgttatctgaaagtcatcgagaaaagtggataccaggcccttccttgggttaggtacatcacaatggctggtgaatatgagctgaggcttatctgatctctgctctagctgttggaacaatcgagcagtttgttagagtctgaggaggcgaggcgaggagcacatgtagtgctgcacctgaattaccgcggcaggatagatggcgtttaccggcaggttggggctcttctccctaaagctccacccttccaccatgcagagttctcttagtggtttttacccatgtttgctgtaagttatcatccatcagtacagttgcctagttgaattcttgttttccaattctttcctggtcgatatcacatgtatcatattggtttatttgccctattgatgtcactcacaagcttgggccctgtttctaatgttactattttgcttccaagctattttcgattaggac

SEQ ID NO: 3801 - DNA, 964 bp, Triticum aestivum
tcaaacaacagtctcctggactctgattttgaagcgcatgttgctgatttcgggcttgccaagttcttgcaggactctggcacatcagagtgcatgtcagccattgccggttcttacggctatattgctccagagtacgcgtatactctcaaggtggatgaaaagagcgatgtttacagcttcggtgtagtgcttcttgagctgattacgggaaagaagccggtaggggagtttggcgatggtgtggacattgttcactggatcaagatgatgacgggttccaaaagggagcaggttatcaagatcatggacccaaggctgtcaacagtgcccgtgcatgaggtaatgcacgtcttctatgttgcgttgctttgtgtggaggaacagagcgtgcagcgacccacaatgcgggaggtggtgcaaatcctcagtgagctacccaagccgactacgaagcatggagaggagcagcttactggtagtggtgatggtgatgaatctggtcctgtaggacctcctgaaactgtggagcctgcaactgatgaagcaaaggagcagcaccaacagcagcaaccgagctcgccgtcttcacttcctcccaatctcatcagcatctgaagaactgtcaacctgaattattgccatttattttgtcaaatttggatgtttaattcttgtagtcttaaggtttggtatgctgttctctgcagcataggtctctggctttctagttgtgctgtcaagctgaattgtttacgtaggtactcctatttgtgctgtaaatatcatgctattttttttctatatctctactttcctgttacaatcaagagactagtcagggagttaagagattagttatggtggagctatcctgctttcctgttacaatcaagtgctttctccatccagtgtggcatctaacaatgactctgcaaatcatcaagatttcttaaaggttttc

SEQ ID NO: 3802 - DNA, 603 bp, Triticum aestivum
agatgatgaacaactgcgccgtccggagcgtcctcagtggtgtcatggggggtggtcttggtgtacttatgggactattttttggagctttggaaaatccaataatgtcagaggagatgacagcaaggcaacaaatagtctaccaggcaaaacagatgggcaggaaaagtatgagccatgctaagacctttgcagtaatgggcttgattttctctgcagctgaatgcgtcgtagagaaggctcgggcaaagcatgacattaccaattcggcagtagctggctgtgtcacaggaggggctttagctgcaaaaggtggccctcaggccacatgtatcgggtgtgtgggttttggtgccttctccgtggcgattgagaagttcatggaacggcatacttgaatcggtgatggaaacgttgcatcctataaaccaagtgatgcgtctttgtagcaaatcattagcaggattcagcattggccgaagaagttttggttattctgcaatattcagtcgttggcatgtatcccaagatggggtaacctaaattttaagtcttgcggctgtccatccattgcactgagtagctaacttagtctgtagccag

SEQ ID NO: 3803 - DNA, 719 bp, Triticum aestivum
gtggagccgctccggctgccaacgccggaggagatcaagggccaggagatgatgaacaactgcgccgtccggagcgtcctcagtggtgtcatggtagggggtggtcttggtgtacttatgggactattttttggagctttggaaaatccaataatggcagaggagatgacagcaaggcaacaaatagtctaccaggcaaaacagatgggtaggaaaagtatgagccatgctaagacctttgcagtaatgggcttgattttctctgcagctgaatgtgtcgttgagaaggctcgggcaaagcatgacattaccaattcagcagtagctggctgtgtcacaggaggagctttagctgcaaaaggtggccctcaagctacatgcatcgggtgcgtgggttttggtgcgttctctgtggcgattgagaagttcatggagcgatataactgaatcggtgatggaaacgttgcatcctataaatcgagtgatgctgtctttctagcaagcattagcaggattcagcattggccgaacaacttttggtttattttgcaatattcagtcgttggcatgtatgtactcagagatggcgtgacctaaattttacgtctcgcggctatccatcgcactgagtagctatattgtttctccagtctgtagccagtttgatgtcatggcatgtggtatacgcattttgacttatgcaatctcgtagctagctg

SEQ ID NO: 3804 - DNA, 730 bp, Triticum aestivum
cgagctgtccggcatccctcctgcacccaggggagttccccagatcactgtctgctttgacattgatgccaatggtatcctgaacgtgtctgccgaggacaagacgactgggcagaagaacaagatcaccatcaccaacgacaagggcaggctgagcaaggaggagattgagaagatggtccaggaggctgagaagtacaagtctgaggatgaggagcacaagaagaaggtggagtcaaagaatgccctggagaactactcctacaacatgcgcaacaccatcaaggatgagaagattgcctccaagctgccagcggacgacaagaagaagattgaggacgccatcgacgctgccatccagtggctggacacgaaccagctcgctgaggcggacgagttcgaggacaagatgaaggagctggaggccctgtgcaaccccatcatcgccaagatgtaccagggcgctggtgccgacatggagggcggcatggacgacgacaccccggctgcttccggcggtgctggccccaagatcgaggaggtcgactaaatgagtcgatgttctgttgcagaggcggtgaagcctgcttcttagttattatgtgtgtcctatgttatctgagactgggttgcggtgtgttttggtacgagtggtcagggttattctgtgcgagttgacattcgtggaacatcagtggattatgggtcacgtcacgtctaagtaatacaa

SEQ ID NO: 3805 - DNA, 651 bp, Triticum aestivum
aatggcattctgaacgtctctgcggaggacaagacgactgggcagaagaacaagatcacaatcacgaatgacaagggcaggctgagcaaggatgagatcgagaagatggtgcaggaggcagagaagtacaagtcagaggacgaggagcacaagaagaaggtggagtcaaagaatgcctggagaactatgcctacaacatgcgcaacactatcaaggacgacaagatcgcctccaagctagctgcggacgacaagaagaaaatcgaggacgccattgaccaggccatccagtggctggacggcaaccagcttgctgaggcagatgagtttgacgacaagatgaaggagctggagggcctctgcaaccccataatcgccaagatgtaccagggtgccggagctgacatggcgggtggcatggacgaggacgatgcgcctccggctgccggcggcgctggccccaagatcgaggaggtcgactaagcgagcacttgtaccagtcttttaccctaaagtttatcccgttcgttatgttggatgctactgcagtacgtggtgttggatgtgagctttgtgtgtgtgaactgcgtttgctgctgcctgcttttctgttaatgttagttacatctggtgatatgctgctattgctctt

SEQ ID NO: 3806 - DNA, 741 bp, Triticum aestivum
  misc_feature (8)..(8): n = any nucleotide
  misc_feature (15)..(15): n = any nucleotide
aaacaacntgctggncaagtttgactctccggcatccttcctgccccccaggggtgtgccccagatcacggtgtgcttcgacattgatgctaatggcattctgaacgtctctgcggaagacaagaccactgggcagaagaacaagatcacaatcacgaatgacaagggcaggctgagcaaggatgagatcgagaagatggtgcaggaggcagagaagtacaagtcagaggacgaggagcacaagaagaaggtggagtcaaagaatgccctggagaactatgcctacaacatgcgcaacaccatcaaggacgacaagatcgcctccaagctagctgcggacgacaagaagaagatcgaggacgccattgaccaggccatccagtggctggacggcaaccagcttgctgaggcagatgagtttgacgacaagatgaaggagctggagggcctctgcaaccccataatcgccaagatgtaccagggtgccggagctaacatggcgggtggcatggacgaggacgatgcacctccggctgctggcggcgctggccccaagatcgaggaggtcgactaagcgagcacttgtaccagtcttaccctaaagttattccgttcgttatgttggatgctactgcagtacgtggtgttggatgtgatgtgtgtgaactgcgtttgctgctgcttttctgttaatgttagttgcatctggtgatatgctgctattgctctcgtccacctgag

SEQ ID NO: 3807 - DNA, 779 bp, Triticum aestivum
tttgagctctctgcatcccgcctgcgcccaggggtgttccccagatcactgtctgcttcgacattgatgccaacggtatcctgaatgtctctgctgaggacaagaccactggccagaagaacaagatcaccatcaccaacgacaagggcaggctgagcaaggacgacattgagaagatggtccaggacgcagagaagtacaagtctgaggacgaggagcacaagaagaaggttgacgccaagaactccctggagaactacgcctacaacatgaggaacaccatccaggacgagaagatcgcctccaagctgcctgctgatgacaagaagaagatcgaggacgccgttgacgccgcgatccagtggcttgacgccaaccagctcggtgaggttgacgagtttgaggacaagatgaaggagctggagggcctctgcaaccccatcatcgccaagatgtaccagggcgccggtgctggcatgcccggaggcatggacgaggacgcgccggctgcgagcggcggtgctggccccaagatcgaggaggtcgactaagttagtcgcttttatatagtgagaaatacactatacaccattttattcagtcctgggtgccaatcatatcacctgggctggaagttttgttgtactttttggtctgtagcatcacgagacttgtgtgtgtcgtgaacaatgcaatgatgcatgttttggctcattgttgatttcagcttaatgcttattatttggactaccctacccgtgtgatttcattctgaatta

SEQ ID NO: 3808 - DNA, 792 bp, Triticum aestivum
gagggtgagaggacaaggaccagggacaacaacctgcttggcaagtttgagctctccggcatcccgcctgcacccaggggtgttccccagatcactgtctgcttcgacattgatgccaacggtatcctgaatgtctctgccgaggacaagaccactggccagaagaacaagatcactatcaccaacgacaagggcaggctgagcaaggacgacattgagaagatggtccaggatgcagagaagtacaagtctgaggatgaggagcacaagaagaaggttgatgccaagaactccctggagaactacgcctacaacatgaggaacaccatccaggacgagaagattgcctccaagctgcctgctgacgacaagaagaagattgaggatgctgtcgacgccgcgatccagtggcttgacgccaaccagcttggtgaggttgacgagtttgaggacaagatgaaggagctggagggcctctgcaaccccatcatcgccaagatgtaccagggtgccggtgctgacatgcccggaggcatggacgaggacgcgccggctgccagcggcggtgctggccccaagatcgaggaggtcgactaagttattctctttgatatagtgagaaaatacactatacgccatttgtttcagtcctgggtgccaatcatatcacctgggctggaagttttgttgtacttttggtctgtagcatcacgagacttgtgtgtaccgtaaacaatgcaatgatgcatgttttggctcattgttgatttcagcttaatgcttattaggtga

SEQ ID NO: 3809 - DNA, 635 bp, Triticum aestivum
ctcaagttccaggactcaaggcgaagaggagcttccgcgtcatcgtgttcaagatcaatgagaaggtgcagcaggtggtggtggacagggttggggaaaaaaatgagagctatgatgatttcacagcctgcttgcccgctgacgagtgccgctacgcggtgtttgattttgacttcgtcactgacgagaactgccagaagagcaagatcttcttcatctcttgggctcctgacacatcaagggtgaggagcaagatgctgtacgcgagctccaaggaccgcttcaagagggagctggacggcatccaggtggagctacaggcgaccgacccgagcgagatgagcatggacatcgtaaaggggcgagccctctgaagaagagaaaatccgagaacagctacttactacgtacacccacatccaaacccaggagcaggagcagaggaggccttcatctgcgccggctcctgttcttgcagttcctccccatccattttccctgccattcttttcctggaagcgaagtgctgtgttctgtatgagactgtatgccgtcttcattcttgttttcccccgtgtttggtgccatagtctctgactactgctgtaaactagaacatattcgcatttgatgcc

SEQ ID NO: 3810 - DNA, 754 bp, Triticum aestivum
tccgtccgtggaaagaagagaaagcccatcgtcagccatggcgaactcggcgtcgggcatggccgtgagcgacgagtgcaagctcaagttccaggagctcaaggcgaagcggagcttccggttcatcacgttcaagatcaacgagcagacgcagcaggtggtggtggaccgggtggggcagccgggcgagacctacgccgacttcaccgccaccatccccgccgacgagtgccgctacgccgtcttcgacttcgacttcgtcaccgacgagaactgccagaagagcaagatcttcttcatctcctggtccccggacacgtccagggtgaggagcaagatgctgtacgcgagctccaaggacaggttcaagagggagctggacggctaccaggtggagctgcaggccaccgaacccagcgagatgacgttggacatcgtcaaggccagagccctctgaacaaatttctcatcgcatcgctccttgcaggctccaaggccagcagctggatctacatcacgccctacgtacctgcgcccccgtaccatcgtatgccgtttcccctccgtcgtcggtgtcggagcctccccctccttgtaaactagacatagatggtctctctcgttgtctttcccgtttccaagattttagacggcatgcccgatcttatttccccccttgttgctgaggtgcgtactacgtaaatttgtccgtgctcgttgtgtaagcgactcgctccacacgggccgcacggca

SEQ ID NO: 3811 - DNA, 848 bp, Triticum aestivum
gattgataatgaagggcgctcttcgttgtttgtttgttgtttgtgtgattgcaatgcaaggcgaaactcggcgtcggggcatgggccgtgagcgacgagtgcaagctcaggttccaggagctcaaggcgaagcgaaccttccggttcatcacgttcaagatcaacgagcagtcgcagcaggtggtggtggaccgggtggggcaaccgggcgagacctacgccgacttcaccgccaccatccccgccgacgagtgccgctacgccgtcttcgactttgacttcgtcaccgacgagaactgccagaagagcaagatcttcttcatctcctggtccccggacacgtccagggtgaggagcaagatgctgtacgcgagctccaaggacaggttcaagagggagctggacggctaccaggtggagctgcaggccaccgatcccagcgagatgacattggacgtcgtcaaggccagagccctctgaacaatttcccatcgctccttccaggctccatggccagcagctggatctgcatcatgccctacgtacctgcgcccccgtatcgtatgccgtttcccctccgtcgtcggtgtcggagtctccccctccttgtaaactagacatagatggtctctctcgttgtctttcccgtttccaagattttagacggcatgcccatcttattttccccttgttgctgaggtgcgtactacgtaaatttgtccgtgctcgttgtgtaagcgactggctccacacgggccacacggcaattattcacgaaaagacaaacattagtaggtgtcttttagcatagtggtctccataatgtgctcgttccaaaaggagccctc

SEQ ID NO: 3812 - DNA, 674 bp, Triticum aestivum
aacagaagaggacgtcatcgacgacctcatggcattccaagagagcaaggagtactatgctaaggtcggacaaggcgtggaagcgcgggtacctcctgtacggcccgcccggcaccggcaagtccactactgactagccgccatggccaacttcctcgacctacgatgtctacgacctcgagctcacggccatcaacaacaacaccgagttgcggaagctcttcatcgagacgacgggcaagtccatcatcgtcatagaggacattgactgctccgccgacctcaccggaaaacgccgcaaggacaagaaggcctctcgcgacaaggactctgatggcaacgacaaacccaagctaccaatcgagccagagaaggatgacgcggccaatgtgacgctctctggcctgctcaacttcatcgacgggctgtggtctgcgtgcggcggcgagcggatcatcatcttcaccaccaactacaaggagaagctggacccggcactgatccggcggggcaggatggacaagcacattgagatgtcttactgccgctttgagagcttcaaggtactcgccaagaactacctagatgtcgtcgggcacgagctgtttggggagattcagcagctgctcgaggagaccgacatgtcgcccgctgacgtggcggacgaacctgat

SEQ ID NO: 3813 - DNA, 1053 bp, Triticum aestivum
  misc_feature (303)..(325): n = any nucleotide
  misc_feature (967)..(967): n = any nucleotide
gcaagtcatcatcgtcgttgaggacatcgactgctccctcgacctcaccggcaagcgcaagacgaagaagaagaaaccaaacaagaagaagagcaagagcggcgacaaaaagaagaaggccccgcggcaccggcaagtccaccatgatcgacgccatggcaaagtacctggactacgacgtgtacgaactggagctgacgtcggtgaagaacaacaccgagctgcggaggctcttcatagagaccaagggcaagtccatcatcgtcgtagaggacatcgactgctccctcgaactcaccggcnnnnnnnnnnnnnnnnnnnnnnnaccaaacaagaagaagaagccaagagcggagacaaaaagaagaaggccccgccggcgccaggcgccggcaaggacgaagaaaacaaggtgacgctgtcggggttgctcaatttcatcgacgggctgtggtcggcatgcggcggcgagcggatcatcgtgttcaccaccaaccacaaggagaagctggacccggcactgatccggcggggcaggatggacgtgcacatcgagatgtcatactgctgcttcgagtccttcaaggtgctcgccaagaactacctgcacgtcgacgaccacgagctcttccatgaaatccggcaacttctaggggcggtcaatatgaccccggccgacgtggccgagaacctgatgcccaagtccaaaaagaaggatgtggacacctccctggccaggctggtcaaagcgctcaaggaagcaaaggaggaagcgttggccaaagcactggccggggcagagcacgaagagggagccgaagatgatgacgaggaggaagatgacagcagcagctcgagcgaagaggaggaaaatgggaagaaaaaagaagagtagaatgatatatacgcaatgatatcatagttttttacaagtactcgtatgtatgaaggcaataagaacttgtantcgtacataacatcatcagtttcaaatgagtaaatatatctccaagcacaaaatgtgagatgatgatacggtcgacaaaatgcgtc

SEQ ID NO: 3814 - DNA, 633 bp, Triticum aestivum
agaggagcttccgcttcatcgtgttcaagatcaatgagaaggtgcagcaggtggtggtggacagggtcggggaaaaaaccgagagctacgatgatttcacagcctgcttgccagctgacgagtgccgctatgcagtgtttgattttgacttcgtcactgatgagaactgccagaagagcaagatcttcttcatctcttgggctcctgacacatcaagggtgaggagcaagatgctgtacgcgagctccaaggaccgcttcaagagggagctggatggcatccaggtggagctacaggcgaccgacccgagcgagatgagcatggacatcataaaggggcgagccctctgaagaagaaaacctgagcccagctacttactacgtacaccgacacccaccccaggagcaggagcagaggagggccttggtctgcaccagctcctgttcttgtagttcctccccatccattttccctgtcattcttttcctggaagcaaagtgttgtgttctgtatgagactgtatgccgtcttcattcttgttatcccccgtgtttggtgccatagtctctgactactgctgtaaacttagaacatatttgcatttgatgcctggtgtgaagcctaatgtggcgt

SEQ ID NO: 3815 - DNA, 639 bp, Triticum aestivum
agctggaggtttagaagccctgatcgcatctttgtggtggcctccccgtactacttcaccgaggctcaagtgcgggagttgcttgaatcctttggaccgttgcgaggatttgatcttgtgaaggatagggagacaggcaactcgaaaggatatgccttctgtgtataccaggatcttaatgtcaccgacattgcctgtgctgccctgaatggtatcaagatgggagacaagaccctcactgttaggcgagcaaatcaaggcacttctcaaccaaggccagagcaagaaaccatcctgttgcacgcacaacaacaagtgcagatgcagaaactcgtgctacaagttggaggcgctctaccgacaaggtggtatgcctgacccaggtggtttcagcagatgaactgagagatgatgaggaatacgaggatattttggaagatatgagggaagaagggcgcaaatatggtaaacaaatgaaatccatggacttgccttcatcttgttttaaacccttgcattctgtaatcattgtgttcagttactgaacttgttttgttttgtgtgttgtctttttgtgtgtcttttttgtagtccacataaatgccattgcagagtcttttgtagtccaaccccatgcat

SEQ ID NO: 3816 - DNA, 562 bp, Triticum aestivum
ctgtttttgaggtaaatgctgccactgcatggtccaccagaatgaagatcgcatgggtgctgcaaggggtcttgccttccttgcacgaaagctgagaagcctgtcatttacagggacttcaagacatcctacatattgctcgacgaggagtacaacgcaaagctctctgacttcgggctggcgaaggatgggccggtcggcgacaaatcacacgtctcgacccgcatcatgggcacctacggctacgccgccccagagtacatcatgacagggcacctgacggcgatgagcgacgtgtacagctacggggtggtgctgctggagctgctgacggggcgcaagtcgctggacaggtcaagaccggtgagggagcagacgctgacggactgggccttcccgctgctggcgcacaggaagaaggtgctgggcatcgtcgaccccaggctcaccgccgacgactaccccgtgaaggccgtgcacaagacggccatgctcgcctaccactgcctcagccgcaaccccaaggccaggccgctcatgcgcgacatcgtcgccaccctcg

SEQ ID NO: 3817 - DNA, 447 bp, Triticum aestivum
gacaagaaggcctctagtgacaaggactccgacgatgatgacaaacccaagctaccgatggatccagagaaggacgacgccaccaaggtgacgctctcgggcctcctcaacttcattgatggactttggtctgcttgcgggggtgagcggatcatcatcttcactaccaaccacaaggacaagctcgatccggcgctgatccgtcgaggaaggatggacaagcacatcgagatgtcatactgccgcttcgagggcttcaaggtgctcgccaagaactacttagatgtcatcgagcatgagctgtttggggaaattcagcggctgctcgaggagaccgacatgtcgcccgccgacgttgcagagaacctgatgccaatgtcgaagaagaaaaaaagggaccctgatttgtgtttgtcgggcctcgtcaaggcactcaagcaggccaag

SEQ ID NO: 3818 - DNA, 881 bp, Triticum aestivum
atgtgagcacagttgtcaagggcagttttggttatctagatcctgaatatttccgcaggcagcagctcactgagaaatctgatgtgtattcgtttggtgtggtgctgttcgaggtcctttgtgctcggcctgccttgaaccccactcttgcaaaggaagaagttagcttggcagagtgggcactgcattgccaaaagaagggaattcttgatcagattgttgatccctacctgaagggaaagattgttccgcagtgcttcaagaagtttgccgagacggctgagaagtgtgttgccgacaatggcatcgagcgcccttcgatgggagatgtgctttggaacttggagtttgctcttcagatgcaggaaagcgcggaggagagtggaagcattgggtgtgggatgtcagatgagggcactcccctcgtgatggttggaaagaaggatcccaatgacccatcaattgattccagcaccactacgaccacaacaacttccctaagcatgggtgaccaaagtgtcgcgagcatcgactcggatgggctgacgccgagcgcggtgttctcacagatcatgaaccccaaggggcggtgaggtaaaaatctgggtctgcttttcagtcagtcaccgttggggcctgcctaatttattcattcagcatattttcatgcgtttgtgctcttgctgtctcgcaagttatgcattagaagtcaaaaaattgttccatattagatatttctgtcttgccttgtttttttttcttcttcctcttcttcagtgttgtaatgactatgcttatttgcatgttgttattgtaccaccactgctatgtgttgttgatccaacatgtaatactgtatgagaaaaagaaagtgatgtgca

SEQ ID NO: 3819 - DNA, 1636 bp, Triticum aestivum
ctcgccaccacacccaatcgcccgctcgctccctcggctcggcgtcgatcgatctctccttctacccgagctgctccgtcgtccggacggcgccgtcgaccgcgtgcttgccagatctgaagtcaaagcaggagaggacggacatgcagggagcgccggtggacagcccgggggcggcggaggcggcggcgcggccgagccggtacgagtcgcagaagcgccgggactggcacacgttcgggcagtaccttcgcaaccaccgcccgccactggagctctcgcggtgcagcggcgcccatgtcctcgagttcctccgctacctcgaccagttcggcaagaccaaggtgcacgccgcgggctgccccttcttcggccacccttccccgccggcgccgtgcccgtgcccactccgccaggcctcgggcagcctcgacgcgctcgtcggccgcctgcgcgccgccttcgaggagcacggcgggcggcccgaggccaacccgttcggcgcgcgcgccgtccgcctctacctccgcgaggtgcgcgactcccaggccaaggcacgtggcatcgcctgttgggagtaaaccacgcctccagacgatgactggtgtgcatgcacgggtatgcgctccaggtccgactcataaggcagcggccgttggcaagagcggagggctagtgcgttggttcgttagctagcccgcatggccgggtctcctgtgtacgcgcatgcaccgtagttagcaggttagttggttagtgcatgcatgcatcatggatatggatgccgtgcatgtagctggcttagtgagtttgttagctagactagtgcgtgcgtgcgtggagttagtggccggtgtggtggccggatggtgtgtgtgcagccgggtataaaaggcctcctgatgtattgatgaagtggagccgtgtgtagccatgtagtcactgtaaggaagaaaaggattggggcgttcgtgcgcccgtggcggcgttcgtgcgccggccggaaaatcttgtgtccattcttcttcttccacctccattcgattgcgaggagaggtagctagagggccgcggttccaacatcctgctgctgcagcgcgaactcgaggttccacagcacgtcgcccatggacggccggtccacgccctggtccgccaggcacttctccgccgtctcggcgaacttcttgaggcagtcgggcgcgatcttcccctccagcaccgggtcgatgatctcctccagggtgcccttccgctggcagctcagcgcgtggtccgccaggctcacctgctcccgcggcaggctcgggttcagcgccggccgcccgcacagcacctcgaacagcaccacgccgaacgagtagacgtccgacttctccgtcagcttctgccgccggaagtactccgggtccaggtacccgaagctgcccttcaccatggtgctcacgtgcgtctggttctgcaccgtcggccccgtcttggagagcccgaagtcggacaccttggccacccacttctcgtcgacgaggatgttggtggtcttgacgtcgcggtggatgatggtgtacttggcgcccgtgtgcaggtagtggagcccccgggcggcgccgatccgatctccagccgctgcctccac

SEQ ID NO: 3820 - DNA, 708 bp, Triticum aestivum
cgcaaccctagagcctcgcctccctcctccccctctcccgggcgcctccaccccccgccttagcggcgcgaagcgaccatgacgttcaagcggaggaacggcgggcgccaacaagcatggccgcggccacgtcaagtacatccgctgctccaactgcgccaagtgctgccccaaggacaaggctatcaagcgtttcttggtgaggaacatcgtggagcaggctgctgtgagagatgtgcaggaggcttgtgtgcatgatggatatgtgcttcccaagctgtacgccaaggtgcaccactgtgtgtcttgtgccatccatgcccacattgtccgtgtccgctcgcgtgagaacaggaggaaccgtgagcccccgcagcgtttcaggcgcagggatgatggcccgaggcctggacagggtggcccgccccgtgctggtggacctggtggcgcgcctgctggcgctggtgccgttcctggtgctcctgctccccgtgtctagtttgggaatgcttccgtgatatggagccagccctagttttactcgtccctggatattgaactattctacctagtttttgctgcaatcggttgtactgaaagttggttggtcaagcacaatttgtgatcaggtctttatgttttgacatttcgctgctatctatatcagagagaaccttttggtttgtctgggatgccccttgttgtttt

SEQ ID NO: 3821 - DNA, 761 bp, Triticum aestivum
gccgcaacctagagctcctccatcccctcctctcccgggcgcctccaccccccgcctagcggcgcgaagcgaccatgacgttcaagcggaggaacggcgggcgcaacaagcacggccgcggccacgtcaagtacatccgctgctccaactgcgccaagtgctgccccaaggacaaggctatcaagcgtttcttggtgaggaacatcgtggagcaggctgctgtgagagatgtgcaggaggcttgtgtacatgatggatatgttcttcccaagctgtatgccaaggtgcaccactgcgtttcctgtgccatccatgctcacattgtccgtgtccgctcccgtgagaacaggaggaaccgggagcccccgcagcgtttcaggcgcagggacgacggcccgaggcctggacagggtggcccgccccgtgccggcggccctggtgcccctggtggtgcgcctgctggcgccggtgccgttcctggtgcccctgctccccgtgtctagtttgggaatgctttgtccgtgatatgcgccagccctagttttactcgtatctggatattggactattctacctagtttttgctgtaatcggttgtactgaaagttggttggtcaagcacaatttgtgatcaggtctttaatgttttgacaatttcgctgctatctatatcggagagaaccttttggtttgtctggggattgccccttgtggttttgtgttcatgcatcatatcatcttgtagttctttcatgatgaga

SEQ ID NO: 3822 - DNA, 702 bp, Triticum aestivum
gccgccgcaaccctagagcctcgcctccctcctctcctctcccgggcgcctccaccccccgcccagcggcgcgaagcgaccatgacgttcaagcggaggaacggcgggcgcaacaagcatggccgcggccacgtcaagtacatccgctgctccaactgcgccaagtgctgccccaaggacaaggctatcaagcgtttcttggtgaggaacatcgtggagcaggctgctgtgagagatgtgcaggaggcttgtgtccatgatggatatgtccttcccaagctgtacgccaaggtgcaccactgtgtttcttgtgccatccatgctcacattgtccgtgtccgctcccgtgagaacaggaggaaccgtgagcccccgcagcgtttcaggcgcagggacgacggcccgaggcctggacagggtggcccgccccgtgctggtggccctggaggccctggtggtgctcctgccggcgctggtgctgtccctggagctcctgctccccgtgtggcgctttgatctagttctggcatgattgggcggtggcgccatccctagttttacccgtgtctggatattgaactattctacctagtttttgctgcaatcggttgtactgaaagttggttggtcaaaagcacaatttgtgatcaggtctttaatgttttggcaatttcgctgctatctataatcagagagactttt

SEQ ID NO: 3823 - DNA, 1707 bp, Triticum aestivum
cccccaccctccgctcccctctcgccgcccattgttctgcctgcggagaaccatctcatatctcggccaagatagagggaaatcctgcacatccagggtgggcaatgcggcaaccagatcggtgccaagttctgggaggtggtgtgtgatgagcatggcattgacccaactgggcgctacaccggtacctctgacctgcagttggagcgtgtcaatgtctactacaatgaggcctcctgtggtcgctttgtgccccgggctgttcttatggacctcgagcctggcaccatggacagtgtccgcactggcccttacgggcagatcttccgccctgacaacttcgtctttgggcaatctggtgcgggtaacaattgggccaagggccactacaccgagggtgctgagcttatcgattctgttttggatgttgtgaggaaggaggctgagaactgtgactgtctgcaaggattccaagtatgccactctcttggtggtggtaccgggtctggcatgggtaccctgttgatatctaaaatcagggaggagtaccctgaccgcatgatgctgacgttctcagtgttcccctcaccaaaagtatctgatactgtggttgagccatacaatgcaactctctcagtccatcagctggttgagaatgctgacgagtgcatggttcttgacaatgaggctctctatgacatctgtttcaggactcttaagctgaccacacctagctttggggacttgaaccatttaatctctgctaccatgagtggagtcacatgctgcctaaggttccctggtcagctgaattccgacctccggaagctggcagtgaaccttatcccattcccccgcctccacttcttcatggtgggctttgctccattgacatcccgtgggtctcagcagtaccgtgccctcactgtcccagagctcacacagcaaatgtgggatgccaagaacatgatgtgcgccgccgatcctcgccatggccgttacctcactgcctctgccatgttccgtggaaagatgagcacaaaggaggtcgacgagcagatgatcaacgtccagaacaagaactcatcctactttgtggagtggatccccaacaatgtcaagtccagcgtctgtgacatcccaccgacagggctctccatggcgtccaccttcgttggcaactcgacctccatccaggagatgttccggagggtgagcgagcagttcactgccatgttcaggaggaaggctttcttgcattggtacactggtgaaggcatggacgagatggagttcactgaggctgagagcaacatgaacgaccttgtctcggagtaccagcagtaccaggatgctactgccgatgaggagggcgagtacgaggatgaagatcaggagcctgaggaggacatgtaaggtgggaggtccatgtggtgctttgctgggtgggggggttctgggggcagagtttgatctgtttggtgctttgttataaatctgtttatcatcgcaactaccgcttgtacgccaccgccattcttcatgcctttcctaagctttgtatttctcatgttatggcaccttttcggtattgtatcacttgatgccatccggtatgttctgtgttgaggtttctggacctctctggtggtgaatggcttctgagttggtatttcttgcaaattatttcgtcagactgtatgcagg

SEQ ID NO: 3824 - DNA, 868 bp, Triticum aestivum
gggcttcgctccattgacatcccgtgggtctcagcagtaccgtgccctcacggtcccagagctcacacagcaaatgtgggatgccaagaacatgatgtgcgccgccgatcctcgtcatggccgttacctcaccgcctctgccatgttccgtggaaagatgagcacaaaggaggtggacgagcagatgatcaacgtccagaacaagaactcgtcctactttgtggagtggatccccaacaatgtcaagtccagcgtctgtgacatcccgccgacggggctctccatggcgtccaccttcgttggcaactcgacctccatccaggagatgttccggagggtgagcgagcagttcactgccatgttcaggaggaaggctttcttgcattggtacactggtgaaggcatggacgagatggagttcaccgaggcggagagcaacatgaacgacctcgtctcggagtaccagcagtaccaggatgccactgctgacgaggagggcgagtacgaggatgaggatcaggagcctgaggaggacatgtaaggtgggatgtccatgtcgtgctttgctgggtgggggttctgggggcagagtttgatctgtttggtgctttgttataaatctgtttatcatcgcaactaccgcttgtacgccaccgccattcttcctgcctttcctaagctctgtatttcctatgttatggcaccttttcggtattgtatcacttgatgccgtgcggtatgttctgtgttgaggtttctggttctctctggtgctgaattcaggctttctgtagttggtatttctgcggtaattattttgtcgaattctgggtgcatcatggttccgacctacgcgcattctcaagtg

SEQ ID NO: 3825 - DNA, 516 bp, Triticum aestivum
ccgtgccctcactgtcccagagctcacacagcttatgtgggatgccaagtacatgatgtgcgctcgccgatcctcgccatggccgttacctctactgcctctgccatgttccgtggaaagatgagcacaaaggaggtcgacgagcagatgatcaacgtccagaacaagaactcatcctactttgtggagtggatccccaacaatgtcaagtccagcgtctgtgacatcccaccgacagggctctccatggcgtccaccttcgttggcaactcgacctccatccaggagatgttccggagggtgagcgagcagttcactgccatgttcaggaggaaggctttcttgcacttggtacactggtgaaggcatggacgagatgaagatcaggagcctgaggaggacatgtaaggtagggaggtccatgtggtgctttgctgggtgggggggttctgggggcagattttgatctgtttggtgctttgttataaatctgtttatcatcgcaactaccgcttg

SEQ ID NO: 3826 - DNA, 666 bp, Triticum aestivum
agcaatgtggatgccaagaacatgatgtgcgccgctgatcctcgccatggccgttacctcaccgcctctgccatgttccgtggaaagatgagcacaaaggaggtggacgagcagatgatcaacgtccagaacaagaactcgtcctactttgttgagtggatccccaacaacgtgaagtccagtgtctgtgacatcccgccgacggggctctccatggcgtccacctttgttggcaactcgacctccatccaggagatgttccggagggtgagcgagcagttcactgccatgttcaggaggaaggctttcttgcattggtacactggtgaaggcatggacgagatggagttcaccgaggcggagagcaacatgaacgaccttgtctcggagtaccagcagtaccaggatgccactgccgacgaggagggtgagtacgaggatgaggatcaggaggccgaggaggacatgtaaggagggaggtccatgtggtgctttgctgggtgggggggttctgggggcagagtttgatctgtttggtgctttgttatgaatctgtttatcatcgcaactaccgcttgtacgccaccgccgctcttcctgtacggaatctgttttctatgttatgaatctattttctatgttatggcacctcctgggtattgtatc

SEQ ID NO: 3827 - DNA, 815 bp, Triticum aestivum
cttcttcatggtggcctttgcccgctcacatctcgtgggtcacagatgtaccgctccctgcactgtcctctgagctcacaccagcagatgtgggactcgaagaacatgatgtgtgctgctgacccgcgcccatggccgctacctcacagcctcggccatgttccgtggcaagatgagcaccaaggaggttgacgagcagatgatcaacgtgcagaacaagaactcctcctacttcgtggagtggatcccgaacaacgtcaagtcaagcgtgtgtgacatcccaccacgcggcctctccatggcgtccaccttcattggcaactccacctccatccaggagatgttcaggcgtgtgagcgagcagttcacggccatgttcaggaggaaggctttcttgcattggtacactggcgaggggatggacgagatggagttcactgaggccgagagcaacatgaacgaccttgtctccgagtaccagcagtaccaggacgccactgccgacgaggagggcgagtacgaggaagaggaagagctggagcaggagtaagatcggtgacgattgcatctctccgtttatgtggtattgtggttttcgtacaactggagcttgttactagtagagactagagggtaccatggctacaactctgctgcttgtttgcgtgtcttggcatgtattggatttgtactgcgttcgtttgtaggcatgttcactcgatgctatgtttctttgcgtgaattatttattctatgtgaggtttcaagcaagtggatttgaaatacagtagaatgctttgtagtttgaacaatga

SEQ ID NO: 3828 - DNA, 540 bp, Triticum aestivum
tgagcaccaaggaggttgacgagcagatgatcaacgtgcagaacaagaactcttcctacttcgtggagtggatcccgaacaacgtcaagtcaagcgtgtgtgacatcccaccacgcggcctctccatggcgtccaccttcattggcaactccacctccatccaggagatgttccggcgtgtgagcgagcagttcaccgccatgttcaggaggaaggctttcttgcattggtacactggtgaggggatggacgagatggagttcactgaggccgagagcaacatgaacgaccttgtctctgagtaccagcagtaccaggacgccactgccgacgaggagggcgagtacgaggaagaggaagacctggagcaggagtaagatcggtgacaaattcatctctccgtttatgtggtattgtggttttcgtacaactggagcttgttactagtagagactagagagtaccatggctacaactctgctgcttgtttgcgtgtcttggcatgtattggatttgtactgcgttcgtatgtaggcatgt

SEQ ID NO: 3829 - DNA, 736 bp, Triticum aestivum
gtcctgagctcacacagcagatgtggactcaaagacaggatgtgtgctgccgacccacgccatgccgctacctcacagcctcggccatgttccgtggcaagatgagcaccaaggaggttgatgaacagatgatcaacgtgcagaacaagaactcttcctacttcgtggagtggatccccaacaacgtcaagtcaagcgtgtgtgacatcccaccacgcggcctctccatggcgtccaccttcatcggcaactccacctccatccaggagatgttccggcgtgtgagcgagcagttcacggccatgttcaggaggaaggctttcttgcattggtacactggtgaggggatggacgagatggagttcactgaggccgagagcaacatgaacgaccttgtctccgagtaccagcagtaccaggacgccactgccgacgaggagggcgagtacgaggaagaggaagagctggagcaggagtaagatcggtgacgattgcatctctccgtttatgtggtattgtggttttcgtacaactggagcttgttactagtagagactagagggtaccatggctacaactctgctgcttgtttgcgtgtcttggcatgtattggatttgtactgcgttcgtatgtaggcatgttcactcgatgctatgtttctttgcgtgaattatttattctatgtgaggtttcaagcaagtggatttgaaatacagtagaatgctttgaagtttg

SEQ ID NO: 3830 - DNA, 769 bp, Triticum aestivum
tggttttacctttggtccactggtctgacaactgaggtcaagttccgttgagatgcaccacgagtccctcctggaggcgcttcctggtgacaatgttggcttcaacgtgaagaacgttgctgttaaggatctgaagcgtgggtttgttgcatccaactccaaggatgaccctgccaaggaggcagccaacttcacctcccaggtcatcatcatgaaccaccctggtcagatcggcaacggctacgcccccagtgctggactgccacacctcccacattgctgtgaagtttgctgagctggtgactaagatcgacaggcgatctggtaaggagctggaggcgctgcccaagttcctgaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggcgccaaggttaccaaggctgccatcaagaagaaataggcatctatctagcagaaggtttttgttcatggtcattgcttttgttgctgcagactcttatcccgggcgagcaatgatcctgtctgtcgtttaattactgtatttctattcctgcttcggctaaactcctgtgccttgagactgatctgttgtgaaatgcaagttattagattgcaacttgttatcttgtttctgctgcttttgccaaatggttg

SEQ ID NO: 3831 - DNA, 597 bp, Triticum aestivum
  misc_feature (572)..(572): n = any nucleotide
acgtgaagaacgtgctggtaaggatctgaagcgtggttgttgcaccactccaaggatgaccctgccaaggagcagccacttcacctcccaggtcatcatcatgaaccaccctggtcagatcggcaacggctacgccccagtgctggactgccacacctcccacattgctgtgaagtttgctgagctggtgactaagatcgacaggcgatctggtaaggagctggaggcgctgcccaagttcctgaagaacggtgacgctggtatcgtgaagatgattcccaccaagcccatggttgtggagaccttcgccacctaccctcctcttggccgcttcgctgtgcgtgacatgagacaacggttgctgttggtgtcatcaagggcgtggagaagaaggaccccaccggcgccaggttaccaggctgccatcagaagaaataggcatctatctagcagaaggtttttgttcatggtcattgcttttgttgctgcagactcttatcccgggcgagcatgatcctgtctgtcgtttaattactgtatttctattcctgcttcggctaaactcctgtgcncttgagactgatctgttgtgaaatg

SEQ ID NO: 3832 - DNA, 1559 bp, Triticum aestivum
gccgcctcctctcggttccttctccttcctcggagctccagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcacccttggagtgaagcagatgatctgctgctgcaacaagatggacgccaccactcccaagtactcaaaggcccgttatgaggaaattgtcaaggaagtctcttcgtacctgaagaaggtcggctacaaccctgacaaggttcccttcgttcccatctctgggtttgagggtgacaaccatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgtttacctttggccccactggtctgacaactgaggtcaagtctgttgagatgcaccacgagtccctcctggaggcgcttcctggtgacaatgtcggcttcaacgtgaagaacgttgctgtcaaggatctgaagcgtgggtttgttgcatccaactccaaggatgaccctgccaaggaggcagccaacttcacctctcaggtcatcatcatgaaccacctggtcagatcgggcaacggctacgccccagtgctggactgccacacctcccacattgctgtcaagtttgctgagctggtgaccaagattgacaggcgatctggtaaggagattgaggctgcgcccaagttcctgaagaacggtgacgctggtatcgtgaagatgattcccaccaagcccatggttgtggagacctttgccacctaccctcctcttggccgcttcgctgtgcgtgacatgagacaaacggttgctgttggtgtcatcaagggtgtggagaagaaggaccccaccggcgccaaggttaccaaggctgccatcaagaagaaataggcgcgctatcttgcagaaggattttgttcacggtcattgcttttgttgcttcagactcttatcccgagcgagcaatgatctgtctgtcgtttaattactgtatttctattcctgcttcggctaaactcctgtgcccctgagactgatttgttgtgaaatgcaagttatta

SEQ ID NO: 3833 - DNA, 607 bp, Triticum aestivum
  misc_feature (12)..(12): n = any nucleotide
  misc_feature (157)..(157): n = any nucleotide
ctcacgatggcntccaccttcatcggcaactcgacgtccatccaggagatgttccggcgcgtgagcgagcagttcacggccatgttccggcgcaaggcgttcctgcactggtacacgggcgagggcatggacgagatggagttcaccgaggccgagngcaacatgaacgacctcgtctccgagtaccagcagtaccaggacgccaccgccgacgaggagggcgagtacgaggacgagctcgaggacgacgacgccgacctccagggctagagatcaaccaagtactactgcgtacgattatcggttcttttctcatgttaatttgatgattgctttaggcttgtgtagtagtgctcttctgtctttcttggtgggtgctgttgttgaggagcagaaaactcatggaagggtggttgctgatgagatagcttggttggtactataacctatggcacaattgctgtggaatgtgcaagcagcaacgccctgttgcgttctactagtggtgtccagtgtcttcactatcatgttcaaatctaatgtaatctgaagttgctcgtgtctgatttcagttcatgatttgtggtatgctcttcatctaattatc

SEQ ID NO: 3834 - DNA, 1075 bp, Triticum aestivum
caaggaggccgagaattgcgactgcctccaaggtttccaggtgtgccactcgctgggcggcggcaccggctccggcatgggcacgctgctcatctccaagatccgggaggagtacccggaccgcatgatgctcaccttctccgtcttcccctcgcccaaggtctccgacaccgtcgtcgagccctacaacgccaccctctccgtccaccagctcgtcgagaacgccgacgagtgcatggtgctcgacaacgaggcgctctacgacatctgcttccgcaccctcaagctcacaaccccgagcttcggcgacctgaaccacctcatctcggccaccatgagcggggtcacctgctgcctgcgcttcccggggcagctcaactcggacctccgcaagctggccgtgaacctcatcccgttcccgcggctgcacttcttcatggtgggcttcgcgccgctcacctcgcgcggcagccagcagtaccgcgcgctcaccgtgccggagctcacccagcagatgtgggacgccaagaacatgatgtgcgcggccgacccgcgccacgggcggtacctgacggcctcggccatgttccggggcaagatgagcaccaaggaggtggacgagcagatgctgaacgtgcagaacaagaactcgagctacttcgtggagtggatccccaacaacgtaaagtcgacggtgtgcgacatcccgcccacgggcctcacgatggcctccaccttcatcggcaactcgacgtccatccaggagatgttccggcgcgtgagcgagcagttcacggccatgttccggcgcaaggcgttcctgcactggtacacgggcgagggcatggacgagatggagttcaccgaggccgagatagcttggttggtactataacctatggcacaattgctgtggaatgtgcaagcagcaacgccctgttgcgttctactagtggtgtccagtgtcttcactatcatgttcaaatctaatgtaatctgaagttgctcgtgtctgatttcagttcatgatttgtggtatgctcttcatttaattatcgtgttaaattttaaagcc

SEQ ID NO: 3835 - DNA, 788 bp, Triticum aestivum
gggattatgcttcaggaaattgattagtagtcccaaacccatgattggtgtgcttggtgggatttgagaggaagttctatcccacttgcatccaactccaaggatgaccctgccaaggaggcggccaacttcacctcccaggtcatcatcatgaaccaccctggtcagatcggcaatggctacgccccagtgctggactgccacacctcccacattgctgtcaagtttgctgagctggtgaccaagatcgacaggcgatctggtaaggagctggaggcgctgcccaagttcctgaagaacggtgacgctggtatcgtcaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggcgccaaggttaccaaggctgccatcaagaagaaataggcgtgctatctagcagaatgtttttgttcacggtcattgcttttgttgcttcagactcttatcccgagcgagcaatgatctgtctgtcgtttaattactgtatttctattcctgcgtcggctaaactcctgtgcccctgagactgatttgttgtgaaatgcaagttattagattgcaacttgttagcttgtttttctgctgcttttgccaaatggttgcctgtttaagatgcttctttttatcgaactttagtttgcatctgttagtactgtgtattctttcatggagttgtctag

SEQ ID NO: 3836 - DNA, 765 bp, Triticum aestivum
tgtcggctcacgtgaagacgtgctgtcaaggatctgaagcgtggtttttgcatccactccaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtatcgtgaagatgattcccaccaagcccatggttgtggagacctttgccacctaccctcctcttggccgcttcgctgtgcgtgacatgagacaaacggttgctgttggtgtcatcaagggtgtggagaagaaggaccccaccggcgccaaggttaccaaggctgccatcaagaagaaataggcgcgctatcttgcagaaggattttgttcacggtcattgcttttgttgcttcagactcttatcccgagcgagcaatgatctgtctgtcgtttaattactgtatttctattcctgcttcggctaaactcctgtgcccctgagactgatttgttgtgaaatgcaagttattagattgcaacttgttagcttgtttttctgcttcttttgccaaatggttgcctgttgttctttttatagaactttagtttgcatctgttagtattgtggattctttcatggagttgtctagctgtggttgtcttctgatctccg

SEQ ID NO: 3837 - DNA, 968 bp, Triticum aestivum
attgctcgccgcgcgcactccgatcaattcaccccgcgcactccgatcaatactgcccaatcaacagaccgatcccacgcgcattccctccgctccccgccccggatcgaccgaccgaccgaccgcgccgcgcgaccgccgggagagcatggggagcgggggcaggacggatctggacggcggcgccgtggcgccgctgaccatctgcgtgatcggcaccggcggcttcatcggctcgcacctctgcgagaagctcatggccgagacccagcagacggtcctcgccgtcgacgtctactgcgacaagatccgccacctcgtcgacccgcccccgccccacctcgccggccgcatctccttccaccgcctcaacatcaagaacgactcccgcctcgagggcctcatcaagatggccgatctgacgataaacctggcggcgatctgcatgccggcggactacaacacgcgcccgctcgacaccatctacagcaacttcatcgacgcgctccctgtggtcaagtactggatccggaagtcgtttgccctgtacgtccaagtcggggcatgcgataaaagaggtcagacttggagaacagcaagcgtctgatccacttctccacgtgcgaggtctacggcaagaccatcggcagcttcctccccaaggaccaccccctccgcaaggttatttgcatcttgattaggagatgatggtgatcatcttttgttgcgggaacctgttagataaagtttatgtgatttgaacctgcaagatacagttttgtataatgttgtgtgagataaaagttgtgaacataggagataagttattgatatgtgttggcctgtctaatgttatgcgagataaagttgtgtgagaaagttttctatacttgtgttattactgtgggaaagaagtactgttactatactgatttgagagtattggctgtaaataaaagaggcttgcc

SEQ ID NO: 3838 - DNA, 712 bp, Triticum aestivum
gcgtccgtccgcctccaccccaccggtcccgacccctctcctccaaggtaagcccgcggcggcggcgagcgcgagcgagcggcggcgatgacgacccgcttcaagaagaaccggaagaagcgcggccacgtgtccgccgggcacgggcgtgtgggcaagcaccgcaagcatcccggaggccgcggtaacgccggaggcatgcaccaccaccgcatcctcttcgacaagtaccatcccggctacttcggcaaggtcggtatgcgctacttccacaagctcagcaacaggttctacacaccgacggtcaacgtcgagaggctctggtccatggttccgtccgacaaggcggcggaggccggcggcgacaaggcccccgtggtcgacgtctcgcagttcggctacttcaaggtgctcggcaaggggatgctgccggagaagcccatcgtcgtcaaggccaagctcatctccaagatcgccgaaaagaagatcaaggccgccggcggcgcagtcgtgctcgttgcctagggttctgttcccgaccgtgccccgagatctatatctgaactattagttgtttcccgtaccagcaatttgtgttgaagaagacatcgttagtttgttatcctggttcctgtgtggtaaaccaacatcttatgagaattttgcgctatgttatgccagtttatatcagacgagttatccatatctgtgc

SEQ ID NO: 3839 - DNA, 1117 bp, Triticum aestivum
cattttcgtaccaagatatcacaaactgttcaagtgatggatggtcacgactcacaaggtccggctcggaccgggggtgtcatttgacatcggctgtgcgcgaggcggctcgagagaccatcggcagcttcctccccaaggaccaccccctccgcaaggaacctgaattttatgtactgacagaagatgagtcaccctgcatctttggtccaatcgtgaaacagagatggtcctacgcgtgcgcaaagcagcttatcgagaggcttgtttttgctgaaggcgcagaaaatggccttgaattcacgattgtgagacctttcaattggattgggccaaggatggacttcattcctggcgttgatggtcctagcgagggtgttcctcgggttttggcttgcttcagcaacaatctcctccgcagagagcccctgaagcttgtcgatggcggcgagtcccagagaacttttgtttacatcaaggatgccattgaagctgttcttttgatgattgaaaaccctgctcgagccaatggtcatatcttcaacgtggggaaccctgacaatgaagtcactgttagggagttggctgaaatgatgacagaggtctatgctaaggtctcaggagagcccccgctggaggagcctgtgatcgacgtgagcgcaaaagaattctacggcgaagggtacgacgacagcgacaagaggatccccgacatgaccctgatcaacaagcagctagggtggaaccccaagacccctctcaaggacctgctggagacgacgctgacctaccagcacaagacctacaaggaagccgtcaagacgcagatgtgtctggccacggcgacgccttcaagctagacgatgacggcgcagctatgctgctcttgatcttttggaagccagatacttatatcgtagtgaaaccgtcgtcgtcgtttttgtcgcgcctctagatcccacccacctatcttcttacctacctagattcgtcattgtgtaaccctatatcgggcaaagggaactgagtatctgagtatctattacatatacctgtggtggcagtgtttgttacgtttggttggttgcacctccagtgctattatttttttgctgtt

SEQ ID NO: 3840 - DNA, 747 bp, Triticum aestivum
cgctcgactccgcctccaccccacccgccccgacccctctcctccaaggtaagcccgcggcggcggcgagcgagcggcggcgatgacgacccgcttcaagaagaaccggaagaagcgcggccacgtgtccgccgggcacgggcgtgtgggcaagcaccgcaagcatcccggaggccgcggtaacgccggaggcatgcaccaccaccgcatcctcttcgacaagtaccatcccggctacttcggcaaggtcggtatgcgctacttccacaagctcagcaacaggttctacaccccgacggtcaacgtcgagaggctctggtccatggtgccgtccgagaaggcggccgaggccggcggcgacaaggcccccgtggtcgacgtctcgcagttcggctacttcaaggtgctcggcaaggggatgctgccggagaagcccatcgtcgtcaaggccaagctcatctccaagatcgcagagaagaagatcaaggccgccggcggcgctgtcgtgctcgttgcctagggttctgttcgcgaccgtgccttgagatctattatatctgaactattagttgtttcccgtaccagcaatttgtgttgaacaagacatcgttagtttgttatcctggttcctgtgtggtaaaccaacatcttatgagaattttgcgctatgttatgccagtttatatcagacgagttatccatatctgtgctcctatttatgtttcgtttgatctgtgttaatcccta

SEQ ID NO: 3841 - DNA, 904 bp, Triticum aestivum
  misc_feature (859)..(859): n = any nucleotide
ccaccccatcctccccgacccctctccccccaggtaagcccgcggcggcggcgagcgagcggcggctatgacgacccgcctcaagaagaaccgcaagaagcgcggccacgtgtccgccgggcacgggcgtgtgggcaagcaccgcaagcatcctggaggccgcggtaacgccggaggcatgcaccaccaccgcatcctcttcgacaagtaccatcccggctacttcggcaaggtcggtatgcgctacttccacaagctcagcaacaggttctacactccgacgatcaacgtcgagaggctctggtccatggtaccggccgagaaggcggcagaggccggcggtgacaaggcccccgtggtcgacgtctcgcagttcggctacttcaaggtgctcggcaaggggatgctgccggagaagcccatcgtcgtcaaggccaagctcatctccaagatcgccgagaagaagatcaaggccgccggcggcgctgtcgtgctcgttgcctaggggataggtttgtgacaattcggatgaaaatcttgctcgtctttggctggtgccacccgtgacggccccctgtgggtgtcgtttcccctccttgaaggcgttgctttttttggagatagcgccttggagatgttgctgtggtgtgtcgacacctcactctttctcacttgattggttgtctctgggcaaaagcctaggttcggatccggatcggtgatggcggcatccttgatgtcgttcttctgttgggatcattgcttttggaggcacgacttggaggtcctagtttgctttcctgtggtcagggccgtctccaggaattcgggaccccgcttccaatgcttttgaaaagcnaatttctctatacttcttgaaaaatgaaagcagaccctgtataga

SEQ ID NO: 3842 - DNA, 557 bp, Triticum aestivum
gccggcggcttcatcggctcgcacctctgcgagaagctcatggccgagacccagcacacggtcctcgccgtcgacgtctactgcgacaagatccgccacctcgtcgacccgcccccgccccacctcgccggacgcatctccttccaccgcctcaacatcaagaacgactggctacttcggcaaggtcggtatgcgctacttccacaagctcagcaacaggttctacactccgacgatcaacgtcgagaggctctggtccatggtaccggccgagaaggcggcagaggccggcggtgacaaggcccccgtggtcgacgtctcgcagttcggctacttcaaggtgctcggcaaggggatgctgccggagaagcccatcgtcgtcaaggccaagctcatctccaagatcgccgagaagaagatcaaggccgccggcggcgctgtcgtgctcgttgcctagggttctgttcgcgactgtgccttgagatcatattatatctttactattagttgtttcccgtaccagcaatttgtgttgaacaagacatcgttagtttgtt

SEQ ID NO: 3843 - DNA, 859 bp, Triticum aestivum
  misc_feature (181)..(181): n = any nucleotide
  misc_feature (192)..(193): n = any nucleotide
  misc_feature (203)..(204): n = any nucleotide
  misc_feature (210)..(211): n = any nucleotide
  misc_feature (315)..(316): n = any nucleotide
  misc_feature (334)..(334): n = any nucleotide
  misc_feature (336)..(337): n = any nucleotide
  misc_feature (345)..(345): n = any nucleotide
  misc_feature (347)..(348): n = any nucleotide
  misc_feature (356)..(358): n = any nucleotide
ggcgcccgagcaaggagcagcaactcctttagcctcgcagaaccccacctcgctggcccgagcaggggtggagcgcctcgtcctcgcctccatctaagcgcagagagagagagatggcgagggctggatctggctaggtggccatggagaatgacgacttggccctgcagccgatgccaanctcatcaactnntcttcccagnntagcannagaagtcaagcccttttgtggtacgatctatcccgaaggaggtcgtcccccgagcccgcatccctgtcgtcgaccttgcgcacagggaaggtcgcaatctgcgnntcatcgaggccggtgggntnntcatctgncnnttccaccnnntctacgagaagctcatggccgagaacccgcacacggtcctcgccgttgacgtttactgcgacaagatccgccatctcgtggacccgcccccgccccacctcgccggccgcatctccttccaccgcctcaacttcaagaacgactcccgcctcgagggcctcatcaagatggccgatctgacgataaacctggcggcgatctgcatgccggcggactacaacacgcgcccgctcgacaccatctacagcaacttcatcgacgcgctccctgtggtcagacttggagaacagcaagcgtctgatccacttctccacgtgcgaggtctacggcaagaccatcggcagcttcctccccaaggaccaccccctccgcaaggttatttgcatcttgattaggagatgatggtgatcatcttttgttgcgggaacctgttagataaagtttatgtgatttgaacctgcaagatacagttctgtataatgttgtgtgagataaaagttg

SEQ ID NO: 3844 - DNA, 1500 bp, Triticum aestivum
acggatctggacggcgccgccgtggcgccgctgaccatctgcgtgatcggcgccggcggcttcatcggctcgcacctctgcgagaagctcatggccgagacccagcacacggtcctcgccgtgcgacggtctacgtgggacaagatccgccacctcgtcgacccgcccccgccccacctcgccggacgcatctccttccaccgcctcaacatcaagaacgactcccgcctcgagggcctcatcaagatggccgatctgacgataaacctggcggcgatctgcacgccggcggactacaacacgcgcccgctcgacaccatctacagcaacttcatcgacgcgctcccggtggtcaagtactgctcggagaacagcaagcgcctgatccacttctccacgtgcgaggtctacggcaagaccatcggcagcttcctccccaaggaccaccccctccgcaaggaacctgaattttatgtgctgacagaagatgagtcaccctgcatctttggtccaatcgtgaaacagagatggtcctacgcgtgtgcaaagcagcttatcgagaggcttgtttttgctgaaggcgcagaaaatggccttgaattcacgattgtgagacctttcaattggattgggccaaggatggacttcattcctggcgttgatggtcctagcgagggtgttcctcgggttttggcttgcttcagcaacaatctcctccgtagagagcccctgaagcttgtcgatggcggcgagtcccagagaacttttgtttacatcaaggatgccattgaagctgttcttctgatgattgaaaaccctgctcgagccaatggtcatatcttcaacgttgggaaccccgacaatgaagtcactgttagggagttggccgaaatgatgacagaggtctacgctaaggtctcaggagagcccccgctggaggagcctgtggtcgacgtgagcgcgaaagaattctacggcgaagggtacgacgacagcgacaagaggatccctgacatgaccctgatcaacaagcagctagggtggaaccccaagacccctctcaaggacctgctggagacgacgctgacctaccagcacaagacctacaaggaggctgtgaagacgcagatgtgtctggccacggcgacgccttcaagctagacgatgacggcgcggccatgctgctcttgatcttttggaagccagatacttatatcgtagtgaaaccgtcgtcgtcgtttttgtcgcgcctctagatcacacccacccatcttcttacctacctagattcgtcattgtgtaaccctatattgggcaaagggaactgagtatctattatacctgtggtggcagtgtttgttatgtttggttggttgcacctcccgtgctattcttttgctgttagtgagagatatattcttgttcggcatagttgatgatgatgtgagattacagtctgggagccttattactgtagtttttagcagagttaatgtcgag

SEQ ID NO: 3845 - DNA, 594 bp, Triticum aestivum
gccaacttcaccgcccaggtcatcatcatgaaccaccctggccagatcagcaacggctatgccccggtgctggactgccacacgtcccacatcgctgtcaagtttgctgagatccagaccaagatcgaccggcggtctggcaaggagattgaggcggcgcccaagttcctcaagaacggtgatgccgggttcgtcaagatgatccccaccaagcccatggtggtggagaccttcgcccagtaccctcccctgggccgctttgctgtgcgcgacatgaggcagacggttgccgtgggcgttatcaaggccgtggagaagaaggatccgaccggcgccaaggtgaccaaggctgcggccaagaagaaatgagatggtgtcgggcggcggcgtcgttggtggttctttaccacatctatggtggtggcggcggtatacggtggtggtcatagtcgtgttagcggatttgcaaacttgttaagcttcggttatttgtgtcgagcagtgttcgaactgcttattactgtggtcagcatagtatcgttccttgtgttggtgaaacttcgtcagataaagttgctattttatatatgcgtg

SEQ ID NO: 3846 - DNA, 734 bp, Triticum aestivum
gccgtcaaggatctcaagcgtgggtatgtcgcttccaactccaaggacgaccctgccaaggaggctgccaacttcaccgcccaggtcatcatcatgaaccaccctggccagatcagcaatggctacgccccggtgctggactgccacacgtcccacatcgccgtcaagttcgctgagatccagaccaagattgaccggcggtctggcaaggagattgaggcggcgcccaagttcctgaagaacggtgatgccgggttcgtcaagatgatccccaccaagcccatggtggtggaaaccttcgcccagtaccctcccctgggccgctttgctgtgcgtgacatgaggcagacggttgccgtgggcgttatcaaggctgtggagaagaaggatccgaccggcgccaaggtgaccaaggctgcggccaagaagaaatgagatggtgtcgggcggtggcgtcgttcgtggtactttaccacatctgtggtggtggtggcggtatacggtggtggttatagtcgtgttagcgaatttgcgaacttgttaagcttctgttatttgtgtcgagcagtgttcgaactgcttattactgtggtcatagtattgttcggttgtgttggtgaaacttcgtcagataaaattgctattttatatatgcgtgatatttggagtcattttatgtctgctgctgcctctacaagtatatttgataatggtgtttgttttgcaaggtggat

SEQ ID NO: 3847 - DNA, 622 bp, Triticum aestivum
tgccaacttcaccgcccaggtcatcatcatgaaccaccccggccagatcagcaacggctacgccccggtgctggactgccacacgtcccacatcgctgtcaagttcgctgagatccagaccaagatcgaccggcggtctggcaaggagattgaggcggcgcccaagttcctcaagaacggtgatgccgggttcgtcaagatgatccccaccaagcccatggtggtggagaccttcgcccagtaccctcccctgggtcgctttgctgtgcgtgacatgaggcagacggtcgccgttggcgtgatcaagagcgtggagaagaaggatccgaccggcgccaaggtgaccaaggctgcggccaagaagaaatgagatggtgtcgggcggtggcgttgttggtggttctttaccacatctatggtggtggtggcggtatacggtggtggtgatagtcgtgttagccgatttgcgaacttgttaagctttggttatttgtgtcgagcagtgttcgaactgcttattactgtggtcatagtatcgttcggttgtgttggtgaaacttcgtcagataaagttgctattttatatttgagtgatatttggagtcgttttatatctgctgcc

SEQ ID NO: 3848 - DNA, 1210 bp, Triticum aestivum
aaaaccctagcagcgaaatccactcgatcgaaaaagttcttcgtctccctctcgcggaatccacagcgcagaccggccgatcccccgcggaagagcagcagcagagatggcgcagtccggcaacaacgacgccgccccgatcagcacccagcccgcggcggaggatgtgacggtggagaggacgcccgaggaggaggaggccaggctgaggtacctcgagttcgtgcagcaggcggcggcgcaggcggtcgtgctggccgccgcggcctacgcgtacgccaagcagggcgccggccccctccgccccggcgtcgaccacgtcgaggggaccgtcaaggccgtcgtcggccccgtctacgaccgctaccacgccgtgccgctcgacctcctcaagttcctcgaccgcaaggttgacgagtctgtccaggaactggaccgccgtgttccacccgtcgtgaaggaggtgccgacctatgcccgctctgcagcagctgaggtgcagaagacaggcataatgggcacagcaactggactgggccaagtcggccattgcttgtgctgagcccaaggcccgtgacttgtatacccgctacgagcctgtggcggagcgcaaggctgccgaagcctgggccgccctgaaccgcctcccgctcgtcccctcggtgacccgtgctgtcctccccacagctgcacagctctcagcgaagtacaactctgccgtgcttgatggcgctaagcgtggcaattccgtcgccacctacctgccactcgtcccaacggagcgcattgcaagggtgttcgccaacccgtccgctgatactgcgcctgccacagctcctgagatgcagcccataccgacgcagtaacaataagagctacccgttgttatgttacctaatagctgttaggagtcagtatctcgttgtgtagtgtcttgtttggcttgtggtggaccgtggtattatgtgtggatggtcactgtggtatccgcctgtctggaagcgactctgaatgctgttgctgtgcagcaaagcctgctttgcgttttagtttgttctgcatgaaccactgtgtaatgctttgaatcaaagttgcatgaaacaccatctgtaaattcacattctatttttatgtttgtgtgtattgactgtcaattggcattgtttacaactgctctgcagttatttgcatgtgatgaattgtttataca

SEQ ID NO: 3849 - DNA, 825 bp, Triticum aestivum
gttacgaccgctaccacgccgtgccgctcgacctcctcaagttcctcgaccgcaaggttgatgagtctgtccaggagcttgatcgtcgtgtcccaccggtcgtgaaggaggtgccaacctatgcccgctctgcagcagctgaggtgcagaagacaggcataatgggcacagcaactggactggccaagtcggccattgctcgcgctgagccaaaggcccgcgacttgtatacccgctacgagcctgtggccgagcgcaaggctgccgaagcctgggctgccctgaaccgcctcccgctcgtcccctcagtgacccgtgccgtcctccccacagctgcacagctctcagccaagtacaactctgccgtgcttgatggtgctaagcgtggcaactccgtcgctacctacctcccgcttgtcccaacggagcgcatcgcaagggtttttgcctacccggcagctgaccctgcgcctgccacagctcctgagatgcagcccatcccgacgcagtaacaataagagctacccggagttttattattacctaatagctgtaggagtcggtatctcgatgtagtgtcttgtctggcttgtggtggacagtggtactatatgtggatggtcactgtggtatccgcctctgttgaggggattcgaatgctgttgctgtgcagcaacacctgctttgtgttttagtttgttcttcatgaaccactgtgtgtaatgctttgaatcaaagttacaggaaacaccatctgtaaattcattactgtttttatgcgagtgtgtatcgactgttggcactgttttattcgctattacaaga

SEQ ID NO: 3850 - DNA, 1689 bp, Triticum aestivum
tcggctccttctccttccttccagtttcagccatgggtaaggagaagactcacatcaacatcgtggtcattggccatgtcgactctggcaagtcgaccatcactggccagctgatctacaagcttggaggtatcgacaagcgtgtgatcgagaggttcgagaaggaagccgctgagatgaacaagaggtccttcaagtacgcctgggtgcttgacaagctgaaggccgagcgcgagaggggtatcaccattgatattgccctgtggaagtttgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggacggccagacacgtgagcatgccctccttgctttcactcttggagtgaagcagatgatctgctgctgcaacaagatggacgccaccactcccaagtactcaaaggcgcgttatgaagaaattgttaaggaggtctcttcctacctgaagaaggtcggctacaaccctgaaaaggttcccttcgtccccatctctgggtttgagggtgacaacatgattgagaggtccaccaaccttgactggtacaagggcccaacccttcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaacgttggcttcaatgtcaagaatgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagctggaggccctgccaaagttcctcaagaatggtgatgctggcatagtgaagatgattcccaccaagcccatggttgtggagacctttgctacttaccctcctcttggtcgttttgctgtacgtgacatgaggcaaactgtggctgttggtgtcatcaagggcgtcgagaagaaggacccaaccggggctaaggtgaccaaggctgccatcaagaagaagtaatttgacaattgatatccaaatcactgtttcaggcaccaagcagtttttagtattggctgagttttgttaagggcattgttcgtactgggtatattctagctgttcagctgttagcgctgcatatcgtgcccttagtggtgtctgtcttgtgccttctacatactgtcctaatgtaagcttcggtgaaacctggatgttatgagacttggttgtgtcttttaatactagtttgttgaattttatctgtgtagatgctttatctagtgcatttttggatgcatctaaacgttcttttgttttgaaggtgtcctta

SEQ ID NO: 3851 - DNA, 755 bp, Triticum aestivum
gtctgacactgaggtcagtctgttgagatgcaccacgagtctctcctggaggcgcttcctggtgacaacgtcggcttcaacgttcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagatagaggccgcgcccaagttcctcaagaatggtgatgctggcatagtgaagatgattcccaccaagcccatggttgtggagacctttgccacttatcctcctcttggtcgttttgctgtccgtgacatgaggcagactgtggctgttggtgtcatcaagggcgtcgagaagaaggacccaaccggggccaaggtgaccaaggctgccatcaagaagaagtaattcgacattgatatccaaatcactgttcagacaccaagcagtttttagtattggctgagttttgttaagggcattgttcgtactggtatattttagctgttcagctgttagcgctgcatatcgtgcccttggtggtcgtctgtcttgtgccttttacatactgtgtcctaatgtaagcttcggtgaaacctggatgttatgagacctggttgtgtcttttaatact

SEQ ID NO: 3852 - DNA, 1644 bp, Triticum aestivum
ccccgaccgccgtcgtcgccgtcgcctcctcctctcggttccctctccttccttcggagacttcagccatgggtaaggagaagactcagatcaacatcgtggtcattggccacgtcgactctggcaagtcgacgaccactggccacctcatctacaagcttggaggcattgacaagcgtgtgatcgagaagttcgagaaggaagccgctgagatgaacaagaggtctttcaagtatgcctgggtgcttgacaagctcaaggctgagcgtgagaggggtatcaccattgatattgctctgtggaagtttgagaccaccaagtactcctgcactgtcattgatgctcctggtcaccgtgacttcatcaagaacatgatcactgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaggttggttacaatcctgacaaggttccctttgttcccatctctgggttcgagggtgacaacatgattgagaggtccaccaaccttgactggtacagggccccaccctgcttgaggcacttgaccagatcaacgagcccaagaggccctcagacaagcccctccgtcttcccctacaggatgtttacaagattggtggcattggaactgtgcctgttggccgtgttgagactggtgtcatcaagcctggtatggttgttacctttggtcccactggtctgacaactgaggtcaagtccgttgagatgcaccatgagtctctcctggaggcgcttcctggtgacaacgttggcttcaacgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcacacattgctgtcaagtttgctgagctggtgaccaagatcgacaggcggtctggtaaggagctggaggccctgcccaagttcctcaagaatggtgatgctggcatagtgaagatgattcccaccaagcccatggttgtggagacctttgccacttaccctcctcttggtcgttttgctgtccgtgacatgaggcagactgtggctgttggtgtcatcaagggcgttgagaagaaggacccaaccggggccaaggtgaccaaggctgccatcaagaagaagtaattccacaattgatatccaaatcactgtttcagacaccaagcagtttttagtattggctgagttttgttaagggcattgttcgtactgggtatattttagctgttcagctgttagcgctgcatatcgtgcccttggtggtgtctgtcttgtgccttacatactgtcctaatgtaagctttggtgaaacctggatgttatgagacctggtttgtgtcttttaatactagcttgtt

SEQ ID NO: 3853 - DNA, 1036 bp, Triticum aestivum
caaaccacaaatggcgatagagcacaataatggaatcgaaatagagtatttaaacgacacatcatagctcgcacacaggtgcaggagtcggaagtgcaacaacgcccaggaacaccacttaacatacactaagattctccaaaaaagacttgacactaaaacttctgctagataactcgatggcagacaccagagcactcatttcttcttgatggcagccttggtaaccttggcgccggtggggtccttcttctcaacgcccttgatgacaccaacagcaaccgtttgtctcaagtccgttgagatgcaccacgagtccctcctggaggcgcttcctggtgacaatgtcggcttcaacgtgaagaacgttgctgtcaaggatctgaagcgtgggtttgttgcatccaactctaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtattgtgaagatgattcccaccaagcccatggttgtggagaccttcgccacctacccacctcttggccgcttcgctgtgcgtgacatgagacaaacggttgctgttggtgtcatcaagggcgttgagaagaaggaccccaccggcgccaaggttaccaaggctgccatcaagaagaaatgagtgctctggtgtctgccatcgagttatctagcagaagttttagtgtcaagtcttttttggagaatcttagtgtatgttaagtggtgttcctgggcgttgttgcacttccgactcctgcacctgtgtgcgagctatgatgtgtcgtttaaatactctatttcgattccattattgtgctcttatcccatttgtggttttgtctgcctgtgttgaatgctcttaatagatgga

SEQ ID NO: 3854 - DNA, 757 bp, Triticum aestivum
ggtctgacaacttgaggtcaaagtctgttgaggatgcaccacgagtctctgctggaggcgcttcctggtgacaacgtcggcttcaatgtcaagaacgttgctgttaaggatctgaagcgtgggtttgttgcatccaactccaagggatgaccctgccaaggaggcggccaacttcacctcccaggtcatcatcatgaaccaccctggtcagatcggtaacggctatgccccagtgctggactgccacacctcccacattgctgtcaagtttgctgagctggtgaccaagatcgacaggcgatctggtaaggagctggaggcgctgcccaagttcctcaagaatggtgacgccggtatcgtgaagatgattcccaccaagcccatggttgtggagaccttcgccacctaccctcctcttggccgctttgctgtgcgtgatatgagacaaacggttgctgttggtgtcatcaagggcgtggagaagaaggaccccaccggtgccaaggttaccaaggctgccatcaagaagaaatgagtgctctggtgtctgccatcgagttatctagcagaagttttagtgtcaagtcttttttggagaatcttagtgtatgttaagtgttattcctgggcgttgttgcactttgactcctgcacctgtgtgcgagctatgacgtgtcgtttaaatactctatttcgattccattattgtgctctcatcccatttgtggttttgtctgcctgtgttgaatgctagtac

SEQ ID NO: 3855 - DNA, 799 bp, Triticum aestivum
tgcgccccgctcgagaagcctggtatggtgttacctttggtcccacttggtctgacaactgaggttcaagtctgttgagatgcaccacgagtctctcctggaggcgcttcctggtgacaacgtcggcttcaacgtcaagaacgttgctgtgaaggatctgaagcgtggctttgttgcatccaactccaaggatgaccctgccaaggaagcggccaacttcacctcccaggtcatcatcatgaaccacctggtcagatcggcaacggctacgccccagtgttggactgccacacctcccacattgctgtcaagttcgccgagctggtgaccaagatcgacaggcgatctggtaaggagctggaggcgctgcccaagttcctgaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctctggtgtctgccatcgagttatctagcagaagttttagtgtcaagtcttttttggagaatcttagtgtatgttaagtgttcctgggcgttattgcactttgactcctgcacctgtgtgcgagctatgatgtgtcgtttaaatactctatttcgattccattattgtgctcttatcccatttgtggttttgttttcctgtggtgaatcctagtact

SEQ ID NO: 3856 - DNA, 761 bp, Triticum aestivum
ctggtatggttgttaccttgggtcccagtggtctgacaactgaggtcaagtctgttgagatgcaccacgagtctctcctggaggcgcttcctggtgacaacgtgggcttcaacgtcaagaatgttgccgtgaaggatctgaagcgtggttttgttgcatccaactccaaggatgaccctgccaaggaggcagccaacttcacctcccaggtcattatcatgaaccaccctggtcagattggcaacggctacgccccagtgctggactgccacacctcacacattgctgtcaagtttgctgagctggtgaccaagattgacaggcgatctggtaaggagatagaggccgcgcccaagttcctcaagaacggtgatgctggcatagtgaagatgattcccaccaagcccatggttgtggagacctttgccacttaccctcctcttggtcgttttgctgtccgtgacatgaggcaaactgtggctgttggtgtcatcaagggtgtggagaagaaggacccaactggcgccaaggtgaccaaggctgccatcaagaagaaatgaggcgtttacctgaatccgtctatgtctgctttttgagatctctagtagtttagtgcctattaagttttgctactgttagcgccgtgtgatatgcgccctgttgatgtgtcatttgagtactgtcgttaatttcggcttttgacaaaacatggaagcttctgagactactcatttttatcctctgctttggaatgttaggct

SEQ ID NO: 3857 - DNA, 807 bp, Triticum aestivum
tggtgtcatcaaccttggtatgttgttacctttggtcccactggtctgacaactgaggtcaagtccgttgagatgcaccatgagtctctcctggaggcgcttcccggtgacaacgtcggcttcaacgtcaagaatgttgccgtgaaggatctgaagcgtgggtttgttgcatccaactccaaggatgaccctgccaaggaggcagccaacttcacctcccaggtcatcatcatgaaccaccctggtcagattggcaacggctatgccccagtgctggactgccacacctcgcacattgctgtcaagtttgctgagctggtgaccaagatcgacaggcgatctggtaaggagctggaggccctgcccaagttcctcaagaatggtgatgctggcatagtgaagatgattcccaccaagcccatggttgtggagacctttgctacttaccctcctcttggtcgttttgctgtccgggacatgaggcaaactgtggctgttggtgtcatcaagggtgtggagaagaaggacccaaccggcgccaaggtgaccaaggctgccatcaagaagaaatgaggcgtttacctgaatccatctatgtctgcttttgagatctctagtagtttagtgcctattaagttttgctactgttagcgccgtgtgatatgcgccctgttgatgtgtcatttgagtactgtcgtgttaatttcggcttttggcaaaacatggaagcttctgagactactcatttttatcctctgctttggaatgttaggctgctacttttagtcttggctgctgtttctcgtt

SEQ ID NO: 3858 - DNA, 1647 bp, Triticum aestivum
atcgccgccgcaggctttgactccatcgcctctccctcctcttcgtctccggccggccaggtagttaacagctccagcagccatggggaaggagaagatccacatcagcattgtggtcattggccatgtcgactctggcaagtcaaccacgaccggccacctcatctacaagcttggaggcattgacaagcgtgtgatcgagaggtttgagaaggaagccgctgagatgaacaagaggtctttcaagtatgcctgggtgcttgacaagctcaaggctgagcgtgagaggggtatcaccatagatattgctctgtggaagttcgagaccaccaagtactcgtgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcatgctctccttgctttcactcttggtgtgaaacagatgatctgctgctgtaacaagatggatgccaccactcccaagtactcgaaggcccgttatgaagaaattgtcaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccgttcaggacgtgtacaagattggcggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaacgtcggcttcaacgtcaagaatgtggctgtcaaggatctcaagcgtgggtacgtcgcttccaactccaaggacgaccctgccaaggaggctgccaacttcaccgcccaggtcatcatcatgaaccaccctggccagatcagcaacggctatgccccagtggctggactgccacacgtcccacatcgctgtcaagtttgctgagatccagaccaagatcgaccggcggtctggcaaggagattgaggcggcgcccaagttcctcaagaacggtgatgccgggttcgtcaagatgatccccaccaagcccatggtggtggagaccttcgctcagtaccctcccctgggccgctttgctgtgcgtgacatgaggcagacggttgcggtgggcgttatcaaggccgtggagaagaaggatccgaccggcgccaaggtgaccaaggctgcggccaagaagaaatgagatggtgtcaggttctttactgcatctatgatggtggtggcggtgacggcatttggtggtggtgatagttgttctagtcgttttgaaaacttgttaagcttcggttatttgtgtcgagcagtgttggaactgcttattgctctggtcattgtatcgttcggttgtgttggtggaactttgtcagttaatgttgctactatatatagtcatcatgtttgg

SEQ ID NO: 3859 - DNA, 902 bp, Triticum aestivum
cccaagaggccctcagacaagcccgctccgtcttccccttcaggacgtgtacaagattggcggcattggaactgtgccagtgggccgtgttgagactggagtcatcaagccaggcatggttgtcacctttggtcctactggcctgaccactgaggtgaagtccgttgagatgcaccatgagtctctcctggaggcgcttcctggtgacaacgtcggcttcaacgtcaagaacgtggctgtcaaggatctcaagcgtgggtacgtcgcttccaactccaaggacgaccctgccaaggaggctgccaacttcaccgcccaggtcatcatcatgaaccaccccggccagatcagcaacggctatgccccggtgctggactgccatacgtcccacattgctgtcaagtttgctgagatccagaccaagatcgaccggcggtctggcaaggagattgaggcggcgcccaagttcctcaagaacggtgatgctgggcttcgtcaagatgatccccaccaagcccatggtggtggagacctttgcccagtaccctcccctgggccgctttgctgtgcgtgacatgaggcagacggttgccgtgggtgttatcaaggctgtggagaagaaggatccgaccggtgccaaggtgaccaaggctgcggccaagaagaaatgagatggtgtcaggttctttactgcatctatggtggcggtggcggtatttggtggtggtgatagttgttctagttgttttggaaacttgttaagcttcggttatttgtgtcgagcagtgttggaactgcttattgctctgtcattgtatcgttcggttgtgttggtgaaacttcgtcagttaatgttgctactatatatagttggcatgtttggagtcgttttatatcagttg

SEQ ID NO: 3860 - DNA, 794 bp, Triticum aestivum
ggaggcgcttccgggacaagtcggcttcaacgtcaagaacgtggccgtcaaggatctcaagcgtggatacgtcgcttccaactcgcaaggacgaccctgccaaggaggctgccaacttcaccgcccaggtcatcatcatgaaccaccctggccagatcagcaacggctatgcccccggtgctggactgccacacgtcccacattgctgtcaagttcgctgagatccagaccaagattgaccggcggtctggcaaggagattgaggcggcgcccaagttcctgaagaacggtgatgccgggttcgtcaagatgatccccaccaagcccatggtggtggaaacctttgcccagtaccctcccctgggccggtttgctgtgcgcgacatgaggcagacggttgccgtgggcgttatcaaggccgtggagaagaaggatccgaccggcgccaaggtgaccaaggctgcggccaagaagaaatgagatggtgtcaggttctttactgcatctatggtggtggtggcggtggcggtatttggtggtggtgatagttgttctagtcgttttgagaacttgttaagcttcggttatttgtgtcgagcagtgttggaactgcttattgctctggtcattgtatcgttcggttgtgttggtggaactatgtcagttgatgttgctactaaatatagtcgtcatgtttggagtcgttttatatcagttgatcatgtttcttgtcatgcaaagttgaatttttgttttgcttccttaactattcctattcctgtgcttcttttgca

SEQ ID NO: 3861 - DNA, 721 bp, Triticum aestivum
gttcttctgtgacaaatgctgcagtttacaagaagcacagaaaagaatgaagataaagaaacagccaaacatcctggtaatccatctcaagcgcttcaagtacatcgagcagcttgggcgctacaaaaagctgacataccgagttgttttcccactggagcttaaactcatgaacacggtcgacaactcagacttggaatattccctcttcgctgtgctagtccacgtcggaagtgggccaaaccatggccactacatcagcgtggtaaagagccacaaccactggttgttcttcgacgatgagactgttgagatgaccgatgagtccatggtacagacattcttcggctcggcacaggagttcagtggtaacaccgacaatggctacatactcttctacgaaagcgtcgctaaaacaagctgatgccttccgtatatctcgtgattagcaacacggtttttttttccttttgtcgccacaccccctgctccgtgctatatagaagattcggtaaatcagaataattagaatggcaaagaccattcaaccttagatgctttggtggagtcagtgcttagcaataaaagaagctgtgacgagttttgcgggtgggtactatagccgccgaatcttgcagtcttcttgatgttgtgtttccgttgtgttgtggcgcaagtttgtattgatctggaataatgtttctcaagaagatcttatcat

SEQ ID NO: 3862 - DNA, 688 bp, Triticum aestivum
ttcagttacaagaagcacagaaagaagaagataaagaaacagccaaacatcctggtaatccatctcaagcgcttcaagtacatcgagcagcttggccgctacaaaaagctgacataccgagtcgttttcccactggagcttgaaactcatgaacacagtcgacaactcagacttggaatattccctctttgctgtgctagtccacgtcggaagtgggccaaatcatggccactacatcagcgtggtaaagagccacaaccactggttgttcttcgacgatgagactgttgagatgaccgatgagtccatggtacagacattcttcggctcagcacaggagttcagtggtaacaccgacaatggctacatactcttctacgaaagcgtcgctaaaacaagctgatgccttcctgcgtatctcgtgattagcaacacagtttttcattttgtcaccacacctactgctccgtgctatatagaagattcggtaaattagaataattagaatggcaagaccattcaaccttagatgctttggtggagtcagtcagtgcttagcaataaagaagctgtgacgagttttgcgggtgggtgctgtagccgccgaagcttgcagccttcttgctgttgttttccgttgtggcgcaagtttgtatcgatctggaataatgtttcttaagaagatctt

SEQ ID NO: 3863 - DNA, 1113 bp, Triticum aestivum
aaaatttgttgacctgcttggcagatctttttgcgcagataagcctatcgaagaaaaagactggtgttatttctccaaaacgttttgtccatagagtgaggaaacagaatgaattgtttcgtagtaatatgcaccaggatgcccatgaatttttgaattttttgttgaatgagattgtcgatattctggaaaaagagtttagtactgtgaaggattctcctgaaagcacatcccctggaggggtggcaaatggcgaagtttatcatttagccaatgaagttcgaagggagccgctggttacatgggtccacaagaattttcagggtattttgaccaatgaaacaaagtgcctgatgtgtgagactgtcaccgcaaaggatgagacatttttagatttgagcatcgacattgaacagaatagttcactaacaagctgcctgaagagtttcttttccaccgagattttaaatgccgaggacaagtttttctgtgacaactgctgcagtttgcaagaagcacagaagagaatgaagataaaaaaggcgccacaaatattggtgatccacttaaagcgcttcaagttcattgaacagctgagtcagcacaagaaactgtcataccgagtggtataccccatggagctgaagctgagcagtgcctctgatgatgtggattgcgaatactcactctttgctgtggtagtccacgttgggaacgctgccaaccacggacattatgtaagccagattaaaagcggcgaccactggctgtcatttgacgatgacagtgttgacaaaattcaggagtcaaccctgcaaacgttctatggttcttctcgcgaatattctggcaacagcgatcatggctacatcttgttctatgagagcgttgcaaagagctaggaattttccaggattagtgctagcgctgaaaataataattacagtgtgcaggatgggaacctgataccttttggtttcaaaatttcctcagtttatttactgcactgcaatagaatatagagtaattcgataagtgaaagttcgactaaagtttttcttgtaacagagaccaaacgggtattcagattcggacagaacttgtatggcgatt

SEQ ID NO: 3864 - DNA, 593 bp, Triticum aestivum
cactgatgattttgttctgagagcagctacgagatttcagaaaagcaaatggactatgcttcagatgtggagataagtacagcaaggaacatcaatgtaagaagcctctgcagctacttactatacaagttggtgaacatggggaagtgtattctattgcagtgcagtaaataaactgaggaaattttgaaaccaaaggtatcaggttcccatcctggacactgtacatattattttcagcactagcactaatcctagaaaattcctagctctttgcaacgctctcatagaacaagatgtagccatgatcgctgttgccagaatattcgcgagaagaaccatagaacgtttgcagggttgactcctgaattttgtcgacactgtcatcgtcaaatgacagccagtggtcgccgcttttaatctggcttacataatgtccgtggttggcggcgttcccaacgtggactaccacagcaaagagtgagtattcgcaatccacatcatcagaggcactgctcagcttcagctccatggggtataccactcggtatgacagtttcttgtgctgactcagctgttcaatgaacttgaag

SEQ ID NO: 3865 - DNA, 1289 bp, Triticum aestivum
agagccttaatcttgatgctgcaaagaagaaggtgcttgattttgtagagggtgaaatgggttacatcgcacctaacctatctgcaattgttggcagtgctgttgctgcaaaattgatgggaattgctggtggtttgggagcacttacaaaaatgcctgcttgcaatgttcagctacttggagcaaagaagaaaaatcttgctgggttttctagtgccacatctcagtttcgtgttggctatcttgaacaagccgaagtatttcagagcacccctccagccctgaggacccgtgcttgcagggttatagctgcaaaggcaactctagcagcaagaattgattcaactagaggtgatccaactggaaaagctggtcgcaacttgttagaagaaattcgcaagaagatcgagaagtggcaagaaccacctcccgcaaagcttccaaaaccacttcctgttccagattccgaacctaaaaagaagagagggggtcgccgccttcgaaaaatgaaagaaagatatgcggtgactgatatgatgaagcttgcaaaccgaatgcagtttggtataccagagtagagctcattaggtgatggtttgggggaaggttatggcatgcttgggcaggccggaagtgggaaactacgtgtctcagctgcgcaaaacaaacttgctgctaaagtggcaaagaaattcaaggagaggagttatggtagcggtggcgcaacatctggactgacatctagtttagcctttacaccagttcaggggatagagctgtcgaacccacatgcccacgggaaccttcttggaagtggaacacagagcacctatttctccgagacggggacgctttctcggatcagtaggccctgactgcggttggaatccgaacatgaaaagggcctgagattagaagagaggattgtttcttggtcccggcgattccatctcattctgcacacaacgctcaagagctcttgggattcttgcaccaggacataatcaacttgtcttctcagttgtaccgtggggttttgtatatgtaagtacagttagcggcttagcgcacaacaacatcacagcatatgaagccaggcggcactcaacattacctatgcttgcttggagcgtggataatctttccagaaaacccgccggaattgaattgttggaactgtcttgtctataacatccgccattgcatgctatgcagaggcatgctgaatcattccataccacaatgtgagtcgtggtcgcgatgcaaattttgatattattttgagagtg

SEQ ID NO: 3866 - DNA, 1057 bp, Triticum aestivum
gcaaaaatgcctgcttgcaatgttcagctacttggagcaaagaagaaaaaatcttgctggattttctagtgcccacatctcagtttcgtgttggctatcttgaacaagccgaagtatttcagagcacccctccagctctgaggacccgtgcttgcagggttatagctgcaaaggcaactctagcagcaagaattgattcaactagaggtgatccaactggaaaagctggccgcaacttgttagaagaaattcgcaagaagatcgagaagtggcaagaaccacctcctgcaaagcttccaaaaccacttcctgttccagattccgagcctaaaaagaagagaggtggtcgccgccttcgaaaaatgaaagaaagatatgcggtgactgatatgatgaagcttgcaaaccgaatgcagtttggcataccagaggagagctcattaggtgacggtttgggggaaggttatggcatgcttgggcaggccggaagtgggaaactacgtgtctcagctgcgcaaaacaaacttgctgctaaagtggcaaagaaattcaaggagaggagttatggtagcggcggtgcaacatctggactgacatctagtttggcctttacaccagttcagggaatagagctgtcaaacccacatgcccacggcaaccatcttggaagtggaacccagagcacctatttctctgagacgggcacattttctcggatcaataataggccatgaccgagcttggaatctgaaggcaaaaaggtcctgagattagaagaggggatcgttccccggtcccagcgattccatctcattctgcacacaacactcaagagttcctgggattcatgcacttgcacagaatcagcttgtattctcagctgtatcgcggggttttgtaatgtaagtacacaaagcgcactacaacatcacgaggtctgaagtcaggcagtacccaacgttacctatgcttcgagcgtcaataatcgttctagaaaacccgctggaattgaattgttgaactgtcttgcctgaaacatctgccatgctggatcatt

SEQ ID NO: 3867 - DNA, 686 bp, Triticum aestivum
agcccaacatggtcacccactggttctcgactctcaagaaggtggcccctgaggtgattgctgagtacaccgcccgcacactattccagaggaccgtcccgtgcgtgccgtccccgccattgtcttcctctctggtggacagagcgaggaggaggcgatccctgaactctgaacgccatgaacaagctccagaccaagaagccatggaacctgtccttctccttcgggcgtgccctccagcagagcaccctcaaggcctggtccggcaagacggagaatgaggagaaggccagggcggcgttcctggtgaggtgcaaggccaactctgaggccaccctcgggacctacaagggcgacgccacccttgccgagggcgcctcggagagcctccatgtcaaggactacaagtactgatctgccccccgctggatggtttgggcattcctgcttactacctccgtctgaaaataagtgtctgacacttatttttggacggagtagtatctgtttggtttcatagtcttgatatttttaaatatcaatccttgtttttaataatataagcttctacttatagttaatttttgacgttgaatcccctgtaatacatttgctgagcagaatgtttttgctctaagcggtattgtattttttctgcttacaatgaaatgaaatgtggacccccg

SEQ ID NO: 3868 - DNA, 662 bp, Triticum aestivum
atcccgctcctggtgccgcacatgaacctagcgacgccaagctcgccggctacgaccatccccgccgagtccaagatcctcgtcaacgcctggttcctcgccaacgaccccaagcggtgggtgcgcgccgacgagttcaggcccgagcgcttcctcgaggaggagaaggccgtcgaggcccacggcaacgacttccggttcgtgcccttcggcgtcggccgccggagctgcccagggatcatcctcgcgctgcccatcatcggcatcacgctcgggcgcctcgtgcagaacttccagctgctgccgccgccggggcaggacaagatcgacaccaccgagaagcccgggcagttcagcaaccagatcctcaagcacgccaccatcgtctgcaagccactcgaggcttaattgaattgaggtctcggtcatgggcgcgcgctgacgcggggagatggatccatacatgtgactgtgtgttttgccttctttctttttggtgttttgcagtagtataagtttaatttttctttggtgttggcctatttgtcttcatgtgaggcgtcgtgttgtaaatttccatatagttggcatgtgatgtaatccaaatacgacatgattacaaattttgcaactcggagaaggtcaaaaccacttggtactct

SEQ ID NO: 3869 - DNA, 473 bp, Triticum aestivum
gatgagttcaggccggagaggttcctcgaggatgagaagcccgtcgaggcccacggcaacgatttccggttcgtgcccttcggcgtcggccgccggagctgccccgggatcatcctcgcgctgcccatcatcggcatcacgctcggacgcctggtgcagaacttccagctgctgccgccgccggggcaggacaagatcgacaccaccgagaagcccgggcagtttagcaaccagatcctcaagcacgccaccattgtctgcaagccactcgaggcttaactgaattgaggtttcggtcatgggcgcccgctgacgcggggagatggatctatgcatgtgactgtgtattttgccttctttctttttggtgttgttttttgcagtagtaagtttaatttttctttggtgatggcctatttgtcttcatgtgaggcgtcgtgttgtaaatttccatatagttggcaatgtgatgt

SEQ ID NO: 3870 - DNA, 661 bp, Triticum aestivum
agccatccgctctcggcccacaggacctcacgacccagctcgcggtacgacatccccgcgagtccagatcctcgtcacgcctggttcctcccaacgaccccaacggtgggtgcgcgccgacgagttcaggcccgagcggttcctcgaggaggagaaggccgtcgaggcccacggcaacgacttccggttcgtgcccttcggcgtcggccgccggagctgccccgggatcatcctcgcgctgcccatcatcggcatcacgctcggacgcctggtgcagaacttccagctgctgccgccgcccgggcaggacaagatcgacaccaccgagaagcccgggcagttcagcaaccagatcctcaagcacgccaccatcgtctgcaagccactggaggcttaagaattttcgatgaacgacatggaggtttatggcatgcgtgcgtccacgctgatgcggggagatccatctatgcatgtgactttgtattttgcatttcttttttggtgttttgtagtagtataagtttaaattatttttttggtgttgggctatttgtcttcatgtgaggcgtcgtgttgtaaatttccatatataatgtgatgtaaaacttcttggctccaaaaaacgacatggttactcattttgcatgcaactccgagctgg

SEQ ID NO: 3871 - DNA, 734 bp, Triticum aestivum
ttataaggccctcaacgacctagcatgtcctcctccgagggcactctcctgaagcccaacatggtcacccctggttctgactccaagaaggtggcccctgaggtgattgctgagtacaccgtccgcaccctccagaggaccgtccctgctgccgtccccgcctattgtcttcctctctggtggacagagcgaggtaggaggcgatccctgaacctgaacgccatgaacaagctccagaccaagaagccctggaacctgtccttctccttcgggcgtgccctccagcagagcaccctcaaggcctggtccggcaagacggagaacgaggagaaggccagggcggcgttcctggtgaggtgcaaggccaactccgaggccaccctcggcacctacaagggcgacgccaccctcgctgagggcgcctccgagagcctccacgtcaaggactacaagtactgattgatctgccttcggtgctgtggcccgtttgggcgtcccgcttaccagtatcattgtcattgtttggtttcctgagtcctgatatatcctcggatatcgaacatcgtttttaataatatggaacttgtgttttcataataccgtagtagtttctttttggagttgaagtaccctgaaaatcgggtgctgcgtatcgtaaattggagcaggtttttgttccatggtcctgtaatttacctgctcatacaatgttaaaacctgtcatattctgagta

SEQ ID NO: 3872 - DNA, 610 bp, Triticum aestivum
gaggtgattgctgagtacaccgtccgcaccctccagaggaccgtccctgctgccgtccccgccattgtcttcctctccggtggacagagtgaggaggaggcgaccctgaacctgaacgccatgaacaagctccagaccaagaagccctggaacctgtccttctccttcgggcgtgccctccagcagagcaccctcaaggcctggtccggcaagacggagaacgaggagaaggccaggacggcgttcctggtgaggtgcaaggccaactccgaggccacccttggcacctacaagggcgacgccacccttggcgagggcgcctctgagagcctccacgtcaaggactacaagtactgatctatctgccttcggagctgtggcccgtttgggcgtcccgcttaccagtatcattgtttggttttctgagtcctgatatatccttggatatcgaacatcgtttttaataatatggaacttgtgttttcataataccgtagtagtttctttttggagttgaagtaccctggaaatcgggtgctgcgtatcgtatattggagcaggtttttgttccatggtcctgtaattttcctgctcatacaatgttcaaacc

SEQ ID NO: 3873 - DNA, 562 bp, Triticum aestivum
ctctggtggacagagtgaggaggagcgaccctgaacctgaacgccatgaacaagctccagaccaagaagccatggaacctgtccttctcctttgggcgtgccctccagcagagcaccctcaaggcctggtccggcaagacggagaacgaggagaaggccagggcggcgttcctggtgaggtgcaaggccaattccgaggccaccctcggcacctacaagggtgacgccaccctcgctgagggcgcctctgagagcctccacgtcaaggactacaagtactgatctatctgccttcggagctgtggcccgtttgggcgtcccgcttaccagtatcattgtttggttttctgagtcctgatatatcctcggatatcgaacatcgtttttaataatatggaacttgtgttttcatgatatcgtagtagtttctttttggagttgaagtaccctggaaatcgggtgctgcgtatcgtatattggagcaggtttttgttccatggtcctgtaatttacctgctcatacaatgttaaaacctgtcatatgctgagtacacatgtgttc

SEQ ID NO: 3874 - DNA, 669 bp, Triticum aestivum
cgcatggccatcccgctgctggtgccccacatgaacctccacgacgccaagctcgccggctacaacatccccgccgagagcaagatcctcgtcaactcctggttcctcgccaacaacccggagcagtggaagcggcccgacgagttccggccggagcgcttcctggaggaggagaagcacgtggaggccaacggcaacgacttcaggtacctgcccttcggcgtcggccgccggagctgccccggcatcatcctcgcgctgcccatcctcggcatcaccatcggccgcctcgtccagaacttcgtgctcacgccgccgcccggccaggacaagctcgacaccacggagaagggcggccagttcagcctccacatcctcaagcactccaccatcgtcgccaagcccagagtgttctagagcagcgacgtaacgtgctctggagtttggacttccagcattttggtttggtggtgttgtactttcacgattgttcgctcgtcctaagtatacttgattatagtatccgtcacagagtagacacacgtttcgttaatgttatccgcaagaaaacagaggagctgaagaaatgtcgaacggggaggaaaagactggacgatttccgtcagatgtactcctgatgctgccataaattaaatcctcgaaaatatt

SEQ ID NO: 3875 - DNA, 568 bp, Triticum aestivum
cgccgacaaccccgaacagtggaagcggcccgacgagttccggccggagcgctttcctggaggaggagaagcacgtggagccaacggcaacgacttcaggtacctgcccttcggcgtcggccgccggagctgccccggcatcatcctcgcgctgcccatcctcggcatcaccatcggccgcctcgtccagaacttcgtgctcacgccgccgcccggccaggacaagcttgacacgactgagaagggtggccagttcagcctccacatcctcaagcactccaccatcgtcgccaagcccagagtgttctaagcagtcccgtaccggacgtacgtgctctggagtttggacttccagcattttggttcggtgttgtactttcatgattgttcgctcgtcctaagtatacttgattatagtatctgtcacagagtagacgcacgtttcgttaatgttatccgcaaggaacagaggagctgaagaaatgtcgaacggggaggaaaagactggacgatttccatcagatgtactcctgatgctgccataaattaaatcctcacaatattgatg

SEQ ID NO: 3876 - DNA, 1492 bp, Triticum aestivum
tcccgcgagggccagacttggtgttcacgtgtacgcgacccctgcgcagatcggcgcatcatgccgtgccgttcttcaccacaaggtggtgcacagtaccggcccggtgggagccgaggcggcccttcgtggtggacaacgtccgcgccgaccccaggccgccaccgatggcgtcgtgctccgccgccacctgcagctcatgatgtacaacaacatgtaccgcatcatgttcgaccggcggttcgagagcatggacgaacccgctgttcctccgcctccgggcgctcaacggcgagcgcagccgcctcgcgcagagcttcgagtacaactacggcgacttcatccccgtcctccgccccttcctccgcggctacctccggctctgcaaggaggtcaaggagacccgcctcaagctcttcaaggattacttcctggacgagaggaagaagctggtgagcaccaaggccgtggaagacaacggtgggctcaagtgcgccattgatcacatcctggaggcggagcagaagggggagatcaacgaggacaacgtcctctacatcatcgagaacatcaacgtcgcagcgatcgagacgacgctgtggtcgatcgagtgggggctggcggagctggtgaaccacccggagatccagcagaagctgcgggacgagatggacgcggtgctgggcgtcgggcaccagatcacggagcccgacacgcacaggctcccctacctgcaggcggtgatcaaggagacgctccggctgcgcatggccatcccgctgctggtgccccacatgaacctccacgacgccaagctcgccggctacaacatccccgccgagagcaagatcctcgtcaacgcctggttcctcgccaacaaccccgagcagtggaagcggcccgacgagttccgccccgagaggttcctcgaggaggagaagcacgtggaggccaacggcaacgacttcaggtacctgcccttcggcgtcggccgtcggagctgccccggcatcatcctcgcgctccccatcctcggcatcaccatcggccgcctcgtccagaacttcgtgctctcgccgccgcccggccaggacaagcttgacacgactgagaagggcggccagttcagcctccacatcctcaagcactccaccatcgtggccaagcccagggtgttctagagcagcgccgtgccggacgtacgtgctctggagtttggacttccagcattttggtttggtgttgtagtactttcatgattgttcgctcgtcctaagtatacttgattatagtatctgtcacagagtagacacacgtttcgttaatgttatccgcaagaaacagaggagctgaagaaaggccaaacctgatgctgcgataaattaaagttaaattcttgaaatcttgatgattttttcataaacgaaataactctccctctgttgtaattatcttgatgcatctgtaacgatcacttgttgcacgttggtga

SEQ ID NO: 3877 - DNA, 762 bp, Triticum aestivum
cgtcgagtctccgaggtcatctacaacagagaaaccgaccagagccgtggatttgggtttgtcaccatgagtacaattgaggaggctgagaaggctgtggagatgttccatcgctacgatgtgaatgggaggctgttgactgtaaacaaggcagctcctagaggcgcccgggtggaaaggcctccccgtgattccggctcttcattcaggatctatgtgggcaacctgccatggcaagtggacgactctaggttggtggagctgttcagcgagcatggcaaagtggtcgatgctagggtcgtctacgacagagacactgggcgctcacggggatttggtttcgtgacaatggcgtcgcaggaggagctggatgatgccatcgctgccctcgatggacagagcttggaggggcgtgccctaagggtgaacgtcgcagaggagcggccacctaggaggttctaatgaaggtgtatttggcggtggactacgacaagattgctgcgtaagagacacgatagcacgcctgataccggcttagaccccccatcatcctcccatccatccttgtgtcatgtcttgtctactctctccagtgtttttctcttttgctatctgcctcttgcttccacgttctcaatctgtcgatgcaattcaaaagttttgtctgacatactacgtatatttaagccccatgggtgtggtgttaccccgagattcatgctcacctgatattggaaaaggatccaaaactcccttatgcga

SEQ ID NO: 3878 - DNA, 980 bp, Triticum aestivum
  misc_feature (609)..(609): n = any nucleotide
  misc_feature (656)..(656): n = any nucleotide
  misc_feature (738)..(738): n = any nucleotide
gcgggatcaagctgttcgccgggatgagcttgccggacctctacccgtcgtcccgcctcgcgatgctcctcagccgggtgccaggccagatgaagcggtaccgcgaagaacgggacgcgttcatggacgccgccgtccgcgagcaccaggagaacagagcggctgacgacgacaaggagggtttgctcgacgtgctcctgaggatccagcgggaaggccacctgcaattccccatgtccattgacaacatcaagtcggccgtcggggacttgttcgccggggggagcgacacgtcagcaacgaccctggaatggaccatggccgagctcgtgaagaaccccagagtgatggggaaggcgcaagacgaggtccggctagccctcgccggacaacccaaggtaacagaggactccctcggcggcctgaactgcatgcgcctggtgatcaaggaggtgctccggctgcaccctccggcgccgctgctgctgccgcgtgagtgcatgaacgactgccgggtcctgggcttcgacgtgcccaaggggaccatggtgcttgtcaacgcctgggccattagcagggaccctgcccactgggacgccgctgaggagntcattccggagaggttcgagcgcggcgagatcgacttcaagggggcngatatggagtacacgccattcggggcgggccgaaggatgtgccccgggatgtcgttcggtttggccaatgttcagctcgcgntcgccgggctgctgtaccatttcgactgggagctgcccggcggggcggggcggagaccgaggagatgggagtcaccgtgaagtgcgccgtgaccttctgcttgttccggtggtccgagcgcccttaccactagactattagctctagctagccaggttctgctaatcgacagggggtattatattagtagcaagtcacatgggagatggcgtgaacttttaattttcagtttgcgaacatgt

SEQ ID NO: 3879 - DNA, 618 bp, Triticum aestivum
aacagtcggagtctccctgcgacagcgaaggtcctactcaccctacgacaggcgcattcttgctcgccccgccatggtcatcgccaccgttcaagatctccataccgctacagaaggcggagtcgcgctcccatgaccgttctgtttcagcatactacagcaggcgctattctccaaggagcagaagacggagctactctcgcagcatatcgccacgcaggagctactcccgcagctgctctccggcgtcggaagaatcaaggagctgttctccgcggaaaggacgcgccgaaagcaaggcatcacgcagcaggtcacctgggaagaggcgttccagagaaagctatgctcacagccgcagttcatgctcgaggtccgtctccagggaacgctcaacctcagcaagcacctgatgttttacgaagcgccaggccaccgtatttccgttgtaatgttggaattttagtaacttggatgtttgtaaacagtgtggatggtatgatcgtgcacctagtgaagcagctgtatttcgtcatggttctggacttgcatgccatatgcatgctaaacgctgtactttatacttctgttttcagtatggttggcagtttacatcat

SEQ ID NO: 3880 - DNA, 635 bp, Triticum aestivum
ggcggtgtcgcaggtggtaactgacatacgcagaggcgaagctgaagacagagactcgagaggcttcgggaggacaggatcgcagtcgcagcggcgacgaagcaaagatgtcgtattcgaggtacaggagtcgttcaaggagtgtggactcgagtgatgttgagaaccctgggaacaatctcttcgtgactggtttatcatctcgtctaactgatcgagatctggagaagcatttctctacagagggagaggtgattgatgcaagtatagtacttgatccatggacaagggaatcacggggattttggtttgttaccatggctactcttaaggaggcagaacactgcatcaaatatctcgaccgttcagtgctggaaggtcgtgtcattactgttgagaaggcaaagagaagacgaggccgaaccccaacaccaggaaggtatctgggcaccaaatcatcgcgtggaaggaggtattcccgaagcaggtcacctgttaggagagaccgttacagctcacgctactcgcctgagcgagaacgctcttattctccttatcgcagaggacgatcatactctcgtcgtgacaggcgtagatcatactcccctgatgacaggagggaaaataatctccct

SEQ ID NO: 3881 - DNA, 745 bp, Triticum aestivum
agagaccgttacagctcacgctactcgcctgagcgagaacgctcttattctccttatcgcagaggacgatcatactctcgtcgtgacaggcgtagatcatactcccctgatgaaaggaggcgatactactctccctatggcagaaggagatcatactctccttctgacaggtcggagtctccctacgacaggcgtaggtcctactcaccctatgacaggtcctactcaccccgccatggtcatcgccaccgttcaagatctccataccgttacagaaggcagaggtcgcactcccacgaccgttctgtttcagcatactacagcaggcgctattctccaaggagcagaagacggagctactctcgcagcatatcgccacgcaggagctactcccgcagctgctccccggtttcagaagaatcaaggagctgttctccacggaaaggatgcgccggaagcaagccatcacgcagcaggtcacctggcaagaggcgttctagagaaagctatgctcacagccgcagttcatgctccaggtccgtctctcgggagcgctcaacctcagcaagcacatgatgttttacgaagcgccttgccaccgtatttccgttgtaatgttggaattttagtaactctgttgtaatggtatgatcgtgcacctgtatttcgtcatgactgttagaataaatccgaggtacgtgaacgatccatcgaggagcaagtaatcacagacaatgatgacaca

SEQ ID NO: 3882 - DNA, 687 bp, Triticum aestivum
accgccaccgctccccatctcgatctaaaaccgagggtttcgtccagctccgtcgccgcgacccaaaccagagcccgccccacccaccccagccagccagccatgccgaagaacaagggtaagggaggcaagaaccgcaagcggggcaagaacgaggccgacgacgacaagcgcgagctggtgttcaaggaggacggccaggagtacgcgcaggtgacgcggatgctcggcaacgggcgctgcgaggccatctgcgtcgacggcaccaagcgcctctgccacatccggggcaagatgcacaagaaggtctggatcgccgccggggacatcgtcctcgtcggcctccgcgactaccaggacgacaaggccgacgtcatcctcaagtacatgaacgacgaggcccgcctactcaaggcctacggggagctccccgacacgctccgcctcaacgagggcgttgacgtcgacggccccgaggagggcgagggcgacagcgactacatccagttcgaggacgaggacatcgacaagatctaagccttttttcctcctccctcgcctatactgtgtgttctattctgttctaatagcgtctgtgtcggtcggtgggctgttgtggattgatggatttggtaacgagaaatcgttgtgacttgaggtgcctaaataattgttgattatcgtgtt

SEQ ID NO: 3883 - DNA, 736 bp, Triticum aestivum
cgctccccatctcgatctaaagccgagggtttcgtccagctccgtcgccgcgacccaagccagagccagccccaccccagccagccagccatgccgaagaacaagggtaagggaggcaagaaccgcaagaggggcaagaacgaggccgacgacgacaagcgcgagctggtgttcaaggaggacgggcaggagtacgcgcaggtgacgcggatgctcggcaacgggcgctgcgaggccatctgcgtcgacggcaccaagcgcctctgccacatccggggcaagatgcacaagaaggtctggatcgccgccggggacatcgtcctcgtcggcctccgcgactaccaggacgacaaggccgacgtcatcctcaagtacatgaacgacgaggcccgcctgctcaaggcctacggggagctccccgacacgctccgcctcaacgagggcgtcgacgtcgacggccccgaggagggcgagggcgacagcgactacatccagttcgaggacgaggacatcgacaagatctaagcttttttcccctcctcctccctcgctcgatatactttgtgttctattctgttctaatagcgtccgtgtctgtctgtgtcggtcggtcggtgggctgttgtggattgatggatttggtaacgagaaatcgttgtgatttgaggtgcttaaataattgtcggattatagtgttcgtcgtattattatgctttgcaacaagccatctgatgat

SEQ ID NO: 3884 - DNA, 917 bp, Triticum aestivum
gcaccaccaccgctccccatctcgatctaaaaccgagggtttcgtctagctccgtcgccgcgagccagagccagcccaccccagccagccagccatgccgaagaacaagggtaagggaggcaagaaccgcaagaggggcaagaacgaggccgacgacgacaagcgcgagctggtgttcaaggaggacgggcaggagtacgcgcaggtgacgcggatgctcggcaacggccgctgcgaggccatatgcgtcgacggcaccaagcgcctctgccacatccggggcaagatgcacaagaaggtctggatcgccgccggggacatcgtcctcgtcggcctccgcgactaccaggacgacaaggccgacgtcatcctcaagtacatgaacgacgaggcccgcctgctcaaggcctatggggagctccccgacacgctccgcctcaacgagggcgtcgacgtcgacggccccgaggagggcgagggcgacagcgactacatccaattcgaggacgaggacatcgacaagatctaagctttttcctctcctccctcgctcgatatactttgtgttctattctgttctaatagcgtccgtgtctgtctgtgtctgtcggtgggctgttgtggattaatggatttagtaacgagaaatcgttgtgatttgaggtgcttaaataattgtcggattatagtgttcgtcgtattattatgctttgcaacaagccatctgatgattattatggtcttgatattgatttgttctccttgattggtttgccgtaatttgggaaacttcctgaggttggcaggactctacttcactaatctggttgcacattagcctcctttatttaattcttcctcttcaaaagaagaacaattatgttctgtttactgattgaagttcacgggacaaaatt

SEQ ID NO: 3885 - DNA, 650 bp, Triticum aestivum
  misc_feature (13)..(13): n = any nucleotide
catcatcaacacnttctactccaacaaggagatcttcctccgtgagctcatctccaacgcctccgatgcgttggataaatcaggttttgagagcctgactgacaagagcaagctggatgctcagccagagctgttcatccgtataatccctgacaaggccacgaacacactcacacttattgacagtggtattggtgatgaccaagtcagacctcgtgaacaaccttggtaccattgcgaggtctggcaccaaggatttcatggaggcactggctgctggtgctgatgtatccatgattggtcagtttggtgtcggtttctactctgcttaccttgttgctgagagagtcattgtgaccagcaagcacaacgatgacgagcagtatgtgtgggagtcccaggctggtggttccttcactgtgacacgtgatactactggagagccccttggaaggggtactaagatcaccctctacctcaaggatgatcagttggagtaccttgaggagcgtcgccttaaggatctggtgaagaagcactctgagttcatcagctatcccatctctctctggacggagaagaccactgagaaggaaatttctgacgatgaagatgaggatgagaagaaggatactgaggagggcaaggtt

SEQ ID NO: 3886 - DNA, 575 bp, Triticum aestivum
ttcctccgcgagctcatctccaacgcatccgatgcgttggataagatcaggtttgagagcctgactgacaagagcaagctggatgctcagccagagctgtttatccatattatccctgacaaggccacgaacacactcactcttatcgacagtggtattggtatgacaaagtcagacctcgtgaacaaccttggtaccattgcaaggtctggcaccaaggatttcatggaggcactggctgctggtgctgatgtgtccatgattggtcagtttggtgtcggtttctactctgcttaccttgttgctgagagagtcgttgtgaccagcaagcacaacgacgacgagcagtatgtgtgggagtcccaggctggtggttccttcactgtgacacgtgatactactggagagccccttggaaggggtactaagatcaccctctacctcaaggatgatcagttggagtaccttgaggagcgtcgccttaaggatctggtgaagaagcactctgagttcatcagctaccccatctctctctggacggagaagaccactgagaaggaaatttctggtgatga

SEQ ID NO: 3887 - DNA, 647 bp, Triticum aestivum
ggggttggcttctcctccccactcagtcctcggttcccggcccggttcggttcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgcgccggcggaggcggcagccgcggcggctccggcggcggcaactggagggagtgaatggtggggcccctcgctggccagttatcctagttacccgatccgtttttacctgtctaccaaaatgttatcgctcgctcgctcccgagtatcctagatctcgctccgtcgcgtaggttccgagatgttcaggctaccgttagatgtgacgctgctaccgttccgtgttactgttccgtccccgctctgttcgctatgcttctaagattgaaatgaaaacctgagcaaagtttggcctcgcatgtgatg

SEQ ID NO: 3888 - DNA, 536 bp, Triticum aestivum
ccgccgcccacgccgcaggagaagaagcagacgcgcggaggagagcttccaggcggcgaccatggtgaacgttccaaagaccaagaagacctactgcaagaacaaggagtgcaagaagcacaccctccacaaggttacgcagtacaagaaaggcaaggacagtctttctgctcagggaaagcgccgttacgaccgcaagcagtcaggatatggtggccagacaaagcctgttttccacaagaaggccaagacaacaaagaagattgtgctgaagctgcagtgccagagctgcaagcattactcgcaacgcgctatcaagaggtgcaagcactttgagatcggtggagacaagaagggcaaggggacctctctcttctaagctgatgatatccctgttttgttcagtgttgtgccagaacttcccactcgaacaatgtattagtatcatattggtattctgggtataactgtatgggctatggagcatatgttttgcctttcctgtcaacgactctcttcagatccttgagacaagt

SEQ ID NO: 3889 - DNA, 919 bp, Triticum aestivum
  misc_feature (508)..(530): n = any nucleotide
ggcttctcctccccactcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctccggcggcggcggcgcggcttcggcgcggcggctccggcggcggctacggcggccagcgtcgtgaaggaggaggcgcggcggctccggcggcggcggcggcggctacggaggtgctcgcagcggcggcggccggtggctacggcagccgtgagggcgcggcgnnnnnnnnnnnnnnnnnnnnnnncgtcggctacggcgcagccgcggcggctccggcggcggcaactggagggagtgaatggtggggccgctcgctggccagttatcctagttaccgatcctttttttacctgtctaccaaaagtgttatcgctcgcctcccgagtaccctagatctcgctccatcgcgtaggttccgagatgttctggctaccgcttagatgtgacgccgctaccgttccgtgttacctgttccgtccccgttggctatgaatgaaatgaaaaatcagagcaaagtttgttcgcatatgatgcttctcgcggaagtgcaagtttgttcctttttctgtttgtgccgtgaacgctttaccttgccgctggatgatattttgctgcacccactacggccatgtt

SEQ ID NO: 3890 - DNA, 581 bp, Triticum aestivum
cggatccaccgccgcttccgcagccatggtgaacgttccgaagaccaagaagacctactgcaagaacaaggagtgcaagaagcacacgctccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacaacgcgctatcaagaggtgcaagcactttgaaatcggtggagacaagaagggcaagggaacatctctcttctaagctgatggtatcctgttatgtttaggatgttgtgccagaacttcccacaagaagaatgtattatctttaattttctggttataaccctatgggctatggagcatatgttttgctattgtgtcaactactttctccagatctaatcgacaagtaaaatgttgtttatgctcggagtgcggtatctttgttcttggtctgattagaattgctgtcgcagtgtatgctcatgatgggatga

SEQ ID NO: 3891 - DNA, 706 bp, Triticum aestivum
agaagaaaaatacgggtgacgccattacttaggtggcgcgaaactatatcctaccaaccggcaagcttaaactacggtagatatgtggtcgtcgagtactacgcggacgattacagtagtaaagttgacagcaaagaagaggatccaccgccgcttccgcagccatggtgaacgttccgaagaccaagaagacctactgcaagaacaaggagtgcaagaagcacaccctccacaaggttacccaatacaaaaagggtaaggacagtctttctgcccaggggaagcgtcgttatgaccgcaagcagtctggatatggtggccagacaaagcctgttttccacaagaaggccaagacaacaaagaagattgtgctgaagttgcagtgccagagctgcaagcattactcacaacgtgctatcaagaggtgcaagcacttcgaaatcggtggagacaagaagggcaagggaacatctctcttctaagctgatgatattgtcgttatgtttagaatgttgtgccagaacttcccacaagaagaatgtattatctttaattttctggctataacattctaaacataacagcgatatcatcagcttagaagagagatgttcccttgcccttctaagctgatgatatcgctgttatgtttagaatgttgtgccagaacttcccacaagaagaatgtattatctttaattttctg

SEQ ID NO: 3892 - DNA, 1426 bp, Triticum aestivum
agctctccaacaaggacttcgactcgtatgtgctatctgagtccagcctgttcatctattctcagaagattgtgatcaagacctgtgggactaccatgctcctgctcaccattcctaggattcttgagcttgctgaagagctgtgcatgccgcttgctgccgtcaagtactctcgtgggatgttcatcttccccggcgcacagcctgctccccacaggagcttctctgaggaggttgatgtcctgaaccgctacttcggccacctgaagtctggtggcaatgcttatgtgatcggagacccagcgaagcctggccagaagtggcacatctactatgccaccgagcaacctgagcagcccatggtcaccctggagatgtgcatgactgggctggacaagaagaaggcctctgtcttcttcaagactcaagctgatggccacgtttcctgtgccaaggagatgaccaagctctctggaatctctgacattatccctgagatggaggtctgtgacttcgacttcgagccctgcggctactccatgaacgccatcaacggatctgccgtctccaccatccatgtgacccccgaggacggcttcagctacgcgagctacgaggtcatgggcatggacgcctccgccctggcctacggcgacatcgtcaagagggtcctccggtgctttggcccttcagagttctctgtggcggtcaccatcttcggtggccgtggccacgccgccacctggggcaagaagctcgaagctgaggcatacgactgcaacaacgttgtggagcaggagctcccctgcgggggcgtcctcatctaccagagctttgccgcgaacgaagaggttgctgtctctgccgggtcgcccaggtccgtcttccactgcttcgaggccgagagtgtgcagagccaccctctggtcaaggaaggcaagctcgccaacctcctcgcatggcgggcggaggaggattccctggaggagggcgcggtgctgtgcgagtgattggctgtcgctgttccgtctgtggactttgttctgactaagtttgtcgtttggttactgtgaagcagctggccaggctattgctactccgaataaactattagctctaggtggtttgctgcgtctgccacaatgagcgtacttctggggagaagttgtctcaaactgataaataagcattttttttctaagacgagtgtcactttgttatcatattcatgttctgtaatcgaaactacttcacagccgatagctgttggacgattcaagcacgattcttaatctagtggctgtgttgcacctagtactaggtatcgatggcctgaattgcagtatcgtccaacaatcggctggaacatgtcgtgtgcatagcagcactcttctgtaattggtgttactctgtgccaagttgcagt

SEQ ID NO: 3893 - DNA, 626 bp, Triticum aestivum
  misc_feature (43)..(43): n = any nucleotide
  misc_feature (178)..(178): n = any nucleotide
gcgcccagggacgtcggccgaagacgagtgaacatgagggtgntccgcgcgctcggggctcgctactgcgggcgatgagccgggacgtggctggcgtcacaacgccgatgctatatgtggcgatgctctacagttggttcgcgtggcacgtggaggaccatgagctgcatagcctggnctacctccacttcggcaagcccaagacttggtacggcgtgccccgagatgccatgcttgccttcgaggatgctgtccgtgtccatgggtacgcggacgacctcaatgccatcagtgcgacagacgagccagacggttgggactggcaccaggtgtagagggctctggtacatggaccaggaggtgcagccagacttggtgtgtgctgcgaccatggaggacaaggagaagcaggcgatgatccatcactgtaggatggggcatgtgtcttttgataagatgagtagaatattttcggatgttatgtgtggaataggcaagggcaagctgacatgtgatgcttgtgaatatgcaaaacacacacgagcctcatatgtgagtaagtggctcaggagcatatctccttttatgcttattcattcggatgtatggactagccctatggtgtc

SEQ ID NO: 3894 - DNA, 1575 bp, Triticum aestivum
  misc_feature (7)..(8): n = any nucleotide
  misc_feature (14)..(14): n = any nucleotide
  misc_feature (52)..(52): n = any nucleotide
ttcgcanncgatcnaatccctctcggcttgatgcttcacgataatctgaccnagttctctagtctttctccctctgttcctctctgctctgctttctgactcaaaactgcaacaatggctgccccgacctctgcgatcggatttgagggctacgagaagcgccttgatatcaccttctctgaggcatcaatctttgctgaccctcatggtcgtggcctgcgcgccctctccagggcccagattgactctgttcttgatcttgcacggtgcaccattgtgtccgagctctccaacaaggactttgactcgtacgtgctatccgagtcgagcttgtttatctactctcagaagattgtgatcaagacctgtgggactaccatgctcctgctcaccattccaaggattctcgagctggctgaagagctgtgcatgtcgcttgctgctgtgaagtactcccgtgggatgttcatcttccccggtgcacagcctgctccccacaggagcttctctgaggaggttgatgtcctgaaccgctactttggccacctgaagtctggtggcaatgcctatgtgattggagacccagcgaagcctggccagaagtggcacatctactatgccaccgagcaacctgagcagcccatggtcaccctggagatgtgcatgactgggctcgacaagaagaaggcctctgtgttcttcaagacttctgctgatggccatgtctcctgtgctaaggagatgaccaagctctctggtatctctgacatcatccctgagatggaggtctgtgacttcgacttcgagcccctgcggctactccatgaacgccatcaacggatctgccttctccaccatccatgtgacccccgaggacggcttcagttacgcgagctacgaggtcatgggcatggacgcttcggcccctggcctatggcgacatcgtcaagagggtcctccggtgctttggcccttcagagttctcagtggcggtcaccatcttcggtggccgcggccatgccgccacctggggcaagaagctcgacgccgaggcatacgactgcaacaacgttgtggagcaggagctcccctgtggaggcgtcctcatctaccagagctttgccgcgaacgaagaggttgctgtctctgccgggtcgcccaggtccgtcttccactgcttcgaggccgagactgtggagagccacccgctggtcaaggaaggcaagctcgccaacctcctcgcatggcgagcggaggattctctggaggagggcgtggtgctgtgcgagtgatttgctgtcgaatgttcagtctgtggaatttgctctgactgtttgtcttttgtcgtttggttactgtgaagcagccggccaggctattgctctctgaataaactattagctctaggtggtttgctgcgtctgccacaatgagcatactgtttggggaaaagttgtctcaacttataaataagcattttttttctaggacgagtgtcactttgttattactactgaattcctttctgcctgtatcatattcatattctgtaattggagttactagatgccaagt

SEQ ID NO: 3895 - DNA, 878 bp, Triticum aestivum
gaccatttcatggttccaaagaggtattcctctctgaccactatgatgtacagagtgctgacacaatagagggaaaatgcaatgtccacagcttccgtagctacacaaagcttgattctgtgaatgccgaggacttcttctgtcgctttgactacaaatcagcatccggcagtttcgtgcccgaccgtatagctgtgttttgcaagtgtgagatgccgtacaatcctgatgaccttatgatccaatgtgaggaatgctctgactggtttcacccttcttgtattggaatgaccattaaagaagcaaagaaacgagaacacttcttctgccagagctgtactgctgaaaatgggaagacaactgagaattctcatgaagccacggcagagtcagaagaaaggccggtggagtcgaaaaggcggagaaggtgatgggctggattaatttgatggaatttccacacggatatacaaactacatagccttctagtctgaggtctgtggtgttgtttgtggcagtctgtgaccccttctaatgtcaggcatgcagtgtacataacttgtaacctgagattgttgtattaggagaaaatagaatttggacgctagtgtcagagtttgagcagtatggtaccatcaagatcccttgtgatcttccctcaaaaaagaaaaaaaatcctttgtgatccattatgctgtggggcctgaccagccttttacgtttgtgagagtcgaatcttgtgttgccatgtggaatgttttgtgtctttgtttcggagcaactcgtggtgcagtatctgtgtagactgatttttagcatttgatttagctgcgtaatttttatagaactattgttgcttaagatcgttaataaagct

SEQ ID NO: 3896 - DNA, 1089 bp, Triticum aestivum
cccaagaagatcctcgagtcctacaccatcaaggggtccgacaaagtcatcaagcctggggactgtgtgctaatgagatcagctgatacatcaaagccaccttatgtggcaaaagttgagtccattgaggcagcagggtctcgaggcacaaatgtgagagtacgggttcgatggtactatcgtccagaagaatccattggtgggaggcgaccatttcatggttccaaagaggtattcctctctgaccactatgatgtacagagtgctgacacaatagagggaaaatgcaatgtccacagcttccgtagctacacaaagcttgattctgtgaatgccgaggacttcttctgtcgctttgactacaaatcagcatctggcagtttcgtgcccgaccgtatagctgtgttttgcaagtgtgagatgccgtacaatcctgatgaccttatgatccaatgtgaggaatgctctgactggtttcacccttcttgtattggaatgaccattaaagaagcaaagaaacgagaacactttttctgccagagctgtactgctgaaaatgggaagacaactgagaattttcatgaagccacggcagagtcagaagaaaagctggtggagtcgaaaaggcggagaaggtgatgggctggattaatttgatggaattcccacacggatataccaactacatagccttctagtatgaggtctgtggtgatgtttgtggcagtctgtgaccccttctaatgtcaggcatgcagtgtacataacgtgcaacctgagattgttgtattaggagaaaatagaatttggacgctagtgtcagagtttgagcagtatggcaccatcaagatcccttgtgatcttccctcacaaaaaaaaaagatcccttgtgatccattctgcgatggggcctgaacagccttttacgtttgtgagagtcgaatcttgtgttgccatgtggaatgtttgtctttgtttcagagcaactcgtggtgcagtatctgtgtagaaggggatctgatttttagcatttgatttagctgtgtaatttttatagaactattgtcgcttaagatcgttaataaagct

SEQ ID NO: 3897 - DNA, 761 bp, Triticum aestivum
caaatgtcaaggttaaagtgcgctggtactaccgaccggaggagtccattggtgggcgcaggccattccatggcgaaaaggaggtgttcctctctgaccaccaagatgtgcagagtgctgacaccatagagtgcaagtgcaacgtctacagcttccgggactacaccaagctttctgctgtcaatcctgaggactatttttgccgcttcgagtacaagtcaatcacaggcagctttgtgcctgatcgcattgctgtgttttgtaagtgtgagatgccatacaaccctgacgatcttatgatccagtgtgaggaatgctctgattggtttcaccctgcttgtattggaaagacaatcaaagaagcaaagaaacttgagaattttacatgcgaaggttgtgttgctgaaaatggaaatggaaatggaaatggagtcaagaatgaaaattcgcatgaatctacaggcgaatcagatgagaagcaggtgcagtcgaagcggcgacggcggtgaaggcgaaggcgatctgggcggaagtcctccatctcttcacgcatgtgacgcggtggatgtacattgctgtttccagtttgatgtagaacgaacctgtattgagagtctcttctagagtctggcattcggccagtttgcgactttgcatatccatgtggacctacctgttagagggagtaatttttctctcttcttttttccttcccccttcgtgttgacatggacatttgtgagtgagcttcaatgcccttt

SEQ ID NO: 3898 - DNA, 801 bp, Triticum aestivum
cagcaggacctcgggcgcaaatgtcaaggttaaagtgcgctggtactaccgaccagaggagtctattggtgggcgcaggccattccatggcgaaaaggaggtgttcctctctgaccaccaagatgtgcagagtgctgacaccatagagtgcaagtgcaacgtttacagcttccgggactacaccaagctttctgctgtcaatcctgaggactatttttgccgcttcgagtacaagtcaatcacaggcagctttgtgcctgatcgcattgctgtgttttgtaagtgtgagatgccatacaaccctgatgatcttatgatccagtgtgaggaatgctctgattggtttcaccctgcttgtattggaaagaccatcaaagaagcaaagaaacttgagaattttacatgcgaaggttgtgttgctgaaaatggaaatggaaatggagtcaagaacgaaaattcccatgaatctactggtgaatcagatgagaagcaggtgcagtcgaagcggcgacggcggtgaaggcgaaggcgatctgggcggaagtcctccatctcttcacgcatgtgttgcggtggatgtacattgctgtttccagtttgatgtagaacgaacctgtattgagagtgtcttctagagtctggcaatcggccagtttgcgactttgcatatccatgtggacctaccagttagagggagtcatttttctctcttcttttttccgtcccccctttgtgttgacttggacaatggtgagtgagcttaaagtcctttcttcattgactagaaaaacaggatacctt

SEQ ID NO: 3899 - DNA, 705 bp, Triticum aestivum
gggcgcgcacgtctctgcggcgccggcagggtccgcgccgccgacgaagctccggcaggtggctaagcggcaggtggactacatcctcggggacaacccgctgcgcatgtcctacatggtcggcgtacggcccgcggttcccgcgccgggatccaccaccgcggcagctccatcccgtccgtggcggcgcacccggcgaggatcgggtgcaaggccggcgccgcctactacgccagcgcggcgcccaacccgaacctgctggtgggcgccgtcgtcggcgggcccagcgacgccaccgacgccttccccgacgcgcgcgccgtgttccagcagtcggagcccaccacgtacatcaacgcgccgctcatgggcctcctcgcctacttctccgcccaccccaacccggccgagtgggccgacgactaaaacccagcagcaggaggatgatatgtacatgaaaaataaaatgcctctgactgacttcggcgtactgcaggagtagtgcactagtactaagctttagcgtcattcatttgtttggtttaactgtaactaattactattattatcggcagccatttcctctcctgcggaaaagaaaagatcagggggctgtataggctgtatctgcaatgttatacttgtaagatttagcgtgcttgaatattggcactatgtaaaatgttcatcagcaaaagagcttct

SEQ ID NO: 3900 - DNA, 925 bp, Triticum aestivum
aatcagatatgcaacaccagtgcaccacagcaacagtgaagtgatctcggaacagttgcacaagcttgggttttcaagaggcggagctgaaagcgttctcaacggccaaaccggcaaaaggatgcagcaactgatccttcgcaggccccaacttctaccagaggctgatccacatggccgaggacaaggtgaagttccggaacacggggccagtgcacccgctcacgaggcagcccgtcgctgacaggaagaggttcggcggggtcaagttcggggagatggagcgcgactgcctgctggcccacggcgcggctgccaacctccatgagcggctcttcacgctgagtgacttctcggagatgcgcatctgccagacgtgcgagcggggggcgaacgtcatcatgcggcctgtttcgggcgggcggaagatccggggcccgtactgcgggttctgcaagtcctcggagaacattgtcaagatcgccgtcccttacggcgccaagctgctctaccaggagctcttcagcatgggcatctgcctcaagttccagacggaggtctgctagaccgagcttcgtcgtggtgtgtatataggttatctatatctatctatggttactgatggacatgttagttaaggttctctgtggttgtggacatggtagttggctgaggttatctgtggttatggacatgtagtggctacgtggaactccttgtgaccatggcgtttgcgtagctgggacaggcctgctcctatggagcgaagctggccgtgcagtgcaggatatcttgtgccgtggggatgtgcctctggcctgaagaaattctgttgagacactgttgtagcttagctagttgaacctgtctcactctgcccctggaatcaactttatcctagtgaacagaattatattgtatagtg

SEQ ID NO: 3901 - DNA, 971 bp, Triticum aestivum
  misc_feature (685)..(685): n = any nucleotide
  misc_feature (883)..(883): n = any nucleotide
gtaatttgcttgctcgacaagtgggttgcactgtgctggcctttgatcgccctggatgggggttaacatctcgacctcgcagaaaggactgggaagacaagaatttgccaaacccgtacgagcttgagtcacaggttgatcttctgatttcattttgcttagacatgggcttgggctcggtcattttagttggtcatgatgatggcggcttgctggcactgaggaccgcagaaaagttacgtgcttctggagattctaggaaggttgaagtgaagggagttgttcttataggcgtaagcttatcaagagaagtgattcctgcatttgctcgtatactcctgcatactcctctgaggaaaaagcacatggtgcgcccacttctacgtactgaaatcactcaggtgatcaatcgacgagcatggtttgatgctaccaagttgacaacagatgttcttaatctttacaaggctccactatatgtcgagggctgggacgaagcactccatgaagtagcccgtctttcattttccaccgtcctatcatcaaaaaagagcaacgggaactactaagatcggtggaagacctccctgttttggtggtagcaggctctgaggatgctcttgtttctctgaagtcagcactaactatggcttcagaacttgtaattctaggtctagtaactatntcaggatgtggtcatctgccacacgaagaaatgtgccaatgcattgctctcagctctttctccgttcatctcaaaattggtatcatcagatgattcattgcaaagattgtagcatacacctgtccatcttcccttttgaattttgctctcttctgtgccctctacattgagtagatgacctctagctgttgcgagttngtgtgagcccatgttagttgcaaagtagtggagcctgacccaaaatctcaagggtcctagagctcccctaatttattttttggtcata

SEQ ID NO: 3902 - DNA, 759 bp, Triticum aestivum
gaccgcagaaaagttacgtgcttctggagattctaggaaggtcgaagtcaagggagttgttcttataggtgtaagcttatcaagagaagtgattcctgcatttgctcgtatactcctgcatactcctctgaggaaaaagcacatggtgcgcccacttctacgtactgaaatcactcaggtgatcaatcgacgagcatggtttgacgctaccaagttgacaacagatgttcttaatctttacaaggctccattatatgtcgagggctgggatgaagcactccatgaagtaggccgtctttcattttccactgtcctatcatcaaaaagagcaacggaactattaagatcggtggaagacctccctgttttggtggtagcaggctctgaggatgctcttgtttctctgaagtcagcacaaactatggcttcaaaacttgtaaattctaggctagtaactatatcaggatgtggtcatctgccacacgaagaatgtgccaatgcattgctctcagctctttttccattcatctcaaaattggtatcatcagatgattcattgcaaagattgtagcatacacatgtccacctttccttttgaattttgctctcttccgtgccctctacattgagtagatgacctctagctgttgcgagttgctgtgattccatgttagttgcaaagtagtggagcctgacccaaaatctcaagggtcctagagctcccctaatttatttttttggtcgtatgtatttctgttc

SEQ ID NO: 3903 - DNA, 675 bp, Triticum aestivum
attgctcgtatactcctgcatactcctctgaggaaaaagcacatggtgcgcccacttctacgtactgaaatcactcaggtgatcaatcggcgagcatggtttgatgccaccaagctgacaacagacgttcttaatctttacaaggctccactatatgtcgagggctgggacgaagcactccatgaagtaggccgtctttcattttccaccgtcctatcatcaaaaagagcaacagaactactaagatcggtggaagacctccctgttttggtggtagcaggctctgaggatgctcttgtttctctgaagtcggcacaaactatggcttcaaaacttgtaaattctaggctagtaactatatcaggatgtggtcatctgccacacgaagaatgtgccaatgcattgctctcagctctttctccgttcatctcaaaattggtatcgtcagatgattcattgcaaagattgtagcatacacctgtccatctccccttttgaattttgctctcttctgtgccctctacattgagtagatgacctctagctgttgcgagttggtgtgatcccatgttagttgcaaagtagtggagcctgacccaaaatctcaagggtcctagagctcccctaatttattttttggtcatatgtatttctgttcccgatctgttcaattaa

SEQ ID NO: 3904 - DNA, 648 bp, Triticum aestivum
agttgggaggcgagaccgttctgaatgccacaacgtgaaaaggatgagtctttggtgttcatggggccaacctactatcagaggctcactcacatgccgaggacaaggtgaagttgcgcaacaccgggccggtgcacccgctcacgaggcagccagtggtggacaggaagaggttcggcggtgtcaagtttggggagatggagcgtgactgcctcctcgctcatggcgccaccgccaacctccaagagcggctcttcacgctcagcgacgtgtcgcagctgcacatctgccaggtgtgtgagcgggtggcgaacgtggtcttgaggcccgtcgaaggggggaggaaggtccgcggcccctactgcggcttctgcaagtccgcggagaacatactccggatcaaggtgccctacggtgcaaagctgctctaccaggagctcttcagcatggggatctgcctcaagttcgagacggaggccagttagaacctgatcgctctcttgaaaatgatgaacctgccctatgctgtgaaacctaacaccgattgggccttcaactttcacaagactgtttttatttaaggctgaacctgcactgtgctgtctaatttgatgaaatttcgaaccattctatggattgttatatggt

SEQ ID NO: 3905 - DNA, 385 bp, Triticum aestivum
gaggccatcatccgctccacgctggcgcgtgacgtggctgccgtgatggagtacaagggtctcccactgcaggaggctgtggacttctgcgttaaggagcggcttgatgaggggttcgcgggtctcatcgccgtgtctggcaccggcgaggtggcatacgggttcaactgcaccggcatgttcaggggctgcgccaccgaggacggcttcatggaggtcggcatctgggagtgagcatgtgcgggagctcagccggagatgtctgcgtgtacatgcatttggccatcctgcgattgccatctggttctagtctaggaatcctccgtagtagcactggttactacataaccatgagctaccggataataaatatgtgaccgcctat

SEQ ID NO: 3906 - DNA, 546 bp, Triticum aestivum
cacgggagggctgatgaacaagatgacgggccgcatcggcgactcgccgctcatcggcgccggcacctatgcgtgcgggcactgcgccgtgtcgtgcacgggcgagggcgaggccatcatccgctccacgctggcgcgcgacgtggcggccgtgatggagtacaaggggctgcctctgcaggaggccgtagacttctgcgtcaaggagcggctcgacgaggggttcgccgggctcatcgccgtgtccggcaccggcgaggtggcgtacgggttcaactgcaccggcatgttccggggctgcgccacccaggacggattcatggaggtcggcatctgggagtgagcaagtgcatctcggagtgtacatacatttggccatcctgcgattgccatctggttctagtctaggaatcatcggttagcagtagcactcgttacttcataaccatgagctaccggataataaatatgtgacgaactatgatgcaccacgtgcctgaaaaaaggttcaaagttccatgaatcccttctattgtaaaataatcc

SEQ ID NO: 3907 - DNA, 662 bp, Triticum aestivum
ggcgggagaaccacaatagcaacggcatggtgatgaacgggctgcccatcagcatctacgcgccgagacggtggggtgcgcggtggtggactctaacggcttcacggcggcggcgacgtccactggcgggctgatgaacaagatgacgggccgcatcggcgactcgccgctcatcggcgccggcacctacgcgtgcgggcactgcgccgtgtcgtgcacgggcgagggcgaggccatcatccgctccacgctggcgcgtgacatggctgccgtgatggagtacaagggtctcccactgcaggaggctgtggacttctgcgttaaggagcggctcgacgaggggttcgcgggtctcatcgccgtgtctggcaccggcgaggtggcgtacgggttcaactgcaccggcatgttcaggggctgcgccaccgaggacggtttcatggaggtcggcatctgggagtgagcaagcaagcgcgtggggtcgcagtggccgctctgaactctgaagatagtgtgacggtgtgagtctgcatttggccatcttgcgatcgccatgtggttctaatctgggatcctgggttagtagcggtagtagtggatctgagattggagattgggaggaataataagatgatgatatcacgatggtatacattgtatgc

SEQ ID NO: 3908 - DNA, 704 bp, Triticum aestivum
cccgctcgccggggccgacacgtgcagcgcgctgccgcagcctccgagaatcacaataacaacggcatggtgatgaacgggctgcccatcagcatctacgcgccggagacgggtgggctgcgcggtggtggactctaacggcttcacggcggcggcgacgtccacaggagggctgatgaacaagatgacaggacgcatcggcgactcgcccctcatcggcgccggcacctacgcgtgcggtctctgcgccgtgtcgtgcacgggcgagggcgaggccatcatccgctccacgctggcgcgggacgtggcggccgtcatggagtacaagggcctcccgctgcaggaggccgtggacttctgcgtcaaggagcggctggacgaggggttcgcggggctcatcgccgtgtccggcaccggcgaggtggcgtacgggttcaactgcaccggcatgttcaggggctgcgccaccgaggacggcttcatggaggtcggcatctgggagtgaagcgcgtgcgctggccagaactctgaagatagtgtgcgtccgttcgtgtgtctgcatttgggcatcctgcaattgccatgtggttccagtctgggatcctgatttagtagcagtagtagtggatcggggattggagattgggaggaataattatgatgatgacgattgtgatggccgtggaaaataataatgtgaaaag

SEQ ID NO: 3909 - DNA, 888 bp, Triticum aestivum
gtcatggacaagtccccacagtcctagctcgccttcgacggcgccgaggatttcccgcgcgagcagggcctggaggttgtggataacagctacttcatcacggaggataacgtgggcatgctcaagctcgccaaggaggccaacagcatcctcttcgactaccgcatcccgctggcgggcaccgacacttgcagcgcgcaggcagcggcggtggagggccacggcagcaatggcatggtgatgaacgggctgcccatcagcatctacgcgcaggagacggtcgggtgcgcggtggtggactctaacggcttcacggcagcggccacctcgaccggcgggctcatgaacaagatgacgggccgcatcggcgactcgcccctcatcggcgccggcacctacgcgtgcgggcactgcgctgtgtcgtgcaccggcgagggcgaggccatcatccgctccacgctggcgcgggacgtggcggccgtcatggagtacaagggcctcccgctgcaggaggccgtggacttctgcgtcaaggagcggctggacgaggggttcgcggggctcatcgccgtgtccggcaccggcgaggtggcgtacgggttcaactgcaccggcatgttcaggggctgcgccaccgaggacggcttcatggaggtcggcatctgggattgaagtgcgcgagctcagccggagatgtgtccgcatgtagtgtgtgtacatacgtttggtcatcctgcgattgccatctggttttactctaagaatcctcggttactagcactggttacttcaaagccatgagctaccggataataaacatgggactgcctatgcacgacgtgcctcaaaaaagttccatcagtaacttatattgtagaccgtttgatc

SEQ ID NO: 3910 - DNA, 841 bp, Triticum aestivum
gtcagtcggtcacaaattcccaaatccaccggagaaagataatcatcaggcagagctgcagcaggtggccatggccgactcccccgagttagctcgtgctcgggacgtcctgagcgtgcgcgccgacgagcacgcgcgggtggacgcgctctcctccgccgcatccgcatccgcatccctatcatcggccactactcatctgtcgccgagcttcttcgagggattcgcgctgcgcgggatccgcgtgctccgcctccatccggggttcatccactgctcctacaccgtccccccgagcctcaccgactccaccaccggctgcctcgccgccggtgccgttgtcgccctggtcgacgagatcggctccgccgcctccatctccgaaggccaaaacctcaaggtctccgtcgacatttccgtcgccttccccgatctctcccaggcccgcccgggggaccggctgagcataacggcaagggcgctcggacacaagggcgcctactccggcacacacgtgctcttcaccaacgccggcaccggcaacgtcgtcgccgagggcaggcactccctcttcggtaacatgaagaagtcgccaccacccaagccagcagccactactcacaggagcaacttgtgatgatgcctctgcctgcctgctcctactccactattctattctgtattctgatgaagagtacttgtcatcagacttcaagtataaagaaaatatgttctgaacgggcgcctactccaagttcggcttgtatatgtaaccttgattcagagcagtgcgatgtatgatgtgtaattatgcaactcaactttggtaatcagagctact

SEQ ID NO: 3911 - DNA, 586 bp, Triticum aestivum
ctctgcttctcctcctactctcgggtgactgtttgattggtaggcgcgcctaagctagctagcaatggcggcccagggaaaaggcggtgcggccgtggtcgtgggcgtgctgctcgtctgcgtgctcctgagcgcggcggcggtggtggaggcggcggtgttcaacgtcggcgaccgcggcggctggtccttcaacaccaactcctggcccaccggcaagcgcttcaaggccggcgacgtcctagtgttcaagtacgacgcgacggcgcacgacgtggtggcggtgagtgcggcggggtacaaggcctgcgccaagccggccaagggcgccaaggtctacaagtccggcgccgaccgcgtcacgctcgcccgcggcacaaactacttcatctgcagcatccccggccactgccagtccggcatgaagatcgccgtcaccgccgcctagcgtcgtgtatcgtacgcgcgatgttatgacacgacgagcgaaacttaattcctgaccaaaataaaaggccgagcgtacgtgcttcgttctttcaagtcctagatcaatgtgcactgtttgatttgcactcaaccgatc

SEQ ID NO: 3912 - DNA, 662 bp, Triticum aestivum
cctcactcacatacctcctctgcttctcctcctactctcgagtgactgtttgattggtaggcgctcctaagctagctagcaatggcagcccagggaagaggcagtgcagccgtggtcgtgggcgtgctgctcgtctgcgtgctcctgagcgcggcggtggcgcaggcggcggtgttcaacgtcggcgaccgcggcggctggtccttcaacaccaactcctggcccaccggcaagcgcttcaaggccggcgacgtcctagtgttcaagtacgacgcgacggcgcacgacgtggtggcggtgagcgcggcggggtacagggcctgcgccaagccagccaagggagccaaggtctacaagtccggcgccgaccgcgtcacgctcgcccgcggcacaaactacttcatctgcagcatccccggacactgccagtccggcatgaagatcgccgtcaccgccgcctaacctcctacatcgtacgcgcgatgttacgtgacacgacgagcgaaacttaattcctgataataaccaaaataaaaggccgagcgtacgtgcttcgttctttcaagtcctagatcaatgtgcactctttgatttctactcgaccgatcgtacttgctcttgtatggtgccatatgtgctgattttgtactcatgtatacgag

SEQ ID NO: 3913 - DNA, 702 bp, Triticum aestivum
ctccctctcagcatttctcctctcaacctgcctctcctcgtacctgctggcttgatcggtagctgctaacctagctagcaatggcggcgcagggaagaggcagtgccaacgtggccgtggtcctcggcgtgcttcttctctgcacgctcgtggcggaggcggcggtgttcaacgtcggcgaccgcggcggctggtccttcaacaccaactcctggcccaccggcaagcgcttcaaggcaggcgacgtcctagtgtttaagtacgacgcgacggcgcacgacgtggccgcggtgagcgcggcggggtacaaggcctgcgccaagccggccaagggagccaaggtctacaagtccggcgccgaccgcgtcaccctcgcccgcggcacaaactacttcatctgcagcatccccggccactgccagtccggcatgaagatcgccgtcaccgccgcatagcctcatcgcgtcgtccatcgtcgagcagcgtctttacgtgacacaacgaccgcagcttgatttactaataataaccaaataaacgggcgagcgtacatacttcggtactatcgatatcaggtgcccggtcagtgtagtcgtattgattatcgtacggtgtgtactatttgattccccactccatcgatcataattgctattttatggccctctgtgatgattttgtacttcatatatacatgaataa

SEQ ID NO: 3914 - DNA, 915 bp, Triticum aestivum
ggattttccttcttatttgacgaagatggtgaagtgggaacaccagtttgctgcccacggttttcctctcctactccctctttcatagatgcctccccggggggaggatcgaggaagaggtcgagcttgaccctgcggcccgaggccgccttggccgccaggcggcgctccttccgcctccccatcgccgctgctcggggcctccctctcagcatttctcctctcaacctgcctctctcctcgtacgtgctacttcttgagttggtaattgatcggtagtcgttcctagctaagctagctagcaatggccgcacggggaggaggcagtgccaacgtggccgtgctccttgccgtgcttcttctctgcactctcgtggcggaggcggcggtgttcaacgtcggcgaccgcggcggctggtccttcaacaccaactcctggcccaccggcaagcgcttcaaggccggcgacgtcctagtgttcaagtacgacgcgacggcgcacgacgtggtggcggtgagcgcggcggggtacaaggcctgcgccaagccggcaaacggcgccaaggtgtacaagtccggtgccgaccgcgtcaccctcgcccgcggcacaaactacttcatctgcagcatccccggacactgccaatccggcatgaagatcgccgtcaccgccgcctagcctcgtccatcgtccatggtgcacgttaattcgtacgcgcgacgttacgtgatacggcgagcgcaacttttaattcctaatgaccaaaataaaaggccgagcgtacgtgcttgggtttttcaagttcttgatcaatgtagcacagtattgattcgtacggtgtgtgtactgtttgatttccactcgaccaatcatacattcatactttctgttgtatggtgccatatgtactgatt

SEQ ID NO: 3915 - DNA, 965 bp, Triticum aestivum
gacggcgccgccgctgaagcgggggccgtggacggcggaggaggacgaggtgctggcgcggttcgtggcgcgggagggggaggggcggtggcgcacgctgccacggcgggcgggcctgctgcgctgcggcaagagctgccgcctgcggtggatgaactacctccggccggacatcaagcgcggccccatcgccgaggacgaggaggacctcatcctccgcctccaccgcgtcctcggcaaccggtggtcgctgatcgccgggaggctgccggggcgcacggacaacgagatcaagaactactggaactcgcacctcagcaagaagctcatcgcccagggcctcgacccgcggacgcacatgccgctcgccgctgctcccggcagggcggcagctcctaccgacaagacgacgtgggcgccgacggtcagaccgccgcacctctgcccccgccagcgcttgtgctgccgacctcgtctgccgctggaactgacgcgacggccgtgacagcccaggcgacggaggcatgacgacctcgccgcggcgatgagcgtcgacgcccatgacttcgaaggtttcggtgatcagcttctcgccgactacgctgcttcccgcggagtcttcaacgacgtgatggggtgtccaatggtggacgacgacaccttcacctcgttcctcgattccttgatgaatgagcgccagttggctgctgatcacaaggttggcgctatctagctgatgcagatttacaatgcactgtagtaatcgcgaatcagctgactagcgaaataagttgattgatgatgggcagatagtacaactgcgtacacatgaattgcttaatgtgatgaaggggtctggtgacgtttgtttgtgactttgtgtgatgaatatcagtactacgaggatgtaatgtaatgtatggattgcacagacataagatttgtagaaggtccgcaattaatca

SEQ ID NO: 3916 - DNA, 713 bp, Triticum aestivum
gacaagagagagaccagggagagaggaaaaaaaagaggctcagcagcggcggcgatggcgagcggcggcggccccgatgacgaagaaggagctcggcgagacccacgacgtcctccgcttcggcgtcaacgacagcgtccgcggcgacctcgcgccggcgcaccccgtccaggccaccatccacaaggaggccaagttctgggaggagaagaagaagttcgggacggaggccatctacggatccgccttcaacatccgcagggatctcgacgcccagatcctctccaggttccaaaggcccccaggtgcattgccatcatttatgctaggatatgaggcgatgacaggttccttggatgattttggatttgaagattaccttaacttgccccaagactctgacagcctccgcataccggacatgcaccacgggatggaggtccgccttggcctgtcgaaggggcctgtctgccccagtttcaattgattcccacccatgtattagtcttgtgatgcgttgtgctccccgtccagcatctataccagtcactagactgtatcatggatttgcgaaacgtgacaactaaatttggtattgcgtcagtttgaattccttaacttcgatcgtactgtcgctgtgttttcagttttggacctctatttatttgcttgtcgttctctgtttaatgggcattcctgttctgtagtctatt

SEQ ID NO: 3917 - DNA, 660 bp, Triticum aestivum
caagacaacagagagagaaagagggaaaaaaagagaggctcagcagcggcgatggcgagcggcggcggcccgatgacgaagaaggagctgggcgagacccacgacgtcctccgcttcggcgtcaacgacagcgtccgcggcgacctcgcgccggcgcaccccgtccaggccaccatccacaaggagaacaagttctgggaggagaagaagaagttcgggaccgaggccatctacggatccgccttcaacatccgcagggatctcgacgcccagatcctctccaggttccaaaggcccccaggtgcattgccatcatctatgctaggatatgaggcgattacaggttccttggatgattttggatttgaagattaccttaacttgccccaagactctgacagcctccgcataccggacatgcaccacggaatggaggttcgccttggcctgtcgaaggggcccatctgccccagtttcaattgattccacccatgtattagtcttgtgatacgtcgtgctccccgtccagcatctataaccagtcactagactgtatcatggatttgtgaaacgtgagaactaaattggcattgcatcagtttgaaattccttaacttcagattgtactgactctgtgttttcagttaatggacctctatt

SEQ ID NO: 3918 - DNA, 552 bp, Triticum aestivum
gccgcggcccgatgacgaagaaggagctgggcgagacccacgacgtcctccgcttcggcgtcaacgacagcgtccgcggcgacctcgcgccggcgcaccccgtccaggccaccatccacaaggaggccaagttctgggacgagaagaagaagttcgggaccgaggccatctacggatccgccttcaacatccgcagggatctcgacgcccagatcctctccaggttccaaaggcccccaggtgcattgccatcatctatgctaggatatgaggcgatgacaggttccttggatgattttggatttgaagattaccttaacttgccccaagactctgacagcctccgcataccggacatgcaccacgggatggaggtttgccttggcctgtcgaaggggcccatctgccccagtttcaattgattccacccatgtattagtcttgtgatacgttgtgctccccgtccagtatctataaccagtcactagactgtatcatggatttgtgaaacgtgagaactaaatgggcattgcatcagtttgaaattccttt

SEQ ID NO: 3919 - DNA, 586 bp, Triticum aestivum
cagcgtccggagagagagagagagcctgagcagcgacgatgtcgagcttgatgacgaagaaggagatcgggcagacccacgacgtgctccgcttcggcgtcaacgacagcgtcagggccgacctcgcgccggcgcaccccgtccaggccaccatccataaggagaccaagttctgggacgagaagaagaggttcgggaccgaggccatctacgggtccgccttcaacatccgcaaggacctggacgcccaaatcctctccaggttccaaaggcccccaggtgcattgccatcatctatgctaggatatgaggcaatgacaggttccttggatgattttggatttgaagattaccttaacttgccccaggactctgacagcctgcgcataccggacatgcaccacgggatggaggttcggcttggcctgtcgaagggccctgtctgccccagcttcagttgattccttccacccatgtattttgcttcccgtccagcatctacactgtatcatggattggtgaaacatgagaagtaaataattgggtattgcatcagtctgaatttcatgaaatctccacggcgtcc

SEQ ID NO: 3920 - DNA, 951 bp, Triticum aestivum
agagagcctgagcagcgacgatggcgagctcgatgacgaagaaggagatcgggcagacccacgacgtgctccgcttcggcgtcaacgacagcgtcaggggcgacctcgcgccgccgcaccccgtccaggccaccatccataaggagaccaagttctgggacgacaagaagaggttcgggaccgaggccatctacgggtccgccttcaacatccgcaaggatctggacgcacaaatcctctccaggttccaaaggcccccaggtgcattgccatcatcgatgctaggatatgaggcaatgacaggttccttggatgattttggatttgaagattaccttaacttgccccaggactctgacagcctgcgcataccggacatgcaccacgggatggaggttcggcttggcctgtcgaaggggcctgtctgccccagcttcagttgattccttccacccatgtatttgtcttgtgcttcccgtccagcatctatggcagtttcatggattggtgaaacgtgagaagtaaataaatgggtattgcatcagtttgaatttcttgaaatgtccccggcgtcctggtcgctagttgagcgttacttactattcttgctagtttggtgttttagcagcaaagttcgttagcgccccactaatatcagtggtgacccctctaggcattaaggggggatggtgtgtcgacgagggaagcttggtggttgctgctgttcttcggaggtgtccgcccatcgagacgcggcgagattttcgatttggggtacgctctttcgcgttgtagttgagttgtgttgttgggacacggcgacccatgtgtcagtggcccaatgttaggtggccgtacgtcaggggatccggctccttgctgttgatggctgtctttggactagctggatgtggaggtgatgctatgctctttgttcgcagtgagtgatag

SEQ ID NO: 3921 - DNA, 546 bp, Triticum aestivum
gaagagagcctgagcctgagcagcgacgatggcgagcttgatgacgaagaaggagaccgggcagacccacgacgtgctccggttcggcgttcaacgacagcgtcaggggcgacctcgcgccgccgcaccccatccaggccaccatccataaggagaccaagttctgggaggagaagaagaggttcgggaccgaggccatctacgggtccgccttcaacatccgcaacgatctggacgcacaaatcctctccaggttccaaaggcccccaggtgcattgccatcatctatgctaggatatgaggcaatgacaggttccttggatgattttggatttgaagattaccttaacttgccccaggactctgacagcctgcgcataccggacatgcaccacgggatggaggttcggcttggcctgtccaaggggcctgtctgccccagcttcagttgattccttccacccatgcatttgtcttgtgcttcccgtccagcatctacgccagtcactactactagactctatcatggattggtgaaacatgaga

SEQ ID NO: 3922 - DNA, 841 bp, Triticum aestivum
gtggaaggctgctgttagccatggcctctgctgaaggaggagacaaataccggtccttcctgcacggcgacggcgagaagaacacggtgtggaggcatggagcccctcccaactacgacctcgtgaacaagctcttcgaggaagagcggaccaaggaatgggccgaggggtctgtggaagagagggtgcagcgcttgctcaagacctgggagatggagttggtccacaaggtgcggcccgaggaccagaagagcgtcaaccccaagaactactccgccaccaccaacgggctgaagcctctgacgcgggaggaggtgatggccatgggcggctacaacgcgttcctggcgaccacgctgccgccggagcaccgcatctacgacccggacgcggagtcggtggagtcggccacgtccaccttcctcacggcgttcccccggggcttcgccatcgaggtgctggacgtgtacagcggcccgcccaggatcgccttcaagttccggcactggggctacatggagggcccgttcaagggccaccctccgcacggccgccgcgtcgagttcttcggcgtctgtgtcttcgacgttgatgaggacaccaaggtggagaaggcggagttcttctacgagcgtggcaactttcttgcgagcttcttgagtgcgcctgcttctgcttctgcttctgcttctgctgcgtcggcttcaggctgccctgtgatgagaggagactgatgcgcgacggaatcgacgaaacatgcatgtcactagctagtattgtctccagagttcggatttggctatattccatgtaatgccaagaaatgtttaaataaaaaaag

SEQ ID NO: 3923 - DNA, 612 bp, Triticum aestivum
gaagtgtcgtcagctgtggagtgaatcatttgtgcaaattttctacttctttcctcaaactcctccctccatttgtccaaagccacgtgatcggccagagaacttgtcaagaaccacctttgcggacgcgtgggcggctccgccgcctccatctccgagggccaaaacctcaaggtctccgtcgacatgtccgtcgccttcccggatctctcccaggcccgcccgggggaccggctgagcataacggcaagggcactcggacacaagggcgcctactccggcacacacgtgctcttcaccaacgccggcaccggcaacgtcgtcgccgagggcaggcactccctcttcggtaacatgaagaagtcgccaccacccaagccagcggccactactcacaggagcaacttgtgatgatgcctctgcctgctcctactccgctactctgttctgtattctgatgaagagtaccttgccatcagacatcaagtataaaggagatatgttctgaacgggcgcctactcctctcttatcagttcggcctgtatatgtaacattgattcagagcagtacgacgtatgatgtgtattatgccactcgactttggtactcac

SEQ ID NO: 3924 - DNA, 706 bp, Triticum aestivum
cgtccgtcagcgccgacgagcacgcgcgggtgacgcgctctcctccgccgcatccgcatccctatcacagtccactactcatctgtcgccgagcttcttcgagggattcgcgctgcgcgggatccgcgtcctccgcctccacccgggcttcatccactgctcctacaccgtccccccgagcctcaccgactccaccaccggctgcctcgccgccggcgccgtcgtggccctggtcgacgagatcggctccgccgcctccatctccgagggccaaaacctcaaggtctccgtcgacatgtccgtcgccttcccggatctctcccaggcccgccctggggaccggctgagcataacggcaagggcactcggacacaagggcgcctactccggcacacacgtgctcttcaccaacgccggcaccggcaacgtcgtcgccgagggcaggcactccctcttcggtaacatgaagaagtcgccaccacccaagccagcggccactactcacaggagcaacttgtgatgatgcctctgcctgctcctactccgctactctgttctgtattctgatgaagagtaccttgccatcagacatcaagtataaaggagatatgttctgaacgggcgcctactcctctcttatcagttcggcctgtatatgtaacattgattcagagcagtacgatgtatgatgtgtaatatgcaactc

SEQ ID NO: 3925 - DNA, 891 bp, Triticum aestivum
cagcaggtggccatggccgactcccccgagttagctcgtgctcgggacgtcctgagcgtgagcgccgacgagcacgcgcgggtggacgcgctctcctccgccgcatcggcatccctatcaacggccgctactcatctgtcgccgagcttcttcgagggattcgcgctgcgcgggatccgcgtcctccgcctccacccgggcttcatccactgctcctacaccgtccccccgagcctcaccgactccaccaccggctgcctcgccgccggtgccgtcgtggccctggtcgacgagatcggctccgccgcctccatctccgaaggccaaaacctcaaggtctccgtcgacatgtccgtcgccttccctgatctctcccaggcccgcccgggggaccggctgagcataacggcaagggcgctcgggcacaagggcgcctactccggcacacacgtgctcttcaccaacgcctgcaccggcaacgtcgtcgccgagggcaggcactccctcttcggtaacatgaagaagtcaccaccacccaagccagcagctaccactcacaggagcaacttgtgatgatgcctctgcctgctcctgctccactattctgttctgtattctgatgaaggtaccttgtcatcagacatcaagtataaaggagatatgttctgaacgggcgcctactcccctcttatcagttcggcttgtatatgtaaacttgattcagagcagtacgatgtatgatgtgtgttacgtgaaactagaactcgggaccttgaagtgcatccaaaagcacgattcatatatcaaacattggtcgtcgtctaacatttattcgtttacatcttataagaaagaaagctgcaattggtattcgtgttgataagattggaa

SEQ ID NO: 3926 - DNA, 1177 bp, Triticum aestivum
atgcgccctcatcacagcacaggccatcacatcttgcctggagttggtgatttggatttgaggaagagattgacaggctcaagcgcgacaagaacctcttgatcacagaggtagtgaagctaaggcaggatcagcaagctactaaggataatgtgcaagccatggaaggcaggctacgagctgctgaacagagacaggcccagatgatggggttcttggcaagagcaatgcgtaacccacacttcttccagcaattagtccagaagcaagataagaggaaggagcttgaagatgccatctcgaagaaaagaaggcggcctatagacaatgctccattttatggttcgggggcaacaacaagtcagagcgagcaacttgattcacagttcctgtttgattctggtgtcctcagtgaacctggaatgaacgggatggagaatttagcgcagaacattcaggagcttgggcagggcaaaacagacgaggagaagaaggatgaagctaatgggcagctggacatcaacagcgatttctgggcagagctattttctgatgattttggagacgaagacgggtctgggctgtcagagttggagggaaggagacctgaagatatcgatgaactgggtcagcagttggggtatctgagttctactagcccgcagtagagttttgttcacagtggttcacttcaaccaacaaacattgcttcttcagtactactattgcagatcatcttgaacaatctgatttagttgattggtggcaacatgactggctatctgaggtgttccataccggggattggaacacctctgggtagggagtagaagctgaagactaattgctgcgtcgcttgatggagacccatgacgtgtattgaatggttacctaaactcgtaactctgaagaagatggtccaggtagtcgacattcggttgttctgagctggtgttcagcagcagtagctgtggaagtgtgttactgtatatactcgttgggtgaagctttgttgtgaaagtctggtctgtagtcagccgttggcatctgggtgtgggttcagtcatttctccttctgccgtccatttgccatttaccttacttttagggcctgtgtcctgtgtgatgattggtagtgtatgctgcacctctgttatattgagataataaatgttga

SEQ ID NO: 3927 - DNA, 766 bp, Triticum aestivum
ggaaatttcccactgcagtcctcatttcaaaggattccgagatgtgtgtacacttcaactaggctgtatgagtataggggttgggattcaaaaattgcaaaccccaagcatcgccggtttacctggggattacagacagcagagcgctttgcggtagatttctacatttccgattttcaatctgggcttcgagcattggtgagaacaggaagtggtgcacgggtgacaccatatgtcgatgaaccggtagtaattgacatcaatcctgagaacaaggacatgtctcctgaatttctaagatggctacgagaaaggaacctctcaagtgatggtcggaaaatgcgcctaaaagaaggatacatcaaggaaggaagcactgtgagtgtgatgggggttgttcaaaagagcgggagcatgttgatgatagtacctccatcggagcctgtctcatctggttgcctgtgggggaagtgcctattcccatcgaaccttgacggactagtcttgagatgtgaagatacttcagacatggatgtcataccagtatagcaagctgagtgtctagatacatccgtatctagcaaatctcagacacgtaatgtggattggagggagtactaaagattgagtatggctgggtaatctgtgttttcactgtatacccctttctcaatgtattacgtcctcttttgctcatttttggttatgagctcttaatacgtgtgtaatatggtggcatttgggttgtttgaagacttgttccctt

SEQ ID NO: 3928 - DNA, 799 bp, Triticum aestivum
tcattcaaggatccgagaggtgtgtacacttcaactagctgtatgatatagggctgggattcaaaactcaaccccaagcatcgccgtttactggggattacggacagcagagcgacatccgttgatttctacatttcagatttccagtctgggcttcgagcattggtgagaacaggaagtggggcacgggtgacaccatatgttgatgaatcggtagtaattgacgtcaatcctgagaacaaggacatgtctcctgaatttcttagatggctacgagaaaggaacctctcaagtgatggtcggaaaatgcgcctaaaagaaggatacatcaaggaaggcagcactgtgagcgtgatgggggtcgttcaaaagaatgagagcgtgttgatgatagtacctccatcagagcccatctcatctggttgccagtgggggagttgtttcttcccagcgaaccttgaaggactggtcgtgagatgcgaagatacttcagacatggatgtcataccagtatagcaagctgatgattgccgtggtgtggaatagctgctgttgaagagggaatgttggcctgtcgaatcttttgacctcgggttgggtttgattggtagagtattagaactgagaaaaaatgtacaaatgttaggtgtgattaaggctagtaaagatgggagtatggctgctggttaatctgtgtttggctgtatagtcctttttcaatgtgttttgtcctcctttgctcctgttttttcggttatgagctctcaatacttgtgtaatatgattgcttttgggctgt

SEQ ID NO: 3929 - DNA, 967 bp, Triticum aestivum
  misc_feature (206)..(206): n = any nucleotide
  misc_feature (213)..(213): n = any nucleotide
attgcatgctcagcttcatccggactgttgtattatatatgtacacagattgcacagactggtattgttaagtagcaaaagtaagttcattgcaaggatgatagtcaatcaagagaacatggaaggctggaccaattccatatcaggggaacattaaagcaagaaagcttgggaagaaggagaggacagtagaggggattacgcanagcagancgacatgcggtcgatttctacatttcagattttcagtctgggcttcgagcattggtgagaacaggaagcggtgcacgggtgacaccatatgtcgatgaatcggtagtaattgacgtcaatcctgagaacaaggacatgtctcctgaatttctaagatggctacgagaaaggaatctctcaagtgatggtcggaaaatgcgcctaaaagaaggatacatcaaggaaggcagcactgtgagtgtgatgggggtcgttcaaaagaatgagagcgtcttgatgatagtacctccatcagagcccatctcatctggttgccagtgggggagttgtttcttcccagcaaaccttgaaggactagtcgtgagatgtgaagatacttcagacatggatgtcataccagtatagcaagctgatgattgccgtggtgtggaatagctgctgttgaagagggaacgttggcctgtcgaatcgggttgggtttgattggtagagtattagaactgagaaaaaaatgtacaaatgttaggtgtgattaaggctagtaaagatgggagtatggctgctggttaatctgtgtttggctgtatagtcctttttcatgtgttttgtcctccttcgctcctgttttttcggttatgagctctcaatacttgtgtaatatgattgcttttgggctgtttgaagacatgttgaatcgggtttatgtgttatttaggatgaacttcttgcactgctgttaaagcctaaatatatt

SEQ ID NO: 3930 - DNA, 742 bp, Triticum aestivum
ctgtcatctcctcttggagcttctgctgattttgacgaggatgaactggaagcggagctggaagagttggagggagcagaattggaatcccaactactggagcctgttgtaactattcctattcatacgacgaccgtgccaggcaaggcgcaaccaactcgccctgctccgcagaaagcgtcggctgaggaggatgagcttgctgcactgcaagctgaaatggcattgtgatcaggtagccttctcctgcgttctagacatggttacttaaactatgccttctcatttgtctttccacaccatcttccatcatttgatcaaacacctctaggacttgcagtttctgggaggaacaacatacaagaaggcccccagtgaatgaagaggtgaaatgtacaaatgattggctggacggtatgtggtcgcaggcgagtctggctacacatatatttggccgtgtgtgtataatcttgggtgggagacatttgacgaacgaggcaggaaaggctgctccagtccagtgtttatttctatctagttgtttgattgaaggtctgtttcccggatataatttttggcacggtcagctccattccaggtcgtgtgcaatgctcattgttgtggcacactatttactgttgacccgtattatctcttgccatgtaaaccaagttatctcattccagtgttcgctaatttggtgtgttgacgggacagttctttcctttcaattctatatata

SEQ ID NO: 3931 - DNA, 733 bp, Triticum aestivum
agctatgaaagcgatgcaaaaagcgaacaaatatcgatgatgtcgacaagactatggacgaaattaatgaacagacagaaaacatgagacaaatacaagatgctctgtcagctcctcttggagcttctgctgattttgacgaggatgaactggaagcggagctggaagagttggagggagcagagttggaatcccaactactggagcctgttgtaactattcctattcatacgacgcccgtcccaggcaaggcgcaaccaactcgccctgctccacagaaagcatcggctgaggaggatgagcttgctgcactgcaagctgaaatggcattgtgatcaggcccccagtgaatgaagaggtgaaatgtacaaatgattggctggacggtacgctgtcgcaggcgagtcctggctacacatatatttgcccgtgtgtataatctttggtgggagacatttggcgaacagaggcaggaaaggctgctccagtccagtgtttatctagttgtttgattgaaggtctgtttcccggacataatttttggcacggtcagctccattccaggtcgtgtgcaatgctcattgttgtggcacactatttactgttgacccgtattatctcttgccatgtaaaccaagttatctcattccagtgtttgctaatttggtgtgttgacgggacagttctttcctttcaattctatatatacaactcactagtactattgagtttg

SEQ ID NO: 3932 - DNA, 1316 bp, Triticum aestivum
gcggagggaagaaaatggcaccgccgcggcgcgtgtgcgtgaccggcggcggcgggttcatcgcctcgtggctcgtcaagctgctcctctcccgcggctacgccgtccacgccaccctccgggacccatgtgaccccaagaatgtccacctcaagcagatggacgaggcccgggagaatctgcacctgctcaaggccgacgtgctcgactacgacgcgctaacacgtgcgtttgagggatgtgagggggtcttccacctcgccactccggtgcctgaagataagattgctgatcctgagtcagaagtattggctcctgctgtgaaaggtacttcaaatgtgctgaaggcctgctcagctatgaaggttcagaaggttattgtcttgtcatccaatgctgctgttgattttaacccgaattggcctcaagacagactcaaagatgagagtagctggtcagacaaagatttctgccaggagaatgaggactggtattctgttgccaagattgtggccgaacaggcatccttggaatattcagagaaacatggattaaatgttgttacgctttgccctcctttggttttgggcccattgttgcagcctactgtgaataccagtagcaaattcttaatctatgttattaatggaggacctgacgtgatgagcaacaagctgtggcacattgtagacgtccgtgatgtcgcggatgccttgctgcttgtgtacgagaaggccgaatcgtctgggagatacatttgcgcgccgaatagcgtctgcacaaaggacttggtggacttgctgaggaagatgtacccacagtacagctatgtgaacaacatcgacgcggaccgtaaagcgccgctgtcatcgcagaagctgaaggatctgggctggaagccgaggaagctggaggagacgctctcggacagcgtgggctgctacgagaaggccggccttctgcagggttccgttgcgcgtcattgccggcttccgcatctgttccgtctggctggtgatcagttaatgtaccttggtgactggtgctttgttttcatatggtcggacttctgtaagctgtagtgtcgctggacggagcctcgcaacagcaacaatggtcgaacctcttcctttgcatccacaaataagcagctatccctgctgtatctgccgccccctgtctgtcacctccggaaatggacaaagtgtaaaacaagcagagcagagacgaaatgcatgtacttcctccgttcctaaataagtactatctctttctagagatttgtataagtgactacatacagacaaaatgagtga

SEQ ID NO: 3933 - DNA, 954 bp, Triticum aestivum
ccatcggttccggccaacgaccggcaggggaccctaggcgagttgacattggagcagttccttgtcaaggccggcgtggtccggggatctggcgccggcggccaggcgcctgtgccggtcggcatggtccatggacagatgaaccccgcacaacaggggcagcagcctggcccaatgatgtacccaattgcaccagccaatggcatgttcccggcgatgggcgacggcatggggttcatccccaatgggtatgcagggatggttgtggtgccgccgccaccacctcctcaaggtggggtggtgggtatcatgagccccgggtcgtcggacgggaggagcgccatgacgcaggctgacatgatgaactgcatgggcgatggaacgatgatggagagtggcggcacctggaaacgcggtgccccagaggatcagtcttgcgagagaagcatcgagcgccgccaccgccgcatgatcaagaaccgtgagtcagccgcacgatcgcgtgctaggaagcaggcttataccgtggagcttgaagctgaactgaaccacctcaaggaggagaacgctcgtctgaaagctgaggagaagacaattctgctgaccaagaaacaaatgttggttgagaagatgatagaacagtccaaggagaacgtgaacgccaagaagggtggcaccctctcgcggcgctgtggcagctgcatctggtgaaaggtgacctgccatccatccatagccgtgctcgcaggaggatgaggaggaattgtggtgtttatagcagtaacattttctttcccgagcggggtcgtatagtaatttactagtagtacctaaaaccataaggacccgaatgtcagtgtttatctggtcaagcaagtgaacttctgttgttgttactgtttataggtatatggatttgtcagaaagaaaattagcaatatgttgatgtgtact

SEQ ID NO: 3934 - DNA, 508 bp, Triticum aestivum
ccggaaacgcggtgccccagaggatcagtctttcgagagaagcatcgagcgccgccaccgccgcatgattaagaaccgtgagtcagccgcacgatcgcgtgctaggaagcaggcttataccgtggagcttgaagctgaactgaaccacctcaaggaggagaacgctcgtctgaaagctgaggagaagacaattctgctgaccaagaaacaaatgttggtggagaatatgatagaacagtccaaggagaatgtgaacgccaagaagggtggcaccctctcgcggcactgtggcagctgcatctggtgaaaggtgacccgccatccagcttccatagccgtgctcgcaggagcatgaggaggaattgtggtgtttatagcagtaaaattttcattccggagcggggtcgtatactaatttactagtagtacctaaaactataaggacccggatgtcaatgttatctggtcaagcaagtgaacttctgttgttgttactagtttatagggg

SEQ ID NO: 3935 - DNA, 686 bp, Triticum aestivum
acctcctcaaggtggggtgggtatcgtgagcctagggtcgtcggacgggaggagcaccatgacggaggttgacatgatgaactatatgggcgacagaacaatgatggagaacagcggcgcgcggaagcgcggcgctccggaggatcagtcctgcgaggggagcatcgagcgccgccaccaccgcatgatcaagaaccgtgagtcagccgcacaatcgcgtggcaggaagcaggcttataccaaggagcttgaagccgaactaaaccacctcaaggaggagaactctcgtctgaaagctaaggagaagacaattttgctgaccaagaaacaaattctagttgagaagatgatggagcagtccaaggaaaatgtgaacgccaagaagggtggcgccctgtcgcggcgctgcagtagctgcatctggggataggtgacccaccattcagcttccatagtcgtgctggcaggaggatgagaatgaataatggttacctttcctttctagagcggggtggtatcataatttactagttgtacctaaaacccataaggacccaaatgccagtgtttttctggtcaagcaagtgaacttatgttgttgttactgtttataggtatataggtttgtcagaaacttcaggaaaatggaacaaaagaaagttagcaatatgttatgtgtactagca

SEQ ID NO: 3936 - DNA, 1126 bp, Triticum aestivum
cacaaatctctatacaatgatacaatccccagagattttcacagatcataagcacgagagagtccacaagaccatcatcaccgagctaacaagaacttcaagatgaacatcaccaccaaggacaccgcaaccatcgaggcaatcgggaacggcttcttcatgaagggcgatgagggtgtgagaacacggcgggggccgagaaccaccaggccgtggcactgcgggtgcagagcgaccaggccgtcttctaccagtgctacttcgacgggtaccaagacacgctactacacccacgcgcaacggcagttcttcacgcgactgcaccgtacaccgggcaccatcgacttcatcttcggtcaactcccaggtggtcatccagaactgcctcatcctgccgcgcaagccccatggacaaccagctcaacatcatcaccgcgcaagggcggcgcgagaagcgctccgtcgggggcaccgtcatgcacaacaacaccatcgagccgcacccggacttcaaggactcgacgggcaagatcaagacctacctggcgcggccatggaaggagtactctaggaccatctacatccagaacgagatcggcgccttcatcgaccccaagggctggctcgagtggaacggcgacttcgccctcgagaccctcttctacgccgaggtggagaacaccgggcccggcgccgatatgagccagcgcgccaagtggggcggcatcaagactgtcacctacgctgacgcacaaaaggagtacaccgtcgaggccttcatccagggcgagcagttcatccccaagtacggcgtgccctacatcccggggctcctcccgcagtcggaggcggggagggatcattaactcatcactccatccgttaccacgtttcatttcccccctgctccgttgctacttatatgcaattagctgagttgacatatactgttaattatacactatggtgcactgcgtaccatgatgattaaccaatacatgtatacttactaactagctttaatttggaggagagaaagatgtgcatgtgtatgtaaacctgggatgtttatttttcgtatgtataccttgctaatttctttactcggtgtgtcttcacgatgagg

SEQ ID NO: 3937 - DNA, 806 bp, Triticum aestivum
ctaccagtgctactcgacgggtaccaatacacgctctacacccacgcgcaacggcagtttttccgcgactgcaccatcaccggcaccatcgacttcatcttcggcaactcccaggtggtcatccagaactgcctcatcctgccgcgcaagcccatggacaatcagctcaacatcatcagccgcgcaagggcgccgcgagaagcgctccgtcgggggcaccgtcatgcacaacaacaccatcgagccgcaccccgacttcaaggactcgacgggcaagatcaagacctacctggcgcgcccatggaaggagtactccaggaccatctacatccagaacgagatcggcgccttcatcgaccccaagggctggctcgagtggaacggcgacttcgccctcgagaccctcttctacgccgaggtggagaacaccgggcccggcgccgacatgagccagcgcgccaagtggggcggcatcaagactgtcacctacgccgacgcgcagaaggagtacaccgtcgaagccttcatccagggcgagcagttcatccccaagtacggcgtgcccttcatcccggggctcctcccgcagtcggaggcggggagggatcattaactcatcactccatccctcaccatgtttcattattccgctgctccattgctgcttgtatgcaattagatgagttgacatatactgttatacactatggtgcagtgcgtaccatgattgattaaccaatacatgtatacttactaactagctttaattttgggactgtctatttgacatttgactgtttttcaat

SEQ ID NO: 3938 - DNA, 691 bp, Triticum aestivum
ggacacgctctacacccacgcgcaacggcagttcttccgcgactgcaccatcaccggcaccatcgacttcatcttcggcaactcccaggtggtcatccagaactgcctcatcctgccgcgcaagcccatggacaaccagctcaacatcatcaccgcgcaagggcgccgcgagaagcgctccgtcgggggcaccgtcatgcacaacaacaccatcgagccgcaccccgacttcaaggactcgacgggcaagatcaagacctacctggcacgcccatggaaggagtactccaggaccatctacatccagaacgagatcggcgccttcatcgaccccaagggctggctcgagtggaacggcgacttcgccctcgagaccctcttctacgccgaggtggagaacaccgggcctggcgccgacatgagccagcgcgccaaatggggcggcatcaagactgtcacctacgccgacgcgcagaaggagtacaccgtcgaggccttcatccagggcgagcagttcatccccaagtatggcgtgcccttcatcccggggctcctcccgcagtcggaggcagggagggatcattaactccatccctcaccatgtttcattattccgctgctccattgctgcttgtatgcaattagctgagttgacatatacgtactattatacactatagtgcattgcgta

SEQ ID NO: 3939 - DNA, 700 bp, Triticum aestivum
gaccaggagctcatcgactgcagcgtcgacggcaacacggctgcaaacgcggcatgatggactacgctttctcctacatcgcctccagcgcgggctccacaccgaggaggcctacccgtacctcatggaggaaggcagctgcggcgacggcaagaagagtgagtccgaggcggtgtcgatcagcggctatgaggacgtgccggcaaaggacgagcaggcgctcatcaaggcactcgcccaccagcccgtctccgtcgccatcgaggcctccggcaggcacttccagttctacagcgggggggttttcgatggtccgtgcggcgcgcatttggatcacggcgtggcggcggtcgggtacgggtcggacaagggcaaggggcacgactacatcatcgtgaagaactcgtggggcgccaagtggggcgagaaggggtacatcaggatgaagaggggcaccggcaagggcgagggcctctgcggcatcaacaagatggcctcctaccctaccaaggacaactgatccatgatgacctgctggcggctgctgatgttcctggctgagatgctgcatccaggggatgcactgaaccatcatcattgagagtcgtcgttcgtcatctttgcatttcccttgttttttttctcttgtgttgtttgtttcggttaacgcgacgacggtggatcgaataagaaaaaaaat

SEQ ID NO: 3940 - DNA, 748 bp, Triticum aestivum
ttattcgacacaaattattcatacagatcaacgggagacatcagtcatggatgatgtcctgcaagtcaaatgcggcgaccgagcagggacaaaacaccaccgatcgccaagatttccaccgtcgcatcccgtcgagtacgtgcttctggtcgtggcgcggcgaagtatcaacatcatgaaggacttcgacgagccggggaccctcgccccgaccgggctgctactcggagacgccaagtacatggtcatccagggtgaacctggcgccgtcatccgcggcaagaagggcgcgggaggcatcaccctgaagaagaccgggcaggcgctggtggtcggcatctacgacgagcccatgaccccggggcagtgcaacctggtggtggagaggctgggcgactacctggtagagcagggcatgtagacgacgacggccatcacgccacgccgcagcaacaacaattactaccggccaaaagacacagtagatctccacgcgcacgcatatgggattgtggttcaatttctctcgcatcctcctctaatcctctctccctgtcccggcaactacttcgccgattaccacccctcttgattgatccgcgatatttttttccccttgtttcatgatgatgaagccgttcgtttcggctaataattttgattttttctcctatacgtatcgtttttggtcatttgggttgccgtttgagttgtggatccggaacaatatatatatgtgattgccatt

SEQ ID NO: 3941 - DNA, 707 bp, Triticum aestivum
gaagagtcgtggcagacttacgtggacgagcacctgatgtgcgacatcgagggccaccacctcgcctccgccgccatcctcggccacgacggcaccgtctgggccccagagcgccgatttcccgtcgttcaagccggcggagatggccaacatcatgaaggacttcgacgagccggggaccctcgccccgaccgggctgctactcgcagacgccaagtacatggtcatccaaggtgaacctggcgccgtcatccgcggcaagaagggcgcgggaggcatcaccctgaagaagaccgggcaggcgctggtggtcggcatctacgacgagcccatgaccccggggcagtgcaacctggtggtggagaggctgggcgactacctggtagagcagggcatgtagactactgacgacgaccacgccacgccgccgcagcaccaacaatactaccggccaaaagacacagtagatctccacgcgcacgcatatgggattgtggttcaatttctctcgcatcctcctctaatcctctctccctgtcccggcaactacttaccacccctcttgattcatccgcgatattttttccccttgtttcatgatgatgagccgttcgtttcggctaataattttgatttttctctcctatacgtatcgttttggtcatttgggttgcccgtttgagttgtggatccggacaatatatata

SEQ ID NO: 3942 - DNA, 717 bp, Triticum aestivum
caggcaacctgaccgcgctgtcggagcaggactgatcgactgcagtgtcgatggcaacagcgctgcaatggcggctagatggactacgccttctcctacatcgcatccagtggcgggctgcacaccgaggaggcgtacccctacctcatggaagaaggcagctgcggcgacggtaagaaggcagagtccgaggcagtgacgatcagcggcttcgaggacgtgcccgccaatgacgggcaggcgctgatcaaggctctcgctcaccagcccgtctccgtcgccatcgaggcctccggcaggcacttccagttctacagcgggggggttttcgatggtccttgcggcgcgcagctagatcacggcgtggcggcggtcgggtacgggtcggacaaggggaagggccacgactacatcatcgtgaggaactcgtggggtgcggactggggcgagaagggttacatcaggatgaagaggggcaccagcaacggcgagggcctctgcggcatcaacaagatggcctcctacccaaccaaggacaagtgatgttccagcctcagatgctgcatccacaggattgaagatttgaaccatccttgagagtccttgttcccgatctttgcatttccatgctttttctttcatggtttttcttttctttttcaatggttcctttcggttaaaacgacgaacatggactgaaataataaaatttgtttc

SEQ ID NO: 3943 - DNA, 636 bp, Triticum aestivum
gatggactacgccttctcctacatcgcgtccagtggcgggctacacaccgaggaggcgtacccctacctcatggaggaaggcagctgcggcgacggtaagaaggccgagttccaaggcggtgacgatcagctggcttcgaggacgtgccggccaatgacgagcaggcgctgatcaaggctctcgcccaccagcccgtctccgtcgccatcgaggcctccggcaggcacttccagttctacagcgggggagttttcgacggtccttgcggcgcgcagctagatcacggcgtggcggcggtcgggtacgggtcggacaaggggaagggccacgactacatcatcgtgaggaactcgtggggtgcggactggggcgagaagggttacatcaggatgaagaggggcaccagcaacggcgagggcctctgcggcatcaacaagatggcctcctacccaaccaaggacaagtgatgttccagcctcaaatcctgcatccagaggattgaagatttgaaccatccttgagagtccttgttcccgatctttgcatttccctgctttttctttcacgtttttccttttctcaatggttcctttcggttaatgcgacgaacatggactgaaataataaaatttatt

SEQ ID NO: 3944 - DNA, 592 bp, Triticum aestivum
  misc_feature (5)..(5): n = any nucleotide
aggangccgacaaggtgttcatccacaccatcaccagcccagttccagaccatcttcggcatcacgctcatcgagatcctgtcgaagcactcctccgacgaggtgtacctcgggcagcgcgacacgccggagtggacgtcggacgccaaggccctggaggcgttcaagaggttcggcacccggctgatggagatcgagaagcgcatcctggacatgaacaaggacccggcgctcaagaaccggaacgggccggtgaagatgccctacatgctgctgtaccccaacacgtcggacgccggcggcgagaaagggctgggcctcaccgccatgggcatccccaacagcgtctccatctgagctgagcgaggtcctttaatctgaacagcgtctcgttcagtagattggttggttcgtgtctcgcgtgcagggtgtattgtgttcctttaatccttctcatcattcgcttctgggtggttgcggtaattagttgcgagggattagtggatgatggcaaatgatgatcgtagatgatgttgatagggagagaacaatgaggcatgaataagcagtcgtgtgtgcattcctcttatct

SEQ ID NO: 3945 - DNA, 642 bp, Triticum aestivum
acctcccgaaccgccgactgtgaccgtcggaagatgccggaggaggcgaagaggagtacaacagctgcagaagggcgggaaggagccgacaaggtgttcatccacaccatcaccagccagttccagaccatcctgggcatcacgctcatcgagatcctgtccaagcactcctccgacgaggtgtacctggggcagcgtgacacgccggagtggacgtcggacgccaaggccctggaggcgttcaagaggttcggcacccggctgatggagatcgagaagcggatcctggacatgaacaaggacccggcgctcaagaaccggaacgggccggtgaagatgccgtacatgctgctgtaccccaacacgtcggatgtcgacggcgagaaagggctggggctcaccgccatgggcatccccaacagcgtctccatctgagtgtactctttctttctcagtagacggacgtccgccggccgttggttgattcctgtctcgcagggtgtattgtgttacttttcattggcttccggctggctgcggtaattagtttgtcaggggtgttgatagggagaggacaatgaggcatgaataagcactgcgtgcattctttctagtactagttatctccagaaatgtcagtgt

SEQ ID NO: 3946 - DNA, 804 bp, Triticum aestivum
ggaaggaggtgcgcgaggttgggcacggtgacctcaaggatgccgactggtggcccaagatggtgaccgtgcaggagctggccaagacgtgcaccaccatcatctgggtggcgtcggcgctccacgcggcggtcaacttcgggcagtacccgtacgctgggtacctcccgaaccggccgacggtgagccgtcggaagatgccggaggagggcgaagaggagtacaagcagctgcagaagggcgggaaggaggctgacaaggtgttcatccacaccatcaccagccagttccagaccatcctgggcatcacgctcatcgagatcctgtcgaagcactcctccgacgaggtgtacctcgggcagcgcgacacgccggagtggacgtcggacgccaaggccctggaggcgttcaagaggttcggcacccggctgatggagatcgagaagcggatcctggacatgaacaaggacccggcgctcaagaaccggaacgggccggtgaagatgccctacatgctgctgtaccccaacacgtcggacgccggcggcgagaaagggctcgggctcaccgccatgggcatccccaacagcgtctccatctgatcgtgcgtgatctttcttcagtactcctagattggttggttcgtgtctcgcagggtgtattgtgttcctttaatccttttcattcgcttttgggtgattgcggtaattagttgttgtcagggattagtggatgatgggaaatgatgatcgtagatgatgttcatagtgagaggacatgaggcatgaataagcagtcgtgtgt

SEQ ID NO: 3947 - DNA, 682 bp, Triticum aestivum
ggtcagcaccggggacgctttcaacgtcgtcggtcagcccctgcgcttcccagagtcccctctagtgagcttctcggcaagggacatgataaggggactactggtcaaggacccgcagcaccggctgggccacaagcgcggagccacggagataaagcagcaccccttctttgagggcgtgaactgggccctgataagatgcgcgagccctccagacatacccaagcccgtggagcttgactgccgcccgaagcaggccccggcggcaaacgggaaggtcgcgccggcctccaaccagaagggctcggacaactacctagagtttgagttcttctagcctctctttggtggtgcattatggatcctccggaacagcagcgcatttgagctgaggcgccacagaaagagaaggaagatgtagagctccccctcttggcctgggaaggtactctcatttgttgtagattgtatgctcttttctggagcctcctccccaagtttttcttctttcctttttcttttccgccattgaacttgttagctctctctttagtcaaatactctctctatgcatgttaattgcgattttcggaaaccgcattgtggcggtgcctcctgaacgggtttgaaggagcgcgcctgttcaggccgtcgaatgtaaccgttatttgtaccttgtaac

SEQ ID NO: 3948 - DNA, 810 bp, Triticum aestivum
cgagtacttggccccagaaatcatcaaaggcgaaggccatggaagtgcggtcgactggtggacctttggtatcttcttgcacgagcttctatacggctagacaccattcaaggggtcaggcaaccgtgccacgctgttcaacgtggtcggtcagcagctgaagttccccgagtcgccgtcgacgagctacgccggcagggatctcatcagggggctcctggccaaggagccgcagcagcgcctcggcgtgaagaggggcgcgacggagatcaagcagcacccgttcttcgagggcgtgaactgggccctcatccggtgcagcacgccccccgaggtcccgaggcccgtcgaggctgagctgcccgtgaagtacggggtgtcggaggcggtcgcgagcaccaacaagagggtggtcggcgcggacgccaagtccagcgggaagtaccttgactttgagttcttttagagtttgcgccttagcggcggagcttgttgtttgcatactgttggtgttgttgggtcagtgtggtgttgtgattttcacggtgctgtttatgtcagtcaccgctgttacaaatttcttgcatctgaactggccgaaattagctaggtgtgtttgatctgcatcacctgatgggaatagcctgtctctgtttctgaacatgttttgcgtgctacagattttgcattgcagaaacactctgaagagtggcgtcttcggggttttgcgccatcactcggcgaatcgggcattctgactggatttaaagaatataattgtagctggtaaatgtattttagtgttgattg

SEQ ID NO: 3949 - DNA, 732 bp, Triticum aestivum
gccatcaacctgcccgagctcctcgcagaacctacatcagctcgatccatgtcattcgttgggactcacgagtacttggccccagaaatcatcaaaggcgaaggccatggaagtgcggtcgactggtggacctttggtatcttcttgcacgagcttctatacggcaagacaccattcaaggggtcaggcaaccgcgccacgctgttcaacgtggtcggtcagcagctgaagttccccgagtcgccgtcgacgagctacgccggcagggacctcatcagggggctcctggccaaggagccgcagcagcgcctcggcgtgaagaggggcgcgacggagatcaagcagcaccccttcttcgagggcgtgaactgggccctgatccgatgcagcacgccccccgaggtcccaaggcccgtcgaggccgagctgccggtgaagtacggggtgtcggaggcggtcgcgagcaccaacaagagggtggtcggcgcggacgccaagtccggcgggaagtaccttgactttgagttcttttagagtttgcgccttagcggcagagcttgttgtttgcatactgttggtgttgttgggtcagtgtggtgttgtgattcttacggtgctgtttatgtcagtcaccgctgttacaaatttcttgcatctgaactggccgaaattagctagatgtgtttgatctccatgtcctgatgggaatagcctgtctctgtttctgaacat

SEQ ID NO: 3950 - DNA, 656 bp, Triticum aestivum
gtcacgagctcccgccggaagtccgcaagcgcactttcacggcccgtcctccgtccgccgcgtgctcatgtcccgccttctcctccgagctccggccacaaatataacgtccgctccatcccgatccgcaaggacgacgaggtgcaggtcgtgcgcggcacctacaagggccgcgagggaaaggtggtgcaggtctaccgccgccgctgggtcatccacgtggagcggatcaccagggagaaggtcaatggatccacggtgaacgtcggcatccaccccagcaaggtgatcgtcaccaagctcaagctcgacaaggaccgcaaggccctcctcgaccgcaaggctcgcggccgcgctgctgacaaggccaagggaaagttcacggcggaggacgtcgccgccgccgctgggggcgccacggccaccggtgcctcgctccaggagatcgattaagcttgggatctgccggttgccatactgctcttgatatcctagttttattaccatcaccagttctgttaggatatgctatctgaagactgctttattattcgtatgatgtcgtggatgagcgttttcaaacctttaatgtgcatctttatgggtctgtgccttggattttgatatgaagacttcattatatgtttaatatctgg

SEQ ID NO: 3951 - DNA, 730 bp, Triticum aestivum
gcccccaggtaagggagagagcctaccccccgccgccgccatgaagcgcaacccccgcgtcacgagctcccgccggaagtgccgcaaggcgcacttcacggcgccgtcctccgtccgccgcgtgctcatgtccgcggccctctcctccgagctcaggcacaaatacaatgtgcgctcgatccccatccgcaaggatgacgaggtgcaggtcgtgcgcggcacctacaagggccgcgagggaaaggtggtgcaggtgtaccgccgccgctgggtcatccacgtggagcggatcaccagggagaaggtcaatggatccacggtgaacgtcggcatccaccccagcaaggtgatcgtcaccaagctcaagctcgacaaggaccgcaaggcgctcctcgaccgcaaggctcgcggccgcgctgctgacaagcccaagggcaagttcacggcggaggacgtcgccgccgccgctggaggcgccacggccgccggtgcctcgctccaggagatcgattaagctttgggatctgccggttgccatactgctcttgatatcctagttttattaccaccgcctgttctgttaggatatgcactgctactttatcattcgtaagatgtccctggatgagtgtttggaacctttatgtgcatctatcatgggtctgccttggattttgatatgaagacttcattatatgtttaatatctggttctttgtttctcgtttaga

SEQ ID NO: 3952 - DNA, 668 bp, Triticum aestivum
ccatgaagcgcaacccccgctgtcacgagctcccgccggaagtgccgcaaggcgcactttcacggcgccgtcctccggtccgccgcgtgctcatgtccgcggccctctcctctgagctccgccacaaatacaatgtccggtccatccccatccgcaaggatgacgaggtgcaggtcgtgcgcggcaccttcaagggccgcgagggaaaggtggtgcaggtctaccgccgccgctgggtcatccacgtggagcggatcaccagggagaaggtcaatggatccacggtgaacgttggcatccaccccagcaaggtgatcgtcaccaagctcaagctcgacaaggaccgcaaggccctcctcgaccgcaaggctcgcggccgcgctgctgacaaggccaagggcaagttcacggccgaggacgtcgccgccgccgctgggggtgccacggccaccggcgcctcgctccaggagatcgattaagctcggtggatctgccggttgccatactgctcttgctatcctagttttttaatatcaccagtcctgttaggatatgctacctgaaatatgctcctttatcattcgtaagatgttcgatggtgacgtttgggaacctttattaatgtgaatctatcatgtggctgtgcgttggattttgatataaagtct

SEQ ID NO: 3953 - DNA, 734 bp, Triticum aestivum
cgtccgcaacgtcgtcgacacacgcatccgaccggtgctccgcgcgctcaagcagaacctgtcgttccttgtgtccgtgctcgttgaccacgcgcagccggtggccgtgcgggaggtgatgaaggcctcgttccaggcgttcctgatggtcctcctcgccggcggcaacgaccggagcttcacgagggcggaccacgggatggtggaggaggacttccggagcctgaagcgcgccttctgcacgtgcggcgagggcctggtccccgaggacgtggtggtgcaggaggcggaggccgcagagggcgtcgttgagctcatggctcggccgacggagcaactcatcgcggcgttcggcgccgccacgtcggagtccatcgcgggcgtgcgagaatacgaggactcggacggcggcgcgaccctcgtgccgccgacgtcgaggcagtggggccccgcggatccaaacaccatcctccgcgtgttgtgccaccgcgacgacgaggccgccaaccagttcttgaagcgcacgttccagctcgccaaacggcggtgatgtcggccaaatgctccaccaatgagcctaggtgctacacattttttagtcccatcactgcaacgacccgttgcggctacgtgggctatacctgtgccggccaagtgagcggctcatgtaatatgttctggtgtgagtgtgccctgttaataaatagccgttgctagcgtcagggttgaggatc

SEQ ID NO: 3954 - DNA, 661 bp, Triticum aestivum
caccactcgctttacgacggctgttacgcgggcggcgtggccgacgcgcgcattccggccggcgctccgcacgctgaagcagaacctgtcgctgctcgtgtccatcctggtggaccgcgcgcagccggtggcggtgcgggaggtgatgaaggcctcgttccaggcgttcctgatggtgctgctcgccggcggcaaccagcggagcttcacgagggaggaccacggcatggtggaggaggacctgcggagcctgaagcgggccttctgcacgcgcggggagggcctggtggcggaggaggttgtcgagagcgaggcggaggccgcggagggcgtggtggcgctcatggggcagacggcggagcgggtggtggaggagctgagcatcgcgacgacggcggcgacggcggcgtgcggcgggtcgccccgggccgcgctgccgatgccgctgacgacgcggcggtggtgccggacggacccggacacgatcctccgcgtgctctgccaccgcgacgacgaggccgccagccagttcctgaagcgcgcgttccagctccccaagaggcggtgacgctacgctttgcgccgctatttgcagccagttgcagactctaattcgtgtggattatgtgtgtgtggtgtgggagacaaataatgatcgctc

SEQ ID NO: 3955 - DNA, 673 bp, Triticum aestivum
cgcgtaccggctcatcttcttcgactcgcaccactcgttctacgacgggctgtacgccggcggcgtggccgacgcgcgcatccggccggcgctccgcacgctgaagcagaacctgtcgctcctcgtctccatcctggtggaccgcgcgcagccggtggcggtgcgggaggtgatgaaggcctcgttccaggcgttcctgatggtgctgctggccggcggcaaccaccggagcttcacgagggaggaccacggcatggtggaggaggacctgcggagcctgaagcgggccttctgcacgcgcggggagggcctggtggcggaggacgtggtggagagcgaggccgaggccgccgagggcgtggtcgcgctcatggggcagacggcggagcgggtcgtggaggagctaagcatcgcgacgacgacggcggcggcctgcggcgggtcgccccgggccgctctgccgatgccgctgacgacgaggcggtggtgccggacggacccggacacgatcctccgcgtgctctgccaccgcgacgacgaggccgcgagccagttcctgaagcgcgcgttccagctccccaagaggcggtgacgctaggctttgcagtttgtaccgctactactgcagactcagactctattttgtgtggacaagtggattatgtgtgtgttg

SEQ ID NO: 3956 - DNA, 711 bp, Triticum aestivum
cacaggcgcatgaacatggacggaattgcagaggtgttgctagcattggaaaggattgaacaacatgatgaattgtcttatgagcaattgctggtgatggaaaccaatctattcctcagtgtccttggcttgaatgatcagcatagagatatgagaatggatattgacgacatgtcttatgaggaattattacaactagaggatagaattggctccgtgagcactgccctttccgaagagcaattggagaagtgtctcagtcgagtcgtgtataaacgagcgaatccagcgctagaagtgaacaaacctgtagtagatgatgtcaaatgcagcatatgccaggaggagtacattgaggacgaagaggttggtagaatgaagtgtgagcatcagtaccatgtgtgctgcattcaggagtggcttcgacagaagaactggtgtccgatatgcaaagcttcagcagtaccttcgccgtcggacgccgcggacaagggggatacatgaatctatgtcaaatactctctccgtcccaaaataagtgtctcaactttaacataacgttataccaaagttagtataaagtagagacagttattctgagacggtgggagtagtatgaagataccatgaaaccatgttagacatcgtaggcactgccacaaatcaaggccctccaacttgtgaatatatacatgatgaactgtttctctc

SEQ ID NO: 3957 - DNA, 723 bp, Triticum aestivum
ttaaagttcttgcctacacagcattcagtagataatcatggaggaagcccttttcagcaaatagctcttgatagcatgttcctggaatcccatcgattattgactatagcatgctactgggaatccacttcagagctcccactcacttgaagctgcccacgtcacatcagaatacacttgaaagcagtggaattacatctgcaatggattgtagcgtgccactgcattgtgaggatgcaaattcctcaaagggatttctactagttgctcacgagccaggtacgacagcaggcggttcccacatcagaggaagcatggttagagcctcagaaggtggttacgaagaagtcgatcttgttctgccgggcaccggcaggtttagagtgcagctaggggtgaacatgccggcccgagctcggaaattgctggaaagcccggacgcggtcgaggagtacgacgtcgtgctctaccttggcatcatagacatactgcaggagtacaacacgtccaagagggtagagcatgcggtcaaatcactcaagttcgaccccctttcgatatcatctgttgatccgaacttgtattcgaaacgattcgttagtttcttggagagggttttccctgagcagatcgtaaaagtagagaggcctagaacagtacatagcagtaatgggtaattttgtttttttttgttgttcttgtttttgttgtaaagaatgaaca

SEQ ID NO: 3958 - DNA, 602 bp, Triticum aestivum
agcccccgcgaccagacgtgcccgtggacacgctgagctcggggcgtgcgtggacctgctgggcgggctggtgcatatcggcctgggcgacccggtggtgaaccagtgctgcccgctgctggaggggctggtggagctggaggcggcggtgtgcctctgcaccaccatccggctcaagctcctcaacatcaacctcgccctgcccctcgccctccagctcctcctctcctgcggcaagaccccgccacccggcttcacctgctccatctagccgacctaacctgggtgagtcagtgcgccagtgcccactgcacgtggagattgatggatcatggatggatcgacatgagaggatgtcgagcgtggtcgcctactagctagtagcgagcaagaagagatcgatcgatcagcttgtttttcttgtggtttttattttgtgtttggctaggtctgtgtgttgtggtttgatgccagaggtgataatctatgtgtgctgatcaattaattggtcacaactgaggaccaactggttaagctagcaaataagaaggaaacaagtaaacagtaatagtagtaagattccatgccatgaataattcaca

SEQ ID NO: 3959 - DNA, 877 bp, Triticum aestivum
  misc_feature (442)..(463): n = any nucleotide
cgccggccaccattcccagtcccccggtctccgcccggttcaccgctcccccgtcgacgccgggaacactccccccgtcgtcgccggggtgcgctgcggttccagccgccagcgccagcgccgccgcgacgcagacgtgcccggtggacacgctgaagctcggggcgtgcgtggacctgctgggcgggctggtgcatatcggcctgggcgacccggtggtgaaccagtgctgcccgctgctggaggggctggtggagctggaggcggcggtgtgcctgtgcaccaccatccggctcaagctcctcaacatcaacctcgcgctgcccctcgccctccagctcctcctcacctgcggcaagaccccgccacccggcttcacctgctccatctagtcgacctaacctcggcgagtcagtgtgccacagtgccagtgcacgtggannnnnnnnnnnnnnnnnnnnnncatgagaggatgtcgatgcatggtcgtcgtctagctagtagctagtagcgagcaagaagagatcgatcgatcagctaagaatgcatcgatgagtgtttgtttttcttgtgatttttattttgtgtttggctaggcctgcgtgttgtggtttgatgccagaggtgataatcgatgtgtgctgattaattaattggtcacaactgatgaccaactggttaagctagcaaataagaagaagaaaacaagtaaacagtagtagtaagattccatgtcatgaataattcacagagctgttccagagtggccagtcgtgattggattagacatcgatcttgactaggagtatgttggtgcaagcaggcatgactgcgacagtgcatgcacggattgtatctcttttcaatgtcggtggta

SEQ ID NO: 3960 - DNA, 1044 bp, Triticum aestivum
cgcaaatctgtccgcctcccactcgcgagccacgacctcttcctcctacgccgcggccggacccgacccgctctcctccgacgccgtctccctcctgcgatctcctctacgacgagcgacgccgcctgcctcatctcctggcaccagcagcgaccccgccgctcgccgtctccgagtcctgaatagcttgctgccggtaggggccattaaccagcttctgaggaaactattcagagccagtctgcttctattccacggttgtactaggctagggtgaacctccttctccggcgaccggcctccattccagcccctcgctaccagatacagcagatctacacaggtggagatccctgtttgtgtgcggtgcactgtacctggcggtcctccatagccatggtttatcactctagtttcactgatgatgatgggatcacaaaagcctgtgggtgccctttgcttccactgaaaactcatatcaagggcccagccccagcctcagattcagataaagcggatatagtcgatgaagcgataactttcttccgagcaaatgttttcttcaaaaacttccatgtcaaaagcccagcagacaagttgcttatctatctgacatcttacatcaatattgccttgaaaagactagaaagctgccggacactggctgttggaactaaggcaatcattaacctggggttggaaactgttcctgtgcccggggaaccggggtttcctttcctggacttttcgctcttcccgaatcccaggaagaagcagaattgttgaggaactatctgaagcagataagggaggaaacaagcgggaggctgctcaactgtgcatacagagctaatggcactccaaacaaatggtggttggcttttgcaaagaggaagttcatgaaccttgtcatcctttagagtgtaattaagcatttcagctacaggttagatgtgtttttgtatatccttatttcactcggacatttatttatatgatgatgtaaataatctttcttctgaagtattcaagtataacatgcca

SEQ ID NO: 3961 - DNA, 643 bp, Triticum aestivum
tgcatgatgtagatgcaatgaaaagtatcaattatcactggctgtttgcctgtgttatttgctgattttgtgcgtatcatcacacgactcccaactttatattcctataacataggtagcttctatcttcgatgcagagtcctgaatagcttgctgccggtaggggccattaatcagcttctgaggaaactattcagagccagtcttcttctgttctacggttgtactagggtggatctccttctcacaggcggagattcctgtttgtctgcggcgcactatagctggcggtcctccatagccatggatcacaaaagcctgtgggtgtcctttcttccactaaaaacacatatcaagggcccagccccagcctcagattcagataaagcagatatagtcgatgaggcgataactttcttccgagcaaatgttttcttcaaaaacttccatgtcaaaagcccagcagacaagttgcttatctatctgacatcttacatcaatattgccttgaaaagactagaaagctgccggacactggctgttggaactaaggcaatcattaacctggggttggaaaatgtccctgtgcccggggaaccagggtttcctttacctggacttttcactcttccatttcgagatg

SEQ ID NO: 3962 - DNA, 563 bp, Triticum aestivum
ctattacagataaagcagatatagtcgatgaagcgataactttcttccgagcaaatgttttcttcaaaaacttccatgtcaaaagcccaggcagacaagttgcttatctatctgacatcttacataaatattgcattgaaaagactagaaagctgccggacactagctgttggaactaaggcaatcattaaccttgggttggaaattgttcctgtgcccggggaaccggggtttcctttccctggacttttcactcttcccgagtcccaggaggaagcagaattgttgaggaactatctcaagcagataagggaggaaacaagcgggaggctgctcaactgtgcatacagagctaatggcactccaaacaaatggtggttggcttttgcaaagaggaagttcatgaaccttgtcatcctttagagtgtaattaagcatttcagcaacaggttagatgtgtttttgtatatccttatttcactcgcacatttatttatatgatgatgtaaataatctttcttctgatgtattgaagtataaaatgcccaaacagtttcttgcaa

SEQ ID NO: 3963 - DNA, 668 bp, Triticum aestivum
tccttcatagccatggtttatcactctagtttcattgatgatgacgggatcacaaaagcctgtgggtgtcctttgcttccactcaaaacccatataaagggcccagccccagcctcagattcagataaggcggatatagttgatgaagcgataactttcttccgtgcaaatgttttcttcaaaaacttccatgtcaaaagcccagcagacaaattgctcatctatctgacatcttacatcaatattgccttgaaaagactagaaacctgccggacgctggctgtcggaactaaggcaatcattaacctggggttggaaaaagttcctgtgcctggggaaccagggtttcctttccctggacttttcactctcccccaatctggggaggaagcagaactgttgaggaactatctgaagcagataagggaggaaacgagcgggaggctgctcaactgcgcatacagagctaatggcactcccaacaaatggtggctggcttttgcgaagaggaagttcatgaacgttgtcatcctttagagcgtaagcacatcagcaacagcttaagaggcattcgtgtaaatcctgattgcacttgcacatttattcctacgatgacgtaaagattccttctcttgaagacttcaagtatacaatgctgaaaacattgt

SEQ ID NO: 3964 - DNA, 922 bp, Triticum aestivum
cctcaccccagcaccggcggcgcacagctcgacgacccgagcgatcctgcggaggcggcaggcatggtgcacgtcaacttctaccgcaactatgggaagaccttcaagaagccaaggcgtccgtatgagaaggagcgtcttgacgctgagctgaagctggttggggagtacggtctgcgggccaagcgtgagctctaccgtgtgcagtacgccctcagccgcatccgaaatgctgccagggagctgctcacctggatgagaagaacccccgccgtatctttgagggtgcagcgctcctccgccgcatgaaccgctacggtcttctcactgaggaacagaacaagcttgattatgtgcttgccctcactgttgacaacttcctccagcgccgtctccagaccatcgtcttcaagaatggcatggccaagtcaatccatcatgctcgtgtccttatcagacagcgccacatcagggttggaaagcagcttgtcaacattccttctttcatggtgagggtggacactgagaagcacgtcgacttctctctcaccagcccccctgggtggtggccaacctggaagagtgaagcggaagaaccagaagaaggcctcaggtggtggtggtgatgacggcgaggaggaggaagactaagcgcccagcctcacccgcataactttcgttgcagaaatgttgagattgccttgtggaactcggaaatgattcaaactttccttcttagaaacttagtggtgtagagcttttgttggttcagaatcttttggctgtcggttctaaaattaaacttatgtgtgtcggttttgcttggttagtgaccaccgagcagaagtgaactcttgaggctgcttcgttttttgtgaaccaaacgtatcttgtttatcgatttgacaagcctggttctgag

SEQ ID NO: 3965 - DNA, 885 bp, Triticum aestivum
gaagaccttcaagaagccaagggtccgtatgagaaggagcgtcttgacgctgagctgaagctggttggggagtacggtctgcgggccaagcgtgagctctatcgtgtgcagtacgccctcagccgcatccgaaatgctgccagggagctgctcactctggatgagaagaacccccgccgtatctttgagggtgcagcgctcctgcgccgcatgaaccgctacggtcttctcactgaggaacagaacaagcttgattacgtgcttgccctcactgttgacaacttcctccagcgccgtctccagaccatcgtcttcaagaatggcatggccaagtcaatccatcatgctcgtgtccttatcagacagcgccacatcagggttggaaagcagctcgtcaacattccttctttcatggtgagggtggacactgagaaacacgtcgacttctcgctcaccagcccccttggtggtggccaacctggaagagtgaagcggaagaaccagaagaaggcctcaggtggtggtggtgacgacggcgaggaggaggaagactaagcgctcagcctcgacccgcataacttccgttgcagaaatgttgagattgccttgtggaacttgcaacgtgaaatgattcaaactttggttcgttcttagaaacttagtggtgtagagctttcgttgcttcagctatcgattctaaaattaaacttatggttgtcagttttgcttggttagtgaccaccgagcataagaagtgaactcagtgaggctgcttcgttttttgtgaaccaaacgtatcttgttatcgattttacaggcctggttctgagttattttactctgtcactgaagtgtgtccttactgtttttctgtttcatctactc

SEQ ID NO: 3966 - DNA, 1060 bp, Triticum aestivum
  misc_feature (158)..(158): n = any nucleotide
  misc_feature (165)..(165): n = any nucleotide
  misc_feature (168)..(168): n = any nucleotide
  misc_feature (195)..(195): n = any nucleotide
gagaaaatcatggtcatgggatcaactgctttgtcaacaggcagctaatctacaactttcctgaagaactttttgctgatgctggcatcctcgcagttgagcacgctgactttgagggcatcgagcggttagctcttgtcacgggtggtgatattgcnatcaacntanttgtgacaacccagagtctagttaagncttgggcactgcaagctcatcgaagagattatgattggggaggacaggctgattcatttctccggggttgcgatggggcaagcttgcaccattgtcctgagaggagcaagtgagcatgtgcttgatgaggctgagaggtccttgcacgacgccctatgtgtgctttctcagacagtaaatgacacgcgtgtcatatttggcggtggatggcctgagatggtgatgtccaaagaggtggatgaacttgcaaggaggacccctgggaagaaatctcatgctattgatgctttttcgcgtgccctgcaagccatcccaacaatcatagctgacaatgctggtctggatagtgccgagctgatctcccagctccgagccgagcaccacaaggagaacagcactgttggaatcgacgtcatcagcggcgggctgggagacatgcagaagcgtggcatctgcgaggcgttcaaggtgaagcaggccatcgtcctgtcggcgaccgaggctgcggagatgatcctgagggttgacgagatcataacctgcgccccacgcaggagggaggacaggatgtgagatacccacgagctgttttgattgatgctgggctatctatgtatggtttgccgagttgtggctgggttaccgtgggtccacggctgctttaaagtctccatttcgattgtcgtcgaaccctggcccctaagcgactggaacttgttgttggagtagctagcgttctgtagggagtggcttcagttttctcgagttattttccactagagaatatagtgatgtgtatgctgtaaccttgttttaactgcatctttgcatgcggaggcgcttatttcagaacatgcatgcactg

SEQ ID NO: 3967 - DNA, 675 bp, Triticum aestivum
cggcgtggtgccgtacgcggcggccaacttctacgcctacgagacgctgcgcggcgtgtaccgccgcgcgtcggggaaagaggaggtgggcaacgtgccgacgctgctgatcgggtccgcggcgggcgccatagccagcacggccacgttcccgctggaggtggcgcggaagcagatgcaggtgggcgccgtgggcgggaggcaggtgtacaagaacgtgctgcacgccatgtactgcatcctcgagaaggagggcaccgccgggctctaccgcgggctcggccccagctgcatcaagctcatgcccgccgccggcatctccttcatgtgctacgaggcctgcaagaagatacttgtcgacgagaaagaagacggcggcgccgccgagccccaggaggagacggagaccggacaggcaggaggacaggcggcgcccaagagctcgaacggtgatcggccatgaactagatgaagcattatggtgaccgtcaaaatcagaagaaaatgcgtgatttgaaatttttgaagtgtagagcctattgcgattgaatcctaagctggaagtggcgccttagaagttgaatttcgttttgttcagggaacatgctccgtttcagtaatgccgtcgaatgatttatggcacctttctgtaatcaattcaataaggaagaagtc

SEQ ID NO: 3968 - DNA, 640 bp, Triticum aestivum
ctacgcctacgagacgctgcgcggcgtgtaccccgcgcgtcggggaaggaggaggtgggcaacgtgccgacgctgctgatcggtccgcggcgggcgccatagccagcaccgccacgttcccgctggaggtggcgcggaagcagatgcaggtgggcgccgtgggcgggaggcaggtctacaagaacgtcctgcacgccatgtactgcatcctcaagaacgagggcaccgccggactctaccgcgggctcggccccagctgcatcaagctcatgcccgccgccggcatctccttcatgtgctacgaggcctgcaagaagatactcgtcgacgacaaagaagacgagccccaggaggagacggagaccggacaggcaggaggacaggcggcgcccaagagctccaacggtgctcgcccatgaacgcgatgaagcattatggtgaccgtcaaaatcagaagaaaatgcgtgatttgaaattttgaagtgtagagcctagtgcgattgaatcctaagctggaagtggcgccttagaagttgaatttcgttttgttcagggaacatgctctgtttcagtaatgccgaagattgatttatggcacctttctgatcaattcaataagaaagaagtccacttttggacc

SEQ ID NO: 3969 - DNA, 661 bp, Triticum aestivum
tgccgcgtgtaccccgcgctcgggaaggaggagtggcaacgtgccgacgctgctgatcgggtccgcggcggcccatcgccagcacggccacgttcccgctggaggtggcgcggaagcagatgcaggtgggcgccgtgggcgggaggcaggtgtacaagaacgtgctgcacgccatgtactgcatcctcaagaaggagggcgccgcggggctctaccgcgggctcggccccagctgcatcaagctcatgcccgccgccggcatctccttcatgtgctacgaggcctgcaagaagatactcgtcgacgacaaagaagacgagccccaggaggagacggagaccggacaggcaggaggacaggcggcgcccaagagctcgagcggtgatcggccatgaacgcgatgaagcaaggattatggtgaccgtcaaaatcagaagaaaatgcgtgatttgaaattttgaagtgttagagcctagtgcgattgaatcctaagctggaagtggcgccttagaagttgaatttcgttttgttcagggaacatgctccgtttcagtaatgtcgtcgattgatttatggcacctttctgtaatcaattcaataagaaagaagtcccctttgggaccttcaactttgcccaaaaaaacccaaaacaccccacccc

SEQ ID NO: 3970 - DNA, 790 bp, Triticum aestivum
gagagaggagagagctccagccatggtgcacgtcaacttctaccgcaactatggtaagacattcaagaaaccaaggcgtccttatgagaaggagcgtcttgatgcagaactaaagctggttggtgagtatggactgaggtgcaagcgtgagctctggagggttcagtatgcattgagcaggatccgtaatgcggcaagacacttgctcacactggatgagaagaatccccgccgtatctttgagggcgcggctcttctccgtcgcatgaaccgctatggtctccttgctgagggccaggacaagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccgtcgttcatggtgagggttgaatccgagaagcacatcgacttctcactgacaagtccattcggcggaggccctgcaggccgggtgaagagaaagaaccagaagaaggcaagtggtggtggcgatgcaggtggtgacgaggaagaggaatgaggaactagtagctatcaccttatatttatcaaatgttggtgttatgagtactttagctgagaggccggagactttcatgggttatcctcttgtcattttgtcactttatcactgttgttagcatgtatgcacttctttatgtttggagctatttggtcgtgatgaaagttatctaaaaat

SEQ ID NO: 3971 - DNA, 829 bp, Triticum aestivum
ggagagagctccagccatggtgcacgtcaacttctaccgcaactatggtaagacattcaagaaaccaaggcgtccttatgagaaggagcgtcttgatgcagaactgaagctggttggtgagtatggattgaggtgcaagcgtgagctctggagggttcagtatgcattgagcaggatccgtaatgctgcaagacacttgctcacactggatgagaagaatccccgccgtatctttgagggtgcggctcttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccgtcgttcatggtgagggttgaatctgagaagcacatcgacttctcactgacaagtccattcggcggaggccctgcaggcagggtgaagagaaagaaccagaagaaggcaagtggtggcggcgacgccggtggtgatgaggaagaggaatgaggaactagtagctatcaccttatatttatcaaatgttggtgttatgagtactttagctgagaggcctgagactttcatgggttatcctcttgtcattttgtcactttatcactgttgttagcatgtatgcacttctttatgtttggagctatttggtcgtgatgttttcgactatgacctggaattattcttcaattgcttctgttggggtggttgtctgatagt

SEQ ID NO: 3972 - DNA, 934 bp, Triticum aestivum
aatggggaagtgatttgcgtgcgtctggtctctgatctggttcgacttctaccgcaactatggtaagacattcaagaaaccaaggcgtccttatgagaaggagcgtcttgatgcagaactaaagctggtcggtgaatatggactgaggtgcaagcgtgagctctggagggttcagtatgcactgagcaggattcgtaatgctgcaagacacttgctcacactggatgagaaaaatccccgccgtatctttgagggcgcggcccttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccctcgttcatggtgagggttgaatctgagaagcacatcgacttctcactgacaagtccattcggtggaggccctgcaggcagggtgaagagaaagaaccagaagaaggcaagtggtggcggtgacgccggtggtgacgaggaagaggaatgaggaactagtagctatcaccttatatttatcaaatgttggtgttatgagtactttagctgagaggcctgagactttcatgggttatcctcttgtcattttgtcactttatcactgttgttagcatgtatgcactgctttatgtttggagctatttggtcgtgatgaaagttatctaaaaatgttcttgactatgacctggaatcctccttcaattgcttctgttggggtggttgtctgatagttcataggaatcaacctttcttttcgagtaaatgaattactttgatgatccatttgctggttcataggaatcaa

SEQ ID NO: 3973 - DNA, 653 bp, Triticum aestivum
ctttctccattgcctcgtcaagattgaacgagaggaagccccctcggagctttcccgtggtctgacgccgagtctgatagggagtggtgccatacgccgcgaccaactactatgcctacgacaccctgaggaagctctacaggaagacattcaagcaggaggagatcagcaaccttgcaaccctcctgattggttcggccgcgggcgccatctcgagcactgccaccttccctctcgaagtagctcggaagcaaatgcaggctggggcggtgggtggaaggcaggtctacaagaacgtgttccatgccctctactgcataatggagaaggaagggatgggcggcctgtacaaggggctcgggcccagctgcatcaagctcatgcccgcggcggggatctcgttcatgtgctacgaggcatgcaagaagattctggtcgaagccgaggagtagagcgaagtgcgccgccagggtcgggtccttaaagaagaggcggcaggaggattaagcctcgtctttctttctatcaagaaaagaaaattggatgatcaactactcatcagaagcttaggtcaaaggtatttgagacacgtctgttagatgaagaagttttggcctctaaattagttctgtgttcgagttgaaatccataaa

SEQ ID NO: 3974 - DNA, 1056 bp, Triticum aestivum
cgccgttggagacaattaggacacacctgatggttgggagcaatggggattcaatgacagaggtgtttcagacaattatgaagtcggagggctggacagggctgttccgtgggaactttgtaaatgttatccgtgttgctccaagcaaggcgattgagctatttgcttttgatacagccaaaaaattcctgactccaaaggctgatgagtcctctaagacccccttccctccatcacttgtcgcgggggcacttgcaggtgtcagctcaacactctgcacatatcctctggaactgatcaagacccgtctgactatagagaaagacgtatatgacaactttctccattgcctcgtcaagattgtacgagaggaaggcccctcggagctttaccgtggtctgacaccgagtctgataggagtggtgccatatgccgcgaccaactactacgcctacgacaccctgaggaagctctacaggaagacattcaagcaggaggagatcagcaacattgcaaccctcctgatcggttcggccgcgggcgccatctcgagcaccgccaccttccctctcgaagtagctcgcaagcagatgcaggcaggggcggtgggcggaaggcaggtctacaagaacgtgttccatgcgctctactgcataatggagaaggaagggatcggcggtctgtacaaggggcttgggcccagctgcatcaagctcatgcccgcggcggggatctcgttcatgtgctacgaggcctgcaagaagattctggtcgaagccgaggagtagagcgaagtgcgccaccggtgtcgggtccttaaagaagaggcggcaggaggattaagcctcgtcttcctttctatcaagaaaagaaaaattggatgatcaactactcagcagaagcttaggtcaaaggtatttgagacacgtctgttagatgatgaagttttggcctctaaattagttctgtgtccgagttgaaatccataaacaatattctgactggcggaagcagttttgtcatgctactttgcttctgtgctactaccctgtttct

SEQ ID NO: 3975 - DNA, 1099 bp, Triticum aestivum
gttgctccaagcaaggcgattgagctattgctttgatacagccaaaaaattcctgactccaaaggctgatgaatcctctaagactccctttcctccatcacttgtcgcgggggcacttgcaggtgtcagctcaacactctgcacatatcctctggaactgatcaagacccgtctgactatagagaaagatgtatatgacaactttctcaattgcctcgtcaagattgtacgagaggaaggcccctcggagctttaccgtggtctgacaccgagtctgataggagtggtgccatacgccgcgaccaactactatgcctacgacaccctgaggaagctctacaggaagacattcaagcaggaggagatcagcaacattgcaactctcctgatcggttcggccgcgggcgccatctcgagcaccgccaccttccctctcgaagtagctcgcaagcagatgcaggctggggcggtgggcggtaggcaggtctacaagaacgtgttccatgctctctactgcataatggagaaggaagggatcggcggcctgtacaaggggcttgggcctagctgcatcaagctcatgcccgcggcggggatctcgttcatgtgctacgaggcctgcaagaagatactggtcgaagccgaggagtagaacgaagcgtgatgcggggtcgagtccttaaagaagaggcggcgggattaagcctcgtcttcctttctatcaagaaaagaaaattggataatcaactactcatcagaagcttaggtcaaaggtatttgagacacgtctgttagatgaagaagtttttggcctctaaattagttctgtgttcgagttgaaatccataaacatattctgactggcggaagcagttttgtcatgctactttgcttctgtgctactctagccatgtttctcccttttatcaccggatcttggtcaatctttacagagaactgctcgcgatctttgctgaaaatagaagtgctacgacaggcagtttgatatcctggatttcatgtcactgcggttggttgaatatgtgggattatattgttttttagcgacatatgggacggagggagtataattgattga

SEQ ID NO: 3976 - DNA, 612 bp, Triticum aestivum
acccgagggcgggagacctgcagaactgtgcacggcaccgcgtcgacctgccatcttcgccacgtgcacaactacgagcgcacctgcccgctctaccagaaccagtgcgtgagcaacgagcggagccgctactcgggcaccatgaacgggaccatcttcgtggtggcgggcggcggcggcagccacctcaacggctacaccagcgccgtccccaagtggagcgtgttcagggaccgggactacggcttcaccaagctcacggccttcaaccactcctcgcttctcttcgagtacaagaggagcagtgatggcgaggtgtatgacaacttcaccatccacagggactaccgcgacgtgctcggctgcgtgcacgacagttgcttccccaccaccctcgctacctgaccgtcgagccgccatggagccaaccagcggctaataaagggagttggccctgtattttcttgtattttcatggtgtgcgcatgttgtggtctctgttcttcgcagtctgttgcgctagagtgtggaggttttctgttactgttgctgtagttgaacaacactgtgtgacgctggtgttcccagtgattatgtcgcttcaataaaaag

SEQ ID NO: 3977 - DNA, 709 bp, Triticum aestivum
  misc_feature (604)..(633): n = any nucleotide
ccaacaagtggtacgccgagcagggctccttcgaggagcccgaggggcgggagagcctgcagaagctgtggcagcggtaccgcgtcgacctggccttcttcggccacgtccacaactacgagcgcacctgcccgctctaccagaaccagtgcgtgagcaacgagcggagccgctactcgggcaccatgaacgggaccatcttcgtggtggcgggcggcggcggcagccacctcaacggctacaccagcgccatccccaagtggagcgtgttcagggaccgggactatggcttcaccaagctcacggccttcaaccactcgtcgcttctcttcgagtacaagaggagcagcgacggcaaggtctacgacaacttcaccatccacagggactaccgcgacgtgctcggctgcgtgcacgacagttgcttccccaccacactcgctacctgatggctcggtccagccatcatggagccaaccagcggctaataaagagagttgatcctgcattttcttaagaatggtttctgagacttgtgcttccatgatgtgcgcatattgtgctctgtgttattcacagtctgttgcactagagtgtggaggtnnnnnnnnnnnnnnnnnnnnnnnnnnnnnnaactgcactgtgagacgcatgtgttcccggtaattatatgatgttttaataaaaagctgggctagcatgagcgtag

SEQ ID NO: 3978 - DNA, 581 bp, Triticum aestivum
  misc_feature (505)..(528): n = any nucleotide
tcggcgacctgccctacgccaacggctacatctcgcagtgggaccagttcaccgcgcagtcgcccccatcagcgcccggaagccctacatgatcgccagcggcaaccacgagcgggaccatcttcgtggtggcgggcggcggcggcagccacctcaacggctacaccagcgccgtccccaagtggagcgtgttcagggatagagactacggcttcaccaagctcacggccttcaaccactcctcgcttctgtttgagtacaagaggagcagtgatggcaaggtgtatgacaacttcaccatccacagggactaccgcgacgtgctcggctgcgtgcacgacagttgcttccccaccacccttgctacctgatggctcggtccagccatcatggagccaaccggcgactaataaagatagttggtcctgtattttctgaatgtcccaggtgtgcgcctattgtgctctctgttcttcgcagtatgttgcgctggagtgtggaggtnnnnnnnnnnnnnnnnnnnnnnnnaactgcactgccagacgcttgtgttcccagagattatgttgttttaagaactg

SEQ ID NO: 3979 - DNA, 708 bp, Triticum aestivum
ccccttcaagacccagcccggtgtcccgctggcgcaggccagacccacgacgagatgcccgtgacctggaccagcggctacgacgtcgcgaggcctacccgttcgtggagtgggcatggtcacctccgctccgcggcgggaaccccgcccgcacccccgccggcacgctaaccttcaaccgcggcagcatgtgcggcgcgccggcgcggacgatcgggtggagggaccccgggttcatccacacggcgttcatgaggggcctgtggcccaacaaggagtacttctacaagatcgggcacgagctccccgacgggacggtggtgtggggcaagccctacaccttccgggcgccgccgacccccgggcagagctcgctgcagcgcgtcatcgtcttcggcgacatggggaaggcggagagggacgggtcgaacgagtacgccaactaccagccggggtcgctcaacacgacggacgcgctggttaaagatctggacaacttcgacatggtcttccacatcggcgacctgccctacgccaacggctacatctcgcagtgggaccagttcaccgcgcaggtcgcccccatcagcgccaggaagccctacatgatcgccagcggcaaccacgagagggactggcccaacaccggagggttcttcgacgtcgaggactccggcggcgagtgcggcgtgctggccgagaccatgt

SEQ ID NO: 3980 - DNA, 638 bp, Triticum aestivum
aagcaccagccatggctcatcttcacggcgcaccgtgtgctccggatactcctccaaacaaagtggtacgctgagcagggctccttcgaggagccccgaggggcgggagagcctgcagaagctgtggcagcggcaccgcgtcgaccttgccatcttcggccacgtgcacaactacgagcgcacctgcccgctctaccagaaccagtgcgtcaccggcgagcggagccgctactcgggcaccatgaacgggaccatcttcgtggtggcgggcggcggcggcagccacctcaacggctacaccagcgccgtccccaagtggagcgtgttcagggatagagactacggcttcaccaagctcacggccttcaaccactcctcgcttctgtttgagtacaagaggagcagtgatggcaaggtgtatgacaacttcaccatccacagggactaccgcgacgtgctcggctgcgtgcacgacagttgcttccccaccacccttgctacctgatggctcggtccagccatcatggagccaaccggcgactaataaagatagttggtcctgtattttctgaatgtcccaggtgtgcgcctattgtgctctctgttcttcgcagtatgttgcgctggagtgtggaggt

SEQ ID NO: 3981 - DNA, 853 bp, Triticum aestivum
gccgagggcgtgcacctggtgatggagctgtgcgagggcggcgagctcttcgaccgcatcttcgcccggagccactacacggagcgcgccgccgccaagatcggccgcaccatcgcgcaggtcgtgcagctgtgccacgacaacggggtcatgcaccgggacctcaagcccgagaacttcctcttcgccggcaaggaggaggactcgccgctcaaggccatcgacttcggcctctccgtctacttcgagcccggggagcggttcaccgaggtggtcggcagcgggatctacatggcgccggaggtgctcatgaggagctacggcccggaggccgacgtctggagcgccggcgtcatcctctacatcctcctctgcggagtgcctcctttctggggagacaccgatgagcacatcgccgagtccataatccggggtgaaatcaagttcgagagggagccatggcccaaggtctcccaaacagcaaaggaccttgtcaagaagatgcttgatccggatcctgctacccgcttgacagcaaagcaagtctttgagcatccgtggctcaagaacgccgacaaggctccgaatgtgtcacttggagagcttgttcgatccaggcttaagcaattctcatccatgaacaagttcaaaaagaaggcactcggagtcgttgccaagaatttaccggcggaggacatcgagaactacactcagatgtttcaaatgatagacaaggacaaggacggtactttgacgcttgaggagctcaaggagggcttgcggataaacggtcatgctgttcctgagacagagatacagatgctgttataagcgtggggacatagatggaaat

SEQ ID NO: 3982 - DNA, 871 bp, Triticum aestivum
atgttcatcttgatattgacgaggacaaagaaatcagaattgggcaccgcccctacatgcctgatgggaagccagttattggatttgttccggatatgtcaaatgttttgattgcaacaggacatgaaggaagtggacttgctttggcgctaggtactgctgaaatggtgacgaatatgattcttggtgacctggaagagtggacttcacgcctttctccatagaaaatagattttcaggaacagcatgaccgtttatccgcaagccctccttgagctcctcaagcgtcaaagtaccgtccttgtccttgtccatcatttgaaacatcttagtgtagttctcgatgtcctctgccggtaaattcttggcaagaccttcattaatcattggaaaatgattcacgtcaagaatatatcacactggaagaaaaatcaagaacatgtagcccggttctgtgcaacttactccgagtgccttctttttgaacttgttaatggacgagaattgcttaagcctggatcgaacaagcgctccaagcgacacattcggagccttgtcggcgttcttgatccacggatgctccaaagacttgctttggccgtcaagcgggtagcaggatcctgatcaagcatcttcttgacaaggtcctttgcagtttgggagaccttgggccatggctccctctcgaagttgatttcaccccggattatcgactcggcgatgcgctcatcgttgtctccccagaacggaggcactccgcagagtaggatgtagaggatgacgccggcgctccagacgtcggcctccgggccgtagctcctcatgagcacctccggcgcctgtagatcccgctgccgaccacctcggtgaa

SEQ ID NO: 3983 - DNA, 1160 bp, Triticum aestivum
cggtatctcggtgttcttcaaccccggcgatcgcttcacggaggtggtggggagcgcctactacatggcccccgaggtcctcaagcgtactacgggcaggaggtggacgtgtggagcgccggcgtcatcctctacatcctcctctgcggtgtgccgcccttctggggggacaacgacgagaagatcgcgcaggccattatccgcggcggcctcgacttcaaccgggagccctggcccagggtgtccggcaaccccaaggacctcatcaggcagatgctcgaccccgaccccgccacccggctcacggcctcgcaagttcttgagcacccgtggctgaagaacgcggacacggcgccgaacgtgtctttgggcgaggcggtgcggtctcggctgcagcagttctcggcgatgaacaagttcaagaagaaggcgctgggcgtggtggcgcggaacatgccggtggaggagctggacaagtacgtgcagatgttccacctcatggacaaggacaagaacggcaacctgtcgctggaggagctcatggagggcctccacatcaacggccagcgcgtgccggagtcggagatcaggatgctgctcgaagccgcggacacggatggcaacgggacgctggactgcgacgagttcgtgacggtgtcgctgcacctcaagaagatgaccaacgagaagtacctggcggcggcgttccgctacttcgacaaggacggcagcggcttcatcgagatcgacgagctgaggcaggagctggggcccaacgagcaggccatcctcgagatcatccgcgacgtcgacaccgaccgggacggacgcatcagctaccaggagttcgagctgatgatgaagtccggggcggactggaggaacgcgtcccgccagttctcgcgagccaacttcagcaccctcagccggaaactatgcaaagaagaaacttcctcctcgtgaattcaatttgttctacggctagatgtgattctttatgtgcatgtaagctgcagagttaacgagatcaacttaggcacgaacaaatggacgtacctggggttgtgcagtgacgagaaatgaatgaaagatattttctcacacacacaaaaaatgctactactttcatattggtgactaaccttagactactcgctccc

SEQ ID NO: 3984 - DNA, 701 bp, Triticum aestivum
gacggtcgctggcgagcgggcgtctcggctgcagcagtctcggcgatgaacaagttcaagaagaaggcgctgggcgtggtggcgcggaacatgccggtggaggagctggacaagtacgtgcagatgttccacctcatggacaaggacaagaacggcaacctgtcgctggaggagctcatggagggcctccacatcaacggccagcgcgtgccggagtcggagatcaggatgctgctcgaggccgccgacacggacggcaacgggacgctggactgcgacgagttcgtgacggtgtcgctgcacctcaagaagatgaccaacgagaagtacctggcggcggcgttccgctacttcgacaaggacggcagcggcttcatcgagatcgacgagctccggcaggagctggggcccaacgagcaggccatcctcgagatcatccgcgacgtcgacaccgaccgggacggacgcatcagctaccaggagttcgagctgatgatgaagtccggggcggactggaggacccgccagttctcgcgggccaacttcagcaccctcagccggaaactatgcaaagaagaaacttcctcctcgtgaattcaatttgttctactgctagatgtgattctttttgtgcatgtaagctgcagggttaacgagatcaacttaggcacgacaaatggacgtacctggggttgtgcagt

SEQ ID NO: 3985 - DNA, 634 bp, Triticum aestivum
  misc_feature (600)..(600): n = any nucleotide
atttgggatcctgaatccaggttctgatgatgagattggagtctgatcttgcacaggtcctgctatccgcatgccagaggggaactgggccaagctttcgctaacctggtcacctgaaatcgcgatggtggtcgtgatggcgagtgaagggtacctggctcttataagaagggaaccgtgataaaaaacatcgacaaggccgagcaggtttctccagctgtcaagatattccatgctgggacagctttggatggagacggcaaccttgtagctgtcggaggccgagttcttggcgtaactgcgaagggcaaggacattgaagaagcgaggtttagagcgtacgatgcggtagatgttgtcgactggccagaaggattcttcaggcgagatattggttggagggcactgaagcaggagcagacggctaactactgattagttaggtttcctaaatctggggtgagcttccatcctcaagtgaaatgaagacagtagagtcaccattgttgtggttgcggaattgacaggagcatagcttctcccgtcgaacatgagcatcttttggccatggtttggctccgaaccatttgtagcagtcangtattttccacaaagtcaggcaatgtgtcaattg

SEQ ID NO: 3986 - DNA, 774 bp, Triticum aestivum
tgtaaagtatgctctgaaggatgcaatttttggtgtgttatatccgggcttatgatagagaagaaatctggcttgcctaagcttattgaatataaatgtgcgattttggggacccaggaatgccaggttttgatgatgagattggagtctgatcttgcacaagtcctgctatccgcatgcaagaggcgaactgggcaaggtttcactaacctggtcgcctgaaatcgcgatggtggttgtgatggcgagcgaaggatacctggctcttataagaaaggcaccgtaataaaaaacatggacaaggccgagcaggtttctccggctgtcaagatattccatgctggaacagctttggatggagacggcaaccttgtagctgtcggaggccgagttcttggcgtcactgcgaagggcaaggacatcgaagaagcgaggtcgagagcatacgatgcggtggatgtcgtcgactggccggaaggattcttcaggcgagatatcggctggagggcactgaagcaggagcagacggctaactactgacttgttaggttttcctaaatccggggtcagcttcgagcgtcaagtgaaatgaagacagtagagtcaccattgtcgtggttgcggaattgacaggagcatagcttctcccgtcgaacatgagcatcttttcaccatggttttggctccgaaccatttgtagcagtcttgtgttttccacaaggcaggcaactttgtcaagtgcaattatctcttgatgtgcaataataataccac

SEQ ID NO: 3987 - DNA, 1133 bp, Triticum aestivum
  misc_feature (836)..(836): n = any nucleotide
  misc_feature (844)..(844): n = any nucleotide
ttggtgtattatatgccgggcttatgattgagaagaaatctggtctgcctaaacttattggaatataatgtgcgatttggggatcctgaatgccaggttctgatgatgagattggagtctgatcttgcacaggtcctgctatctgcatgcagaggagaactgggtaaggtttcgctaacctggtcacctgaaatcgcgatggtggttgtgatggcgagcgaaggataccctagctcttataagaagggcaccgtaataaaaaacatcgacaaggccgagcaggtttctcctgctgtcaagatattccatgctgggacagctttggctggagacggcaaccttgtagctgtcggaggccgggttcttggcgtcactgcgaagggcaaggacatcgaggaagcgaggtcgagagcgtacgatgcggtagatgtcgtcgactggccggaaggattcttcaggcgagatatcggctggagggcactgaagcaggagcagacggctaactactgattagttgggttttcctaaatctggggtgagcttccagcgtccagtgaaatgaagacagtagagccaccattgttctggttgcagaattgacaggagcatagcttctcctgtcgaacatgagcatcttttgaccatggtttggctccgaaccatttgtagcagtcttgtgttttcctcaaggctggcaacgtgtcaagtgcaattatctcttgaggtgcaataataccatcaactgattattttctagtgaacataaccacgtgagctcttcataagcatttgcttataggacctactccttccattcctaaatataaatctttttngatatttnaatatgaactacatacggatgtagtagaaattatgtggtgagctcatgacacattagaggagggacaatacatgaattcaatagtctgttgaggaacagcccatgctgccatagcctcctcttttgctattcggggttcatcgccatcactaactgatatgagcagaacattcttctcttccggggttcatcgccatccattgtcatctctttgctactatttgtatgtatggatctctttgctacttttttgtatcgatctctgtgctacttcaaggtgcagtttggt

SEQ ID NO: 3988 - DNA, 600 bp, Triticum aestivum
gtgttctgggcggagcagtaccgcgagatcgaggccaccaccgacttcaagaaccacaacctgcccctcgcccgcatcaagaagatcatgaaggccgacgaggacgtccgcatgatcgccgccgaggcgcccgtcgtcttcgcccgggcctgcgagatgttcatcctcgagctcacccaccgcggctgggcgcacgccgaggagaacaagcgccgcacgctgcagaagtccgacatcgccgccgccatcgcccgcaccgaggtcttcgacttcctggtggacatcgtgccgcgggacgaggccaaggacgccgaggcggccgtcgccgccgggatgccccaccccgccgccggcatgcccgccgccgacatggggtactactacgtcccgcagcagtaacgcctgcagtatgttacagcggacttaagttgcatctaagattgtgctgttgatttagtgctctcctatgtttgtttgttcaccgctgaataattaagatcttgtcatcatttgaggggcctcctctatgttataagtgattcgatccaagaagaatcggtgtaggttcttctgatcgaggcaggccgtatgatgctcatg

SEQ ID NO: 3989 - DNA, 1192 bp, Triticum aestivum
  misc_feature (170)..(193): n = any nucleotide
gccagccagccagcgagcgagcgcaatccctagcgccgaggcccattcccccgtcgtccttccccgcccattccacgatccctcggccgcggtcgggtcgccatgggaatggggccgctcgagaacgccgccgccgtcgtcgagggcggcgtcgccgccccggtggtgcnnnnnnnnnnnnnnnnnnnnnnnngaggggggtcgtacgcgctgctgcagtgcggggaggactcggcgtacgtgcgggacgcgtacgggggctacttcgaggtgttccgcgcgctgctggccgaggacggcgagcgctggcaggtgtaccgcgccgtgcgcggcgagctgccgtcggaggaggacgcggcggggctcgacgggttcgtcatctccggcagctgcagcgacgcccacggggacgagccctggatcctcgccctcgtcgacctcatccggggccagatcgccgccggcaagcgcgtctcggcgtctgcttcggccaccagatcctgtgccgggcgctgggcggcaagaccgggaggtcctgcaaggggtgggacatcggcgtcagctgcatccaccccaccgccgcggcggcgaggctcttcgcgcccctcaagatgccggtgcacctgcccatcatcgagttccaccaggatgaggtgtgggagctgcctcctcacgccgaggtgctggcccggtcagacaagaccggcgtcgagatgttccggctgggcgaccgcgccatgggcgtccagggccaccccgagtacagcaaggacatcctcatgagcatcgctgaccgcctcctccgccagaacctcctcctggactgtcaggtggacgtggccaaggcgagcttcgacgtgcggcagccggacaaggagttctggaagaaggtgtgcagggggttcctcaagggcaggctccagccgcagcagcagaagcagcagccgccgcagcaacataagcttcagctataggagtcggaggatgagacggtggcgagtccgagaagaaggccgtcaccggtgccgccggaggaggaaggaaggaggacgacatagtagcgttactgagctgggggggttgccattgcgagcgtagaattaatccttatttttctgcttcggagtttgacatcaccatcatcatcttgtacagaaacccaaccgcctatctaatcgaagcattaataaag

SEQ ID NO: 3990 - DNA, 1172 bp, Triticum aestivum
  misc_feature (297)..(297): n = any nucleotide
  misc_feature (305)..(305): n = any nucleotide
  misc_feature (314)..(315): n = any nucleotide
  misc_feature (397)..(397): n = any nucleotide
  misc_feature (405)..(405): n = any nucleotide
gatttattctcaaggaagatgaagataacctggatgcgctgttacttcgtggtcgagcatactattaccttgctgatcatgatgttgccaacaggcactaccagaaaggactgcgtctagaccctgaacattcagaattgaagaaggcgtattttgggttgaaaaaacttctgaagaagaccaagagcgcagaggataatgctgccaagagcaagttccgcgtggctgttgaagactacaaggcagcactagcaatggatccagaccacactatgtacaacgtacaactttatctcngggctatngtaagactnnctggttaaacttggcgagaggccaaggaggcccaatcaacagctgtacagaagcactcagcattagatgaagaaacttgttngatgcttntggcacagagaggtgaggctaaacttctaacagaagattgggaaggtgcggttgaggacctcaaagaggctgcccagaaatccccacaggacatggcaatcagagaggcgctcatgaaagctgaaaggcagctcaagctgagcaaaaggaaagactggtacaagatcctgggcatctcaaagacagcatcggccgcggacatcaagcgcgcgtacaagaggctggcgctgcagtggcacccggacaagaacgtggagaaccgcgaggaggcggagaacatgttccgagagatcgcctccgcatacgaggtacttagcgacgaggacaagcgtgtgaggtacgaccggggagaggacctggaggagatgggcatggggggaggcggcggcggctttgacccgttcggcggaggcggtgggcagcagtacacgttccaccacggcggtgggttccccggcgggggcttccccggtggcttccagttcaacttcgggtaaaaagcaggccaggcttactgtttagttttgctgtcactgctagtgagtagtgtgtcgtggtcttttggtttaggagggagagcttaacgacaacatgtgttaattatatatatctagctaagagcttttaccatcttggctcttactctggttaaagaaagttttgctttagcaccaattatacaagaaattttccgtgagatgaattgtactagtgtattatgatttatagctggcgattctgtgatgcatcggccagttgattggaaa

SEQ ID NO: 3991 - DNA, 1210 bp, Triticum aestivum
  misc_feature (14)..(14): n = any nucleotide
  misc_feature (16)..(16): n = any nucleotide
  misc_feature (21)..(21): n = any nucleotide
gcattcataatttntnataanaacataatctttcacagcaaacagttcatcacagccacaacatcattttgcaacaaagataatgcaaacaaatgtatccatctcttggtgtcatgggagaaatttatccattcggcttgtttattgtgccttcttttggtgcttgagaaccgaaattaggcgtgacaactggatcccaagaatcggggcggcaggcaccggggagaagtccagtacgccggaggagatcgccgacgtcgagcggcgcgtagtcttggggaggagtcggcggcggcgtcttggaggactacaaggcagcactagcaatggatccagaccatactttgtacaacgtacaacttcatcttgggctctgtaagactctggttaaacttggaagaggcaaggaggcaatcagcacctgtacggaagcactcagcatagatgaagaacttgttgaagctttgtcacagagaggtgaggctaaacttctaacggaagattgggaaggtgcggttgaggatctaaaagaggctgcccaaaaatccccacaggacatggcaatccgagaagcgctcatgaaagccgaaaggcagctgaagctgagcaaaaggaaagactggtacaagatcctgggcatctcgaagacagcgtcggccgcggacatcaagcgcgcgtacaagaggctggcgctgcagtggcacccggacaagaacgtggagaaccgcgaggaggcggagaacatgttccgagagatcgcctccgcatacgaggtgcttagcgacgaggacaagcgtgtgaggtacgaccggggagaggacctggaggagatgggcatggggggaggcggcggcggcttcgacccgttcggcggaggcggtgggcagcagtacacgttccaccacggcggtgggttccccggcggcggattccccggtggcttccagttcaacttcggttaaaagcgggccaggcttactgtttagttttcctgtcccggtctttggtttaggagggagagcttaacgacaacatgtgttaattatatatatctagctaagagcttttactgtcttggctcttactctggttaaagaaagttttgcttaagcaccaattatacaacaaattttccctgagattaattgtactacatgtattatgatttatagctggtgattttgtgatgcatcgaccagttgattggtaa

SEQ ID NO: 3992 - DNA, 1653 bp, Triticum aestivum
gaagatactgggaataaatccggagtactccaagccagaagattgcaagagatccagaaagtgacgctcatttattttgtttgtactgtttttgaaaggggtgcttaaggttagagagatattcaacttcacacaagatgatatgatgacggaagacatatttattttggactgtcattcatgtgtatttatatgggttggacaaaatgtggacacaaaaatacgtgcacaagctttgagcattggagagaaatttctagaacttgacattccaatggaaaacttatcacgagaaacaccactttatgtgatcaatgaaggaagtgagccccaatttttcaccaggttcttcacttgggattctgcaaaaacagccatgcatggcaactcatttgaaaggaggctgtctatattgaaggatggaataaaaccaagaagagataaacctaaaagaagaacaacaacatcatcgcacactggaagatcaagtgtgcctgataaatctcagcggagaagtacgtctttcagccccgatcgtgtaagagttagaggaaggtcaccggcattcaatgcattggctgccacctttgagaattcaaatgcccgaaatctatcaacccctccaccagttgcaagaaaatcattttcgaagtcttcctcccctgatcctgtgaagccaccccagagagctgcctcgatcgccgcaatgtctgcttctttcgagcggcctagacaaactctgataccaaagtcaattaaagcgagtcctgaggtaaagaaaccacaatctgaagcaagcaaacctaagccagaggaagacgccaaagaaagtacccctgctgcgaaggatgggcaaactgtgactccgacaatacaggaagatgtaaaggaggatcaacccgaagacgaggaagggcttcctacatatccgtatgatcgcttgaggacatcttcaagcaatcctgtcacagacattgatagtaccaggcgtgagacgtatctatcttcggcagagttcagggagaagtttggcatgacaaaggaggcttttgcaaagctaccaaagtggaagcagaataggctcaagatcgcactccagctcttttaaagtcttctgctgtcatatatgcagcagttaatgtctgcttggtgaaagtaaggacggcgagattgtttttcaaaggcaaatctcaaacacgaagatctctctcgcacatgtcgtaatgttaagaagagacatcggtaagtgtaagcctatctgggtcaaggggacccttggtaggcgtcggaggggctggagcagtgagttttgagctgcccatgccctggaattgtgtgttgtccactgacgaattctccatgtcgtgtgtcgggtcactgcattggtggtccggtcacacaccctaattctttcctttccaaggtcaccggtttggttgtgagcttgcaatgctttttcctcgccctctttgaaacctcaccatttgtttcattctttcatgcgtgtatggtttcctgacacaaataattatgttacatatatggtgtaagaagttaggtgatgggatgaacgccccttatgttggaaaatccaggcgatgtacgggagacgggcgtcttgcccttggaatttgatcttttaacgtggtaatt

SEQ ID NO: 3993 - DNA, 1002 bp, Triticum aestivum
gtcggacgtgttgctgtgcgtgctgccgctgttccacatctactcgctcaactcggtgctgctggcggggctgcgcgccgggtgcgcgatcgtgatcatgcgcaagttcgaccacggcgcgctggtgagcctggtgcgcgcgcacgcggtcaccgtggcgcccttcgtgccgcccatcgtcgtcgagatcgccaagagcgaccgcgtcaccgccgccgacctcgcgtccatccgcatggtcatgtccggcgccgcgcccatgggcaaggacctccaggacgccttcatggccaagatccccaacgccgtgctcggacaggggtacgggatgacggaggctgggcccggtgcttgtccattgttgcctggcggttcgcgcaagtgagccgttcggggtcaagtcggggtcgtgcggcacggtggtgcgcaacgcggagctcaagatcgtggaccccgacaccggggcctccctcggccgcaacctgccgggggagatctgcatccgcggcaaccagatcatgaaaggttatctaaatgatccggaggccacaaagaacaccattgacaaggacggttggctgcacactggagacattggttacgtcgatgatgacgacgagatcttcattgtcgacaggctcaaggagataatcaaatacaagggattccaagtacctcctgcggaacttgaagcccttctcattacacacgccgaaataaagatgctgctgtcgtatcgatgcaagatgaacttactggtgagattccagttgcattcattgtgcggattgaaggctctgagataagcgagagcgagatcaagcagttcgttgcaaaagaggttgttttctacaagaggatccacaaagttttcttcgcggactcggttccgaagagtcctgccggcaagatcctcaggaaggacctgagagcaaagcttgctgcaggcatcccaggcagtggaagcacacagtccaaaagctgagcccatcttacacacac

SEQ ID NO: 3994 - DNA, 598 bp, Triticum aestivum
gatcttcatcgtcgacaggctcaaggagatcatcaagtacaagggcttccaggtggcgccggcggagctcgaggccctcctcatcacgcacccggagatcaaggacgccgccgttgtatcactgaaggacgatcttgctggcgaagtcccggtcgccttcgttatgcggatcgaaggctccgaaatcaccgaggatgacatcaagaaattcgtcgcaaaggaggttgttttctacaagaggatccacaaggtcttcttcaccgactccattcccaagaacccttccggcaagatcctgaggaaggacttgagagccagactcgccgccggcatcccaagctaggggctgcggccgtcgtccgcttctcaggcactcagccagccagcagggtgctgttatagatcatgtaatattggtcgatctccacgaaatggtcggaggaggttgagtttgttggttcttcctacttgtgtaatgttgataaaaatgaaatgatatatgaagatgcgttgtttttgaccacaagaacaaggctggtttccaagggtacatgtatacttcttttccatcagagaatatcttgtttggatcatatca

SEQ ID NO: 3995 - DNA, 586 bp, Triticum aestivum
gacgacgacgacgagatcttcatcgtcgacaggctcaaggagatcatcaagtacaagggcttccaggtggcgccggcggagctcgaggccctcctcatcacgcacccggagatcaaggacgccgccgtcgtatcactgaaggacgatcttgctggcgaagtcccggtcgccttcgttatgcggatcgaaggctccgaaatcaccgaggatgacatcaagaaattcgtcgcaaaggaggttgttttctacaagaggatccacaaggtcttcttcactgactccattcccaagaacccttccggcaagatcctgaggaaggacttgagagccaggctcgccgccggcatccctagctaagggatgcgccgtcgtccgcttctcaggcactcagccagccagcagggtgctgttatagatcatgtaatattggtcgatctccacgaagtggtcggaggaggttgagtttgttggttcttcctgcatgtgtaatgttgataaaaatgaaatgatatatgtagatgcgttgtttttgacaacaagaacaaggctggtttccaaagggtacaatgtatacttcttttcaatc

SEQ ID NO: 3996 - DNA, 1478 bp, Triticum aestivum
cgaggcctgcgccgtggacaaggtgctggagtacgcggccggcaagggcctgcccgtggtcaccgtcgacggggcgcgcgacgggtgcgtggacttcgccgagctgatcgccggcgaggagctgccgcgggacgaggaggccgggatccaccccgacgacgtcgtcgcgctgccctactcctccggcaccaccgggctgcccaagggcgtcatgctcacgcaccgcagcctcatcaccagcgtcgcccagcaggtggacggagagaacccgaacctgtacttcagcaaggaggacgtgctgctgtgcctgctgccgctgttccacatctactcgctcaactcggtgctgctggcggggctgcgggccgggtcggcgatggtgatcatgcgcaagttcgacatcggcgcgctggtggagctggtgcgcgcgcacggcatcaccatcgcgcccttcgtgccgcccatcgtggtggagatcgccaagagcccccaggtgaccgccggcgatctcgcctccatccgcatggtcatgtccggcgccgcgcccatgggcaaggacctccatgacgccttcatggctaagatccccaacgccgtgctcggccaggggtacgggatgacggaggccgggccggtgctggccatgtgcctggcgttcgccaaggagccgttcaaggtcaagtccgggtcgtgcggcacggtggtgcgcaacgcggggctcaagatcgtcgaccccgacaccggcgcctccctcggccgcaaccagcccggcgagatctgcatccgcggcgagcagatcatgaaaggttaccttaacgacccagagtccaccaagaacaccatcgacaaggatggatggctgcacaccggagacatcggccttgtcgacgacgacgacgagatcttcatcgtcgacaggctcaaggagatcatcaagtacaagggcttccaggtggcgccggcggagctcgaggccctcctcatcacgcacccggagatcaaggacgccgccgtcgtatcactgaaggacgatcttgctggcgaagtcccggtcgccttcgtgatgcggatcgaaggctccgaaatcaccgaggatgacatcaagaaattcgtcgcaaaggaggttgttttctacaagaggatccacaaggtgttcttcaccgactccatccccaagaacccttccggcaagatcctgaggaaggatttgagagccaggctcgccgccggcatccccagctaggggctgcggccgtcgtccgcttctcaggcactcagccagccagcagggtgctgttatagatcatgtaatattgtttgatctccatgaaatggtcggaggaggttgagtttgttggttcttcctgcttgtgtaatgttgataaaaatgaaatgatatatgtagatgcgttgttgttgaccacaagaacaaggctggcttccaaagggtacaatgtatacttcttttccatcagaga

SEQ ID NO: 3997 - DNA, 1246 bp, Triticum aestivum
  misc_feature (110)..(234): n = any nucleotide
gacggacggcatagcgtagggaggggatccatccagcagagtagaggagagcagcgaccggtcggagcagagcagtggcggcccactgggtcggtcggcatggattaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcagctgtgcttcgtggggaggggcggcgggtgtcggggggcggagaggaagcggcggttcacggaggagcagacacggtcgctggagtccatgttccacgcgcaccacgccaagctggagccccgggagaaggcggagctggcgcgcgagctgggcctgcagccgcgccaggtggccatctggttccagaacaagcgcgcgcggtggcgctccaagcagctggagcacgacttcaccgccctccgcgccgactacgacgccctccactcccgcgtcgagtccctcaagcacgagaagctcgccctcgccgcacagttgcaggagctgagcgagaggctgagggagagggacggcggcggcggtggcgcggcgaccgccaccgccagcagcagcagctgcaacggaggcggccgggagctggacgacgacaagaggaacgtcgtcgacgtcgagccccccgagagctgcgtgctcggcgggacggcgtgcggcacgccggcggacgtctcggcgtcggtggagtccgagtgcgacgaccacctccactacgacggggcggtcttcccggagtccttctgcgccacgccggagctgtgggagccgtggccgtggccgcccgtcgagtggaacgcggtggcttgaggccctggagtagtatatacatgttgtgaacccacgtaggcggcttgtgtgtgtagcttcacgtacgtacgtgcatgttgtgctcgatttcccatctggttggggatacatgcgagagaggcgaacgggggcgcggcaatgacgggtgggtccgtgtaagacagagggtgatgcacctgaatccagagaagtgacctgaaaccatggaggcgaccgcccagccaatgggatcagggattcggatgctgctaaaatgttgcgagttagagatcattggtggagtttgcatcagctgttctgtttgttgttgcacccgctgtgaattcaaatgttggaggtaggaccgatccatcattgataatactac

SEQ ID NO: 3998 - DNA, 593 bp, Triticum aestivum
tcggtgggctgttcctgacgcactgcgggtggaactcgacgctggagagcgtgtgcgccggcgtgccgatggtctgctggcccttcttcgccgagcagccaaccaactgccggtacgcgtgcgccaagtggggcatcgggatggagatcggtggcgacgtggcgagggaggaggtggcgcggctggtgcgcgaggccatggacggcgagaggggcaaggcgatgagagcgagcgcgacggcgtggaaggaaagcgccagggcagcgacgggggcaggtggctcgtcgagcgagaacatggatcggctggtcgagttcttgcgtgccgggtgtgatggtgctacctgaatgagttatacgggtgtgtttggtagcatgcatggacctagtctagttgttcttctctgatacatgttgaacgtagacatgctcagttcatgtatactagatcgttatcacgccttggcgcgagggtgccggtccaaccgacatgaccaagcgatggaagatcaaaccacatgatgcattagcaaaaagcatgagtaggaacgcatgatgcacaaccgattttctggttcaaggaaaagaataaat

SEQ ID NO: 3999 - DNA, 1521 bp, Triticum aestivum
aggatgtttttacaacacccgaagtggtgccacttggacataatttacttatcacataccgcaagcttctcaatcatgctcaggtgtttgatctacttgatgaaactccagacaaagtcttacacaaactctacaacaacgtggaaaggctcaagcgtgatggggatactcttgcttctgaaatccataggaggttgaggctaatagttgctggaggcgatggaacagccggttggttgcttggagttgtatctgatctcaagctagttcatccacctcccgttgctacagttcccctgggaactggaaataacctgccatattcttttggatggggcaagagaaatcctggcacagatcgtgagtctgtcatatccttcctaaagttggtaaaagaagcaagagagataaacattgatagctggcatactgtcatgagaatgaaatgcccaaaacgttctccttgcgatccaattgctccttctgatttgccgcattctctgcatgcatttcaccgtgtgccaaagacagatccagaagatatggaatattcttacacatatcgtggagggttttggaattatttcagtatgggaatggatgcacaagtgtcttatgcatttcattctcagaggaaattgcacccagagaaattcaagaatcagttgtctaatcagaaacagtatttgaagctggcatgcacacaaggatggttctgtgcctctttaagccatccaatgtcacggaatattgctcaccttgcaaaggtaaagataatgaagaaatctggaaaatgggaaaccttggaaattccacagagtatccggtccattgtctgtctcaatttacccagcttttctggtggactgaatccctggggaacaccaagtaagaggaagcaaagaaaaagagacttggtactgcctccacttgtggatgatggccttctggagattgtgggtttcaaagatgcttggcatggccttgtattgttatctccgaaaggccacggcactcgtcttgctcaggcccatcgtgtccgattcaaatttcaccggggtgcaactgaccatgcctacatgagaatcgacggtgagccctggaagcagcctcttccacaggaggatgacggcaaggttgtcgtggagatatcccacgctgggcaggtcaagatgctcgcaaccaaggactgtatagccaaaggcatcaacgactcccctatgtcaacaacctgcacagattccagctccagcgatgactcggacgatgacttcacagaggagcggaggaacttcggggccgccttgtcgttccggtacatgaatgatgtgaaaaaaacagtagaagcttgaatctctaactgggccctgtacagtttgtcctgcgtaggagatagatcgttgcactgattttgtcgagcagtggacgttgcccctgtaagatccttttgctggcaaggctgtttgtgtatggcaaagttgttgtggcgtactggtgcaggtgggtttttacttacgtggc

SEQ ID NO: 4000 - DNA, 1045 bp, Triticum aestivum
  misc_feature (138)..(138): n = any nucleotide
  misc_feature (295)..(295): n = any nucleotide
tcgcgcgccccccgactacaacgaccgcgccccaagtcccccccaaatgacggaccaaggagagggatgactacaacgtgagcgagacgacttcagcttcgggaacaggggcgcgctggaccgggacgcgagccggcngacgataaggccatgacggcggacccgaacaatgcgatgggccggggccgacggcgatgccgccgacgagcgtgatgacgcggctgatcctgatcatggttggcgcaagctcatccgcaaccccacacctactccagcctcatcgcactcatctgtncgctcgtctgcttcaggtggaacttcacgatgccggcaatcgtcctgggatccatctccatcctgtcggatgcggggctaggaatggccatgttcagcctcggtctgttcatggcgctgcagccgcggatcatcgcgtgcgggaacaaggtggcgacgtacgccatggcggtgcggttcctcgccgggccggccgtcatgaccgccgcctccttcgccgtgggcctccgcggcacgctcctgcacgtcgccatcgtccaggccgcgctgccgcagggcattgtccccttcgtcttcgccaaggagtacagcgtgcaccccgacatcctcagcacggcggtcatattcggcatgctcatcgccctgcccatcacgctcgtctactacatcctgctcggcctgtgagcgggcgccgcatgtaaagatccgtcgcttcgctaccgcaggctcaggagcggcagaggaggaggaggacgcgtgcttggagcacgaggggggctcttcatttttcttcccctctctctctctagagcagcaggataatggcggcgctcctagctaggtaggacaatggcgagagttgatcaacgacactcagaagggcacgggaagaagaaagtgcaagtacagagaagcttgggcggggggcaggggtcgggttcaggtcgcggaatggctgggttgtgaaagcggtttgcgagttttggtgcctgacccctgtaaaatggatgccgttctgatagtaactgac

SEQ ID NO: 4001 - DNA, 713 bp, Triticum aestivum
aaagggagtatgcctgagatcttcaagagtggagcaactcccatcctggttgcaactgacgtgcttgctcgtgggcttgacataccagatgtcgcccacgtcatcaattttgatctgccaaatgacatagatgactatgttcaccgcattgggagaactggtagagctgggaagtctggtctggcaactgcatttttcaatgagggcaacatgtcactggccaggccattgtgtgaactgatgcaggaagccaatcaggaggttcctcagtggctggagcgctattctgcccgttcctcgtttggaggcggcggaggaggcagaaaccgcaggtcaggaggcggcggcggtgctcgatttggtggacgtgacttccgtcgcgacacgaggggcggcggcggtggaggaggtggtggctatggcggcggtggcggtggcggttaccgttgttggtgcgaggttatgtgtggaggcgcttctagctcgtgggactgatgggttcacctggtaatggtgagaattgaatgaaagtgatggatggatggtattctattgacttagctgaaaacagatattggggtttgtagtcaccgtggtgtgggtatggtgcccttgcccccatttaccttattttgtgcctggttgttgtcaccgcacttgtgtttcccctgtactggttattttctgactggcatcaaagtccgggtgggcta

SEQ ID NO: 4002 - DNA, 699 bp, Triticum aestivum
gctgagatccttcaagagtggagcaactcccatcctggttgcaactgacgttgctgctcgtgggcttgacataccagatgtcgcccacgtcatcaattttgatctgccaaatgacatagatgactatgttcaccgcattgggagaactggaagagctgggaagtctggtttggcaactgcatttttcaatgagggcaacatgtcactggccaggccgttatgcgaactgatgcaggaagccaatcaggaggttcctcagtggctggagcgctattctgcccgttcctcgtttggaggcggcggaggaggcagaaaccgcaggtcaggaggtggtggcggtgctcgatttggtggacgtgacttccgtcgcgacacgaggggcggcggcggtggaggaggtggtggctacggcggtggtggcggttacggttgtagtggaagttatggtggaaggcgcgtctagctcgtgggactgatgggttcacctggtaatggtgagaaattgaaacgaaaccgatggatggatggtattctattgacttagctgaaaacagatattggggtttgtagtcaccgtggtgtgggtatggtgcccttgcccccatttaccttattttgtggctggttgttgtcaccgcacttgtgtttcccgtgtactggttattttccgactggcgtcaaagtccgggtgggctaatt

SEQ ID NO: 4003 - DNA, 945 bp, Triticum aestivum
  misc_feature (88)..(112): n = any nucleotide
cgctgtcggagatgtaccagagcgcgcggcggctgctgctgtcggcccgcgacggcgtgtcccttgtggagcggctcgcctcggcgcnnnnnnnnnnnnnnnnnnnnnnnnnggcgccgctcgtcggcgcgccggacccggcgggcgccgaggccgtgcgcagggaggtggcgcagatccagggcctctgcgcgcagatggaccgcctctggcgctccatccccgccaagggccagcgcgacctctggaagagaaaagtggagcagctatctgaagaggttgattcattgaaggaaaccctcgacaagcactcattgcggcaacgaaagcggattttggaagccaaggaaagggcggagctatttgagagagctaatggtgagtcgtcgcatgtccttcaaatatttgacgacgaagcccaggcaatgcaatcggcccgcagctcctctcgaatgcttgacgaagcctttgagacaggagtggccatcctccacaagtactctgaccagagggatcgtctgaagagcgcgcaaaggaaggccctagacgtcctgaacaccgttggcctgtcaaactcggtcttgaagctcatcgaaaagcggcaccgagtcgacaagcggattgcgtacggtggcatgatcattaccgtcgtgctgatggttgcgttattggcgatggacacactagtttttcaatgttctctagaggtgggcacactagtgcatgaggaattaaggaaggggggttgttgttcagtttaaagtttgctagctctggtccttccttgtgtagtaggcacaactctgcccgcccggttactgatctatcttctttgtattactatcatatatactgtgtgtatagcgattatggaaagatgttgacaagtctcagatcagatgtattcttctgtatgcacagtacagtggcatgttttgttaccat

SEQ ID NO: 4004 - DNA, 606 bp, Triticum aestivum
  misc_feature (99)..(99): n = any nucleotide
agcttttgaatggagtatcgcatacaacacattggcacttgacctcaaagcgacaatttacttgttaattaagggatcctcagcgtccaatatgcaagnttggtgaccttgggctttcaaaagtcaagtgtcagaccctcatctctgtggtgtgaggggaacgcttccatggatggccccagagcttctgaatggaagcagcagcctggtctctgaaaaggttgatgtcttctcctttgggattgtcctgtgggaactcctcacaggagaggaaccatatgcagatttgcattatggtgttatcattggtggcattgtgagcaacactctgcggccgcaggtgcctgactcatgcgacccagagtggaggtcgctgatggagcatgctgggcgacagaaccgtcggaacggccagcttcacccagatcgccgtcaggtcagtctgaagaatgtggtgatgaactggttgtgtaatctgggtggtgtaatacagtttttgggaactgtcagttgaggtcctatattgcttgtatatgcttggtttttcgtgtgtttgttatgtataccgaaatggttcggtgtcgctgtaaaaagggtccagttgtt

SEQ ID NO: 4005 - DNA, 1193 bp, Triticum aestivum
ctttgctgaagaattccaagagcctggatcgacgcaaacggctaattattgccatggacacagcttttggaatggagtatctgcataacaaaaacattgtgcactttgacctcaaaagtgacaatttacttgttaatttaagggatcctcagcgtccaatatgcaaggttggtgatcttgggctttcaaaagtcaaatgtcagaccctcatctctggtggtgtgaggggaacgcttccatggatggccccagagcttctgaatggaagcagcagcctggtctctgaaaaggttgatgtcttctcctttgggattgttctgtgggaactcctcacaggagaggaaccatatgcagatttgcattatggtgttatcattggtggcattgtgagcaacactctgcggccgcaggtgcccgactcatgcgacccagagtggagtcgctgatggagcaatgctgggcgacggaaccgtcggaacggccaagcttcacccagatcgccgtcaggctgcgcgcaatggcagcgtcccagaaggtgcaatcctagtagcgccagcagtggtcttgaaaaaacttctggggccatccatccgtcttggacaagttcgtcttcgcatattgcgtattttaggaaatccggtgctgagatatataaatattatatatatggcttggtctcgttctttcatagcgtcggtcggtcggtccctagggtctatctatctgttcataccccttcagttgtttcataccttgtaatcataaatcatcagccctccctcccaacctccccgtgtctagaagtgtcggtcggtcgtcgtcccagatccgtattcatgtcgatgtgatacccttccccttttggctttggcttaagaggcgcgctgaataagccagtcttattgtctagtttatacgagagtcccgatatcttttattgttattgtgtcctttcccctttctgtgctcgcccgtgcgcttcgtgctctgtgcggctatatgaatgcgtagttcgtggttgtggtaaagttcgcttgtgtcgcgatctaggtctacggtctaggtctagtctgtaagatatgtggtgatgaactaggttgtgtaatctgggtggtgtaataacaagtttattgggaaactgtcagattgaggtcctatattgcttgtatatgacttggtttttcgtgtgtttg

SEQ ID NO: 4006 - DNA, 796 bp, Triticum aestivum
  misc_feature (617)..(644): n = any nucleotide
caatgtgctcttcaagcaacatccaggacatgctgacggtgacagtgcagtgctcgctgagaccgggactcctggttcaactgccagaagctgaagctgcccgagggctgcgggtatgaattccaaatgcagtatggctcgattggatggtcggtgggtgcattgctcgggtacgcgcaaggcgcaagcgaaaagcgtgttatagcctgcattggtgatgggagcttccaggtgacagcacaggatgtgtcgactatgctgcggtgcgaacagaacagcataatcttcctgatcaacaatggcgggtacaccatcgaggtggagatccacgacggaccttacaacgtcatcaagaactggaactacaccgcccttgtggaggccatccacaacggggagggcaaatgctggactgccaaggtgaagtgcgaggaggagctgacggcggcgatcgagatggcgctgggggagaaggaggactctctctgcttcatcgaggtgatcgcgcacaaggacgacaccagcaaagagcttctggaatggggctccagggtctctgctgccaactccaggccacccaatccccagtagacagaccgaccaaagccacgcctgcnnnnnnnnnnnnnnnnnnnnnnnnnnnncgcacgttgcccatcaaataatgttgaacagtttatctttgctcttctgttatgttcttagttttgtgccttgtagtgacttgtgccatcgcctgtgttctatcctgccaatgctacgaagattatgagatatttttagcttccctcagcta

SEQ ID NO: 4007 - DNA, 930 bp, Triticum aestivum
atttgggtgtgttctgatgaaggacttcctgcatgcacttggaacccggctgaagaagaacacagctgcctacgacaactacagtcggatttttgtgcctcagggcgaacccctttcctctgcgcctggagagcctttgagagtgaatgtacttttcaagcatattcagaaaatgctgtctggcgactcagctgttatagcagagactggggactcatggtttaactgccagaagctgaaactgccagaaggctgtgggtatgaatttcagatgcaatatggatcaattggttgggctgtgggtgcaactctgggatatgcgcaggctgctaagggtaagcgagtcatttccttcattggagatggcagctttcaggtgacggcacaagaagtgtcgacgatgctccggtgggaacagaacaacatcatctttctcataaacaacgggggttacaccattgaggtggagatccatgacggcccttacaacgtcatcaagaattggaactacaccggcgtggtggaagcattccataatggcgagggcaagtgctatacggccaaggtccgaacagaggaggaactgaagaaggcaattgaggcatccctaggacccaacaaggacagcctgtgctttatagaggtaattgttgcacaaggatgacactagtaaagagcttcttgagtggggttctagggtttccgccgcgaatagccgcccaccaaatccccagtgacacatcaggtctccacaagatcctcatccagcttaatgatgtcatgtggaagttctgaatagatgttactgttctctgaataaatcatccatttgagtccattgctgttgcaagtgctcatggttactgtacatagatggtcttagttcaggaacctgtgcttgtatattacttcaataaatctgaaatcgat

SEQ ID NO: 4008 - DNA, 1193 bp, Triticum aestivum
cctatttgtttgctggcccgatatttaatgactacagctcggttgggtactcgcttcttctcaagaaggagaaggccatcattgtccagccggaccgagtcgtgattgggaatgggcctgcatttgggtgtgttctgatgaaggacttcctgcatgcacttgcaacccggctgaagaagaacacagctgcctacgacaactacagtcggatttttgtgcctcagggcgaacccctttcctctgagcctggagagcctttgagagtgaatatactttttaagcatattcagaaaatgttgtctggcagctcagctgttatagcagcagactggggactcatggtttaactgtcagaagctgaaactaccagaaggctgtgggtatgaatttcagatgcaatatggatcaattggattgcgtcctgtgcggatgctactactgggagatagcgcatggctgctaagcgataaagcgagtcatttccgtatcagttggagatggcagctttcaggtgacggcacaagaagtgtcgacgatgctccggtgggaacagaacaacatcatctttctcataaaccacgggggttacaccattgaggtggagatccatgacggcccttacaacatcatcaagaactggaactacaccggcgtggtggaagcattccataatggcgagggcaagtgctatacggccaaggtccgaacagaggaggaactgaagaaggcaattgaggcatccctaggacccaacaaggacagcctgtgctttatagaggtaattgtgcacaaggatgacactagtaaagagcttcttgagtggggttctagggtttctgccgcgaatagccggccaccaaatccccagtgaacgcaccaggtcaccaaagatcctcatccagcttaatgatgtcatgtggaagttctgaatagatgttactgatctttaaataaatcatccatttgagtccactgctgttgcaagggctcatggttgctgtacatagatggtcttagttcaggaacctgtgcttgtatattacttcaataaatctgaaatcgatgtcatagccagctaaagacgcccttgattttggcatctttcttgattttgacaacagtttcaggcttgttgtgtttctgaaaagcatttgtaagacaaaacaagttgcgtttctagaatgcgaataaga

SEQ ID NO: 4009 - DNA, 1735 bp, Triticum aestivum
tcgacgagcccggctgcgcctcgtcggctgctgcacgagctcacgcggggtacgcgccgacggctacgcgcggcccgcggcgtcggcgcctgcgcggtcaccttcaccgtcggcggcctcagcgtgctcaacgccatcgccggcgcctacagcgagaacctgcccgtcatctgcatcgccggcgggcccaactccaacgactacggcaccaaccgcatcctccaccacaccatcggcatcccggacttctcacaggagctacgctgcttccagaccgtcacctgccaccaggcggtggtgaccaacctggacgacgcgcacgagcagatcgacacggccatcgcgacggcgctcagggagagcaagccggtgtaccttagcatcagctgcaacctccccgggctacctcaccccacctttacccgtgacccagtccccttcttcctcgcccccaggatgagcaacaagatggggctcgaggctgcagtggaggcaactgtcgagttcctgaacaaggcggtgaagccagtgcttgtggccggccccaattgcgcgtggcgaaggcggggaaggccttcgtcgacctcgtggacgccagtgggtatgcctatgctataatgccatcggccaagggctttgtgccagagacgcacccccacttcctcggcacctactggggcgccgtcagcaccgccttctgcgccgagattgtggagtcggccgacgcctacctcttcgcaggccctatcttcaacgactacagctctgttggctactcgttcctgctcaagaaggacaaggccatcatcgtgcagcctgagcgtgtcatcgtcgggaacggcccggcattcggctgcgtcatgatgaaggagtacctgtctgcattggccaagcgggttcagaagaacaacactgcctacgagaactacaagaggatcttcgtgcctgagggccatccgctgaagggcgaggcgaacgagccgctgcgtgtcaatgtgctcttcaagcacatccaggacatgcttacgggtgacagtgcagtgctcgccgagaccggtgactcctggttcaactgccagaagctcaagctgcccgagggctgcgggtatgaattccaaatgcagtatggctcgattggatggtcagtgggtgcattgctcgggtacgcgcaaggtgcaagcgacaagcgtgttatagcctgcattggtgatgggagcttccaggtgacagcacaggatgtgtcaactatgctgcggtgcgaacagaacagcataatcttcctgatcaacaatggcgggtacaccatcgaggtggagatccacgacgggccttacaatgtcatcaagaactggaactacaccgcccttgtggaggccatccacaacggggagggcaaatgctggactgccaaggtgaagtgcgaggaggagctgacggcggcgatagagacggcgctgggggagaagaaggactctctgtgcttcatcgaggtgatcgcgcacaaggacgacaccagcaaagagcttctcgagtggggttccagggtctctgctgccaactccaggccacccaacccccagtagaccaagcaaacttgcctgcatcagtagtagtagcagcagcagaacgcacgttgcccatcaaataatgtggacagttatctttgctcttctgttatgttcttagttttgtgcctactagtgacttgtgagactgtaggccatcgcctgtgttc

SEQ ID NO: 4010 - DNA, 996 bp, Triticum aestivum
ctgttggctactcgttccctgctcaagaaggacaaggccatcatcgtgcagcctgagcgtgtcatcgtcgggaacggcccggcattcggctgcgtcatgatgaaggagtacctgtctgcattggccaagcgggttcagaagaacaccaccgcctacgagaactacaagaggatcttcgtgcctgagggccatccgctgaagggcgaggcgaacgagccgctgcgtgtcaatgtgctcttcaagcacatccaggacatgctgacgggtgatagtgcagtgctcgctgagaccggtgactcctggttcaactgccagaagctcaagctgcccgagggctgcgggtatgaattccaaatgcagtatggctcgattggatggtcagtgggtgcattgctcgggtacgcgcaaggggcgagtgacaagcgtgtcatagcctgcattggtgatgggagcttccaggtgacagcacaggatgtgtcaactatgctgcggtgcgaacagaacagcataatcttcctgatcaacaatggcgggtacacgatcgaggtggagatccacgacgggccttacaatgtcatcaagaactggaactacaccgcccttgtggaggccatccacaacggggagggcaaatgctggactgccaaggtgaagtgcgaggaggagctgacggcggcgatagagacggcgctgggggagaagaaggactctctgtgcttcatcgaggtgatcgcgcacaaggacgacaccagcaaagagcttctggaatggggctccagggtctctgctgccaactccaggccacccaacccccagtagaccaagcacgcctgcatcactagtagtcgcatccagcagcacgttgccatcaaataatgttgaacagtttatctttgctcttctgttatgttcttagttttgtgcctactagttacttgtgagctgtggccatcgcctgtgttctatcctgccaatgctaagaagatcatgagatat

SEQ ID NO: 4011 - DNA, 709 bp, Triticum aestivum
acaagttccctgatgcacatgtggatgaattcaaatcaatcgagaaattcaagatcttcaacactaacaacctatggggtgagcttgaaggctatcaagcgccttgtcgaggctgatgccctcaagatggagatcattccaaacccgaaggaagttgagggcgtgaaagtccttcagttggaaactgcagctggtgccgcaatcaggttctttgaccacgcaatcggcatgaatgttccgaggtcccggttcctaccggtgaaggcaacatcagatttgcagctagtgcagtctgatctgtataccttggtcgatggctttgttacacgtaatgcagctagaacaaatccatcaaatccctcaattgaacttggccctgagttcaagaaggttgggtgcttccttggccgcttcaagtcgattcctagcattgttgagctcgacagcttgaaggtttccggtgatgtttggtttggttctggcatcgtgctgaagggcaaggtgaccatcacagcaaaacctggtgttaagctggaaatcccagatggaaaagtgattgagaacaaggacatcaacggccctgaggacctttaaatgagcatcagaacatgctgactttacaatggcagatcgattttactatatagaatctgctatgagtcatacatgcaccatgacattgtggtgaatatctgtgatacagttgctt

SEQ ID NO: 4012 - DNA, 723 bp, Triticum aestivum
ggttcctgatgcacatgtcaatgagttcaagtcaattgagaaattcaagatcttcaacaccaacaatctatgggtgagcttgaaggctatcaaacgccttgtcgaggctgatgcactcaagatggagatcattccaaacccgaaggaagttgagggcgtgaaagtccttcagttggaaactgcagctggagccgcgatcaggttctttgaccacgcaatcggcatgaatgttccgaggtcccggttcctaccggtgaaggcaacatcagacttgcagctagtacagtctgatctgtataccctggttgatggcttcgttacacgtaatgcagctagaacaaatccatcaaatccctcaattgaacttggccctgagttcaagaaggttgggtgcttccttggccgcttcaagtcgattcctagcattgttgagctcgacagcttgaaggtttccggtgatgtttggtttggttctggcatcgtgctgaagggtaaggtgaccatcacagcaaaacctggtgttaagctggaaatcccagatggaaaagtgattgagaacaaggacatcaacggccctgaggacctttaaatgagcatcagaacatgctgacatcacaatggcagatcaattttactatatagaatctgctatgagtcatacatgcaccatgacattgtggtgaatatctgtgatacagtttgcttcaacataaatacattgaa

SEQ ID NO: 4013 - DNA, 551 bp, Triticum aestivum
  misc_feature (285)..(307): n = any nucleotide
cagggacccgtcgccggcggcgaggtgggcctggtggagggcggcgtgcggcgctgcacgcactgcgcctcggagaagacgccgcagtggcgaacggggccgctggggcccaagacgctgtgcaacgcgtgcggcgtgcggttcaagtcaggacggctggtgccggagtaccggccggcggcaagccccacgttcctgctgacgcagcactccaactctcaccgcaaggtgatggagctgcgccgccagaaggagctcgttctcatccgcggcagccaccgtctnnnnnnnnnnnnnnnnnnnnnnngccccggccccggggtgaccgtgaagccggagctcatgttccatgactacggcatatgttgatcgcttgagccggccgtacggatgtactcctagctagttagccgtgcatcatcgcgcgcccgcgcagcctagctagctagctagatccctttgcaaaattctcaggcctccttttcttcacttttcgcctttttttctcttcatatattttgcatctttttgttaattaatttgttggtacc

SEQ ID NO: 4014 - DNA, 1019 bp, Triticum aestivum
  misc_feature (287)..(304): n = any nucleotide
aactgtcgcccaccaccccgtccgccacgtcgtcggatcaccagacgtccatgctctccttcgccgacgagttctacatacctagcgaggaagctgcggagctcgaatggctatccaagttcgtgggacgactcctactcggacatgccgaattactcatcggccgcgcatgcggcaatggcggcggctaacgcggcgaacaacggcggtggcagctcggctggtcaagacagctgcgtcacagcggtgccagccgcggagcgcgaagcaagcggtcgcgcgcgagnnnnnnnnnnnnnnnnnnatggcactccctcatgccgcacccgccttcgcagccatcgccctcgtcctcgtgttcatcgtccgacttcccgtcctcaacgacggcacgacctagcggctccaactgcggcggtcgcggcaagaagcatggacccgttgccggcgcggaggtgggcctggtggagggcggcgtgcggcgctgcacgcactgcgcgtcggagaagacgccgcagtggcgaacggggcccctggggcccaagacgctgtgcaacgcgtgcggtgtgcggttcaagtctggacggctggtgccggagtaccggccggcggcaagccccacgttcctgctgacacagcactccaactctcaccgcaaggtcatggagctgcgccgccagaaggagctcgttctcatccgcggcagccaccgtctggacgcggtggcggcggctggccccggccccggggtgaccgtgaagccggagctcatgttccatgactacggcatatgttgatcgcttgagccggacgtacggatgtactcctagctagttagccgtgcatcatcgcgcgcctgcacgcagcctagctagctagctagacccctttgcaaaattcccaggcctccttttctcacttttcgctttttccccatatattttgcatctttttgttaattaatttgttggtacctacctcccttccaagttctactacgagtgatgaatatcaagatc

SEQ ID NO: 4015 - DNA, 934 bp, Triticum aestivum
gccagcactacgacagagttagggggtgggttggtttctctgtcaggttggctcatcgtatgaccgcaggagctgatatactgttgatgccgtcaaggttcgagccttgcgggttgaaccagctctatgcaatgatgtatgggaccgtgcccgtggtgcattcggtgggtggccttcgagacactgtccagcactacaatccatatgaggaggttgggcttggttggacttttgaaaatgcggaagcaaacaggatgatcgatgcgctggggcactgcctgaacacgtacaggaactacaagtctagctgggagggactccggaggagagggatgatgcaggacctgagctgggacactgctgctaaacgctatgaggaggttcttgttgctgccaagtatcagtggtgactggggaatggatccacgagcctactgatggttgtcattcacagactggaagacactcttgtgtgtttgcccagtgtcctaagtagagcatgttggttgaaactggaagacgaaatctttcctgtcagagcccaagtcattctcagcaatgcaactgttagcctacttcctaggcgaaagctgctgaagaggtgtttctttggaggaggtttaagcggcacatagaagattcagcggacagcggacaaacatcctcccttttgaaggaattgcaaacatggtgcatttctgaagcagcctctgttcccacaggatgagctcagttacatgctttatttagctcactagtatttagctcagtagagtacctaccagctagctcgggaatcattgcttggtttatttgattgattgatagctgggctgtacatcccgtctaggagtttgctgctgggttggtcatttcttagagcaaagtcatgtagatagacagttgtagcatgaggttacctggctttgagctt

SEQ ID NO: 4016 - DNA, 682 bp, Triticum aestivum
gcaccggatcacggcgggcgcggacgtcctgctgatgccgtcgctgttcgagccgtgcgggctgaaccagctgtacgcgatggcgtacgggaccgtgcccgtggtgcacgccgtcggcgggctccggggacacggtggcgccgttcgacccgttcggcggcaccgggctggggtggacgttcgaccgcgcggacgccggcaggatgatcgacgcgctcgggcactgcctcaacacgtactggaactacaaggagagctggaggggcctccaggtccgcggcatgtcgcaggacctcagctgggaccacgccgccgagctctacgagaacgtcctcgtcaaggccaagtaccagtggtgatgcgctcgctgatgctgacgcctctcctgcaatgcatgcacgtacttacgggaccgccggaatcggggccgacgatcacgatcactggcgccccggagtagccaagggtcacgcgatgccaccggcggcagccggacgacggtggaggtagaggtagtgaaccgtgcccgtggcgccacccaacttttgggttcacgggttgtatacaccagttcagtcgggttcgtggcgtctgtggattaccgagtcgtaggcgatcaaataggaagttgcagagtctgtatactgccattttctcggctcttggtgtggaaaaacacagt

SEQ ID NO: 4017 - DNA, 658 bp, Triticum aestivum
gaggacaagatcctgcgcgaggtcgcgcggtgcgcgcgtcgggcgcggcgcagcgtcgactcccagcttggacgagctgcgcgagatgcactacctccacgcggccatcacggagtcgatgcggctgtacccgccggtgcccgccgacacgcacagctgcaaggaggacgacttcctcccggacggcacggttcgtcgggaaagggtggctgatgacgtactgcgcgttcgccatggcgcggctggagggcgtgtggggcaaggactgcgaggagttcaggccggagcggtggctcgacgaggagggcgcgttccgggcggagagcccgttcaagtacgcggtgttccacgcggggccgaggatgtgcctcggcaaggagatggcctacatacagatgaagtccatcgcggcgtgcgtgctggagaggttcagcctccggtacgccggcggcgaggggcatcccaggctcataatgtcacttacgctgcggatgggaggcggcctgccgatgcaggtgaagagcagaacagaggtggctagctaggatgcttggagtagtccatttcgtcacgaatcacaattgctcatactccattttctgttgtgttcttgcttggttcgggcaaaaaaatcgctagcgggtttaaaggtgttcat

SEQ ID NO: 4018 - DNA, 520 bp, Triticum aestivum
tcacggagtcgatgcgctgtacccgccgtgccgccgacacgcacaagctgcaaggaggacgacttcctcccggacggcacgttcgtcgggaaagggtggctgatgacgtactgcgcttcgccatggcgcggctggagggcgttggggcaaggactgcgaggagttcaggccggagcggtggctcgacgaggagggcgcgttccggccggagagcccgttcaagtacgcggtgttccacgcggggccgaggatgtgcctcggcaaggagatggcctacattcagatgaagtccatcgtggcgtgcgtgctggagaggttcagcctccggtacgccggcggcgaggggcatcccaggctcataatgtcactgacgctgcggatgggaggcggcctgccgatgcaggtcaagagcagaacaggggaggctaacgcctaggatgcttcatgcttggaggagtcacaaatcacattgctctgtactccatttctgtagtgttcttgcttggttcggccactaaat

SEQ ID NO: 4019 - DNA, 830 bp, Triticum aestivum
aacatcccagcgaagaaggatcgcccaaccatccacaacggcgcgagcacctcggcgaactccggcagagcgagatggggagccgatgtcacacttcttgtgtgcgacgagtcgtttgcgcacacagggcatactggcctcacggtctccggttttcaaggcccagttcttcggagacatgaaggagaagtgctcggcacgcgtggagatcaaggacatggaggcggcggtgttcagggccatgctgcacttcatctacactgacatggtgcctgagcttgatcggccgctcgaggaggtgaccacgatggctcaacatttgcttgtggccgctgacatgtatggacttgagaggctcaagctgatttgtgaaataaagctctgtggttgcatcactgtggacaccgcagcggccactcttgctttggcggagcagcacgattgctcgaagctcaaggccaaatgtgtcgagttcatcgtcagcacgcctgctgttcttgaggctgtgttggcgacagatgggtataagcaccttgaagaaagctgccctctggtcctgactgagcttctcaagtctgtccatgtgagtaagagttgaagggtagcatagtgctaggcctccaagaattgaaaatgcatagtctctgtttgtgcttgcatccatgtgtgctgtacgtagtaaaaacttatgtctgaatttacctaaaatggaaaacttatgcgcatctatatatgttatgttatgagcaacttaatgctttcattgctcctccaatttcgatgtaatttagtacaatgtcgtccaagatttggttgcatgcttgtcaata

SEQ ID NO: 4020 - DNA, 670 bp, Triticum aestivum
acgcgaccccacaagcccgcagcctcctccgcaacagaaccgtctgccgtgttcaccatcgacgggtacgaggacgttccggccaacgacgaagcggcgctgaagaaggcggtgccgtgcagccggtggctgtggccatcgaggctagcgggtcgcacttccagttctactcggagggggtgttcgcgggcaagtgcgggacggagctggaccatggcgtgacggcggtggggtacggcgccaccgtggacggcaccaagtactggatcgtgaagaactcgtgggggccggagtggggcgagaaggggtacatccgcatgaagcgcgatgtggaagacaaggaggggctctgcggcatcgccatggaggcatcctaccccgtcaagacctcagccaacccgaagcatgccggtgcccatgacgagctctgaagtctgaatctctcatcgattatctaactaattattggcccctaatatgcatgatcagggcattatcgcaagggaaaaataaataaacaatcaattgatatgtacccatcacatatattagttgcactatacttaattatcatacatgtactgcggtttcgaccgatttgtatctaaacggtttacattatatatcctgtcacttttttttgtgaaacctcactcatatttaataatta

SEQ ID NO: 4021 - DNA, 723 bp, Triticum aestivum
ggcggctcatggactacgccttccagtacatcgccaagcacggcggggtggccgcagaggacgcgtacccctacaaggcccggcaggcctcctcctgcaacaagaagccgtccgccgtggtcaccatcgacgggtacgaggacgtgccagccaacgacgaagcggcgctgaagaaggcggtggccgctcagccggtggccgtggccatcgaggctagcgggtcgcacttccagttctactcggagggggtgttcgcgggcaagtgcgggacggagctggaccatggcgtgacggcggtggggtacggcgccaccgtggacggcaccaagtactggatcgtgaagaactcgtgggggccggagtggggcgagaaagggtacatccgcatgaagcgcgatgtggaagacaaggaggggctctgcggcatcgccatggaggcgtcctaccccgtcaagacctcagccaacccaaagcattctggtgtccatgacgagctctgaagtctgaatctctcatcgattatctaactaattattggcccccaacatgcatgatcagggcattatcgcaagggaaaaacaaataaacaatcaatcgtatgtacccatcacatatattagttgcactacttaattgtcatacatgtactgcggtttcgaccgatttgtatctaaacggtttacattatatatcctgcctttttttttttgtgcaaccttaccc

SEQ ID NO: 4022 - DNA, 723 bp, Triticum aestivum
gattgtttgcaggcaaagctgcttgatcatgatggaaaatcgtttgtggttgcagggctagatggtgattacaaaaggaacaagtttggctcagtactggacatcattcccctggctaactcggtcaccaagctaacagcacggtgtgagctgtgcgatcgccgggcgtccttcacattgaggaagacacaggaaaccaggaccgaactcattggtggagccgatgtgtatatgcctgtgtgcaggcagcactacttggacgggcagattgtcatcgaggccacaaggattgttatggatattgaaagatccacggaagtagctcgctgctagttaggggtgtgtgtggcttatccagaatatccctctcttcagtgtgtcattcatccaacagcgtgttgagatgtgctaccagtgtgtacctgttattgatcatctgtggcagcatgccagcctgagtttcagattatgaggcgttgccatattaccataggagaacttaattaagttgcgatttgagcagattgtaaatatttaccagttgggaatgttggtgcaaatagctcttcttttagaatacccacctgttgcgacacaatgggttataatacagtttctggctgggaagggaatgcttagtaatatgcgtttgttggttacaaacattggttggcatgaaattgtttgtctctatgaggtagaatgagaaactgaagaggtaac

SEQ ID NO: 4023 - DNA, 1048 bp, Triticum aestivum
  misc_feature (97)..(120): n = any nucleotide
cccgctccaccgcctccgcccgctgctctcgctccctttccggccggatctttcccgccccaggcccttcgcccccccggccaggtcgctctctaannnnnnnnnnnnnnnnnnnnnnnncagggctcggatagacgaacgtgtttcggggatggaggtccaggcggcgaattccggcgagattcacatcatcgtcgggcccatgttcgctggcaagaccaccgcgcttctccgccgggtccaggccgaggccggcaccggcaggactgtggcactcataaagtctgacaaagacaatcgatatggattggattctgttgtgacccatgatggcacaaagatggcatgctgggctctaccagagctttcaactttccaagataaattagggagagatgcttatgataaggtagatgtcataggtatcgatgaagcccagttcttcgatgatcttcatgatttttgcagcaaagccgctgatcatgatggaaaaatcgttgtggttgcagggctagatggtgattacaaaaggaacaagtttggctcagtactggacatcattcccctggccaactcggtcaccaagctgacagcacggtgtgagttgtgcgatcgccgggcgtccttcacattgaggaagacacaggaaaccaggaccgaactcattggtggagccaatgtgtatatgcctgtgtgcaggcagcactacttggacgggcagattgtcatcgaggccacaaggattgttatggatatcgaaagatccacggaagtagctcgctgctagttaggggtgtgtgccttatccagaatatccctctcttcagtactccaacagcgtgttgagatgtgctaccagtgtgtacctgttattgatcatctgtggcagcatgccagcctgaatttcaagttatgaggcaatgccatattaccataggagaacttaattaagttgcaatttgagcagattgtaaatatttaccagttggggatgttggtgcaaacatctcttctttttagaatacccaccttttaattcgaaaatgat

SEQ ID NO: 4024 - DNA, 1076 bp, Triticum aestivum
gacaactccgcgtccggtttaccccttcttctcccccgcccgctttcaccagagcgactccagaccacgagccccgccgacgaagccgccatcgccagacgccgcccccgagcaagaggggagcgccccactcccgacattcaagccgatcggagcgcgatccggcaggtcggagcccagccatgtcgggggttttcggcagggtgttcgggaagtccaaggagcagagccaggcgtccgcgctggcctccatcgacaagctcagcgagactcttgaaatgttggaaaagaaggaaaatttactaatgaagaaggcgaatcttgaagttgagaaggcaaaggcgttcaccaaagccaagaacaaaaaagctgcactacagtgtctcaagaggaagagattatatgagcaacaggtggagcagcttgggaatttccaattgaggattcatgatcagatgataatgctggaaggtgcaaaagctacaacagagactgtggatgcattgagaaccggagcatcagcaatgaaagctatgcacaaatcaacaaatattgatgatgttgacaaaaccatggatgaaattaatgacaatatggagaacatgaggcagatccaggatctactgtctgcgcctatgggagcagcaagtgatttcgatgaagatgagctggaagctgaacttgcggatttggagggcgaggagttggaggcacagctactagcaccaaccacaagtgctcctatgactgctccagcgcgtgtacctcagcagtcgagtcggcccactgctcagagtagtaaaaccgaagatgatgagctggcagctttacaagcagagatggctatgtagttagtttgcaggacttgggcgtgggcatgtttagagaccagattgtgcaaatatatttgggaccacggtattttcatggaggtcttcctgggaagacgtcagaagtgcacacagaaactagttgcatctcaccctgatgatctcttatgtatatcttatcatgttacttctgtaatcaaacatctaagatgcgctgttgagcgcattatcagctaataaagggca

SEQ ID NO: 4025 - DNA, 640 bp, Triticum aestivum
aggccagcacgtgctcctggacgccgacatgaacggccggctgggggacttcgggctgcgcggctgtacgaccacggcgtggacccgcagacgacgcacgtggtgggcaccatggggtacctggcgccggagctggtgcgcacgggcaaggcgacgccggtgacggacgtattcgcgttcggcgtgttcgtgctggaggtgacctgcgggcgccgcccgctggggtgcatcgcgcccgacgaccagaacgtgctgctggactgggtgcaggagcacgagcgcaggcgcgcggggctcgacaccgtggacccgcggctgtgcggcaagtacgacgccgacgaggcgcggctggcgatcaagctggggctgatgtgcgcgcacccgctgccggacgcgcggcccgggatgcggcaggtgacgcagtacctggagggcgaggtggccatgccggaggtcgtcccgacgttcctcagctacaccacgctggcgctgatgcagaacgacgggttcgactcgttcgccatgtccttcccgtccacggtcaccacggacgccagccccacctccggcgacgtctcggccgtctccggcctctctggcggaaggtgaataaacaaggacaagaagtggtagtcgccgc

SEQ ID NO: 4026 - DNA, 666 bp, Triticum aestivum
gcaccatggggtaccgggcgccggagctggggcgcacgggcaaggcgacgccggtgacggacgtgttcgcgttcggcgtgttcgtgctggaggtgacctgcgggcggcgcccgctggggtgcatcgcggccgacgaccagaacgtgctgctggactgggtgcaggagcacgagcggcggcgcgcggggctggacacggtggacccgcggctgtgcggcaagtacgacgccgacgaggcgcggctggcgatcaagctggggctgatgtgcgcgcacccgctgccggacgcgcggcccgggatgcggcaggtgacgcagtacctggagggcgaggcgaccgtgccggaggtggtgccgacgttcctcagctacaccacgctggcgctgatgcagaacgacgggttcgactccttcgccatgtccttcccgtccacggtcaccacggacgccagccccacctccggcgacgtctcggccgtctccggcctctcgggcggacggtgaatgaataaacaaggacaagaagtcgtcgtacgtagtagtcgctgcgtgagtcgttggtttgattcctcatctatcgtgacgtacgtacgtcatctgctgtaacactgagcagtggcacttttcctagtagtggataattaactgtgagcagtaatacagtgat

SEQ ID NO: 4027 - DNA, 718 bp, Triticum aestivum
  misc_feature (704)..(704): n = any nucleotide
acgaggactgggacaagatcgtgatccaccgcgacatcaaggccagcaacgtgctcctggacgccgacatgaacggccggctgggggacttcgggctggcgcggctgtacgaccacggcgtggacccgcagacgacgcacgtggtgggcaccatggggtacctggcgccggagctggtgcgcacgggcaaggcgacgccggtgacggacgtgttcgccttcggcgtgttcgtgctggaggtgacatgcgggcggcgcccgctggggtgcatcgcccccgacgagcagaacgtgctgctggactgggtgcaggagcacgagcgccggcgcgcggggctcgacaccgtggacccgcggctgtgcggcaagtacgacgccgacgaggcgcggctggcgatcaagctggggctgatgtgcgcgcacccgctgccggacgcgcggcccgggatgcggcaggtgacgcagtacctggaaggcgaggtggccatgccggaggtggtgccgacgttcctcagctacaccaccctggcgctgatgcagaacgacgggttcgactcgttcgccatgtcattcccgtccacggtcaccacggacgccagccccacgtccggcgacgtctcggccgtctccggcctctcgggtggaaggtgaatgaataaacaaggacaagatttctcatgtatcgtggtgtacgtcatctggtgnaacatgcagtagca

SEQ ID NO: 4028 - DNA, 742 bp, Triticum aestivum
cgactcgggctgcgcggctgtacgaccacggcacggacccgcacacgacgcacgtggtgggcaccatggggtacctggcgccggagctggggcacacggggaaggcctccaaggcgtccgacgtgttcgcgctcggggccttcatgctggaggtggcgtgcgggcggaagccggtggtgcaggacgcgcgcgacaaccacctggtgctggtggactgggtgctcgaccagtggcgcgccgggacggtcaccggcgccgtcgacccacgcctgggcggcgacgtcgtggaggaggaggcgagcctggtgctgaggctgggactgctgtgctcgcacccgctgcccggcgcgcggccgaccacgcggcaggtggcgcagtacctggacggcgacctcaagctgccggagctgtcgcccacgtaccagagcttcaacatgctggcgctcatgcaggaccagggcttcgacccctacgtcatgtcctacccgatgacctccatcaccgccggcaccatgtcccagatgtctgacctctccggagggaggtgatccgcggtcgtcggcgtgtaactaggaatgctgtctgctagcgtcttcatattttgtgtatgttcagaaccgggtgagtttttcttcgtgtggtagtacatggatcgataacctgaatggaaagtgttgtgcaatcatgctcggcatggttttatgttcagatgagatattaccgaccaaaaaagtgagattta

SEQ ID NO: 4029 - DNA, 736 bp, Triticum aestivum
gcaaaagccagcagtatcatattcctaccaacgatccgatacagaattttctgagctcacaacccgaagcaatcaacaccagcaatgtcgatcgtgcggcggagcaacgtcttcgaccccttcgccgacctctgggcggaccccttcgacaccttccgctccatcgtcccggcgatctcaggtggcagcagcgagacggccgcgttcgccaatgctcgcatggactggaaggagacccccgaggcgcacgtcttcaagccgaccttccagcgtgaagaaggaggaggtcaaggtggaggtggaggacggcaacgtgctcgtcgtcagcggcgagcgcaccaaggaaaaggaggacaagaacgacaagtggcaccgcgtggagcgcagcagcggcaagttcgtcaggcggttccggctgccggaggacgccaaggtggaggaggtgaaggccgggctggagaacggtgtgctcaccgtcaccgtgcccaaggccgaggtcaagaagcccgaggtgaaggccatccagatctccggctgagtgaatgcgtctctgcgaatgatcatcagggttggagccagtttggttaatgtgtgcgagttctgcaacctgaaagtatgctatagttgtgtcttcgtcttgccgagtctgatgagacatctctgtagtgcgtttctttccccagccgtgtatgttcttgtgtaatcgccaacagatttggcgatgaataaatgaaaa

SEQ ID NO: 4030 - DNA, 809 bp, Triticum aestivum
gcaagcatccccaccgacccgagaccgcgtgcgctccacgcagcatccccgcagcaccgccccagagaagtccccccggagaaggaggaggatgtcgtggcagaacgtacgtcgacgaccacctgtgctgcgagatcgacggccagcacctcacctccgccgccatcctcggccacgacggcagcgtctggggcgcagtccccccaacttcccccagttcaagcccgaggagattgctggcatcattaaagactttgaggaacctggacatcttgcaccaactggtcttttccttggaggcacaaagtacatggtcatccaaggtgaacctggggttgtcatccgaggaaagaagggcaccggtggcatcactatcaagaagaccggcatggccctgattcttggtatctacgatgagcccatgactcctggccagtgcaatttggtcgtggagaggctcggcgactacctggtcgagcagggtttctaagcccgccctgatatgatgttattttggtcgtctgggactaagtttgctctactgtgggctttgcatccatctgcttggcgtaccgcatgatatatgcagtgaataattttagcttggggtttgtcggttggtgacgtgtcgaagggaaaaaaaggattttactatgttttctttttaatgtttggcatcgcgtcgtatcaaactcagccgctctttcgctgagtaatgtacatttgcctcgtcatggtaacttgtgggttctgctgctgctttattgaagatgattgcatttttactgacgtgcttgcctggtactacg

SEQ ID NO: 4031 - DNA, 614 bp, Triticum aestivum
ctcagcagcccccctcacatcccccccaagctcaacctccccacacgctccaaccaccagcacccatggcacccaaggcggcggagaagaagccggtggccacggccgagaaggcgacggcggggaagaagcccaaggcggagaagcgggcgccggcgtccaaggaggccggcggcgaggggaagacgaggggcaggaagaagggcagcaaggccaagaagggcgtggagacgtacaagatctacatcttcaaggtgctgaagcaggtgcacccggacgtcggcatctcctccaaggccatgtccatcatgaactccttcatcaacgacatcttcgagaagctcgccggcgagtccgccaagctggcccgctacaacaagaagcccaccatcacgtcccgggagatccagacctccgtccgcctcgtcctccccggggagctcgccaagcacgccgtctccgagggcaccaaggccgtcaccaagttcacctcatcctagacagcttaggcttgatcctcgtcgcttcatgccttctgtgtgtacctagtcggcagtatgatgttacaatctttgtaaggattctgctgcttgcttgcggccttgaaagaaata

SEQ ID NO: 4032 - DNA, 892 bp, Triticum aestivum
  misc_feature (144)..(144): n = any nucleotide
tgcttaagagtcaatgattcattacttacatgcccgcaaaaaaaaatgatccattacttacatgcccaaggcgtcagactcctaacacatcatcacacaggccgtgtggatacaaccgacaataatttacatatataggagcanctcacatacatacagagcctccccggcgagctgctcggagcgttcataagctcgcggcagccggcgcccggggctccagaaatgtctacagcatcagcaacccccctcacatcccaccgaaaccccatcttcccacacgctccaaccaccagcacccatggcacccaaggcggcggaaaagaagccggtggccacggccgagaagacgacggcggggaagaagcccaaggcggagaagcgggcgccggcgtccaaggaggccggcggcgaggggaagcagcggggcaggaagaagggcagcaaggccaagaagggcgtggagacgtacaagatctacatcttcaaggtgctcaagcaggtgcaccccgacgtgggcatctcctccaaggccatgtccatcatgaactccttcatcaacgacatcttcgagaagctcgccggcgagtccgccaagctggcgaggtacaacaagaagcccaccatcacgtcccgggagatccagacctccgtccgcctcgtcctccccggcgagctcgccaagcacgccgtctccgagggcaccaaggccgtcaccaagttcacctcatcctaggcttcatcgtcgtcgttttaacgaatcgatgatgatgttctgtatgtagttggcagtacgatgttacaatatttgtaaggattgtgctgcctgtgtgtttgaagaaatagtgatgttgctgtttgaatacagggagcaagttcgtttttgttatcc

SEQ ID NO: 4033 - DNA, 816 bp, Triticum aestivum
agtgagaaacgaaaacatctacatgctggctttttccttacggtgtcccctgaatctattcagcttgttgctgagcatgctgctgcaaataacaaggttttcttgatgaacctctccgctccctttatctgtgagtttttccgtgatgcccaagagaaggttcttccgtattctgactacatctttggaaatgaaaccgaggcaaggatcttctctaaagtccgagggtgggagactgagaatgtcgaggagatcgctttgaagatctcacaactgcctctggcttctggaaaacaaaagaggattgctgtgattactcagggtgctgatccagtagttgtggctgaggatgggaaggtaaaaacattccctgtgatcctattgcccaaggagaagcttgttgacaccaatggcgctggtgatgcgtttgttggcggcttcctctctcagttggttcaagggaagagcatcgaggactgcgtaaaggccggttgctacgcagcaaacgttatcatccagcaatctggctgcacttaccctgagaagcctgacttcaactaggccaaattcagcgattctacggaaagcaacacttaaccgcttgatggttcggcttgttctccctgtattattttgaggctttccatctgatccggcctaattttcggccgtggatatctgttgtactgctataatcggtacctttatctttggtataaggcatggttgccattatatggggtgttacttgtggccgtcttatccaagtatatgccgaagcgtggtcagaccgacgatactgcttgaaggcacgag

SEQ ID NO: 4034 - DNA, 698 bp, Triticum aestivum
gaatctattcagcttgttgctgagcatgctgctgcaagtaacaaggttttcttgatgaacctctccgctccctttatctgtgagtttttccgtgatgcccaagagaaggttcttccgtatgcggactacatctttggaaatgaaactgaggcaaggatcttctctaaagtccgtgggtgggagactgagaatgtcgaggagatcgctttgaagatctcacaactgcctctggcttctgggaaacaaaagaggattgctgtgattactcagggtgctgatccagtagttgtggctgaggatgggaaggtgaaaacattccctgtgatcctattgcccaaggagaagcttgttgacaccaatggcgctggtgatgcgtttgttggaggcttcctctctcagttggttcaagggaagagcatcgaggactgcgtaaaggccggttgctacgcagcaaacgttatcatccagcagtctggctgcacttaccctgagaagcccgacttcaactagaccaaattcggcgatggtacggaaagcaacacttaaccacttaatggttcggcttgttctccctgtattattttgaggctttctatctgatccggcctatattttaaggccgtggatgtctgttgtactgctataattggtaccttaatcttttggtataaggcatggttgccattatatggggtgtt

SEQ ID NO: 4035 - DNA, 1011 bp, Triticum aestivum
ctggctttccctacgggtccctgatctatcagctgttgctgagcatgctgctcccataacaggttttcttgatgaacctctccgctccctgttatctgcgagttttttccgtgatgcccaagagaaggttcttccgtatgcggactatatctttggaaatgaaactgaggcaaggatcttctctaaagtccgagggtgggagactgagaatgtcgaggagatcgctttgaagatctcacaactgcctctggcttctggaaaacaaaagaggattgctgtgattactcagggtgctgatccagtagttgtggccgaggatgggaaggtgaaaacattccctgtcatcctattgcccaaggagaagcttgttgacaccaatggcgctggtgatgcgtttgttggaggcttcctctctcagttggtgcaagggaagagcatcgaggactgcgtaaaggccggttgctacgcagcaaacgttatcatccagcagtctggctgcacttaccctgagaagcctgacttcaactagaccaaccaaattcggcgatggtacggaaagcaacacttaaccacttaatggttcggcttgttctccctgtattattttgaggctttccatctgatccggcctatattttaaggccgtggatatctgttgtactgctataattggtaccttttatctttggtataaggcatggttgccattatatggggtgttacttgtggccgtcttatccaagtatatgcggaagcgtggtcagaccacgatagtgcttgaatgcagtggaattctatggacgtgtttgttttgtgagaagtatggcagagcgtggctacaggctaatgtggctaatggcatgtctgtcagtgaaccaagggcattatttgcctgtcgtggctagaaatagtgcagtgcgaatgtaagtcgctccttgtgacaaactgcgtgttcagactcgagaccaagaagcccctgctgcctgctacaagtacaggttccaactatat

SEQ ID NO: 4036 - DNA, 706 bp, Triticum aestivum
  misc_feature (26)..(26): n = any nucleotide
tttgatgtcaagtagatgtagacganacatgatttccggttgaattggtggtgtgcaaacagacgtgacattacattttattcgaaggataatagcaaacatatacacatctggcatgggaagcatcaccatcattacagcaaaccatgagggctgagcatttactcgatgatagttctcaacctagccaggcttccgagggaaggtcacatccaaaagggagtgttttggcaccaatggctggtttggtcgttaaggttctgcttaaggatggggtacacgtggaagatggtcagcctgtcatggttatagaagcaatgaagatggagcacgttgtgaaggcgcctcgggcaggttatatagaagggctgaaggctaccgctggacaacaagtttttgactccagtgtccttttcactgtcaaggataagagcacaaactgatgaaccaagaaattggagccacgcatcagaattcaagtggcgactccgcctttcagaaagaagaataagcaaaaaagcagctggagatcattctgtgactaaataatactaggtgatctccctagttagctggagatcatatcttccggtacccatttcctgtatagcgtgtacattagtgtcagtggcattgtgcaatgtaacaaatcatgtgagtatgtaacgcaatttgtctgccttgctttgtcccacgtgaaccttct

SEQ ID NO: 4037 - DNA, 1066 bp, Triticum aestivum
tccaaaattaattacactaggtagcattatcacgcatcgatgccgttacgtacgtgagccttgatcgctatacggccgccggcgacgtggaccgacttgatttggttccaagttacaagcgggacggcatgacgccgaatttgtcggcctcggtgacgacgtggttgcgggtgatgtcggccagcgagttgcagccgttcagcgccatggtcagctcgaactcgtcgcgcagcatcttgagcacgttgctcaccccggcctccccggccaccgccagcgagaacaccaccggccttccgatgaagacgccggcggcgccgagagcgagcgccttgaagaacgtcggtgccgcggcgcacaccgccgtccaggaagacggggatctgcccgccagcacccttcacgacctcttccagggcgctgatggtcgccgggacgtgtccagttgccgggcgccgtggttggacacgatgattccggccgcgccgttctcgacggcgtagcctgctgtcctctgcggtgatcactcctttcaccaggatcggcatcgtggtgatggactgcagccacctcacaaagacaagtcaacctcaccgaggagaagcagagagaagggagaagatgtcggggcgcggcaagggaggcaaggggctcggcaagggcggcgccaagcgccatcggaaggtgctccgggacaacatccagggcatcaccaagccggcgattcgacgtctggcacgtcggggcggcgtgaagcgcatctcggggctcatctacgaggagacccgcggcgtgctcaagatcttcctcgagaacgtcatccgcgacgccgtcacctacaccgagcacgcccgccgcaagactgtcactgccatggacgtcgtctacgcactcaagcgccagggacgcaccctctatggattcggaggctaggctccggcgaggcgaatccagctcgcacctgctgatcagatattcagattagcagtagctaggcgttgttcagtgttcatggtgatcgatgtaatttatgatgtatggtgcctgttcgttggaatggataaat

SEQ ID NO: 4038 - DNA, 377 bp, Triticum aestivum
  misc_feature (111)..(111): n = any nucleotide
  misc_feature (255)..(255): n = any nucleotide
  misc_feature (281)..(281): n = any nucleotide
  misc_feature (358)..(358): n = any nucleotide
  misc_feature (360)..(360): n = any nucleotide
  misc_feature (365)..(365): n = any nucleotide
  misc_feature (374)..(374): n = any nucleotide
ggttgaagatggatgggaagcagcagcattggccctcaaagggccatgaccaatcacctcagcgtgtgcttgagcttccactcgagcatgctcagccatggccatacgcancttagcttcagcacctcgcggcctgctttctccctagattctatctctgctcttagttccatcgaagcctgcttctcctcctgtaacaaagcttgctctagcatgagtcgctcctccgatcgaaactcaccaatggcccttttnttggtcattatgttgtatgccaacanttgcttctcaaaagttgttgtgaactcagcaatttttaccagaatgttatgatcccattgctgaagacgagagggantntggcnagttgcgtngct

SEQ ID NO: 4039 - DNA, 852 bp, Triticum aestivum
caggacccttgatagccacgcaactggccagattccctctcgtcttcagcaatgggatcataacattctggtaaaaattgctgagttcacaacaacttttgagaagcaagtgttggcatacaacataatgaccaagaaaagggccattggtgagtttcgatcggaggagcgactcatgctagagcaagctttgttacaggaggagaagcaggcttcgatggaactaagagcagagatagaatctagggagaaagcaggccgcgaggctgctgaagctaagatgcgtatggccatggctgagcatgctcgagtggaagctcaagcacaccctgaggtaattggtcatggccctttgagggccaatgctgctgcttcccaaggcgatgatggtcctagtcatgacatggcacaagaacaggttgaagatggatgggaaaacactcaaagggatgatgatgatccatccgaggatttcctcaatgatgagaatgaaccagagaatggaaactctgatatgcaagaggagtggcggcgatcgggggaatttgatctaaactctaggtaagactgcaaggggtacggcgtcggtggtggcaatctgatctgaactctaggcaagataggtgcacccgacttgagaaaaggcttgaggatgcatcggctggtgcctggtaacttgtctctagttatctgattatatatgttttgaagataacttgtcctgtcattgtggctgtaaacacgcaattcaaaactagtactatttagcttttctttttgagaaaactagtactccctccgcaaactaatataagagcactactcatgtgtttaaacagtgtttagaatgtt

SEQ ID NO: 4040 - DNA, 737 bp, Triticum aestivum
tgaaggtttctttccttgctgttagggcatcacaaggaaaatggcaagcagagcaggtggcgatggcaaagaacccataaatgagcaagtagttgcaaatacctatgccacatgcgcactgaaatgaaccagctctacaccaagatcacggagctggaaatggaagtcagtgagcacgcccttgtgattggcgcaatagagccctggaccccacaaggcgttgctacaggatgattggcggagtcttggttgagaggaccatcagggaagtcttgcccgccgtgcaccgcaacaaggagggccttgaagaggtcgtcgctcgcatgaaggaggctctggagaggaagaagcaagagatcaccgagtttgagctcaagtacaagatcaggatcaggaagggcgacaacagcgccaacgaagaaggcagcatgaaggaagcctctgcccagggtgttcttgttggccttgcgggccagtagagcagaatggcagggcaaggagacttgcacagttctttatcgaagccagattgcttgttaccggatgccaacctgacagtgattgtgtgtttctgggtgcagtttatcatgctacacctatgcagtactgttgaatcctcgcgtgtaaaactagagattatggtagatcaggactctgttcgtaaactgcagattttgcgctggttgtgtcatgactcgcgtgtcttttgtctcccttatgttgttgcgctttaacac

SEQ ID NO: 4041 - DNA, 824 bp, Triticum aestivum
agatctcccatcggcggcggcgcgcgcgaaggtttctttctttgctgttagcgcatcacaaggaaaatggcaagcagagcaggtggcgatggcagagaacccataaatgagcaagtagtcgcaaatacttatgccaacatgcgcactgaaatgaaccaactctacaccaagatcacggagctggaaatggaagtcagtgagcacgcccttgtgattggcgcaatagagcccctggaccccacaaggcgttgctacaggatgattggcggggtcttggttgagaggaccatcagggaagtcttgcccgccgtgcaccgcaacaaggagggccttgaagaggtcgtcgcccgcatgaaggaggctctggagaggaagaagcaagagatcaccgagtttgagctcaagtacaagatcaggatcaggaagggcgacaacagcgccaatgaagaaggcagcatgaaggaagcctctgcccagggtgttcttgttggccctgcgggccagtagagcagaatgacagggcaaggagacttgcatggttccttatcgacgccagattgcttgttaccggatgcccgcctgacagtgattgtgtgtttctggatgcagtttatcatgcagtactgttgaatcctcgcgtgtaaaactagagattatggtagaccgggactctgttcgtaaactgcagattttgcactggttgtgtcatgactcgcgtgccttttgtctcccttcttgttgttgcgcttcagaatatttctgtctgttgatgacatgttttgattcaagatgagtttcaaagaaattttaccgcattgaaatgt

SEQ ID NO: 4042 - DNA, 717 bp, Triticum aestivum
gtgcgccgccaagacccataatgaccattagtcaaacacttatgccacatgcgcactgaaatgaaccaggctctacaccaagatcacggagctggaaatggaagtcagtgagcactccctggtgattggcgcaatagagcccctggaccccacaaggcgttgttacaggatgattggtggagtcttggttgagaggaccatcagggaagtcttgcccgccgtgcaccgcaacaaggagggccttgaagaggtcgtcgcccgcatgaaggaagctctggagaggaaaaagcaagagatcaccgagtttgagctcaagtacaagatcaggatcaggaagggcgacaacagcgccaatgaagaaggcagcatgaaggaagcctctgcccagggtgttcttgttggccctgcaggccagtagagcagaatggcaggacacaaggagacttgcatagttctttatcgaagccagattgcttgttaccggatgccaacctgacagtgattgagtgattgtgtgtttctggatgcagtttatcatgctacacttatgcagtactgttgaatcctcgcgtgtaaaactagagattatggtagatcagaactctgttcgtaagctgcagattttgcactggttgtgtcgtgactcgcgtgtcttttgtctcccttctgttgttgcgcttcagatcttttctgtctgttgatgacatgtttcgattc

SEQ ID NO: 4043 - DNA, 583 bp, Triticum aestivum
acgagcagccccacacgattgcggcggacctggtcttcatcatcgacgagaagccgcacccggtgtacacccgggacggcaacgacctggtggcgacgcagaagatcccccttgccgaagccctgacggggtacacggtgcacctgacgacgctggacgggcgcagcctgacggtgcccatcagctcggtgatccacccggggtacgaggaggtggtgcgcggcgagggcatgccgatccccaaggacccgtccaggaagggcaacctgcgggtcaagttcgacatcaagttccccgccaggctcaccgccgaccagaagtccggcgtcaagaggctcctggggcagtagggcgtgcccagggagccttgtctgtctgtgtgttgttgaactgaacaggggatgtgagatgagatattgcctgcttttggagcatcggcgatcaccgagttggccctgtggactagatgatgagaaaatgtatacaatgtgaacttgaggtgcatagataggtaaatcttggatcaagtgcatttcttgtaagcttttggagatcgaagttcgtccgctggatgacttaattt

SEQ ID NO: 4044 - DNA, 742 bp, Triticum aestivum
  misc_feature (22)..(22): n = any nucleotide
tgaagaaggcaccaaaatcacnttcccggaaagggcaatgagcagccccacacgatcgcggcggacctggtcttcatcatcgacgagaagccgcacccggtgtacacccgggacggcaacgacctggtgcgacgcagaagataccgctggcagaggcctgacggggtacacggtgcacctgacgacgctggacgggccgcagcctgacggtgcccatcagctcggtgatccacccggggtatgaggaggtggtgcgcggcgagggcatgccgatccccaaggacccgtccaggaagggcaacctgcgggtcaagttcgacatcaagttccccgccaggctcaccgccgaccagaagtccggcgtcaagaggctcctggggcagtagagcaggtctgtgtgtgttgttgaactgaatgcaggggatgtgagatgctgcctgcttttggagcatcggcgatgatcgagttggccctgtggattagatgagaaaagtgtatacgacgatgtgaacttgaagtgcatagataggtaaatcttggaagtgcatttcttgtaagcttttggtgatcgaatgtggtctgctggacgagctattttttgttgtacctggcttctgtttggattagttatgcggtagaggtaataaaatggtttcatggttgtccaaaaaactgcgtgtacatttgtacgctaccggctgatgttattacattgcttgtaaaaccttgcagactggaattc

SEQ ID NO: 4045 - DNA, 536 bp, Triticum aestivum
atcctcaccatcaccaaccagttccaggcgctggtgggcatctcgctgatggagatcctgtccaagcactcctcggacgaggtgtacctggggcagcacgagacgccggcgtggacgtcggacgccaaggcgcaggaggcgttcaggcggttcggggcgaggctggagggcatcgagaagcaggtggtggccatgaacggcgacccgcggctcaagaaccgcaccgggccggccaagttcccctacatgctgctctaccccaacacctccgaccacaccggccaggccgaggggctcacggccaggggcatccccaacagcatctccatctgaggacctctatctctgcttgcttgcttgcaccggatactagctactagctatatgcttgccatgatctcagtaataaggcaataatgcgtgtgtgcacgacgggtccgatcggcatgcggaagctcagctggctactgcctaccggttaatgcatcgtcgtgtacagaaaaattcccttcttttttgtccaataatgaagtcga

SEQ ID NO: 4046 - DNA, 714 bp, Triticum aestivum
gcagacggtggcggagctgatcaaggcctgcgccaccatcatctggaccgggtcggcgctccacgcggccgtcaacttcgggcagtacccctactcggggtaccaccccaacaagccgtcggcgagccggcggccgatgccggcgccgggcagcgaggagtacgccctgctggagcgcgacccggagaaggcctttatcctcaccatcaccaaccagttccaggcgctggtgggcatctcgctgatggagatcctgtccaagcactcctccgacgaggtgtacctggggcagcacgacacgccggcgtggacgtcggacgccaaggcgcaggaggcgttcaggcggttcggggcgaggctggagggcatcgagaagcaggtggtggccatgaacggggacccgcggctcaagaaccgcaccgggccggccaagttcccctacatgctgctctaccccaacacctccgaccacacgggccaggccgaggggctcacggccaggggcatccccaacagcatctccatctgaggagctccatccctgcttgcttgcttgcttgcaccggatactagctagtgtgggtgttctgctggtgcatatgctttgccatgaccacaataataaggcaataatgcgtgtgtgcacgacgggtccgatcggcatgcggtgcgtcgtcgtgtacagaaaaattcccttcatttgcccaataataa

SEQ ID NO: 4047 - DNA, 782 bp, Triticum aestivum
tcatctgacggggtcggcgctgcacgcggccgtcaaccttcgggcagtacccctactcgggggtaccaccccaacaagccgtcggcgagccggcggccgatgccgtcgccgggcagcgaggagtacgccctgctggagcgcgccccggagaaggcattcatcctcaccatcaccaaccagttccaggcgctggtgggcatctcgctgatggagatcctgtccaagcactcctccgacgaggtgtacctggggcagcacgacacgccggcgtggacgtcggacgccaaggcgcaggaggcgttcaggcggttcggggcgaggctggagggcatcgagaagcaggtggtggccatgaacggggacccgcggctcaagaaccgcaccgggccggccaagttcccctacatgctgctctaccccaacacctccgaccacacgggccaggccgaggggctcacggccaggggcatccccaacagcatctccatctgaggacctccatctctgcttgcttgcttgcttgcaccggatactagctactagctactgtgggtgttctgccggtgcatatgcttgccatgatctcaataataataaggcaataatgcgtgcgtgcacgacgggtccgatcggcatgcggtgcgtgtgcgtcgtcgtgtagagaaaaattcccttcatttgcccaataataaagtcgatgttgtgatgttccctctgcttgggcgttgtaagctcctctgtttgctctgttttcggatcaagttcaagttgctcaatagcat

SEQ ID NO: 4048 - DNA, 833 bp, Triticum aestivum
cgcacgcgcgcgcgcccgtcagcgccccatcgagagaactgcgtgctccctcgagagctctacaagggaccaccaagaagatgaagatctccagggagatcgccgatgccagcgggaagacgattccggtggaggagattctgacgatcgacgtgaagccggggtggaagaagggcacgaagatcaccttcccggagaagggcaacgagcagccccacacgattgcggcggacctcgtcttcatcatcgacgagaagccgcacgcggtgtacacccgggacggcaacgacctggtggcgacgcagaagataccgctggcggaagccctgacaggctacacggtgcacctgacgacgctggatgggcgcagcctgacggtgcccatcagctcggtgatccacccggggtacgaggaggtggtgcgcggcgagggcatgccgcttcccaaggacccatccaggaagggcaacctgcgggtcaagttcgacatcaagttccccgccaggctcaccgccgaccagaagtccggcgtcaagaggctcctggggcagtagagcaggtctgtgtgtgttgttgaactgaacgcagggggatgtgagatgctgcctgcttttggagcatcggcgatgaccgagttggccctgtggattagatgagaaagtgtatacgatgtggacttggaagtgcatagataggtaaatcttggaagtgcatttcttgtaagcttttggagatcgaagttcgtctgctggatggcttattttttgttgttcctggcgtttgtatggattagtgatgcggtagaggccaataaagtggtttcatagatcccc

SEQ ID NO: 4049 - DNA, 833 bp, Triticum aestivum
cggacgcgtggttgtccacacacatttccttgtagttttggtgtgtaccacgagcaccccgtctcatctcatcccatccaagctagacaagtcccgcactgtgctgtggtgctccatctagccagcttttttgctcagcttagcttccaaatctgctccacagctccggcggcacaagaagaaaatatccgtgcgtccgcgagaggaagggagatcgtccatggagaaggacaaccacaaggagggggagggggcgacggcgtggatgacggtgccggcgttcggggactgggacatgaagaacggcgccatgccggactactccatggacttctccaagatccgggagatgcgcaagcagaacaagaaggagctctcccgcgccagcctcggcggcgacgacgacctcctcgcccaccacaagcatcagcaccagcagcaccagcccgccgccaaggctccccagcccaccaagctcggcgctccggccaaagaccacggcccgctccacggccgcgaccactcgcccacgggaaggaagaggttcctgagctatttccagtgctgcatcaaggcctgaagaccagctgctgccactgccctccgtcgaggtgtcgcagcatgaagcagcttagcaaatttagcctaggcttctttggtgtttggtcaagcttgcaactcaatgtgtaatataattccacgtcctgacgctgcctgtttagagaacgggacggtttatgtggggaacagattgcttgtgaatgtcaaggttactatcttgcctagtagtaataatattcactgtgagaaatggcatctgatatgataatttt

SEQ ID NO: 4050 - DNA, 566 bp, Triticum aestivum
cacgcgttcctggcgaccaagctgccgccggagcaccgcatctacgacccggacaaggagacggtcgactccggcatgtcgacgttcctcacggcgttccccaggggcttcgccatcgaggtgctggacgtgtacagcggcccgccgagggtcgccttcaagttccggcactggggttacatggaggggccgttcaaggggcaccctcctcacggccagcgcgtcgagttctttggggtctgcgtcttccatgttgatgaggagatgaaggtggagaaggcggagtacttctacgagcgcggcaacttcctcgcaagcttcttgagcgcgcctgctatctgctgctgctgcatcggcttcaggttgtcctgtgatgagaggaaactgaagcaccaaagaaacatgtcgctcatatcgttggatgaccagcttcagatttcaaattggcttttgatttcatgtggtggcattacaatgtttgaataaagtggcttattatgtctggtacaaacaccacttcgggtgtgtaggtgtaagaagcccaacttggatttggacatcgctat

SEQ ID NO: 4051 - DNA, 1028 bp, Triticum aestivum
cacacctagaccacaagcatcaaaggcaagcaagcagtagtaaccacaaatcaaacatgaagaccttcctcatctttgtcctccttgccatggcgatgaacatcgccactgctgctaggcagctaaaccctagcaacaaagagctacaatcacctcaacaatcattttcccatcaacaacaaccatttccacagcaaccatatccacaacaaccatatccatcacagcaaccatatccatcgcaacaaccatttcccacaccccaaccacaatttccccagcaatcacaacaaccatttacccagccccaacaaccgacccccctacaaccacaacaaccattcccccagcaaccccaacaaccacaacaaccttttccacagccgcaacaaccatttccctgacaccacagcatccgcaagcccctcacatcccacaccaagccccacgctcgaaccaccacaccaccagcacccatggcacccaaggcagcggagaagaagccggtggccacggccgagaagaccaccgcggggaagaagcccaaggcggagaagcgggcgccggcgaccaaggaggccggcggcgaggggaagacgaggggcaggaagaagggcagcaaggccaagaagggcgtggagacgtacaagatctacatcttcaaggtgctcaaacaggtgcacccggacatcggcatctcctccaaggccatgtccatcatgaactccttcatcaacgacatcttcgagaagctcgccggcgagtccgccaagctggcccgctacaacaagaagcccaccatcacgtcccgggagatccagacctccgtccgcctcgtcctccccggcgagctcgccaagcacgccgtctccgagggcaccaaggccgtcaccaagttcacctcatcctaggctggcttcgttgttgtttcatgagttgatggcggcaggcgtcgtgtacgtagtcggcagtagtacgatgttacaatctctgtaagaattgtgctgcttgtgtttctgaagatatag

SEQ ID NO: 4052 - DNA, 647 bp, Triticum aestivum
gcattagtgcagtgcgagatgcatttgagaagtctcttggctttcgactgcaaaagatgaatcctaataccgattaccattgtttgaaaacatttggatcttacttcagggaagacattcgaatacctgcaggtacaaagatcgacttccgtcaaacatgtgatggccagcttataactgaagttgatggcaaacaaattggtgctgtccagagcaaagatctttgcagggctttcttcgatatgtatatcggtgacccgcctgtttcagtggagaccaaacaagacatcgctcagaatgtgggtggactcattagaagatgctagggtaatggctaactaaatagccggcggttggaattatttgattcttctattaggggggaaagagcatatatatagatacgggaaaccaggagaagatcggttgtatgtatagtagtgatagatctgtaacttgtaaactatagactggcagaacttgtaacttgcagaggcttagcatcttctcctgggcaaatgcctccatgattttcatatgggttggcattttgctgtttcctggattgtatcatgtacactgatccagttagaagtgtagcagagagcgcgtgtttcctgcatcatcaatatcaaaatcatggcttc

SEQ ID NO: 4053 - DNA, 543 bp, Triticum aestivum
atcttctaagggaaaatattcatatgacagtcagactggtagttagctacaatgggcttagcattagtgcagtgcgagatgcatttgagaagtctcttggctttcgactgcaaaagggaagacattcgaatacctgcaggtacaaagatcgacttccgtcaaacatgtgatggccagcttataactgaagttgatggcaaacaaattggtgctgtccagagcaaagatctttgcagggctttcttcgatatgtatatcggtgacccgcctgtttcagtggagaccaaacaagacatcgctcagaatgtgggtggactcattagaagatgctagggtaatggctaactaaatagccggcggttggaattatttgattcttctattaggggggaaagagcatatatatagatacgggaaaccaggagaagatcggttgtatgtatagtagtgatagatctgtaacttgtaaactatagactggcagaacttgtaacttgcagaggcttagcatcttctcctgggcaaatgcctccatgattttca

SEQ ID NO: 4054 - DNA, 574 bp, Triticum aestivum
gaaatctcttggctttcgactgcaaaagatgaatcctaatactgatgaccattgcctgaagacatttggttcttacttcagggaagacattcgaatacctgtgggtacaaagatcgacttccgtcaaacatgtgatggccagcttataactgaagttgatggcaaacaaattggtgctgtccagagcaaagatctttgcagggctttcttcgatatgtatattggtgacccacctgtttcagtggagaccaaacaagacatcgcccagaatgtgggtgggctcattagaagatgctagggtaagagctagacggtctgtaattatttcattcttctatacgggggaaagggcatatagagacgggaaacctaggagaagatcagttgtatgtatagtagtgatagatctgtaacttgtaaactatagactggcagaacttgtaacttgacagaggcttagcatcttctcctgggcaaatgcctccatgattttcatgattggttggcatttgctgtttccttgccattgtatcatgtacactgatcccgttagaagcgtagcagagagcgcgtg

SEQ ID NO: 4055 - DNA, 984 bp, Triticum aestivum
  misc_feature (288)..(288): n = any nucleotide
cgcgatgacatcgaggatgtgcagcggagtccagatcatgcaccacctcacgggtcaccgcaacatctcgagctcccggcgcctacgaggaccgccactcggtcaacctcatcatggagctatgtgagggcggggagctattcgaccgcatcatcgcgcgggggcactactccgagcgagccgccgccctgctctgccgcgagatggtctccgtcgtgcatagctgccactccatgggggttttccaccgggatctcaagcccgagaactttttgtttctcaacacanaggaggactcgccgctcaaggccactgactttggcctctccgtcttcttcaaacacggggagcagtttaaggatctcgttggaagtgcgtattatgttgctcctgaggttctgaagcggcactatggagcagaagctgacatatggagtgcggggattattctgtacatccttctgtctggtgttcctcctttttgggcagacaatgaggatggcatatttgaggctgtcttgcttggtcacatacttaaaacatttgaatattttgataaggaccacagcggatacataacacaatgcacatgaatagattggagaaggaagaccacatacttaaaacaattaaagatattatcgctgaagttgatacagatcatgatggaagaatcaactaccaggagttcgttgccatgatgagaaacaacagcccggagattgttccaaatcggcggcgcatgttctaattatcttctaccgtaacatcttcctggccccattatcgtccaagaataattttgagggatgtgccgctttgatgttattgtccctcatctttagatttggcgtgtatttccttgatcacatgatcggttccattgctgctccgagggtattatgatcatatgcgtactcctcctgatcatttatatggaaacaggcgttgtgtaacagttttttaatgattatgttaagcagc

SEQ ID NO: 4056 - DNA, 588 bp, Triticum aestivum
gagatactaccactcaagccgtgaccgagatactgaccactcaagccgtcaccgtgatactggccgttcaagccatgaccgagagcgtgatcattcaagccgtcaccgagagcgagatcgttcaagccatgacagagagcgtgattatgaccgtcacagcagggattgtgactattacaggtccaggcattcagaagaaagaagggattaccgaagcaagcgtgacaatagtagacacagacgctccagctcatgtcataggagcataagccggagtcgtagcaggagcaggagcaggagccggagtcggggcaggaatgaacatcgatccagtccatttggggatacaagcaaagaaaaggctgctgctgcctcgagcaacctagctaagctgaaagacctgtacggtgacgtaactgagaagaaggatgacgctgatgccatgcggcttcaccatgattcatgtgccgaggaggttattaggctgggaggccctaggtggagataaatttgaaccgccgaactgtcattaaggttatgttactccactgttcgatctaccggcttctgcattgacattagtgagag

SEQ ID NO: 4057 - DNA, 679 bp, Triticum aestivum
tgaaaggtggaggagccagaagaatcagtgccggagcttcctgcaactgcaagtagcgagcctgctgtggtaactgaggaagtagcagcctcggatgagaaaaccacagaggtttctgctgctggagctgcagaagcaagcacaaccacagcaactatttctcctgctcttgtcaagcagttgcgtgacgcaactggagcaggcatgatggactgcaaaaaggctcttgctgaatcgagtggtgacattgataaagctcaagaattcctccggaagaaagggctggctgctgctgacaagagggctggaagagccactgcagagggaagaattggttcttacatacatgacagcagaatcggtatccttattgaattgaactgtgagactgactttgtatcacgaggtgatgtctttaaggagttggtcgatgatcttgccatgcaagctgctgcttgccctcaagtaaattacatttccattgacgatgtccctgaggaggttgtgaagaaggagacagagttggagatgcagagggaggacttgctgtcgaagcctgagcagatccgcgctaagattgtcgagggccgagtaaagaagaggcttggagaatttgcattgcttgaacaaccattcatcaagaatgacaaggtcacaacgggtgaatgggtgaagcaaa

SEQ ID NO: 4058 - DNA, 691 bp, Triticum aestivum
gccttcgacgtggcaacccggacgggtactggaaggcgccctacgcgctcatctaccgcacatggccatcctcggcgtggagggcttctcggcgctgccgcagcactgcctgcagctctgcgcggcgttctttgccttcgccgtgctggctaacctggcgagggacttcctgccgcgcggctcgggaggttcgttccgctgcccatggccatggccgtgccgttcctcgtcggcgccagcttcgccatcgacatgtgcgtggggagcctcgtggtgttcctctggcactggctcgacgggaagaaggctgcgctgctcattccggccgtcgcctcgggcctcatctgcggcgacgggatatggattttcccgtcgtcgctgctcgcgctggccaagatcaagccgccgatgtgcatgaagttcacgcccggaagctagagagaggatccatacaacgtcagattacataggcggtctgcatatagaagaagcaaataaccagagcattccattttggggtggccattacggtacatagagtgatgccgggtaaatccggcgacttgttcatatgagtctagactctagggagtcgtgtatactgtacatcagcagagatgtcaaattttcagagcgacgagaactattgcttgttgtcgcctacagactacaaagaatatcggcgccttat

SEQ ID NO: 4059 - DNA, 729 bp, Triticum aestivum
ctctttacgagccttcgacgtggccaacccggacgggtactggaaggcgccctacgcgctcatctaccgcaacatgccatcctcggcgtggagggcttctcggcgctgccgcagcactgcctgcagctctgcgcggcgttcttcgccttcgccgtgctggccaacctggcgagggacttcctgccggggcggttcgggaggttcgtgccgctgcccatggccatggccgtgccgttcctcgtcggcgccagcttcgccatcgacatgtgcgtggggagcctcgtggtgttcctctggcacaagctcgacgggaagaaggccgcgctgctcattccggccgtcgcctccggcctcatctgcggcgacgggatatggatattcccgtcgtcgctgctcgcgctggccaagatcaagccgccgatgtgcatgaagttcacgcccggaagctagaggatcgatccacacagcgtcagattacataggcggtctgcatatagaagcaaataaccagagcattttggggttatcataccattacgttacatagagtgatgccgggtaaatccggcgacttgttcataagagtctagactctagggggtcgtgtatactgtacatcagcagagatgtcgaattttcagagcgacgagaacaattgcttgttgtcgcctacagactacaaagaatatggtgtcttatcttcgtttcttagagatccataacagatcc

SEQ ID NO: 4060 - DNA, 720 bp, Triticum aestivum
caaatgttgaccctcaaaagaggaaaccggtgtcagaggttgtgaaagtcacaaggcgtgaaaatgttgatgaaaggcctgtacgcctaagtaagaaagtatcaaaaccatcaacatccaagaagacttctcagccaaaggctgaaagtccactcgacagttttctgaaatcactaggacttgagaagtattctattaccttccaggcggaggaggttgacatggcggccctacgtcacatgactgaaagtgatctcaaggcgttgggcatcccgatgggtcctaggaagaagattacccttgccttggaatccagagcgtagggcaagtccctggagtacaatgtagaaaagcagggagatgtggtaggtttttgctcatctacaagtttggcatatcttggaaagcagtggtacaggtacaacaatgcggtgtctcttgtaatggcatgttgctgtaagattattagactgctgttgtttatctggtctgcatgctttcctggccagaccagctgattaactgatgaggtatccgtgctgttgaagctgcggtgatgttcttgctgtatactattattacgccttttttttcattggaaactggcactattagagtcatagagttgagattctccaattagtatttcaagtgttgcgttgctcagtgtaaaggttttaaatttcatctgttttcttgctcagcccttgttcggaatgt

SEQ ID NO: 4061 - DNA, 805 bp, Triticum aestivum
atcacaagttcacaacacccaaccatggcgccttcactcttcatccttgccctcctcctcaccgtcgctgcaaccgacgcggccaccatcacggtggtgaacaagtgctcctatacggtgtggccagccgccatcccggtgggaggtgggaccaagctcgaaccaggccagttgtccacaatccacccgcccgccggcacaaattctggcaggatctgggcgcgtacgggctgcaaatttgacgccagcggcaaggggtcctgtaccacgggagactgcggcggcctgctggcctgccgtgccggcgggaagccacccgcctcgctcgccgagtacactctggggacaggcagcaatgctgacttctacgacatctccctcgttgacggattcaacgtgccgatgagcttcgggcccgccggtggcagctgccgcgcggtcagctgcgccgcggacatcaacgcaaagtgcccgtcggagctgaaggtggacgggggctgcatgagtgcctgcggcaagttcggcaccccacagtactgctgcccggcgccaagtacgccggcgacctgtgggccgacgagctactcgcgtttcttcaaggggatctgcccagacacctacagctacgcctacgacgacaagagcagcacattcacctgcgccgccggaacaaactacaaagtcacattctgcccgtagatccgtcatcgtcatgcatattcatgcatgctaggaactgaatttggtttgatgaataaatatgtactggaactagaattagaatgaatgaatcgaggtagtttcc

SEQ ID NO: 4062 - DNA, 768 bp, Triticum aestivum
agggggagacgatcgggtgcagttcgagaactgctggtgtcccccaaggtggacctcgtcctcgccggccacgtccactcgtacgagcgcaccgccgcttctccaacgtcgcctacaacatcgtcaacggcaaggccacgcccgtgcgcgacttggacgcgcccgtctacgtcaccatcggcgacggcggcaacatcgagggcatcgccaacaacttcacggagccgcagccgtcctactcggccttcagggaggcgagcttcgggcacgcgacgctggagatcaagaaccggacgcacgcctactacgcgtggcaccgcaaccacgacggcgccaaggccacagccgactccgtctggctcaccaacagacaccacctccccaccgacgactccaagtgaagtggccggacggatcatctgcccctttacttgagcaacgtggggtttttcttacatgtcgatccatccggctgcgatgggacagaaaagaagacatcttgggcagctgcaaatggttgctacacggctgcttctttcatctcatttgtgaatctcttgagctcgagccgtagttagtgcaattagtcatgtaaccttaagggtaaagctcttgcgcgtagtctcgtttgaaataaaataacaaaagagatttgggaggttcttctcaagcacctgatctgcattcgactatatacacgtgttgactgaaactgtgcatgataatcagatcatgtgcagagagcatcatttcttctcaatataatat

SEQ ID NO: 4063 - DNA, 767 bp, Triticum aestivum
tggctcatccttgctcatgcactcgccatggtacaacagcaacaacttccactacatggagggggagacgatgcgggtgccagttcgagagctggctcgtcgccgccaaggtcgacctcgtcctcgccggccacgtccactcctacgagcgcagccgccgcttctccaacgtcgcctacaacatcgtcaacggcaaggccacgcccgtgcgcgacatggacgcgcccgtctacgtcaccatcggcgacggcggcaacatcgagggcatcgccaacaacttcacggagccgcagccgtcctactcggcgttcagggaggcgagcttcgggcacgccacgctggagatcaagaaccggacgcacgcctactacgcgtggcaccggaaccacgacggcgccaaggccacagccgactccgtctggctcaccaacagacaccacctccccaccgacgactccaagtgatcggacggatcgtctcatctccgaagcaatgtcgtgggaggggacccgttttactgcccctttacttgagcaatgttgatcgttgtggctgcgatgggggtttgttgcttagttttgggacagaaaagaagagatcttgggcagctgcaaaatggttgctacgggacacatgactgcctttttcatctcatgttttggatgtcgtcgtcacaaatgtcttgagctcgagctgtagttagtgcaattagtcatgtaaccttaagggtaaagctcctgcgcgtagtctcgtttgaaataaaataa

SEQ ID NO: 4064 - DNA, 617 bp, Triticum aestivum
tcctacctcccagcgaaacaccaccacacccgtccccggcgaaggagcagcggcatccatggcccccaaggcggagaagaagccggtggcggagaaggccgagaagaccacggcggcgaagaagaccaaggccgagaagaggccgccggcgtccaaggagggcggcgctgacaagaaggggaagaagaagtccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcccgctacagcaagaagcccaccatcacgtcccgggaggtgcagacctccgtccgcctcgtcctccctggtgagctcgccaagcacgccgtctccgagggcaccaaggccgtcaccaagttcacctccgcatagatgggctgctccctgccatgttggatgatgatgctgtttgtactctgtcatcttgtaagttaactgtttcatgaactgaagaaatagtaacagtgctgatttattctgtctctgaatctgactgtctatcatgttcggt

SEQ ID NO: 4065 - DNA, 494 bp, Triticum aestivum
caccgcacatctccccggcgaagcagcagcaaccagcggcatccatggcccccagggcggagaagaagccggtggcggagaaggccgagaagacgacggcggcgaagaagaccaaggccgagaaccgcccgccggcgtccaaggagggcggcgagaagaaggggaagaagaagtcgaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctccgcttagatagtctgttcctgtcttctttgtcgatcgatg

SEQ ID NO: 4066 - DNA, 990 bp, Triticum aestivum
aaattccccaatctcctcccgcactcaacccaatccccacctacccgcaccccatggcgccgaaggcggagaagaagccggcggcgaagaagcccgtggaggaggagcccgcggcggagaaggccgagaaggcgcccgccgggaagaagcccaaggccgagaagcgtcttcccgcggcgggcaagacctccgccaaggacggcgacaagaaggccaagaagaagagcaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgaggccgccaaactcgcgcgctacaacaagaagcccaccatcacctcccgcgagatccagacctccgtccgcctcgtcctccccggggagctcgccaagcacgccgtctccgagggcaccaaagccgtcaccaagttcacctcctcctaggttcgcccgccccccctcatggtgaccgctgttgatcccctgctggatctgcctgcctatctagatatatatagtagtattagtagtgcttgatggaaatcgttggacggatgatggttcgtgtgtagtcgtcggtggttgtaagatgatgttcccgtggtgctacttttgcgtagtcgatctgaatattaatggaacaaaaatctgctactctgagtttctgatgaattgtttcaagagtagttatatttgacatcctgtttgtgctattcttgattagtttgagatggttatatgattttgatccgacctgttgtgcaccgtgggtgttagtttacatcgttctgttgttcctggtcatagattgaatcaagttagacccaattggggtgtgaatcaagttagacccaattggggtgtgaatcaagttagacccaattggggtgttacaattggttgatctgaatgttaatgaaat

SEQ ID NO: 4067 - DNA, 922 bp, Triticum aestivum
ctttattcaggaacatttattcatcatttccatattgcaactagtacttgccacacatgatgatgcatgacatttttattttgccaccgctacattgatcaactagtacgcaccaccaccaccatcaatcacaacacccaaccatggcgtcttcactcttcatccttgccctcctcctcaccgtcgctgcaaccgacgcggccaccatcacggtggtgaacaagtgctcctacacggtgtggccagccgccatcccggtgggaggcgggaccaagctcgaaccgggccagttgtccacaatccatccacccgccggcacaaaatctggaaggatctgggcgcgtacgggctgcaaattcgacgccagcggcaaggggtcctgtaccacgggagactgcggcggcgtgctggcctgtcgtgccggcgggaagccacccgcctcgctcgccgagtacactctggggacaggcagcaatgctgacttctacgacatctccctcgttgacggattcaacgtgccgatgagcttcgggcccgtcggcggcagctgccgcgcggtcagctgcgccgcggacatcaacgcaaagtgcccgtcggagctgaaggtggacgggggctgcatgagtgcctgcggcaagttcggcaccgcacagtactgctgcccaccgccgagtacaccgtcgacttgcgggccgacaaactactcgcgtttcttcaaggggctctgcccagacgcctacagctatgcctacgacgacaagaccagcaccttcacctgcgctagcggaacaaactaccaactgaccttctgcccgtagatccgtcatcatcatccatatgcatatgcatgctaggaactgaatttcttcgatgaataagtctgtacttgacggaactagaaatagaacgaatgaatgaagga

SEQ ID NO: 4068 - DNA, 1074 bp, Triticum aestivum
tccgactcggcggaccccgtcaccaccatccacatgtgggtccccgccaggccgccacgcaaccccctggtcctcctccacggcttcggcgcctccgccacgtggcagtggtacccctacctccgccccctcatcgccgccggcttcgaccccatcgtccccgacctcgtcttcttcggcaactcctccacccgcctccccgatcgctccgacacattccaggcgtggtcgatcaagacggcgctggaggcgatcggggtgaccaagtttgggctggttggggtgagttatggagggttcgtggggtacaggatggcggcgatgtacccggtacgcggtggagagggtgactctggtgtgcgccggcgtttgcctggaggagaaggacctcgcggagggtctgttcccggtggccgcggtcgatgaggcggcagcgctgctggtgccacggcggccggaggaggtgcggcgcctggtcaggctcacattcgtgcgaccgccgatcatcatgccgtcgtgcttcctttgggactacattaaggtgatgggctcagaccatatccaggagaagactgagctactacacgctttgattagtgggaggcaaatttcgactcttccaaaactacgtcagaagacgctgataatttggggggagcaagataaggtgttcccgatggaattggctcacagattgaagagcatgtgaacaaattggcaggcatctggatgggaactctcggttggcagtcatacacaacgctgggcacgcagtcaatctcgagaagcctgcagaggtgtgcaagagcatcatcgagtttttccaagagccgatccccgaagcttcaaacgacgaaagggtgtagtaggcgtggctctcatcgaagcggcggatggtgtcttcttcgctgggcatcggcattgcggtcaaaactgacactggaagaggggaggaagaggggggatcgcagcgttttcacccttctcggtggaaaaatacctgatgtatgttgccttgagcagtgtaatcatcggttatgtgaactggcatgcctgccagagcacgttgtgcta

SEQ ID NO: 4069 - DNA, 880 bp, Triticum aestivum
tccaccacccgctcccccgatcgctccgacacattccaggcgcggtcgatcaaaaaccggcgctggaagccatcgggggtgaccaagtttgggctggtttggggtgagctatggagggttcgtggggtacaggatggcagcgatgtgacccggacgccgtggagagggtgactctggtgtgcgccggcgtttgcctggaggagaaggacctcgcggagggtctcttcccggtggccggggtcgacgaagcggcagcgctgctggtgccacggcggccagaggaggtgcggcgcctggtcaggctcacattcgtgcgaccgccgatcatcatgccgtcgtgcttcctttgggactacattaaggtgatgggctcagaccatatcgaggagaagactgagctactacacgctttgattagtgggaggcaaatttcgactcttccaaaactacgtcagaagacgctgatagtttggggggagcaagataaggtgttcccgatggagttggctcacagattgaagaggcatcttgatgggaactctcggttggcagtcatacacaacgctgggcacgcagtcaatctcgagaagcctacagatgtgtgcaagagcatcatcgagtttttccaagagccaatccccgaagcttcaaacgacgaaagggtgtagtaggtgtggctctcatcgaagcggcggatggtgtcttcttcgctgggcatcggcattgcggtcaaaattgacactggaagaggaaaggaagaggggggatcgcagcgttctcgccattctcggtggaaaaatacctgagttatgttgccttgagcagtgtaatcatcggttatgtgaactggcatgcctgccagatcacgttctgctaccgt

SEQ ID NO: 4070 - DNA, 748 bp, Triticum aestivum
caaacccaaagaggaggaagaacaccaaggactcactaccagcgcctctccgcgatccaaatcctcccgggaaagatcttggttgatctcttcctcctcgaccgcctcccaggttcttggtgcagcttttgccagtctcagcaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggtctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgagcaactgccagctccatatcagagtctacatgcaaagcagctatatattggtggtgcagtatatttagttgtgtgctagcgctagcaggcgttaccagcttgcgcgctctgagtatacagaaaatctagcatagcccacctctctgcgtgtatgcttgttaccgttgtgttgaaactttgtaaggagcaccgtctttagatggcttgttaccctctcccatcaaggttgaataatatatgctttgtta

SEQ ID NO: 4071 - DNA, 938 bp, Triticum aestivum
agaaacccagagtcgtccgcctcctcccgtctgtaaattccgctccttccctcgtctctctataggaggcatccaacccaaagaggaggaagaacaccaaggactcacttaccagcgcctctccgcgatccaattcctcccgggaaagttcttggttgatctcttcctcctcgaccgcctcccaggttcttggtgtagcttttgccactctcaccaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggtctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgagcaactgccagctccatatcagagtctacatgcaaagcagctatatattggtggtgcggtatatttagttgtgtgctagcgctagcaggcgtcaccagcttgcgcgctccgagtatacagaaaatctagcatagcccacctctctgcgtgtatgcttgttaccgttgtgttgaaactttgtaaggagcaccatcgttagatggcttgttaccctctcccatcaaggttggataataatatatgctttctgaagcgtggtatccttcgtatcatccattttggtttgacattcgccatcccagccggtgtcgatacatctagtcttgaactgtatctgcatctgcttgatgactgcattatgctgc

SEQ ID NO: 4072 - DNA, 720 bp, Triticum aestivum
cgacgcgtggcaaggactgactgccagcgcctctccgcgatccaaatcctcccgggaaagttcttggttgatctcttcctcctcgaccgcctcccaggttcttggtgtagcttttgccactctcaccaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggcctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgaacaactgccagctccatatcagagtctacatgcaaagcagctatatattggtggtgcagtatatttagttgtgtgctagcgcaagcaggcgttaccagcttgcgcgctctgagtatacggaaaatctagcatagcccacctctctgcgtgtatgcttgttacccttgtgttgaaactttgtaaggagcaccatcgttagatggcttgttaccctctcccatcaaggttgaataat

SEQ ID NO: 4073 - DNA, 624 bp, Triticum aestivum
gggtctccatgtcccgcgtggactacgcgccgtggggcgtgaacccgccgcacacccacccgcgagccaccgagatcgtctacgtgctcgagggctccctcgatgtcggcttcgtcaccaccgccggcaagctcttcgcccgcaccgtctgcaagggcgaactcttcgtcttcccccgtggcctcgtccactaccagaagaacaacggaggtgcgccggccgccgccatctcggccttcaacagccagcttccgggcacgcagcccctcgccctagcgatgttcgcagcctcaccaccggttcctaccgacgtgctggccagggcgctccagatcgacggcggcctggtggaggccatcaagtccaagttcccgcaaaagtaaccagcatgcatgcatgttggttgggtcagctctacgtgcgtatgtgctgccaataatgacgaaggaccacgtaaaagtgcagttttaataaatttgcttgacaatgtatcttttgtcggtgcatgtttagtgaagggcctcgtcggttttactgttaattgttgctttttcttcacgaacctactggttattaaattgtatgtgtccattattggtaaatgcagtgcccgactgcttgaat

SEQ ID NO: 4074 - DNA, 610 bp, Triticum aestivum
  misc_feature (4)..(4): n = any nucleotide
  misc_feature (63)..(63): n = any nucleotide
  misc_feature (72)..(72): n = any nucleotide
  misc_feature (473)..(474): n = any nucleotide
  misc_feature (557)..(557): n = any nucleotide
  misc_feature (606)..(607): n = any nucleotide
tcgnttccgcgttgacggccggcgaacgtggagaactcccggggcttcaacacgctgggcgtnttccatgtnacgcgtggactacgcgccgtggggcgtgaacccgccgcacacccacccacgcgccaccgagatcatctacgtgctggagggctccctcgacgtcggcttcgtcaccaccgccggcaagctcttcgcccgcaccgtctgcaagggcgagctcttcgtcttcccccgtggcctcgtccactaccagaagaacaacggaggcgccccggccgccgccatctcggccttcaacagccagcttccgggcacgcagtccctcgccctagcgatgttcgcagcctcgccaccggtgcccacggacgtgctggccagggcgctccagatcgacggcggcctggtggaggccatcaaggccaagttcccgccaaagtaaccagcatgcacgcatgttggttgggtcaagnnctacgtgcgtacgtgctgctaataatgacgaaggaccgcgtaaaagtgcagttttaattcatttgcttgacaatatcttgtgncggtgcatgttttgtgaagggcctcgtcggttttactgttaattgttgnnttt

SEQ ID NO: 4075 - DNA, 559 bp, Triticum aestivum
gacggcggcgaacgtggagaagctcccggggctcaacacgctgggcgtctccatgtcccgcgtggactacgctccgtggggagtgaacccgccgcacacccacccacgtgccaccgagatcatctacgtgctagagggctccctcgacgtcggcttcgtcaccaccgccggcaaactcttcgcccgcaccgtctgcaagggtgagcttttcgtcttcccccgcggcctcgtccactaccagaagaacaacggcggcgcgccggccgccgcaatctcggccttcaacagtcagcttcccggcacgcagtccctcggcctagcgttgttcgcagcctcaccgccggtgcccaccgacgtgctggccagggcgctccaggtcgacggcggcctggtggaggccatcaggtccagattcctgccaaagtaaccagcatgcatgcatgcatgcatgttggttgggtcagctgtacgtgcatacgtgctgctaataataaaggaccacgtaaaagtgcagttttaattcattcgcttgataatatgttttgtagtactatattct

SEQ ID NO: 4076 - DNA, 585 bp, Triticum aestivum
  misc_feature (12)..(13): n = any nucleotide
  misc_feature (53)..(53): n = any nucleotide
tcgcgcgtgganntacgcacccgtggggcgtgaacccgccggaacacccaccnacgggcgaccgagatcatctacgtgctggagggctccctcgacgtcggcttcgtcaccaccaccggcaagctcttcgcccgtaccgtctgcaagggcgagctattcgctttcccccgcggcctcgtccactaccagaagaacaacggaggcgcgccggccgccgccatctcggccttcaacagccagcttccgggcacgcagtccctcgccctagcgatgttcgcagcctcaccaccggttcctaccgacgtgctggccagggcgctccagatcgacggcggcctggtggaggccatcaagtccaagttcccgccaaagtaaacagcatgcatgcatgtctacgtgcttacgtgctcctaataaacacgaaggaccacgtaaaagtgcagttttaattcatttgcttgacaatatcttgtgtcggtgcatgtttagtgaagggcctcgtcggttttactgttaattgttgctttttcttcacgaacctactggttattaatttgtatgtgtccattattggtgaatgaatga

SEQ ID NO: 4077 - DNA, 813 bp, Triticum aestivum
catcaggaatctgaaggagaaggcatcgttcaagaacccagatgagttctatttcaagatgatcaacagtaaaaccgtggatggaatccataggcccaagcctgaagcaaataataagtacaccgaagaggaacgtatgctcttgaagcataaagacatgggatacatctttcaggccattcaaagtgaaagaaagaaagttgaacgattgagctcaacccttcacgcagtggatgacaagcgttcaaacaagcacatttactttgcggaagacagagaagaagccaaagaaatacgatctaggataggtgaaagcagcagcgcacctcaatttggtaacatcccttctcgtataaagaggaaaacagcttcctcctacaaggagttagaaagcaggaaagaaagggttaagaatcttgagaaattgtatgcggacatggccttgcaaaaagaactgaagaaacctggacgcaaaaggaagctccgtgaagaagagattttaaattcaacatcacagcctgtttacaagtggcgtgcgcaaaggaagcgatgataggaatggcgaaagctggacaattgggaacagacaagctggtgcttgaagagtttcacttccctgtgacattgcccttgcccttacacaaccccatccattgctttcagatacctttataacctttgcctggtgatatttgtggatcctatgccggagaccatgtactgctattagtctattaccatatgttaatttctcgaaatgttaagtgatcagagtcaccatgtaggaacaattttgatggatatagttgaaat

SEQ ID NO: 4078 - DNA, 714 bp, Triticum aestivum
agaggaacgttatggctgttgaagcataaagacatgggatacatctttcaggctgttcaagtgaaagaaagaaagttgaacggttgagctcaacccttcactcagtggatgacaagcgttcaaacaagcacatttactttgcggaagacagagaagaagccaaagaaatacgatctaggataggtcaaagcagcagtacacctcaatttggcaacatcccttctcgtataaagaggaaaacagcttcctcctacaaggagttggaaagcaggaaagaaagggttaagaatcttgagaaattgtatgcggacatggccttgcaaaaggaactgaagaaacctggacgcaaaaggaagctccgtgaagaagaaattgtaaattcagcatcacagactgtttacaagtggcgtgcgcaaaggaagcgatgataggaatgacgaaagctggacatttgggaacagacaagctggcgcttgaagagattctcttccctgtgacatcgcccttgcccttccacaaccccccatccattactttcagatacctttataacctttgcctggtgctatttgtggatcctatgccggagaatgtactgctattagtctattaccttatgtcaatttctcgaaatgttaagtgatcacagtcaccatgtaagaacaattctgatgggtatagttgaaaatcatgcctgtgttgttatcaagatat

SEQ ID NO: 4079 - DNA, 1059 bp, Triticum aestivum
ttctctttccggcctcccctctcccttctcctcgccgcgtagcccctcccaaatccgctcatccgccggtccgctcgttcttccgggagaggggcagcgaggacgaagatgtcgtccctgcggaactcgattccgcggcgggctcacaaggagcgcgcccagccggagtcgcggaagaagtacgggcttctggagaagcacaaggaccatatcctccgcgccagggcctaccagcgcaaggaggatttcatcaggaatctgaaggagaaggcatcattcaagaacccagatgagttctatttcaagatgattaacagtaaaaccgtggatggaatccataggcccaagcctgaagcaaataataagtacaccgaagaggaacgtatgctgttgaagcataaagacatgggatacatctttcaggccgttcaaagtgaaagaaagaaagttgaacgattgagctcaacccttcacgcagtggatgacaagcgttcaaacaagcacatttactttgcggaagacagagaagaagccaaagaaatacgatctaggataggtcaaagcagcagcacacctcaatttggcaacatcccttctcgtataaagaggaaaacagcttcatcctacaaggagttagaaagcaggaaagaaagggttaagaatcttgagaaattgtatgcggacatggccttgcaaaaagaactgaagaaacctggacgcaaaaggaagctccgtgaagaagagattgtaaattcagcatcacagactgtttacaagtggcgtgcgcaaaggaagcgatgataggaatggcgaaacctggacaattgggaacagacaagctggcgcttgaagagttttacttccctgtgacattgcccttgcccttccacaaccccatccattacttccagatacctttataacctttgcctggtgatatttgtggatcctatgccggagaccatgtactgctattagtgtattaccataatttctcgaaatgttaagtgatcagagtcaccatgtaggaacaattttgatggatatagttgaaattat

SEQ ID NO: 4080 - DNA, 686 bp, Triticum aestivum
gccggggtcccccgccggcggcgctgctggcgcgtacgagctcggcggaccctcggcggaagcagctttcggcaaggtgaagcacgcgcggcaccgggcacgggggaccacttcgccgtgaagatcctggaccgcggcagggtgctctccctccggggcgccgacgaccagtgcgcagggagatcgccacgctcaccatgctcgcgcaccccaacgtcgtccgcctccacgaggttgctgctagcaaacaaagatctacatggtgcttgagtttgtcaatggaggcgaactgtttgacaggattgcaatgaagagaaaactatccgaacgagaaggaagaagactttttcagcagctaattgatggtgtgagctattgccatggaaagggtgtctaccacagagacctcaagcctgaaaacgttcttattgaccgaaaaggcaacatcaagatctctgattttggtctctgtgctttacctcaacacctcgggaaggatggattgctgcatacaacctgtggtagccccaactatgttgcacctgaggttctgaaaaacagaggttatgatggatcactgtcagatatctggtcctgtggagtaattctttacataatgctcgtaggacaacttccatttgatgacagaaatatggttgttctttatcagaagattttcaagggcg

SEQ ID NO: 4081 - DNA, 687 bp, Triticum aestivum
tcgagccctggatgacgggcaactgccgcggcccctccaccgccttctgcctcctctacaagctcttcaccatgaagctcaccgtcaaccagatgcacggcctgctcaagcacccggactccccctacatcagagctattgggtttctgtacctgcgctatgccgcggacccaaagaccttatggacctggtatgagccctacattcaagatgacgaggagttttcccctggatccaatggtaaaatgacaactatgggcgtttatgtgcgtgatgtcatccttggtcaggttactgcccatctggagaaaatgaagctcccaacaaagcagtcagggataactggggattctagccgccttggttcagatgatactgcccggcggcctccttcagtgaaggcttctctgtccgtctcttttggtcagcgtgctccacaccgtgcatccacaagggattcatccccagtccgaaagacattgccttctgtacgagaaagggaaaggagtcatgatggcagtcatgccagatctccacccaggaagcaccgaactcagagtcgtgaacgcaggcgtgaccttgaaaggaccgtcagatcgcaccgggaacgaccagataggagctggtcggccagccggatacgaaacggatacgcggcaagcaaccaaaggcattaaagccgccaaa

SEQ ID NO: 4082 - DNA, 576 bp, Triticum aestivum
aagatcaagacgtaccacgaggtcagtcgacgagatctacaaccaggtggaccacgtcgagccctggatgacgggcaactgccgcggcccctccaccgccttctgcctcctctacaagctcttcaccatgaagctcaccgtcaaccagatgcacggcctgctcaagcacccggactccccctacatcagagctgtaaattgggtttctgtacctgcgctatgccgcggacccaaagaccttatggacctggtatgagccctacattcaagatgacgaggagttttcccctggatccaatggtaaaatgactactatgggcgtttatgtgcgtgatgtcatccttggtcagtactacttcgacagtcttcttccacgagtgcctctcctaattctgcgacaggttactgcccatcttgagaaaatgaagctcccaacaaagcagtcagggataaccggggattctagccgccttggttcagatgatactgcccggcggcctccttcagtgaaggcttctctgtccgtctcttttggtcagcgtgctccacaccgtgcatcacaagggatcatccccg

SEQ ID NO: 4083 - DNA, 1236 bp, Triticum aestivum
agaaaattctgatctcatcattattgacacaagtggacgccataagcaagaggctgcactcttcgaagaaatgcgtcaagttgcagaagcaacgaaaccagacctggtgatatttgtgatggatggcagtattggtcaggctgcgtttgatcaggcacaagcatttaaacaaagtgcttctgttggtgctgtcatcgtaacgaaattggatggtcatgcaaaaggaggcggtgcacttagcgcggttgcagctacaaaaagtccagtgatatttattggaactggagaacacattgatgaatttgagatttttgatgtgaaaccatttgtcagccgtctgctaggtatgggagacttgtctggcttaatggacaagatccaggatgttatgcctgctgatcaacagcctgagcttctggcaaagctggctgaaggaaccttcactctcagacttttgtatgagcaattccagaatcttctgaaaatgggtcctattggccaggtcttctccatgttgcctggatttagttcagagttgatgccaaaaggacatgagaaagaaggccaagcgaagattaagcggtacatgacgattatggattccatgacagcagcagagctcgacagtacaaacccaaagctgatgactgagtcgcgaatcatccggatcgctcgggggtctggcaggcaaatcagagacgtgatggacatgctggaagagtacaagcggctagccaagatgtggagcaagatgaaggggctaaagatgccgaagaatgggaagatgagcgacctgtcccagaacctgaacatccagcagatgaccaaggcgctcccgccgcaagtgctgaagcagatgggcggcatgggcggcctgcaggccctgatgaagcagatgggcggcaaggacatgagcaaaatgctcggtggcatgggactgggcggtgattagcctggcaaatgtaggtagagtttattctgggcataggtggtgtgattgctgcgttgtcagagtttgctatatttatatagatctcaaaagatttcccatcctgacaaatatagtcctcaactcttgaaaaaatcatttgaaatttctctggaactaacatctagtaaggtcatcaaatttacaggtagtgtagcttctgtgaatttgttgcgtcgtcgcgttcctcgcttggtatacttgttttatgaatcatgcggtcttctggatctggagagcctgaaacc

SEQ ID NO: 4084 - DNA, 830 bp, Triticum aestivum
agattttagttgcagagaaatttcacataactttttgaggagttgggaagtatctttgtcaggatggaaatctttagagatctatataaatatagcaaactccacagcgcacaagcacaccacctatgccacaagaaactacctatatttgccagatctcatcaccaaccaccaatccattccccaccagcaccttccggcgaaacacagcacctctccccggcgaacagcagcgtccaatggcccccaaggcggagaagaagccggctgccgcggagaagaccccggcggccgagaagaccacggccgggaagaagcccaaggccgagaagcggcccccgaagtccaaggagggcggcgctgacaagaagaagaagaagggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcccgctacaacaagaagccaaccatcacgtccagggagatccagacctccgtacgcctcgtcctccccggcgagctcgccaagcacgcagtgtccgagggcaccaaggccgtcaccaagttcacctcctcctagaccacgatggttctctgtaacagtcacctgtttagaccatgtcgtcttgtaacttgcgttggttctgtgggaacacactgtttcattacctcatgaaatggtaatggtgcttctttgatctgtgtcatggttatgtatcatgttcagttcttgtcccccga

SEQ ID NO: 4085 - DNA, 482 bp, Triticum aestivum
  misc_feature (416)..(416): n = any nucleotide
gcgaagattaagcgatacatgacgattatggactccatgacagctgcagagctcgacagcacaaacccgaagctgatgaccgagtcgcgaatcatccgtatcgctcgagggtctggcaggcaaatcagagacgtgatggacatgctggaagagtacaagcgactagccaagatgtggagcaagatgaaggggctaaagatgccgaagaatggaaagatgagcgatctgtcccagaacctgaacatccagcagatgaccaaggccctcccgccgcaagtgctgaagcagatgggcggcatgggtggcctgcaggctctgatgaagcagatgggttgcaaggaaatggaccaaaatgttggggggcaatgggaattggtggtgaattaaatctggcaaatataggtagtttcttgtgnataggtggtgtgcttgctgcgctgtggagtttgctatatttatatagatcatctaaaggtttccat

SEQ ID NO: 4086 - DNA, 1020 bp, Triticum aestivum
cttagagaaagaaccaactctggttcggggccaagggcataggcccaaactgcttgccaatcataagctttctcagaattagctccttccacattatcagctagatccatcttatgcaggttgtgcaatgccctattcagaacagaagcaagaagctgcagtcctagtacacgctgcccaggaaccatgctcctggtaagtgccaacgcctcattgattgtgtaaccaacagctgcaggatctccctctgttcgtaggaagtcacgctcagctacactttctccatgggtcttcttgccatctggttgctcctgagaagattgaaatcccagaatatctccatctaatgcaaacctacacgacctgatccgctccactctctcactccatgccttccaagagtgtgcactctgctcaccagcagtcaaatgctcgcctggaatagcctttgcagtcttccttggccctgaagtttgcctactcttatccttaccctcatctttcttgccaccaggcagagctcgacagcacaaacccgaagctgatgaccgagtcgcgaatcatccgtatcgctcgagggtctggcaggcaaatcagagacgtgatggacatgctggaagagtacaagcgactagccaagatgtggagcaagatgaaggggctaaagatgccgaagaatggaaagatgagcgatctgtcccagaacctgaacatccagcagatgaccaaggccctcccgccgcaagtgctgaagcagatgggcggcatgggtggcctgcaggctctgatgaagcagatgggtggcaaggacatgagcaaaatgctcgggggcatgggactgggtggtgattaaatctggcaaatataggtagtttcttgtggcataggtggtgtgcttgctgcgctgtggagtttgctatatttatatagatctctaaagatttccatcctgacaaagatacttcccaactcctcaaaaagttatgtgaaatttctctgcaactaacatctgctaggtca

SEQ ID NO: 4087 - DNA, 483 bp, Triticum aestivum
ccgcggtgctgcctcccgagttcctcgaggccaccaagggcaggtgcctcctagcgagctggtgcgagcaggaggcggtgatgcaccacgaggcggtgggcgccttcctgacgcactgtgggtggaactcgatgatggaggggctcagcgccggggtgcccatgctatgttggcctttcttcgccgagcagcagaccaactgccgatacgcgtgcatggagtggggcgtcggggtggaggtcggcgacgacgtccgccgggaggcggtcgaggcgaggataagggaggtgatgggaggagaagtagggagggagatgaggaggagggcggcagagtggaaggaggtcgcttctcgctcaaccgcgcaacctggtggcaggtcgttggccaaccttgagagtctgctcaaggatgtactgaagtgaccgccaataacaaataattaaggtgggtatatagtcactccttgcaaaactatagtgg

SEQ ID NO: 4088 - DNA, 425 bp, Triticum aestivum
tgtcgagccttccctatgtggatgccatcgtcaaagagaccatgcggttgcacccggtagcgccgatgcttgtaccccgcctttcacgcgaggacacgtctatcaacggctacgacatccccgccggcacacgggtgctagtcatggtctggtctattggccgtgacccggagttgtgggaagcgccggaggagttcatgccagaacgcttcctcggtagcaggctcgacgtcaaggggcaggattatgagttgcttccattcgggtcgggacgcaggatgtgcccggggtatagtcttgggctgaaggtgatccaagtaagtctggcgaacctcctgcacgggttcacgtggaggctccctgatggcgtggagctgagcatggaggagatctttggactgtcaacaccacgcaagtacccactg

SEQ ID NO: 4089 - DNA, 700 bp, Triticum aestivum
ccagaggtgcttgccaaccactgaggagatggaccgtttgtgggcgagccgatgggtcaccgaaaaggacatgccgagccttccctatgtggatccatcgtcaaagaaaccatgcggttgcatccagtagcgccgatgcttgtaccccgcctttcccgtgaggacacgtccatcaatggctacgacattcctgccggcacacgggtgctagtcatggtctggtctattggtcgcgacccagagttgtgggaagcgccggaggagttcatgccggagcggttcctcggcagcaggctcgatgtcaaggggcaggattatgagttgcttccattcgggtcgggacgcaggatgtgccccgggtatagtcttgggttgaaggtgatccaggtaagcctagcgaacctcctgcacgggttcacgtggaggctccctgatggcgtggagctgagcatggaggagatcttcggactgtccacgccacgcaagttcccgctggaggctgtcatggagcccaagctcccagctcacctctacgttgaggcttgaatatttgatacatgtgtgctctcgtgtgttgagtaattattactacttgtgttgttttattttttctataatctttttctagtattgtatggtttgcggtgtaactaaagtgatcgagatgtgcaggaagggtgtaaaaaaatgtttggtaatt

SEQ ID NO: 4090 - DNA, 625 bp, Triticum aestivum
acccacaccaagctcttcgtcgggggcctcgcctgggagaccaccagcgagaggctccgccgcttctacgagcgcttcggggacatcctcgaggccgtcgtcatcaccgaccgccactccggccgctccaaaggatacggcttcgtgacgttccgcgatgccgaggcggccaccaaggcctgcgaggaaccgtcgccggtcatcgatggcaggcgggccaactgtaacctggcgtcgctaggtcgcgcccagccttccacacccctcgggcggccacgatcagctggctcctactttggtgttcctgtcccaaggggcatttatgtaggtggttatggtcagcaccgaccccttccgcttgggtactaccagtaccagggatttccggttccacaatacagttactccgcatatggcaccgactacatctatccacagggtacattaaacccatatgttggtcagcaatatgttccagtttacggtgtctcagctgcagcaaatactgctaaccaaccatttagccaattgagcccatccatttctggtgggggcaacggctatccgatgatgcatggttacagtatgccaggaaatcaatttgtgcatctcactgggtcaaact

SEQ ID NO: 4091 - DNA, 1291 bp, Triticum aestivum
gaagatgctaaagcgatcgtgtacagattttgagtgtagtggccttttgtcatcttcagggagtagtgcatcgtgatttgaagccagagaacttccttttcacaacacgagatgaaaatgcgcccatgaagttgattgattttggtctctctgatttcatcagaccagatgaaaggctcaatgatattgttggaagtgcatattatgttgccccagaggttctacacagatcatacagtatggaagcagacatttggagtataggtgtcataacatacattctgctctgtggtagtcggccattttgggcacggacagaatctggaatcttccgatctgtattgagagctgatcccaaccttgatgattcaccatggccttcagtgtcagctgaagctaaggattttgtgaaaagatttcttaacaaggattaccgcaaaagaatgacagctgtccaggcattgactcacccttggttgcgggatgaccaaagacagattccgctggatattcttgtctacagattaattaagcaataccttcgtgccactcctcttaaacgtttggcgctaaaggcattatccaaggctttaaaggatgacgaactcttatatcttaggctacagtttgatctacttgaacctagagatggagtcgtgtcacttgacaactttcggacggctttaacgcggtatctaactgatgcaatgaaggaatcaagaattcttgagtttttgcatgcgttggaaccacttgcatacaggagtatggatttcgaagaattctgtgcggcggctataagcccttaccagcttgaggccctggacagatgggaggagattgctggaacagctttccagcactttgaacaggagggcaaccgggtcatatcagtcgaggagttggcacaggaactaaatcttgctccgactcattattccatcgtgcaagattggatcagaaaaacagatggcaagctaaactttcttgggtttaccaaatttttacatggtgttacaatacggggggcaaacacaagacggcattaagtaaaccatgcggaaaaaaaaagatgtatctggttataattttaccgctgctcattatatggctctgattttgttgttgccccccaccccaccctgcttcttctgtcttgtggttaatgatcattcttcttctttttgtgatgtttttggttgttgtcaccatagctcttgtagagagaatacatgtaaaaatcttttgtaatgaaggcgatcggatggtttgttcgagaaatatagtgttc

SEQ ID NO: 4092 - DNA, 646 bp, Triticum aestivum
gaaggagcagacgaatgcctcgagtggctggacggcagggagcccggctccgtcgtctacgtcaacttcggtagcatcaccgtcatgaccaacgcgcagatggtggagttcgcgtgggggctggcgcagagcgggaagcacttcatgtggatcgtccgccgagacctggtgaagggcgacgccgcggtgctccccgaggagttcctggccgagacggccgggcgcgggctcatggcgtcctggtgcccgcagcagcaggtgctggaccaccctgccgtgggcaccttcctgacgcacagtggctggaactcggcgctcgagagcttgtgcggtggtgtgccggtgatcagctggccgttcttcgccgaccagcagaccaactgcaggtaccagtgcactgagtggggcgtcggcgtggagatcgacagcaacgtccggcgtgaggccgtcgccggacttatcacggagatcatggaaggggagaaggggaaaagcatgaggaagagagcgcgggactggaaggagagcacggtcaaggcggccatgcccggaggctcgtctcaccgaaacttcgacgagctggtccgcggcgtgctcctgcccaagaactagctctacaacgatcttcactgtaattacagaacgt

SEQ ID NO: 4093 - DNA, 585 bp, Triticum aestivum
gttcatgtggatcgtccgccgagacctggtgaagggcgacgccgcggtgctccccgaggagttcttgtccgagacggctggccgcgggctcatggcgtcctggtgcccgcagcaggaggtgcttaaccaccctgccgtcggagcgttcctgacgcacagcggctggaactcggcgctggagagcttgtgcggcggcgtgccggtgatcagctggccgttcttcgccgaccagcagaccaactgcaggtaccagtgcaacgagtggggcgtcggcatggagatcgacagcaacgttcggcgtgacaccgtcgccggacttatcacggagatcatggaaggggagaaggggaagagcatgaggaagagagcgcaggagtggaaggagagcgcagtcaaggcggtcatgcccggaggctcgtctcaccgaaacttcgacgagctggtccgcgaagtgctcctgcccaagaactagatctacaattgatcttcacagtaaatagagaacactattactgtatcttatttgcttgttaaggaagttcgttccttccgagagtgatgtccgttttgatgtacaaagatgaa

SEQ ID NO: 4094 - DNA, 718 bp, Triticum aestivum
ccccgctcccgctgctggcgcacgaggagatgccacgccgcgatggccatcaaccctcagcctctggaaggagcagaacgagtgccttgagtggctggacggcaaggagcccggctccgtcgtgtacgtcaacttcggcagcatcactgtcatgaccaatgcgcagatggtggagtttgcgtgggggctcgcgcagagcgggaagcagttcatgtggatcgtccgccgagacctggtaaagggcgacgccgcggtgctccccgaggagttcctggccgagacggcggggcgcgggctcatggcgtcctggtgcccgcagcagcaggtgctggaccaccccgccgtgggcgccttcctgacccacagcggctggaactcggcgctggagagcttgtgcggcggcgtgccggtgatcagctggccgttctttgccgaccagcagaccaactgcaggtatcagtgcaatgagtggggcgtcggcatggagatcgatagcaacgtccggcgtgacgccgtcgccggacttatcagggagatcatggaaggggagaagggcaagagcatgaggaagagagcagagaactggaaggagagcgcggtcaacgcggccatgcccggcggttcgtctcaccaaaacttcgacaagctggtccgcgacgtgctcctgcccaaaaactagctctacattgatcttcactgtaattagagaacactacta

SEQ ID NO: 4095 - DNA, 791 bp, Triticum aestivum
cctcgagtggctggacggcagggagcccggctcggtcgtgtacgtcaacttcggcagcatcaccgtcatgaccaacgcgcagatggtggagttcgcgtgggggctggcgcagagcgggaagcagttcatgtggatcgtccgccgagatctggtgaagggcgacgccgcggtgctccccgaggagttcctggcagagacggcggggcgcgggctcatggcgtcctggtgcccgcagcaggaggtgctgaaccaccccgctgttggagcgttcctgacgcatagtggctggaactcggcgctggagagcttgtgcggcggcgtgccggtgatcagctggccgttcttcgccgaccagcagaccaactgcaggtaccagtgcaacgagtggggcgtcggcatggagatcgacagcaacgtccgacgcgacgccgtcgcggggctcatcacggagatcatggaaggggagaaggggaagagcatgagtaagagagcgcaggagtggaaggagagcgcggtcaaggcggccatgcccggcggctcgtctcaccgaaacttcgaccacctggtcagcgacgtgctcctgcccaagtactaggtctacatcgatcgatcttacacggtaattagagaaacacatacatacgtacggagatatcttatttgcttcttaagaaagttcgtcccttcagagagtgatgatggacctgagacggagtaaccaaaaatgctaaaatacagcggacagctattgtaacggagtgctgatgtaggccatggtaagtttttcattt

SEQ ID NO: 4096 - DNA, 567 bp, Triticum aestivum
gccaccaccgctcctcgacctccatccgctctctcaactcgaaccaaggcgagttcgtcagcgaccatgtccgggcgcggcaagggaggcaaggggctgggcaagggcggcgccaagcgccaccggaaggtgctccgcgacaacatccagggcatcaccaagccggcgatccggcgcctcgctcggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggataggcgccccccttcgtcagcaactctgccccgctgtggccgcagacgggagaagtctgccatgtcttatgttcagtagctgtagccggaacaatgtcacctgttctcccatctgtctatcgcagaatctctctagttaccttgtagctccatgagcccagtcgtgtaatcgaatatatcgtctataccgtg

SEQ ID NO: 4097 - DNA, 1241 bp, Triticum aestivum
tgaccgtcaagccacaatatggttttggcgagcaaggaagggcggctactgaagttgaaggcgccgtgcccccgaattccacattgcacatcgatcttcagctagtttcctggaagacggttaccctcatcggtgacgacaagaggatcttgaagaaggtgctcaaggaaggagaaggctacgagcgccccaacgatggggcagttgtcagagtgggactgatcggcaagttggacgatggcactgtgttcacgaagaaaggacatgaaggcgacgaaccattcgagttcaagacggacgaggagcaggtcatccaagggctggacacgacggtgctcaccatgaagaaaggagaggtggcgtcagctagaataccacctgaacatgcgttcggatccaccgagacgaagcttgatcttgctgtggttcctcctaactccaccgtcttctatgaagtggagcttgtttccttcgagaaggagaaagaatctggggacttgaagagtaattctgagaagatcgaagcagcttctgaaaagaaagatgaaggaaatgcgtggtttaagatgggcaagtacgccaaggcttccaagagatatgagaaggctgcaaagtacatcgagtatgacagctccttcagcgaggatgagaagaagcaatccaaggcagtgaagatcagcatcaagctcaacaacgcagcgtgcaaactgaaactcaaggattacaaagaagcagagaaactctgcacaaaggttttggagctggagagcacaaacgtcaaggctctgtaccggagggcgcaggcgtacaccgagctcgtggatctggaactggcagaactagatatcaagaaggctctggagatcgacccggacaacagggaggtgaaggttgcgtacaaggcgttgaaggacaagctgagggagtacaacaagagggatgccaagttctacggcaacatgttcgccaaatggaggaagacggagaacgccgccgggaagcaggaagcgcagcctatggccatcgacagcaccgcgtgacgggtctacggcgtcgtggtacagccgggtctggatgcactagttttgtatcagcattgtaccgtggtttcggttgtcttgtcctctcttctgcaccttgtgcttcgtctgtgatcggctgcgtgccttgataatgtactcataatttgctggcgtacgattctagtaaaaaagagtgtctatttcgttttaaacgaattt

SEQ ID NO: 4098 - DNA, 609 bp, Triticum aestivum
gggctccgcggtgatgcaccccatagacgtgccggcaaggtgtgccagcacgacgagcccgcgccatcgcctgcagcatgccgaagctccggcacctggagatcgggtacatgctgatcgcgaccaacgtccgtggtggagatcgcgtcccggtgccgcgacctcagcttcctggacctgcgcggctgctggggcgtggacgacaagctgctgcaggacaagtacccggggctcaaggtcctgggcccgcgcgtggacgactgctacgagaacagcttcctggaggagtgctccgacgactcggacgacgactccatctactcgtgggaggagttcatggacgacgaggactacttcgccgccgggagcgacgacgacgaggccctgtgggacgacggccacgccctcgaggggctggaggtgaggttctacggcggcgggttcggcgagggcgccttcgccggcttcgactggccggagtctccatgaaccaagccttcttcttcatcaataagctgcttgcagatattggcctggatgttgagtgagcttgtctggaatgtaaaaaaacctgtggtgcttaaaacatagagcaacaaatcatcaata

SEQ ID NO: 4099 - DNA, 569 bp, Triticum aestivum
ctgatcgcgaccaacgccgtggtggagatcgcgtcccggtgccgcgacctcagcttcctggacctgcgcggctgctggggcgtggacgacaagctgctgcaggacaagtacccggggctcaaggtcctgggcccccgcgtggacgactgctacgagaacagcttcctggaggagtgctccgacgactcggacgacgactccatctactcgtgggaggagtacatggacgacgaggactacttcgccgccgggagcgacgacgaggaggccctgtgggacgacggccacgccctcgaggggctcgaggtcaggttttacggcggcgggttcggcgagggcgccttcgccgggatcgactggccggagtctccatgaaccaagatttcctcttcatcaataagctgtcaagagaagtgaagcctgcctgcctgcctgcttgcttgctcctgctgctgctgtctttatagcatgcttcagctttgaagcatcttcttccgtgttcgtgtgcttgtaaaaattgtgtcaaattgtgtcgtctttagctgcttgcagatattggcctggatgtt

SEQ ID NO: 4100 - DNA, 353 bp, Triticum aestivum
gtctcctggaagacggtcaccctcatcggtgaagacaagaggatcttgaagaaggtgctcaaggaaggagcaggctacgagcgccccaacgacggggcagttgtgagtgtgaggctgatcggcaagttggacgacggcactgtgttcacgaagaaaggacatgaaggcgacgaaccattcgagttcaggacggatgaggagcaggtcatcgaagggctggacacgacggtgctcaccatgaagaaaggagaggtcgcgtcagctagaataccacctgaacatgcgttcggatccaccgagacgaagcttgatcttgctgtggttcctcccaactccaccgtcttctatgaagt

SEQ ID NO: 4101 - DNA, 927 bp, Triticum aestivum
accgcgggactcccttcaagttcaagctcgggcaggggcaggtgatcaagggatgggaccagggcatcaagaccatgaagaagggcgagaacgccgtcctcaccatcccgccggacctcgcgtacggcgaggcgggctccccgcccacgatcccgcccaacgccacgctccagttcgacgtcgagctcctctcgtgggccagcgtcaaggacatctgcaaggacggcggcatcttcaagaaggtcctggtcgagggtcagaaatgggagaatcccaaggatctcgacgaagttacctgtcaagtacgaggcgagacttgaggatggatccgtcgtgtccaagtcagagggtattgaattcgcagtgaaggatggttacttctgccctgcactttccaaagccgtgaagaccatgaagaagggcgagaaggtcctcctgaccgtcaagccacaatatggtttcggcgagcaaggaaggccggcttctgaggttgaagccgcggtgcccccgaattccacattgcacatcgatcttgagctagtctcctggaagacgatcaccctcatcggtgacgacaagaggatcttgaagaaggtgctcaaggaaggagaaggctacgagcgccccaacgacggggcagttgtcagagtgagactgatcggcaagttggacgacggcactgtgttcacgaagaaaggacatgaaggcgacgaaccattcgagttcaagacggatgaggagcaggtcatcgaagggctggacacgacggttctcaccatgaagaaaggagaggtcgcgtcagctagaataccacctgaacatgcgttcggttccactgagacgaagcttgatattgctatggttcctcccaactccaccgtcttttatgaagtggacctcgttccttcgagaaggagaaagaatctt

SEQ ID NO: 4102 - DNA, 752 bp, Triticum aestivum
caccctcggcgacagcatactgctcatcccgcgctctgcttccactccgtcttcgagggcatcgccatcggagtcgccgagacgaaggcggacgcgtggaaggcgctctggacgatcagcctgcacaaggtgttcgcggcggtggccatgggcatcgcgctgctccggatgctgcccaaccggccgctgctctcctgcttcgcctacgccttcgcgttcgccgtctccagccccatcggcgtcggcgtcggcatcgtcatcgacgccaccacgcagggcgccgtggccgactggatcttcgccgtctcgatgggcctcgccaccggcatcttcatctacgtctccgtcaaccacctcctctccaagggatacgtgccccagaggcccgtcaaagccgacacgccactcggccgctggctcgccgtcgtgctcggcgtcggggtcatcgccgtcgtcatgatatgggacacctgatcctgatcgtgtggttcggggatggtttggtaattagttttggacgttagttcatattcatagtggaaggatatatactagctttaatgtgtagactactattgcctcatagtacatgtgctgtttacataatgctccctatgttccaaagttcaaaaaagcgctaggcgcgaattatgcgtttgggcacctacttgcgcttttctagcttaggcgtgattaggcaaaattaggcgcaattaggcgttagtactgtaacatgaagaaataagctagat

SEQ ID NO: 4103 - DNA, 788 bp, Triticum aestivum
gcacaaaggcaacggctcggatcaacgagcagctgagcagacgcgcacgggccgtcggcgacgggccactcgacggcgtcgatgctgcggaacgccagcaccctcggcgacagcatactgctcatcgccgcgctctgcttccattccgtcttcgagggcatcgccatcggagtcgccgagacgaaggcggacgcgtggaaggcgctgtggacgatcagcctgcacaaggtgttcgcggcggtggccatgggcatcgcgctgctccggatgctgcccaaccgcccgctgctctcctgcttcgcctacgccttcgccttcgccgtctccagccccgtcggcgtcggcgtcggcatcgccatcgacgccaccacgcagggcgacgtggccgactgggtcttcgccgtctccatgggcctcgccaccggcatcttcatctacgtctccgtcaaccacctcctctccaaggggtacaagccccagcggcccgtcaaagccgacacgcccctcggccgctggctcgccgtcgtgctcggcgtcggcgtcatcgccgtcgttatgatatgggacacctgatcgtctgaagttacatggggctggtttgttaattagttttggacgttcgttcatactgtagtatatttcatagtgcaaggataccagtagcttcaatgtaggctattgcctcatagtacatgtgctgtgataagagaactgtttacataatactactaggtgaaaacaagcaaaatgttaattcttaatattacgctcggaaaccactatcacct

SEQ ID NO: 4104 - DNA, 595 bp, Triticum aestivum
ctgcttttaaatggtgtgacctcttcaagtaaaaatgattcaaaggatgatgagtgggcatcttcagatgatgatgcagatgccatggaacatgatagtgactcagaagctgacaaatcatcagtgagtttcaaggagcaccgccgcaatcactatgatgaattccgcaaggtcaaggaactgatgcgcactggatccctggttgaagatgaggcccgtgcgaatgagcgagctgcaaacaacgtcgaagacaaaaccacaggagagaaggcaacaggcgacaagagtgaatcgccaacatcacctcaagtatgagccgcaaagtgaattctgtggtcgctaagcctagggaagttcaactaagcaggagcatgcagtttgcgcctgctctgtgtgtattggtggatccttgttttcataccagatcggatggttttctgtagccaaagaacatgttgctcttttttttcgagatgttccggtgcctaaaatgatggataattctagttgaactagctacttcaccttcagtcaggaggctagaatttgtctgcggcgctttttataatactagaactgaactatgtcaacaaga

SEQ ID NO: 4105 - DNA, 563 bp, Triticum aestivum
atccatggcccctaaggcggagaagaagccggtggcggagaagcccgagaagaccacgacggcaaagaagaccaaggccgagaagaggccaccggcgtccaaggaggcggcgagaagaagggcaagaagaagtccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctggccaggtacaacaagaagcccaccatcacgtcccgggagatccagacctccgtccgcctcgtcctccccggcgagctcgccaagcacgccgtctccgagggcaccaaggcagtcaccaagttcacctcctcttagatagcctgctcttgtgtcttctctgaatgtgttgacatctcgtgggtgtttgatgaatccactgtgctctgtagttagatgttcagaacgcagcatcttgtaatttgtgagggcacaaatgtttcaggatatggtggaaatag

SEQ ID NO: 4106 - DNA, 687 bp, Triticum aestivum
gaagatgggtcactatcaccaacacgccctttcgacaagtgtctagatgagactgttagtgctgaagctatattgactgctttaaatggtgtggcctcttcaagtaaaaatgattcaaaggatgatgagtgggcatcctcagatgatgatgcagatgccatggaacaggatggtgactcagaagctgacagatcatcagtgagtttcaaagagcatcgccgcaatcactacgatgaattccgcaaggtcaaggaactgatgcgcactggatccctggttgaagacgaggcccgtgcgaacgagcgagctgcaaacgacgtcgaagacaaacccgcaggagagaaggcaacaggcgacaagagtgaatcgtcagcatcacctcaagtatgagccgcaaagtgatttctgtggtcgctaagcctagggaagttcaactaagcgggagcatgcagtttgcgcctgctctatgtgtattgctggatccttgttttcataccagatcggatgattttctgtacgcaaagaacctgttcctcttttcatattttgagatcttgtggtgcctaaagtggtggagaattctagttacttcacgttcagtcagggggctagaatttgcctgggctgctttttataattctggaactgagttatatggacaacccttttcttcgtgagatcatgctt

SEQ ID NO: 4107 - DNA, 766 bp, Triticum aestivum
tctgtatgagattgaatcaaacaagccagtgagccagaagataacccgagcccaagacaccgtatcaccctatgatggatgaagatgggtcactatcaccaacacgccctttcgacaagtgtctagatgagactgttagtgctgaagctatattgactgctttaaatggtgtggcctcttcaagtaaaaatgattcaaaggatgatgagtgggcatcctcagatgatgatgcagatgccatggaacaggatggtgactcagaagctgacagatcatcagtgagtttcaaagagcatcgccgcaatcactacgatgaattccgcaaggtcaaggaactgatgcgcactggatccctggttgaagacgaggcccgtgcgaatgagcgagctgcaaacaacgtcgaggacaaaaccgcaggagagaaggcaacaggtgacaagagtgaatcgtcagcatcacctcaagtatgagccgcaaagtgaattctgtggttgctaagcctagggaagttcaactaagcgggagcatgcagtttgcgcctgctctgtgtgtattgctggatccttgttttcataccagatcggatgattttctgtacgcaaagaacctgttcctctttcttattttgagatgttgcggtgcctaaaatggtggagaattctagttacttcacgttcagtcaggaggctagaatttgctgggccgctttttataattctggaactgaattatatggacacccttgagcaaattttcttcttgatat

SEQ ID NO: 4108 - DNA, 743 bp, Triticum aestivum
  misc_feature (606)..(624): n = any nucleotide
tggagtatctgcactcgaagaacattgtgcatttcgacctgaagtgcgataacctgctggtcaacctcagggaccacgcacgccctatctgcaaagtgggtgattttggctgtccaaaatcaagaggaacaccctggtttcggcggcgtgagggggacactccctggatggccccggaattactcaacgggagtagcagcaaggtgtctgagaaggtggatgtgttctcgttcggtatcgtcttgtgggagatcctgaccggggaggagccctacgccaacatgcactatggcgcaataataggtggcatcgtgaacaacacgctgcggccgccggtgccggccaactgtgggccggagtggaggaggctgatggagcagtgctggtcgccggacccgtcgcagcggccggccttcacggagattgcggcgcggctgcggtccatgtcggccgcggccaaccagcaggccaaggcagctgcggcggccaagtagaagtacaaatcgccggctggggctgggttctggttgtgctgattggtgggaggaacgtatactacttgctacttgcggttgtggctgtggtggagtctgtggtgtatgtatnnnnnnnnnnnnnnnnnnntatagagttgtgagtgtaaaaatattggtgagatgaatgaaatgaatgaatggtgtcctcggtcgggtgtaaaaatatacacacgctatgtactattattataaacaaatattatatat

SEQ ID NO: 4109 - DNA, 647 bp, Triticum aestivum
catggcacccaaggcggcggagaagaagccggtggcggtggccgcggagaagacggcggcggggaagaagcccaaggcggagaagcgggcggcggcgaccaaggaggccggcggcgaggggaagacgaggggccggaagaagggcagcaaggccaagaagggcgtggagacgtacaagatctacatcttcaaggtgctcaagcaggtgcacccggacgtcggcatctcctccaaggccatgtccatcatgaactccttcatcaacgacatcttcgagaagctcgccggcgagtccgccaagctggcgcgatacaacaagaagcccaccatcacgtcccgggagatccagacctccgtccgcctcgtcctccccggcgagctcgccaagcacgccgtctccgagggcaccaaggccgtcaccaagttcacatcatcataggtttcgtcgtctgtttcatggattgatggcggcaggcgtcgtgcatgtagttggcagcagtacgatgttacaatctctgtaagaattgtgctgcttgcggccttgaagaaatagtgatgttgctgtttgaatcaatgttcgtctgtgcttgcgtgtcgcttcagagttcagactcttcttgatgctatttgtttatgtcagcaagttt

SEQ ID NO: 4110 - DNA, 585 bp, Triticum aestivum
ccaccgcagcacccatccccacccgtctttccggagcagcgatggcccccaaggcggagaagaagccggcggcgaagaagcccgcggaggaggagcccgcgacggagaaggccgaaaaggccccggccgggaagaagcggctgccggctggcaagaagaccgcctccaaggagggcggcggcgagaagaggggccggaagaagggcaagaagagcgtcgagacctacaagatctacatcttcaaggtgctgaagcaggtgcaccccgacatcggcatctcctccaaggccatgtccatcatgaactccttcatcaacgacatcttcgagaagcttgccggcgaggccgctaagctcgcccgctacaacaagaagcccaccatcacctcccgggagattcagacctccgtccgcctcgtcctccccggggagctcgccaagcacgccgtctccgagggcaccaaggccgtcaccaagttcacctcctcttagattccattgcctgtatccaatagctgttcgccctggttatcgccaagtagaagcagtgctagtgctggatgggagttgctgaatgcttgccgat

SEQ ID NO: 4111 - DNA, 943 bp, Triticum aestivum
tgatttgatatcgaagaaaaatattatcgagaatgacaagtcaaaaatcaagaaagtgatagaagagttggatgagaagaagaaagagaccttgaaagttacatggctgaaagttaacaaggattttgggtctatattcggtactcttctacctggtacaatggcaaaacttgatcctcctgaaggtggtaccttcttggatggtcttgaagttcgggtggcatttggaactgtctggaagcaatctttatctgaacttagtggaggacagcggtcccttcttgctcttagtcttattctggcgttacttcttttcaaacccgcgccactttacatattagatgaggttgatgctgcccttgatctgagccatacgcaaaacattggtagaatgataaaggcacattttccgcagtcccagttcatagttgtgtcgcttaaagagggtatgttcaacaacgctaacgtgatatttcgaacgaaatttgtggatggggtgtccactgtgacacgaacagtcccttcgaaacagaaatgataggcatgctatgtctgaagggacatgtgaagaactctttggtcatggaaatcaactaatcggcttcctatgttctgcgctagcgaatgccctgttgactgttggtacaaaaaaagtctcaagcccctcgcttgtaggcccttggcatcacatttgcaaacctatgcactaactcaatattagaacatgtcgtcatgttgatgtacatatatttttttcttgtgtgaatcttggcctgatggcctatattcactctatatttgtaaccgtttgtttccgttagggtctatttttgtttgaatatcaaacagtttctctaaaaaaaaaagtggactcagtattgaaaatttgaaatgacaagagatatcgaacgtataaaataaacaacgatgctatatatcaaca

SEQ ID NO: 4112 - DNA, 847 bp, Triticum aestivum
gtttgagaaggcagaggatgaatacaatgatttgatatcgaagaaaaatattatcgagaatgacaagtcaaaaatcaagaaagtgatagaagagttggatgagaagaagaaagagaccttgaaagttacatggctcaaagttaacaaggattttgggtctatatttggtactcttctacctggtacaatggcaaaacttgatcctcctgaaggtggtaccttcttggatggtcttgaagttcgggtggcatttggaacagtctggaagcaatctttgtctgaacttagtggaggacagcggtcccttcttgctcttagtcttattctggcgttacttctttttaaacctgcgccgctttacatattagatgaggttgatgccgcccttgatctgagccatacccaaaacattggtagaatgataaaggcacattttccacagtcccagttcatagttgtgtcgctaaaagagggcatgttcaacaacgccaacgtgatattccgaacgaaatttgtggatggggtgtcgactgtgacacgtacagtcccttcgaaacaaaaatgatagtcatgctttatctgaaggggtgcctaattcagggacacgactgtgaagaactctttggtcatggcaatcaactaaccggcttccaatgttctgcggtagttggattcgccacaaagtctcaagcccctcacttgtaggctattggcatcacaatatgtttgcaaacctttgtactaattcaatattagaacatgtcgtcatgttgatgtatatatttttttcttctgtgtatcttggcctggtggcgtattatattcactctatatttgtaactgttaa

SEQ ID NO: 4113 - DNA, 943 bp, Triticum aestivum
  misc_feature (161)..(161): n = any nucleotide
  misc_feature (185)..(185): n = any nucleotide
  misc_feature (261)..(261): n = any nucleotide
acaaagttgagtattgcgcgctgcccgcggttaactttggatggtcttattgccaatctaaagtcatttaatatgaaagcagtgtcgggtattaagtgcctcagaattgacaaaaacttcaatttaccaaaagaggattatgaggagttattatccttgtngagcatcgacaagagacaggagtngcacaaccgggctccgcgattccgtcattctaatcattttttattagattgcaatgacggatatgctcttgatatngagatgtgccccatctgtcaaagttacaaacttgtttttgactggcctgaagcggagtgcagtgacaagagatctggcaagtgcagagcatgtgaggtttgcatcaagagattccggcagtgtggaaggtgcttagaacgaaatgagaagtttgaagagaaatttgatctggtctacctttgctacaagtgtcgaggcgatccggcttcaccatctctcggtgtggaaaaggatctggtctccattttatccagtggaagaataccttctccttgaacatggaggagcaacagtccatgtccagccattcagccatctttcttagcattactgatgaagaaaaaaaaatatagtttgctattcatgaaggtgtgtggtcgtttgacagatggtacatttgcttgcaagaaaaacaaaaaaagatgttactaattccagcagaaataaagggatgattcccactattacagcctcaccagcgacaaggagggatgtttcttcatggaatttgcagttcaagagtgtataggtacatggtgagattggtgtcggtgtgttgcttgatgctgcatcttcctgtgaagaagactgaagacgaacttattccttagcttccaagtatattatatctgtatatgcgtgacattgtaatagtttgtcctggatacgtcgtgtcgtatga

SEQ ID NO: 4114 - DNA, 514 bp, Triticum aestivum
agtcatttaatatgaaagcagtgtcgggtattaagagcctcagaattgacaaaaacttcaatttaccaaaagaggattatgaggagttattatccttgttgagcatcgacaagagacaggagttgcacaaccgggctccgcgattccgtcattctaatcattttttattagattgcaatgacggatatgctcttgatattgagatgtgccccatctgtcaaagttacaaacttgtttttgactgccctgaagtggagtgcagtgacaagagatctggcaaatgccgagcatgtgaggtttgcatcaagagatgccggcagtgtggaaggtgcttagaacgaaatgagaagtttgaagagaaatttgatctggtctacctttgctacaagtgtcgaggcgatccggcttcaccatctctcggtgtggaaaaggatctggtctccattttatccagtggaagaataccttctccttgaccatggaggagcaacagtccatgtccagccattcagaa

SEQ ID NO: 4115 - DNA, 753 bp, Triticum aestivum
cagacctgaaggtgaacgggttcccgtgcaaggcgaacgcgacggcggacgacttcttcaccggggtgctcgccaagcccggcgccaccaacaccacggccggctccgtcgtcaccggcgccaacgtggagaaggtcccgggcctcaacaccctcggcgtctccctctcccgcatcgactacgcccccggcgggctcaacccgccgcacacccacccgcgcgccaccgaggtcgtcttcgtcctctacggtgagctcgacgtcggcttcatcaccaccgcaaacaagctcttcgccaagaccatctcccagggcgacgtcttcgccttcccgcgcggcctcgtgcacttccagaagaacaatgctgacaagcccgccgctgtcatctcggccttcaacagccagctccccggtacacagtccatcgccatggcgctcttcggggcctccccagaggtacccgacgacgtgctcgccaaggccttccagatcggcactgtggaggttgacaagatcaaggccaagtttgcgccaaagaagtgaaggaccggagcacgaataagattcagacttttgtaaaatacgttctcagtggttcgtttattgatttgttggttatccaataactgcgttaagcaagtcatactaatgcagtcgtgtcgtgcattcttggcgacccgactggcgacctgtgtaagtggcctgaagaaccacaaatttgtactactactaagtgggactgttggagtttcga

SEQ ID NO: 4116 - DNA, 945 bp, Triticum aestivum
acaatcgcagcagtggagtagggcgggcaccatgatgatggcccgggggtggcttcgccctgtttcttgcggtggcggcgcttgtcctcgcggtgccggcgcttgccggcgacccggactacctccaggacatctgcgtcgccgacctcaaatcagacctcaaggtgaacgggttcccgtgcaaggcgaacgcgacggcggacgacttcttcaccggggtcctcgccaagcccggcgccaccaacaccacggccggctccgtcgtcaccggagccaacgtggagaaggtgccgggcctcaacaccctcggcgtctccctctcccgcatcgactacgcccccggcgggctcaacccgccgcacacccacccgcgcgccaccgaggtcgtcttcgtcctctacggcgagctcgacgtcggcttcatcaccaccgcaaacaagctcttcgccaagaccatctcccagggcgacgtcttcgccttcccgcgcggcctcgtgcacttccagaagaacaatgctgacaagcccgccgccgtcatctccgccttcaacagccagctccccggcacgcagtccatcgccatgacgctcttcggggcctccccggaggtaaccgacgacgtgctcgccaaggccttccagatcggcactgtggaggttgacaagatcaaggccaagtttgccccgaagaagtgaaggaccggagcacgaataagattcagacttttgtaaaatacgtacaattctcagtggttcgtttattgatttgttggtcttccaataactgcgttaagcatgtcatactaatgcagtcgtgtcgtgcattatttgcgacctgactggcgatctgtgtaagtggactgaagaacgagaaatttgtactgctaagttggactgttggagtactggaggggagaatctatatctatctactaggtgttacccc

SEQ ID NO: 4117 - DNA, 881 bp, Triticum aestivum
ctccctcgcaacaactcgcccatttccctccacaccagcccgacacctcaagctcaaccccgatcgatggcgcccaaggccgagaagaagcccgcggagaagaagccggccgccgaggtcgcggagaaggccgagaagacccccgccggcaagaagcccaaggcggagaagcggctgccggcgtccaagtccgccaaggagggcggcgacaagaaggggcggaagaagaacaagaagagcgtggagacctacaagatctacatcttcaaggtgctcaagcaggtgcacccggacatcggcatctcctccaaggccatgtccatcatgaactccttcatcaacgacatcttcgagaagctcgccggcgaggcggccaagctggccaggtacaacaagaagcccaccatcacgtccagggagatccagacctccgtccgcctcgtcctccccggcgagctcgccaagcacgccgtctccgagggcaccaaggccgtcaccaagttcaccagcaactagggagggaaggtgtatctctagggttccgtcgccgtgttctcctctagcttctgtgttgccgtcggtcgtgtccatgtgtatcgttctaggtaggtagcgcgcctgctttgtaaatcgtgtcaggttgtgatggacggctttgatttcatttaatgggagaggttgtttgtgacttctcaatctgctagctgattgcgtcattctgcacaaaataattggggatctagggtttgagggagtgggtgctcgagccgccgtcagacgccgccgccactgccgatgatgttgcgagggagggtgatgcgtttggcctctcgtcataatggttcagccatggcttcagcaccgagatacatcgtgaggag

SEQ ID NO: 4118 - DNA, 678 bp, Triticum aestivum
ctccctcgcaacaactcgcccatttccctccacaccagcccgacacctcaagctccatcccgatcgatggcgcccaaggccgagaagaagcccgcggagaagaagccggccgccgaggtcgccgagaaggccgagaagacccccgccggcaagaagcccaaggcggagaagcggctgccggcgtccaagtccgccaaggagggcggcgacaagaagggccgcaagaagaacaagaagagcgtcgagacctacaagatctacatcttcaaggtgctcaagcaggtgcacccggacatcggcatctcctccaaggccatgtccatcatgaactccttcatcaacgacatcttcgagaagctcgccggcgaggcggccaagctggccaggtacaacaagaagcccaccatcacgtccagggaaatccagacctccgtccgcctcgtcctccccggcgagctcgccaagcacgccgtctccgagggcaccaaggccgtcaccaagttcaccagcaactagggttccgtcgcggtgtctctagggttccgtccccgtgttctcttctagtagcttttgtgtcgccgtcggtcgtgcccatgtgtatcgttataggtaggtagcgcgcctgctttgtaaatcgtgtcaggttgtgatggactgctttgatttcaattaatggaa

SEQ ID NO: 4119 - DNA, 641 bp, Triticum aestivum
caccttcttccagcactcacgagtcacagcccaccagcgaagccccaaccccgatcagcctcagcatcgatggcccccaaggcggagaagaagccggcggcgaagaagcccgcggaggaggagccgacgacggagaaggccgagaaggccccggcggcgaagaagcccaaggccgagaagcggctgccggcgggcaagaccgcctccaaggagggcggcgagaagaggggccgcaagaagggcaagaagagcgtggagacgtacaagatctacatcttcaaggtgctcaagcaggtccaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccccggcgagctcgccaagcacgccgtctccgagggaaccaaggccgtcaccaagttcacctcctcttagattccgctgcctgtatctgcaactagaagtagtgttagtgctggctggaaatagttgaaagcttgccaatgctttgttggctcgttgattgtaagggttgaatttgtgctagc

SEQ ID NO: 4120 - DNA, 631 bp, Triticum aestivum
aagcatcgatgccccccaaggcggagaagaagccggcggcgaagaagcccgcggaggaggagccgacgacggagaaggccgagaaggccccggcggcgaagaagcccaaggccgagaagcggctgccggcgggcaagaccgcctccaaggagggcggcgagaagaggggccgcaagaagggcaagaagagcgtggagacgtacaagatctacatcttcaaggtgctcaagcaggtccaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctcctcgtagattgccatgttcgcatctcagaaactgtagtttgctgccgtgtatctaaaactagtgtttattgctgaatggaaattcgtggaatgctgttagtttttggttcgattgctggtgttgccgtgtcatgtactgatctgaaatggtaaacgatgtggtgcgcatat

SEQ ID NO: 4121 - DNA, 526 bp, Triticum aestivum
gacgacggagaaggcccgagaaggccccggcggcgaagaagcccaaggccgagaagcggctgccggcgggcaagaccgcctccaaggagggcggcgagaagaggggccgcaagaagggcaagaagagcgtcgagacctacaagatatacatcttcaaggttctcaagcaggtccaccccgacatcggcatctcctccaaggccatgtccatcatgaactccttcatcaacgacatcttcgagaagctcgccggcgaggccgccaagctcgcccgctacaacaagaagcccaccatcgcctcccgggagatccagacctccgtccgcctcgtcctccccggcgagctcgccaagcacgccgtctccgagggcaccaaggccgtcaccaagttcacctcctcttagatcgctagtttctggcagtgcttgtagttacctggtgttgactcgtttgtctgaatctagaagtgttggtgatgaatgaaatttgttggatgctcttgggatgctctaaactggaatagaaa

SEQ ID NO: 4122 - DNA, 593 bp, Triticum aestivum
gcccgcggaggaggagccgacgacggagaaggccgagaaggccccggcggcgaagaagcccaaggccgagaagcggctgccggcgggcaagaccgcctccaaggagggcggcgagaagaggggccggaggaagggcaagaagagcgtcgagacctacaagatctacatcttcaaggtgctcaagcaggtgcaccccgacatcggcatctcctccaaggccatgtccatcatgaactccttcatcaacgacatcttcgagaagctcgccggcgaggctgccaagctcgcccgctacaacaagaagcccaccatcacctcccgggagatccagacctccgtccgcctcgtcctccccggcgagctcgccaagcacgccgtctccgagggcaccaaggccgtcaccaagttcacctcctcttagattgccatgtttacatctcagaaactgtagttggctgccgtgtatctaaaactagtgtttattgctcaatggaaattggtggaatgctgttagtttttcgttcgattgctgatgttgccgtgccatgtactgatctgaaatagtaaacgatgtggtgcgcatattttgggag

SEQ ID NO: 4123 - DNA, 652 bp, Triticum aestivum
tccccctccgaagcagcgatggccccccaaggcggagaagaaccgcggcgaagaagcctgcggaggaggagcccgcggcggagaaggccgagaaggcccctgctgggaagaagccgagggccgagaagcgggttccggcgggcaagaccgcctccaaggagggcggcgagaagaggggcaggaagaagggcaagaagagcgtcgagacctacaagatctacatcttcaaggtgctgaagcaggtgcaccctgacatcggcatctcctccaaggccatgtccatcatgaactccttcatcaacgacatcttcgagaagctcgccggggaggctgccaagctcgcccgctacaacaagaagcccaccatcacctccagggagatccagacctccgtacgcctcgtcctccctggggagctcgccaagcacgccgtctccgagggcaccaaggccgtcaccaagtttacctcctcttagatcgcgtcgcctgtatctagtagcaaatgtagttccttgctgttggcttagtgcttgtctgtggactctggttatctgcaagtaatattagtcctactgttggatgaaaattgctgaatcattgcaaatggtttgttggctcgttggccacctgcaagaagtgagttatgtccgct

SEQ ID NO: 4124 - DNA, 749 bp, Triticum aestivum
aagggcaagaagagcgtcgagacctacaagatctacatcttcaaggtgctgaagcaggtgcaccctgacatcggcatctcctccaaggccatgtccatcatgaactccttcatcaacgacatcttcgagaagctcgccggggaggctgcccgcggcggagaaggccgagaaggcccctgctgggaagaagccgagggccgagaagcgggttccggcgggcaagaccgcctccaaggagggcggcgagaagaggggcaggaagaagggcaagaagagcgtcgagacctacaagatctacatcttcaaggtgctgaagcaggtgcaccctgacatcggcatctcctccaaggccatgtccatcatgaactccttcatcaacgacatcttcgagaagctcgccggggaggctgccaagctcgcccgctacaacaagaagcccaccatcacctccagggaagatccagacctccgtacgccctcgtcctccctggggagctcgccaagcacgccgtctccgagggcaccaaggccgtcaccaagtttacctcctcttagatcgcgtcgcccgtatctagtagccaatgtagttccttgctgtaggcttagtgcttgtctgtggactccggtatctgcagtaatatagtcctacggtggttgaacacacacacacaaaaaacaccaacacaacaaaggggggcggctacacacacaacacacacgccaggcacacaacactaaggccaaaaagc

SEQ ID NO: 4125 - DNA, 919 bp, Triticum aestivum
ggcatcctccagggcggacgctggagatccgactccgctcggttccttctctcgtcggacataatggcggatatccagttaggatgttacactataaagtcccatggagccaaagtggcaagactccacatgtatgactggataatacttctcctccttgctgtcatagatggactgttgaatataatcgagccttttcaccgcttcattgggaaggacatgatgactgacttgagatatccattaaagggcaatactgtgcccttttgggctgttccgctcattggaattgtcttgccatgtgtcatctttggtggaatttacttcaagaagaagaatatctatgatttgcaccatggcatactgggtattctttattcggtgctcataactgcggtgattactgatgcaattaaggatggagttgccgaccacgtcctgatttcttctggcgctgtttcccagatggaaaggatctttatgataatgtcactactggcgttctgtgccatggagagaagagtgtcatcaaagaaggtcacaagagcttcccaagtggacactcatcatggtctttcgccggcctaggcttccttacatggtacttgactgggaaaatcgcagtttttgaccgtaaaggtcatattgcaaagctgtgcattattgttctgcctctacttactgctgcacttgttgctgtttctcgagtggatgactactggcatcactggcaagatgtggttgcaggagctgttctaggtttgccattttcgtagttctgtaaattcatataggtgaccttctatatttttctaaatatgcatataattattttctttttctgttgttccctgttccctttgcaggtctcacagtggcttcattttgttacctgcaatttttcccatatccttatgat

SEQ ID NO: 4126 - DNA, 581 bp, Triticum aestivum
cacaaaatgtggtaattttcatttatggatatgtaccaagagaagcaaagcaaaagcaagatggtgccaggattgttcccaataccatgttgccaaggacggagatgggtgggtggaaaatagatattctgcatccttgaagttagaaataccaagagcttttgtctgtgcggagagtaaaatatctgatgtatctgagtgggctacttgccagggaatggagtgcaaaccataacactcatggtccaacttttatggtgaacatggttggtgcggataggatgcctcagagatcgcagagttctcggtatccctttagcctggacgccgagatgatccccgaagacgaatttgagctgtggcttcaacaggcattggcgacgggcgtcttctctgacagcccgaaacgaaggaaaagctggagccccttcaaactgcctcagaaagggatcagaagttggcggcgatcgtcatgagggtgacgttaaatagcatggctacatggggcctcagatggtagcaacattgggaaaaaggcaataataacaaggtgtgtatttgtaaatagactgatcacaaag

SEQ ID NO: 4127 - DNA, 482 bp, Triticum aestivum
tgtgcggagagtaaaatatttgatgtatctgagtgggctacttgccagggaatggagtgcaaaccaaacactcatggtccaacttttatggtgaacatggttggtgcggataggatgccgcagagatcccaaagttctcggtatccctttagcctggacgccgagatgatccccgaagacgaatttgagctgtggcttcagcaggcattggcgacgggcgtcttctctgacagcccgaaacgaaggaaaagctggagccccttcaaactgcctcagaaagggatcagaagttggcggcgatcgtcatgagggtgtgacgttaaatagcatggctacatggggcctcagatggtagcaacattgggaaaaaggcaataatacaagggttgtatttgtaaatagactgaccaaaaaaatttgcctggatgagcaactaattttgtccgaaagagaaacaacaagtaaaaggaactcttaaatga

SEQ ID NO: 4128 - DNA, 969 bp, Triticum aestivum
cgcgtccggtggaaaatagatattctgcatccttgaagatagaaataccaagagcttttgtctgtgcggagagtaaaatatttgatgtatctgagtgggctacttgccagggaatggagtgcaaaccaaacactcatggtccaacttttatggtgaacatggttggtgcggataggatgcctcagcgatctcacagttctcggtatccctttagcctggacgccgagatgatccctgaagacgaatttgagctgtggcttcagcaggcattggcgacgggcgtcttctctgacagcccgaaacgaaggaaaagctggagccccttcaaactgcctcagaaagggatcagaagttggcggcgatcgtcatgagggtgtgacgttaaatagcatggctacatggggcctcagatggtagcaacattgggaaaaaggcaataatacaagggtttgtatttgtaaatagactgaccaaaaaaatttgcctggacgagcaactaattttgtccgaaaagagaaacgacaagtaaaaggaactcttaaatgaaaagacacagtgaacctgactgttgaaattagttctctctgctgggttcccacaagttgtttcaaagaaaagaccaggcatggggtcgaaacatgagtagctgttcggcgtgcgaactccatcagtgcagggatcgacgacgaaaagagtgctgacctggattacaggagcaaattctgcgggtgttgcgctgctctttctgaagcatcgctgaaggaaagatgctctgttcatggaagcagcaagttctgtgaagctcgttctggagaagagaagggggaaaaggaagaaacctgaaaagagatggtagaaactggctgctgtgtaaccatgggaaaccctgcatgagaaatgcactcgctcactgctctgtaaccattatatcactgatactactaacatcctgtggaaaaaactaccata

SEQ ID NO: 4129 - DNA, 471 bp, Triticum aestivum
caccgctcctcctccatttccatctcagtcagctccaagccgtcagccatgtccggccgcggcaagggagggaagggcctcggcaagggcggcgccaagcgccaccgtaaggtgctccgcgacaacatccagggcatcaccaagccggccatccggcgtctggcgcggcggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgttgtctacgcgctcaagcgacagggacgcactctctacggtttcggcggctaggcctgcgcccgctgctgctccatcgagtcgactctgctggatgctgctgttcctctgctatggtttcgtttctgagtgcgtgtcctgctgttccataggtctgtgtagtta

SEQ ID NO: 4130 - DNA, 464 bp, Triticum aestivum
tccatttccatctcagtcaaactccaagatgtccggccgcggcaagggagggaagggcctcggcaagggcggcgccaagcgccaccggaaggttctccgcgacaacatccagggcatcaccaagccggcgatccggcggctggcgcggcggggcggcgtgaagcgcatctcggggctcatctacgaggagacccgcggcgtgctcaagatcttcctggagaacgtcatccgggacgccgtcacctacaccgagcacgcccgccgcaagaccgtcaccgccatggacgtcgtctacgcgctcaagcgacaaggacgcaccctctacggattcggcggctgacctgcgcccgctgctgctccatcgagtcgactctgctgcatgctgctgttcctctgctatgcgtttcgtttctgagtgcgtgcgttgctgttccatctgtctgtgtagttagtggaaggcgatg

SEQ ID NO: 4131 - DNA, 891 bp, Triticum aestivum
gctatactacctcattcctctcgtgcttctactagctacctgcaggctgtagatatttgtcatcgatcatcaccaacttttcagttcaagctaggtagctagccatggctagggtgctggagcctctcatcgttggaaaggtcatcggggaggtcatcgacaacttcaacccaacagtgaagatgacggtgacctacagctccaacaagcaggtgttcaacggccacgagttcttcccgtcggcggtcgtgtccaagccacgcattgaagtccagggtggggacatgagatccttcttcactctggtcatgacggacccagatgtgccagggcctagtgatccataccttagggagcatctccactggatcgtcagtgatattcctggcaccacagatgcttcttttggaagggaggtggtgagctacgagagccccaagcccaacattggcattcacaggttcaccttcgtgctgttccaacagaagaagcggcaggccatgaaccctccctccaccagggactacttcaacacgcgccgcttcgccaacgagaacgaccttggcctcccggtggctgccgtctacttcaacgcgcagcgggagacagcggcacgccgccgctgacggaaacaatcagcccaacccttcttctcttgcatgcatggcgcatgcaacaagcctatggatcaacctatagctactattagctaccatctacatatatctccactcaaataagagtttgcttgtgagcgtcttgtgtgtgctgtttccagtagtctttctactgttcagttttttcttcggtcaatttagttactagttgatctgtgaaccagtgtacgtgcaatctacatctaccactagtgtgaatttgattcagctccta

SEQ ID NO: 4132 - DNA, 718 bp, Triticum aestivum
gtggggacatgagatcttcttcactctgttcatgcggacccagatgtgccagggccctaggtgaatccatacccttagggagcatctccactggatcgtctagtgatattcctggcaccacagatgcttcttttggtaagtccttttcatgcatgactgctttatcttttgctgattggtcccatccttaatttccctgaataaacacatgaatgcatgcaggaagggaggtggtgagctacgagagccccaagcccaacattggcattcacaggttcaccttcgtgctgttccaacagaagaagcggcaggccatgaaccctccctccaccagggactacttcaacacacgccgcttcgctgacgagaacgaccttggcctcccggtcgctgccgtctacttcaacgcgcagcgggagacagcggcacgccgccgctgacggaaacaatcagcccaccccttcttctcttgcatgcatggcgcatgcaacaagcctatggatcaacctatagctactattagctaccatctacgtatatctccactcaaataagagtttgcttgtgagcgtcttgtgtgtgttgtttccagtagtctttctactgttcagttttttcttcggtcaatttagttactagttgatctgtgaaccagtgtacgtgcaacctacatctaccactagtgtgaatttgattcagctcctatttgtggagacga

SEQ ID NO: 4133 - DNA, 899 bp, Triticum aestivum
cacatcaactggcaccaatgtgcaagtggtacaatcacattgagcactcctgaagctgagtggagttactgcccctggtcaaggtgtgaaggttctgtcatcagttgtccctgaaacctcaactactgatgttgctgaggctcctgcagctgatgatgacgatgacagcgatgttgacctttttggagaggaaaccgaggaggagaaaaaggcagctgaagagcgcgctgccaaagcaaaggcttctaccaagaagaaagaatctggcaagtcatcagttttgcttgatgttaagccatgggacgatgagaccgacatggtcaagctggaggaagctgtccgaagcatcaagatggagggccttctgtggggtgcttccaagctcatgcccgttggatatggcatcaagaagctccagattatgatgaccatcattgatgacctcgtctctgtcgacactcttattgaagaccatctctgcgttgaaccagccaacgagtacatccagagctgtgacattgttgccttcaacaaaatctaaatcttcctgaggcaggtgatggcggtgggcgcacaatatatctacagttttctgttgccgtgatggtgtcgtagctaaagcaagcataacatatctgccctgtgaggtttttggaccttagatcgagttgattcgtagtattactactgagtgttatttgcttcgtatgaaatgagacaatgtggttggattcctgttgctattctcttctgtctgccgtcttcatcggagctacttgtgtgtactcgcctacttttctcccttagatgcctggacgccggagctgttttttggtttgaattaccagcagtgctcctgtgccgtgttccccagctctacctgtgtatgtgtggctagc

SEQ ID NO: 4134 - DNA, 1214 bp, Triticum aestivum
ctcctcctcgcctccccgcggccacacctcgactcgctccctcgagtagatcatctgttccatccttttgaggcgagatggcggctaccttcaatgttaacgctgaggcaggccttaaaaagcttgatggctaccttctgtctcgcagttacatctctggataccaagcttccaaggatgacttggctgtgtattctgaattctcagttgctccaccatcaacttgcaccaatgttgcaaggtggtacaatcacattgatgcactcctgaagctgagtggagttactgcccctggtcaaggtgtgaaggttctgtcatcagttgtccctgagacctcaactactgatgtggctgaggctcctgcagctgatgatgacgatgacagcgatgttgacctttttggagaggaaaccgaagaggagaagaaggcagctgaagagcgtgctgccaaagctaaggcttctaccaagaagaaagaatctggcaagtcatcagttttgcttgatgttaagccatgggacgatgagactgacatggtcaagctggaggaagctgtccgaagcatcaagatggagggccttctgtggggtgcttccaagctcatgccagttggatatggcatcaagaagctccagattatgatgaccatcattgatgacctcgtctctgtcgacactcttattgaagaccatctctgcgttgaaccagccaacgagtacatccagagctgtgacattgttgccttcaacaaaatctaaatcttcctgaggcaggtgatggcggtgggtggacaatgcagcagcacaatatatctacagttttccgttgccgtgatggtgtcgtagctaaagcaagcataacatatctgccctgtgaggtttttggaccttaggtcgagttgagtcgtagtgttattactgagtgttatttgcttcgtatgaaatgagacaatgtggttggattcctgttgctattctctttctctgccgtcttcatcgcagctacctacttgtgtgtgctcgcctactttctcccttaacagatgcatggacgctggagctgttttgtcgtttgaattacaagcatggcgcctgtgccgcgttctccagctactgcgcctgtctttgcgtggctggctggtgcttgtctaccatagtcaccagtcagttcctgctaacctgtggctatgcgtcttcgctgttcttgcctatgta

SEQ ID NO: 4135 - DNA, 1008 bp, Triticum aestivum
ctcctcctcgcctccccgcggccacacctcgactcgctccctccctcgagtagatcatctgtgtcatccttttgaggcgagatggcggctacattcaatgttaacgctgaggcaggccttcaaaagcttgatggctaccttctgtctcgcagttacatctctggataccaagcttccaaggatgacttggctgtgtattctgagttctcagttgctccaccatcgacctgcaccaatgttgcaaggtggtacaatcacattgatgcgctcctgaagctgagcggggttactgcggccggtcaaggtgtgaaggttctgtcatcagttgtccctgaaacctcaactactgatgttgctgaggctcctgcagctgatgatgacgatgacagtgatgttgacctttttggagaggaaaccgaagaggagaagaaggcagctgaagagcgtgctgccaaagcaaaggcttctaccaagaagaaagaatctggcaagtcgtcagttttgcttgatgttaagccatgggatgatgagactgacatggtcaagcttgaggaagctgtccgaagcatcaagatggagggccttctgtggggcgcttccaagctcatgccagttggatatggcatcaagaagcttcagattatgatgaccatcattgatgaccttgtgtctgttgacactctgattgaagaccatctctgcgtcgagccagccaacgagtacatccagagctgtgacattgttgccttcaacaaaatctaaatcttcctgaggcaagtgatggcggtcggtggacaatgcagcagcacaaacaatatatctacagttttccgttgccgtagctaaagcagcataacatattctgccctgtgaggtttttggaccttaggttgagttgggtcgtagtattactactgagtgctatttgcttcgtatgaaatgagacaatgtggttgattcctgttgctattttcttctgtctgccaccttcattggagctacttctgt

SEQ ID NO: 4136 - DNA, 643 bp, Triticum aestivum
cagttatgatcatggacattcttcggagagcgaaagcaaatgttgtcgttgcatccttggaaggcactttggagattgttgcatccaggaatgtgaagatggttgctgatgtgcttttggatgatgcgcttaagcagcagtacgatctcattttgttacctggtggtcttggtggtgcccaagcatatgccaaatcagataaactgattggattgatcaagaagcaagccgaggcaagcaaactgtatggagccatatgtgcctccccagcaattgcccttgagccacatggcctgctgaagggaaagaaggctacatcctatcctgctatgtggagcaaactcgcggaccaaagcgaatgcgagaacagagtcgtcgtggatggcaacatgatcactagccaaggtccgggcacttccatggaattctcgcttgccatcgtggagaagctctttggaagggaaagggccttcgagctggccaaatcaatggttttcgtgtgagtgctgttgctactagagagtgacgctgtttgtgaatatgcgaggggatgctgtgttagctggtggtttttgttgcttagtactacaaataacgcaacagctcgtaatggatggaaatgcaataaagagttcagatgaat

SEQ ID NO: 4137 - DNA, 742 bp, Triticum aestivum
gtgaaaatcctcaaattctcgtaccaattgctaatggcacagaggagatggaggcaattatgataattgacattcttcgaagggcgaaagcaaatgttgtcgttgcatctttggaaagcactttggagattgttgcatccaggaacgtgaagatggttgctgatgtgcagttggatgatgcccttaagcagcagtacgatctcattttgttacctggtggtcttggtggtgcccaagcatatgccaaatcagataaactgatcggtttgatcaagaagcaagccgaggcaaacaaactgtatggagcaatatgtgcctccccagcaattgcccttgagccacatggcctgctgaaggggaagaaggctacatcctatcctgctatgtggagcaaactcgtggaccaaagcgaatgcaagaacagagtcgtcgtggacggcaacctgatcactagccaaggtccaggcacttccatggaattctcgcttgccatcgtggagaagctttttggtagggaaagggccttcgagctggccaaagcaatggtttttgtgtgagttctgttgctacgatgaagttcctggtcagactagagtggcgctgtgaatatacgaggggatgctgtgttagctggtggcctttgtttcttactagtacaataacgcaacagctcgtaatggatggaaatgcaataaaaagttaagatgaatacgatgcagttaagaatgtggaatgacactac

SEQ ID NO: 4138 - DNA, 841 bp, Triticum aestivum
tccccatcttccctgcctccagcaaactcacacatctcaccaccggagctcccaatcccacccgaagcggcagccatggcccccaaggcagacaagaagcccgtcgccgagaacaaggtggagaaggcggcggagaaaacccccgccggcaagaagcccaaggccgagaagcggctgccggcgggcaagacggcgtccaaggaggccggcggcgaggccaagacgaggggccggaagaagggcagcaaggccaagaagagcgtcgagacgtacaagatctacatcttcaaggtgctgaagcaggtccaccccgacatcggcatctcctccaaggccatgtccatcatgaactccttcatcaacgacatcttcgagaagctcgccggcgagtccgccaagctcgcgaggtacaacaagaagcccaccatcacctcccgggagatccagacctccgtccgcctcgtcctccccggcgagctcgccaagcacgccgtctccgagggcaccaaggccgtcaccaagttcacctcctcctagactgacggcgtgtagttggtttctgtatctgtactctgcttatctatctatctgcaagtagcggtagcggtagcagtacctgtgctgggtgattgccaacgctttgttggctcgttggttgtagtaagaactcaagttgctgctttggcaaactgaaatctatctagaactcaagttgtgttcctatattctgtactagtgatcttgcctgactgatgttagcttttgacccttctgaaatgtctggccatttgtattctggttgctgaactctggttatctgcaaacagtggtaataaaaacc

SEQ ID NO: 4139 - DNA, 799 bp, Triticum aestivum
  misc_feature (626)..(674): n = any nucleotide
accgcgccggcatcgtgcccgtctcctacagaagggtgccgtgcgtgaagaaggggggcatccggttcaccatcaacggccactcctacttcaacctggtgctggtgaccaacgtgggcggcgccggcgacgcgcagtccgtgtccatcaagggcacgcgcaccggctggcaggccatgtcccgcaactggggcatgaactggcagagcaacaccttcctggacggccagtgcctctccttccgggtcacctccagcgacggccgcaccgtcaccagcaacgccgccgcgcccgccggctggcacttcggccagaccttcgagggcgcccagttctagtccgcttcctcctcttctcttctccacaagcataagcgctggagagaagagacggagcactatattcaagaattattttggcattcgcgtgcgtgcgtgcaggaggaggaagaaaggccggccggcctcttcgttatagtgaaggaggacgctccgggctacgctgaggctgctaattagcacccgcttagacgctttccttctctcgatcaaagtctcaagtttactgaagactcgaacaaccatccatcaagtaccgtaccgtacgtagcagcttggcactccttnnnnnnnnnnnnnnnnnnnnnnnnnnnnnnnnnnnnnnnnnnnnnnnnnttaataatggcagtagttatgatcagtactagaagtacctttggtggtttgtaccagtactaatttgtactacggggtggtggcccttgcgatgaaattgaagatttgcaaggccatatttatgg

SEQ ID NO: 4140 - DNA, 429 bp, Triticum aestivum
cagcggagatgtctgggcgcggcaagggcggcaaggggctcggcaagggcggagcgaagcggcacaggaaggtgctgcgcgacaacatccagggcatcacgaagccggcgatccggcggctggcgcgtcggggcggcgtgaagcgcatctcggggctcatctacgaggagacccgcggcgtgctcaagatcttcctcgagaacgtcatccgcgacgccgtcacctacacggagcatgcgcgccgcaagaccgtcaccgccatggacgtggtctacgcgctcaagcgccagggccgcaccctctacggcttcggcggctaggctttccgttcctcgtagcggcttgtttgctggtggtgtggtggtggtagtttggtgtcgaatgttgtgttcctgatgtaaccgtgccctgttgcagtgaagtaaatcc

SEQ ID NO: 4141 - DNA, 785 bp, Triticum aestivum
gcggcctgctctactgggtcgcccagctcctgggctccaccgccgcctgcttcctcctccgcttctccaccggcgggctccccaccggcaccttcgggctgaccggcatcggcgcgtgggaggcggtggtgctggagatcgtgatgaccttcgggctggtgtacacggtgtacgccacggccgtggaccccaagaagggcagcctgggcaccatcgcgcccatcgccatcggcttcatcgtgggcgccaacatcctggtcggcggcgccttctccggcgcgtccatgaaccccgccgtctccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactaagcaaccaagcttgcatgcgagctcgccgtccatccgtgtgatgatcgatcgcgtctcgtcatcgtctccttccttgccatcgccatgagtcgttttagtttgctttgaatgaatccatccatccctgggtcgatcggtcggccagtagtcgagtcagtttgtggtgcgttcgtgcgtggagctgtaaaagcgtggatgatctcgatctgggacgaccgaccctgtcaatttgcttctgtaaaactgtgaattcgcccgccccgcccgagtaatttcaagttcagttgagtttgaacccgtcgtgccttcttggtaggaacttgaattctggaatta

SEQ ID NO: 4142 - DNA, 1143 bp, Triticum aestivum
cacatcaggggattggacctttacttacgttggacaataaaagaattgatagccaatgtacggcttagttgatgatacagtggaattttcattggccacgcgcttgctctccatagggatgatcgtcacctcaatgaaccagcacttgatactgtgaaaaggatgaaattatattcggagtctcttgcacgttttcaagggggctcgccttatatttatcctctatatgggctgggtgagctgccacagggttttgcacgtctaagtgctgtttatggtggcacttacatgttaagtaagccagaatgcaaggttgaattcgatatggaaggaaaagcgtgtggtgttacatcagaaggtgaaaccgcaaaatgcaagaaagttgtctgcgatccttcgtacttgacctacaaggtcaggaagatcggcaaagttgcacgtgcaattgctattatgagccatccaatcccaaatacaaatgagtcccactcagtccagattattttgccacagaaacaacttggacgcaattcagacatgtatgtcttctgttgctcatacacccacaacgtcgcaccaaaagggaagttcattgcatttgtctctgcagaagcggagagtgataatatacaatccgaacttaagcctggcattgatctacttggtccagtagatgagctcttttttgatatgtatgacagatatgaaccagtgaacgaaccatctcttgataattgcttcatctcaacgagctatgatgctaccacacattttgagactactgtgacagatgttcttaacatgtatacatgatcaccggaaagactattgatctgcgttgatttgagtgctgctagtgctgctgaagaagaatactagatttcataatcaaatacggctgttctcttcaacctgcaggacaaccataacaatgtcctgactatttcacccgcagatcaaatctggtgttatggccattgtcttccgcatgcttgtcgcttgcagcatatggaaaaaatgctggttccagacgattgaaccatcgtggttttatttactactgtactagaagagtaattagtgaatggtgtgaacagtgagcagggttggctatgaactttgtggttttattgtatgtatcat

SEQ ID NO: 4143 - DNA, 1121 bp, Triticum aestivum
tcatctctctccactccggccggccagccagtctcttcttcttcttctccagcgagcgagcgagctaggctcggaggtgagcgaaaatgccggtcagcaggatcgccgtggggagccaccgtgaggtgtacgaggtgggcgccctcaaggcggcgctcgccgagttcatctccacgctcatcttcgtcttcgccggccagggctccggcatggccttcagcaagctgagccccgacggcgcggcgacccccgccggcctcatctcggcggcgatagcccacgccttcgcgctgttcgtggcggtgtccgtgggcgccaacatctccggcgggcacgtgaacccggccgtgaccttcggcgccttcgtgggcggcaacatcaccctcttccgcggcctgctctactggatcgcgcagctgctgggctccaccgccgcctgcttcctcctccgcttctccaccggcgggctccccaccggcaccttcgggctgagtggcatcggcgcgtgggaggcggtggtgctggagatcgtgatgaccttcgggctggtgtacacggtgtacgccacggccgtggaccccaagaagggcagcctgggcaccatcgcgcccatcgccatcggcttcatcgtgggcgccaacatcctggtgggcggcgccttctccggcgcgtccatgaaccccgccgtctccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactgagcagcgagctcagcgcagccagcctgcttgcttgcgtgcaagcccgccgcctgcctgcccgtccgtccgtgtgatctatgatcgcgtcgtctccttccttgccatcaccatgagtcgtttaagtttgcttcctgggtcgatcagtttgtggtgagttcgtggagctgtaaaaccgtggacgacactgtcaatttgcttctgtaaaactgtgaattcgcccgtcccgcccgagtaatttcaagttgagttgagttcgaccgtgcctctgaaaacttgaattct

SEQ ID NO: 4144 - DNA, 1146 bp, Triticum aestivum
ctctctcgactccggccagtctcttcttctctagaaagctagcgaggcttggaggtgagcgaaaatgccggtcagcaggatcgccgtggggagccaccgtgaggtgtacgaggtcggcgccctcaaggcggcgctcgccgagttcatctccacgctcatcttcgtcttcgccggccagggctccggcatggccttcagcaagctgagccccgacggcgcggcgacccccgccggcctgatctcggcggcgatagcgcacgccttcgccctgttcgtggcggtgtccgtgggcgccaacatctccggcgggcacgtgaacccggccgtgaccttcggcgccttcgtgggcggcaacatcacccctcttccgcggcctgctctactggatcgcccagctcctgggctccaccgccgcctgcttcctcctccgcttctccaccggcgggctcccccaccggcaccttcgggctgaccggcatcggcgcgtgggaggcggtggtgctggagatcgtcatgaccttcgggctggtgtacacggtgtacgccaccgccgtggaccccaagaagggcagcctgggcaccatcgcgcccatcgccatcggcttcatcgtgggcgccaacatcctggtcggcggcgccttctccggcgcgtccatgaaccccgccgtctccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactaagcagcgagcttaggatcggagtcgccgtccatccgtccgtgtgatgcttcgtctcccccttccttcccgtcatcagtcgttttagtttctcgcgcggtcgccgcatgccatgatgcatgtatgcggagctcgcctcgtttgctttgaatcaatcagtcctgggatccgtcgatcggtcggtcagtcgagtcagtttgtggtgcgtgcgtggagctgtaaaagcgtggatgatctcgatctgggatgaccgacccagtcaatttgcttctgtaaaactgtgaattcgcccgcccgagtaatttcaagttcagttgagttggaatggat

SEQ ID NO: 4145 - DNA, 622 bp, Triticum aestivum
ccttcaagctcatccacacaagcacctctcggctctcccggtcgaagcatccgcatcctcatccatggcccccaaggcagccgagaagaagccggtggagaagaccccggcggggaagaagcccaaggcggagaagaaggtgccggcgtccaaggagggcggcggcgacaagaagggcaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctggccggcgagtccgccaagctggcgcgctacaacaagaagcccaccatcacgtcccgcgagatccagacctccgtccgcctcgtcctccccggcgagctcgccaagcacgccgtctctgagggcaccaaggccgtcaccaagttcacctccgcctgatctggccgtctccgtttgtcttctttgatggatgtatcggtgttgctctgtagtagttagctgttcgtgctctgtcgtgttgtagcttgtgctggttgttttggatcacatttcatgatccggagaaatagtaattcagttcttgac

SEQ ID NO: 4146 - DNA, 958 bp, Triticum aestivum
ttcttccttcttgcatctagaaactttacattccccaaaggttaaaaaaagggtagcgctaaggttagccaaaggtaaaaaagaaaaggctaatccatccgtccgcccgtccactgacgacgactgatcagacggccggcatggtctcgtggcggagcacggcgagatcggacggcccgaaggactcgtcgccgaagccgaagaggccggcgtcgaagccgtcgtcgccccactcggccgcggccgcggcggcagccgctgccgcctccggcgaggaggcgacgccgccgaaggcgtaggcgccgtcaatctcgtccgcgatgccccccaaggcggagaagaagccggcggcgaagaagcccgcggaggaggagcccgcggcggagaaggcggcgagaaggccccggcggcgaagaagagcgtggagacgtacaagatctacatcttcaaggtgctgaagcaggtgcaccccgacatcggcatctcctccaaggccatgtccatcatgaactccttcatcaacgacatcttcgagaagatgccgatgtcagggtgcacctgcttcagcaccttgacatcggcatctcctccaaggccatgtccatcatgaactccttcatcaacgacatcttcgagaagctcgccggggagtccgccaagctggcccgctacaacaagaagcccaccatcacctcccgggagatccagacctccgtccgcctcgtcctccccggggagctcgccaagcacgccgtctccgagggcaccaaggccgtcaccaagttcacctcctcctagactgacgatgcgtcgcttgttgtgacagatgtggctgtctgatgtatctgcaagtagaagtagtagttcgtgtggtagaagattgccacgctttgttggcttcttggttgtgagaactgaacgtgttgcttttgcaactgaaatctatctaaaaaatgtt

SEQ ID NO: 4147 - DNA, 761 bp, Triticum aestivum
gtgttagtatgggcaatcctcattgcatcacgtttggttcaaaagagttgaaggttctgcatgttgatgatttgaagcttagtgacattgggcccaaatttgagcatcatgaaatgtttcctgctcggaccaacactgaatttgtggaggtcttgtctcgctcacacctcaaaatgcgagtttgggagcggggtgctggagcaactcttgcttgtgggactggtgcttgtgccgttgttgttgcagctgttcttgagggccgagctgaacggaaatgtgtagttgatttgcctggtgggccattggaaattgagtggagggaggataacaatcatgtttacatgactggtcctgctgaggctgtcttctacggatctgttgtacactaggtgctggggacgaagatggaagggttacataactcagagcctgaaaaaatgattacaaggtctctcaaaacactttcctggtaccagtgtccctcccttcttgataatgactgctcactgtgggcaaaaacgagggaatgctatgggcagaattagaggctttcttttgaaccaatttaggtgtattttacattttaaccttttgtactccttcagtatcatgttagaaccctgtgttgggttatggatctgtcctgtcttctttctttgctaataagcttgggctgcctatgcatagcttgaatattgttgtctacaaatttaccttgatttactgcataatgattgggcttatctgttaattggtgagat

SEQ ID NO: 4148 - DNA, 1268 bp, Triticum aestivum
atgagagcgctcaaatggattttgctaaggtagagaagcgtgtgcgcacacaggcggtggaagcactggaactgttaggaatttgcgtatcagagaagacactgcaagtatcttctgaatcttgatgtgaactctgcatattatgatccaaaacccgctcgatgcgtgaggatcctttgccagatgcagaccccaatgataaattctatgtgggtgataaccaaaatagacttagtggacaagctcttgagttcaagcaactcaatgtccatgcatgggaggcttttgacaaggggcaggatttccatatgcaagcagctccatctcaagctgaactactgtacaagagtttcaagatcaagaaggagaagttgaaatctgaaagcaaggacaaaattatggagaagtatgggaatgctgcatctgacgaaccaatccctcgtgagcttcttcttgggcaaagtgaaaaagagattgagtatgaccggactggtcgcataatcaaaggacaggatgtagctcttcctaagagcaaatatgaagaggatgtcctaattaataaccacacaacagtgtggggttcatggtggaaagatcatcaatggggctataagtgctgcaagcagactattaaaaatagttactgcacaggccttgctggaatcgaggctgctgaagcatcagctgatttgatgagggaaaatatggcccgcaaggaggccgccgaagaggaacctgtacgacaagaagaaaagaaactagccacttggggaacagatattcctcaggatcttgttctggaccagaagttgcttgaggaatccttaaagaaggaggcaaagaggaagaaggaagagatggacgaaagaaagaggaagtacaatgtgaagtggaacgacgaggtcaccgccgaagacatggaggcctaccgtatgacgagagtccgccatgacgatcctatgaaagattttctcaattaggagttcatgtccgctggttgcgtggcagctgttatctaatgcatgtgtaagctggccacgcctgaagtactgctgctgtctgtccattcttcgctggattgttgtgtctgtattctcggccatctctaggaagacgggatgggatggcatgccggttcgtgagttactgatgttgtgaattacagatatgatcgcgtgatgtccaaaagcagaacgaagtttgttctcatatgttctttgtaacatcctggtaaccacggcgtacgcccaattaattgatgagtaata

SEQ ID NO: 4149 - DNA, 1069 bp, Triticum aestivum
attctatgtgggtgataaccacaatagacttagtggacaagctctggagttcaagcaactcaatgtccatgcatgggaggcttttgacaaggggcaggatttccatatgcaagcagccccatctcaagctgaactactgtacaagagtttcaaaatcaagaaggagaagttgaaatctgaaagcaaggacaaaattatggagaagtatgggaatgctgcatctgacgaaccaatccctcgtgagcttcttcttgggcaaagtgagaaagagattgagtatgaccggactggtcgcataatcaagggacaggatgtagctcttcctaagagcaaatatgaagaggatgtcctaattaataaccacacaacagtgtggggttcatggtggaaagatcatcaatggggctataagtgctgcaagcagactattaaaaatagttactgcacaggccttgctggaattgaggctgctgaagcatcagctgatttgatgagggaaaatatggcccgcaaggaggctgccgaagaggaacctgtacgacaagaagaaaagaaactagccacttggggaacagatattcctcaggatcttgtcctggaccagaagttgctcgaggaatccttaaagaaggaggcaaagaggaagaaggaagagatggacgaaagaaagaggaagtacaatgtgaagtggaacgacgaggtcaccgcggaagacatggaggcctaccgtatgacgagagtccgccacgacgatcctatgaaggattttctcaattaggcgttcatgtcccctggttgcttggcagctgttgtgtaatgcaggtgtaagctggctacgcctgaactcctggtctgcccatcctttgccggattgtcgtgtctgtattctctgcgatctctaggaagacgggatggcatgccagttcgtgagttgctgatgttgtgaagtacagatatgactcgtgatgtccaaaagcagaatgaagtttgttctcatatgttctttgtaacctcttggtaaccatggcatacgcccacttatatggatatttgtaccgttcatgagtaa

SEQ ID NO: 4150 - DNA, 1232 bp, Triticum aestivum
tgagctctctaatgacaagattgactcgtatgtcctctctgaatcaagcctcttcatctacccgtacaaggttgtgatcaagacctgcggttacaccaagctcctgctggccattccaaggattcttgagcttgctgaggagttgtccctgccacttgctgctgtgaagtactcccgtgggacattcatattccctgaggcacagccttctccacacaagaacttctctgatgaggttgccttcctgaatggctactttggtggactcaagtctggcggcaatgcctatgtcattggtgatcctgcaaagccaggccagaagtggcatgtctactatgccacccagcagcctgagcagcccatggtcaaccttgagatgtgcatgactggtctggacaagaagaaagcttctgtcttcttcaagacctctgctgatggctacacatcttgtgccaaggagatgaccaagctctctggcatctctgaaataatcccggagatggagatctgtgactttgatttcgagccatgtggctactccatgaacgccatccatggctctgctttctccaccattcatgtcacccctgaggacggcttcagctatgctagctatgaggtcatggggttggaccctgcctccatggcctatggtgacctggtcaagagggtgctgagatcctttggcccgtctgaattttctgttgctgtgaccatcttcggcggtcacagccttgctggcacctggggggagaggctgaatgttgggatctatgatagtaccaacatggtcgtccaggagctgcctgacgggggcgctctcatctaccagagcttcactgctgtcggcgaagacttcaccgggtcaccaagatctgtcctgaattgcaacgttgatggcaatttagttactggctgcaagatggatgctttcctttgctgggaagacgatgctgcgcaggagaaggatgagaggggggctggtaagaagatgaagagctcctgatggtgatgctagctggtctgaatgagcttgttgcgtcagtttgttcttagatttccttttcctgctcctgtcctagtactctgttatgggcaagtgacgtgaaaatggttagcgttttctgccagtgtgagcgaatgtatggaaatgcctgcatctggctgcatggtttatgaatataaagaataagccttgtattgagcaaatgttattttgttatttcctgaaa

SEQ ID NO: 4151 - DNA, 671 bp, Triticum aestivum
aaaagtgtcttgtttacgagcttatacgcaatggaagtgtggaatcccatcttcatggtgctgacaaggataagggcatgctgaactgggatgtcaggatgaaaattgctttgggtgctgctagaggcctggcgtacctacatgaagattcaacccacatgtcatacaccgcgacttcaaaggtagcaatatattgctggaggatgatttcactcccaaggttactgattttggtttagcaagggaagcaaccaatggaatcaatcctatttccacaagggtaatggggactttcgggtatgttgctccagagtatgccatgacagggcatcttcttgtcaagagcgatgtctacagttatggggttgtcttgctggagcttttatcaggaaggaagcctgtaggcatgtcggacaacatggatcctgagaaccttgtgacttgggctcgtcctcttctaggcaatagagagggcttggagaggctgatcgacccttctctgaacggcaactacaatttcgacaacgtagccaaagtggcgtccatcgcttcggtgtgcgttcacagcgatccgtcacagaggccattcatgggtgaagtagtccaggcactgaagctgatttacaatgacgcagaggaggccgttggtgattcctacagccacagggagt

SEQ ID NO: 4152 - DNA, 1302 bp, Triticum aestivum
  misc_feature (45)..(45): n = any nucleotide
  misc_feature (134)..(134): n = any nucleotide
  misc_feature (171)..(171): n = any nucleotide
  misc_feature (1082)..(1105): n = any nucleotide
gacaaggataagggcatgctgaactgggatgtcaggatgaaaatngctttgggtgctgctagaggcctggcgtacctacatgaagattcaaacccacatgtcatacaccgcgacttcaaaggtagcaatatatngctggaggatgatttcactcccaaggttactgatttnggtttagcaagggaagcaaccaatggaatcaatcccatttccacaagggtaatggggaccttcgggtatgttgctccagagtatgccatgacagggcatcttcttgtcaagagcgatgtctacagttatggggttgtcttgctggagcttttatcaggaaggaagcccgtaggcatgtccgacaacatggatcctgagaaccttgtgacttgggctcgtcctcttctaggcaatagagagggcttggagaggttgatcgacccttctctgaacggcaactacaatttcgacaacgtggccaaagtggcgtccatcgcttcggtctgcgttcacagcgatccgtcacagaggccgttcatgggtgaagtagtccaggcactgaagctgatttacaatgacgcagaagaggccgtcggtgattcctacagccacagggagtcatcatgtgacccggacgacgacctcccggcgggcttcatctttgacagtggtagcggcagctggtggaacagcggggcttccgggtgcctggactaccggaacccctcgccattcataaacatggagtacaggctccggccgaatagaagcgaggcaggagcgcgacggtgacccttactcggtagcgtcgacgggcggccgtgtacaaaagccagcaccccagagtagatcagcccctctgcagatcaggaagctctccccgtctcactggtcaagaggcagcttcagcgagcacgggcggcggcctcgccattgatttgatataaactagcgttagaccgactgttagcttcggttttttagacttgatgagacaggggctgggggggaatgccattcgctgattcgcctcccgtcgattcgtgcctctggtcagtgtacagttttccgacagagtcccagccagtgannnnnnnnnnnnnnnnnnnnnnnnggtagtctgatgatgtttgtaatctgccttgagctgccctgcttccctagaagaaacgacgacggggctggcggcgcggctggcagatgctgtctaatttttggagatggcagttcgtttgaaatgtgtcaggtttgtgtgatcttggtagggggattattgccagaaatctgggcgatatcatacgtgttggtgta

SEQ ID NO: 4153 - DNA, 649 bp, Triticum aestivum
tgctacatgaacagctgctcacaggcctgcactactgccacgtcaatcaggtctgcatcgggatatcaaaggttctaaccttttgatagacaatgagggtaacctcaagcttgctgattttgggcttgcgaggtcattctctagtgatcacaatggcaacctgactaaccgtgtcatcaccttgtggtacagacctccagaactgcttctcggaagcacaaggtatggtccagctgttgacatgtggtctgtgggctgtatttttgctgagcttctcaatggaaagccaatcctgccagggaagaatgagccggagcagctgaccaaattttcgagctttgtggcacccctgatgagttaatctggcctggtgtcactaagatgccatggtacaacaacttcaagcctccccgagtgttgaagagaaaagttaaagatgcctttaaacattttgaccggcatgctctggacctgttggagaggatgttaactttagatccatcacagaggataccagcgaaggaggcacttgatgcagagtatttctggactgatcccttgccatgtgacccgaaaagtttgccatcgtatgaagcatcacacgaattccagactaagaaaaaacgtcagcagcagaggcaagcggagg

SEQ ID NO: 4154 - DNA, 1016 bp, Triticum aestivum
atagacatgagggtaacctcaagctggctgattttgggcttgcgagctcgttctctagtgatcacaatggcaacctgactaaccgtgtcatcaccttatggtatagacctccagaactgcttctcggaagcacaaggtatggtccagctgttgacatgtggtctgtgggttgtatttttgctgagcttctcaatggaaagccaatcctgccagggaagaatgagccggagcagctgaccaaaattttcgagctttgtggcacccctgacgagttaatctggcctggtgtcactaagatgccgtggtacaacaacttcaagcctcccagagtattgaagagaaaagttaaagatgcctttaaacattttgaccggcatgctctggacctgttggagaggatgttaactttagatccatcacagaggataccagcgaaggaggcacttgatgcagagtatttctggactgatcccttgccatgtgacccgaaaagtttgccatcgtatgaggcatcacacgaattccagactaagaaaaaacgtcagcagcagaggcaagcggaggaagctgcaaagcgccaaaaaataaatcatcctcccccacattctcgcttgcctccgatccagcatccaggccaatcacaccagatcaggcctggccatgcgccacctgtggcaggtggctcgagccactatgcgaaacctcggggacctggagggcctaacaggtacccgcagggtgggaaccaaggcgcaggctataataacccgaaccgcggagggcaaggcagtggctatggcagcgccccgtatcctcagcaaggaagaggacctcctccgttccctgcagcaggtgctccacgcggtggtgaccaggacagatggacatatggagtcggtggcacccataattacccacacaggcggatccgccgatatggcacagtatggatcacaaggaccgaggaaggccccaactatcatcaaggcaggttcatcagcaaatcagcagcagta

SEQ ID NO: 4155 - DNA, 698 bp, Triticum aestivum
  misc_feature (48)..(48): n = any nucleotide
ctcactcccacttccaccttcgaagctccagcggcagccatggccccncaaggcagacaagaagccggccgccgagaacaaggtcgagaaagcggcggagaagacccccgcgggcaagaagcccaaggccgagaagcggctgccggcaggcaagacggctgtccaaggaggccggcggcgaggccaagacgaggggccggaagaagggcagcaaggcgaagaagggcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcccgctacaacaagaagcccaccatcacctccagggagatccagacctccgttcgcctggtcctccccggcgagctcgccaagcacgccgtctctgagggcaccaaggctgtcaccaagttcacctcctcttagactgacgctgcgtcgcttgttatgacagatgtagttggctgctgttttcttctgttagtggtcgctgactctgcttatgtatctccgactagtggtaggaatggtcctctctgtgctggatgattgccacgcttcgttggctcgttggttgtgagaactgaagttgctaatctatctgaatgttattgtttcaag

SEQ ID NO: 4156 - DNA, 1745 bp, Triticum aestivum
  misc_feature (1597)..(1597): n = any nucleotide
ggcaaagcataaaaaaggctacacgcgccatgtgtcgccgcgcgtcctcacacgtgcccccctcctttcattcccatcgggcgacgttgcacaaccccttatccgcccaacaaccagagtccagagctagtcaggtagtatcacgggcctataaatacaagaccaaccaactacagggcaagccgatccatcgttactcacagcctcacacgcaaaaaggccagaaagaagtggttttagcctgtgacagacccatcagcgtcgtgctcacgagggacctgccgccattgctgcaacttggaacttcatcttcccatcgtgatataaaggagaagctcgacacgatgcagagcgcccagcagaaagcgaggaggaagaacgcgcaggtgctggacgggtccgacatccgggagctggtggagaacgagggggcgttcgcgaagttcgtggagaacaagttccggcaccttgacgccgacggcgacgggaggctgtcgctgagggagctccagcccgccgtcgcggacatcggggccgccatcgggctgccggcgaaggggtcgtcggcgcaggcggaccacatctactccgaggttctaaatgagttcacccacgggaagcaagattcggtgagcaagccggagttccagcacgtgctgtccgacatactcctcggcatggcggccgggctcaagagggacccgatcatgatcctgaggatggacggggaagacctgaatgagtttgtcgagagcacggcgtacgaagcagaggcggtcgccatattctctcaaatcgagtccgggaatgcgtcgttgcgacaatgtttgcccgccgctcttcggcagctgacggtcgatcacggcatgccaccggcttcggactctctggttatggagaaggtcattgaacctgcattgcaggaactgccagcagatcagctcgaccgaccggcatcgcaagaggtcttcttccaagaattcaagaagtatttgggagtgatcgcccggcgactccaggagcgcccgataattgtggcgcacactgagaacacctttgatggggctggcattaggaagatactgtccaacaagttcgagttcgagaagctgctggattctgtctgggtagatgtacccaaggaacacaaagatagaacatcgaagaagtaccttcgcgtcgcgcttgacaagttggccgcctcagtaaatctaccaccatacggagctgttgatcaggtggatgttgtggtgaatgaggcgttcaagatggccaacgccgacgacgggaaggaggtggacgaggccgagttcaagaagctgctcaccgagatcctcggggcggtgatgctgcagctagacggcaacgccatcgcggtgtccacctacacctcctccacgagcccatgtccacttcgtcgaccttgttgtcaccgtcgccgtcgccgcccacggtgtcaccgccgagcgagtagacacatgtttggtagagtaacagtttccgctgacgctgtaactgcgaccgacgccggaatccacctgcttacactgcaataacgtgacgtttttgcctgtaacgtcaacctgagacggggtgnttatatgcatacagttggtgatcatgtaacctgctcggtgatttgtgatgaaataaggctttgcgtgccagaagggaacaagtgtagggactgagatatgtcatcatcacaaactgattcccgtttgatgaaagactagcaaacagtg

SEQ ID NO: 4157 - DNA, 745 bp, Triticum aestivum
gagggcctcgcgcggcccatggacgacgccggcgtccctggctcttcagagacaaggcctacctccacccgaaaaaggtggtggacctgggggagaagggcggtgcccgcctgggcctggaaggtggaggacgaccccaaggagaagaggactggaggcagcctccagggagaagaaaggacggcatcgaacaagtggcgcacaggcaggtccggcgcatcctctggtccgggctggggctgatcatgtcccagatcggcctcttcttccgcctcaccttctgggagctctcctgggacgtgatggagcccatcgccttcttcaccaccgcgtccgggctgctcgtcagctacacctacttcctcgtgacatcgagggacccgacgtaccaggacttcatggagaggctcttcctgtccaggaggaggaagctctgcgccaagcacaggttcgacatggagaggtacctggagctgcacaggctttgcaagtgccctctcgaaggccactatcctcatggccccaagcttcacaacttgtaacgccagggctagaatttcccagctggactctctggattgtgcaataggcaaatatatagcttccaaagtgttcgctgcatctttgcagaagtcaccagttacctgctagattaatcttgcagacatactaaaggctaatctcagtgatgggccactgtcattatgccattatggttctctatgttttaaagttgaagtacttc

SEQ ID NO: 4158 - DNA, 827 bp, Triticum aestivum
  misc_feature (208)..(208): n = any nucleotide
tgaccattatgagtcttacatagataagcctcagggctgaacatcaaataaactcaagcagcggagatcttcgttgataggtagaacccatgccatctgccttaaccctacaggcattctgacgtgggaaagcgtcctagttcgcatgttctgtctccaaagaacttttcttcaaattctctgctcttccatgcctggacaattaaanaaactgatttcttgtgtaggggtacgacacggtggtcggggagcgcggcgctcagctgtcgggagggcagaagcagcgggtggcgatcgcacgggccgtggccaaggaccccaggatcctgctgctggacgaggcgacgagcgcgctggacgcggagtcggagcgggcggtgcaggacgcgctggaccgggtggcggcgagccggacgacggtggtggtggcgcaccgcctgtcgacggtccggggcgccgacgtgatcgcggtggtgaaggacggcgcgatcgtcgagaggggcacgcacgacgccctgatcgccgtcaagggcggcgcctacgcgtccctcgtcgccctccactccgcgtcgtcggcgtcgtcgtagcgccgctccaagaggggcgctcgcgaatgaaatcgtgccgagcctgcgagattgttgggggtggcacgcctggtaattattaccacgttcggttcaggtgtcagttcgctgtgaaaatgaaaccctatcatcaagaatcagaatacctaagcacgaacgctttatatttctttctagaaaaaggaacaagaaagttctataggaataacaatacccaaatatatctgctacgtatcaaaa

SEQ ID NO: 4159 - DNA, 760 bp, Triticum aestivum
gacgcgggccacatacttctggacggggtggacatccagaagttccaggtgaggtggctgaggcagcagatggggctggtgagccaagagccagccctcttcaacgacaccatccgggccaacattgcctacgggaaggaaggggaggccatggaatcagacatcgtgtctgccgcgcaactcgcgaatgcccacaagttcatcagctcgctccatcaggggtacgacacggtggtgggggagcgcggcgctcagctgtcgggagggcagaagcagcgggtggcgatcgcgcgggccgtggccaaggacccgaggatcctgctgctggacgaggcgacgagcgcgctggacgcggagtcggagcgggcggtgcaggacgcgctggaccgggtggcggcgagccggacgacggtggtggtggcgcaccgcctgtcgacggtgcggggcgccgacctgatcgcggtggtgaaggacggggcgatcgtcgagagggggacgcacgacgcgctcatcgccgtcaagggcggcgcgtacgcgtccctcgtcgccctccactccgcgtcggcggcgtcgtagcgccgctccaagaggggcgctcgcgaaattgtgggtggcgcggctggtaattattaccacgttcggctcaggtgtcagttcgctgtgaaaatgaaacccctatctctccgaatacctacgcaggcacgctttatatttcttgttagaaaggaacaagaaagttctataggaataacaaatatcc

SEQ ID NO: 4160 - DNA, 637 bp, Triticum aestivum
agaaggagccacgaatcgacatcgtatccccgcgcaactgcgacgcccacaagttcatcagctcactcccaacaggggtacggcacggtgtcggggagccggcgcgcagctgtcgggagggcagaagcagcgggtggcgatcgcgcgggcggtggccaaggaccccaggatcctgctgctggacgaggcgacgagcgcgctggacgcggagtcggagcgggcggtgcaggacgcgctggaccgggtggcggcgagccggacgacggtggtggtggcgcaccgcctgtcgacggtgcggggcgccgacgtgatcgcggtggtgaaggacggcgcgatcgtggagcggggcacgcacgaggccctgatcgccgtcaagggcggcgcgtacgcgtccctcgtcgccctccactccgcggcggcgccgtcgtcgtagcgccgctccaagaggggcgctcgcggaattgttgggggtggcacgcctggtaattattaccacgttcggttcaggtgtcagctcgctgtgaaaatgaaaccctatccgaagacctacgcacgaacgctttatatttctttgttagaaaaggaacaaaaaagttctatataggaataacaatacccaaatattatcttctatcaa

SEQ ID NO: 4161 - DNA, 638 bp, Triticum aestivum
ctccatactggtacctgctccgcacgagtggggttacgagcaataagatgcctcgccgcgccttcggcacacttggtgccgtggacatcgccggagacgaggtggctgccaacaagttgggcttgaagaagatggccacatatgtcatatatggcaccggtgctttctttgccggatgggttttgtccgctgttgtttcagcaattgactccatccccttgctcccaagaatactggagatggtgggcctcggatacacggtttggttcagctcacggtatcttcttttcaaggacaacagagaggaattgtttgccaaagcttatgatctcaaaatgagaattgttggatccggtgatgcatgatgtgttcacatatggttggacggctgagtgtaataacttctctctcgttttgggagaaatactaagttgtgtgtttcaaacatatgttactgagtttgtgatgtagtgtctgttatgtttgaactattcggagaaaaatgtatgtcgtgctttctagagaaaatgtggtgtatgtgataactggaataagcaagtaagacccatgtaggacatggctaggacaaataatcccaacattgccccttttatgcagagcaaacatgaaagcttatg

SEQ ID NO: 4162 - DNA, 831 bp, Triticum aestivum
aaagctgacgcaatggcggcttgttttgcatcagcacccccgccgccgccgcccttccccacctcccgcgcggacgcgcacccccgtgcgacgtcgcgctcgccgctccggttcctgcccgtctctccctccgccgccgcggcctcccaactacagggctgcgctgctccggcacggagttggggttacggatgcaataaggatggccgcggccacgccgttcgggcacaacctggtggcggtggacatcgtcggtgacgaggtggctgccgacaagctccagttgggcttcaaggagatggccacatatgtcatatatggcaccggtgctttctttgccggatgggttttgtccgctgttgtttcagcaattgactccatccccttgctcccaagaatactggagatggtgggcctcggatacacggtttggttcagctcacggtatcttcttttcaaggaaaacagagaggaattgtttgccaaaacttatgatctcaaaatgagaattgttggatccggcgatgcatgatgtgttcacatatggttgggcagctgagtgtaataacttctctctcgttttgggagaaatactaagttgtgtgtttcaaccatatgttactgagtttgtgatgtagtgttcgttatgtttgaactattcggcgaaaaatgtatgccgtgctttctagagaaaaatgtggtgtatgtgataactggaataagcaagtaagacccatgtaggacatggaggctaggccaaataatcccaacattgccccttttatgcagagcaaacatgaaacttatgggaggttggtatgatatggtgtc

SEQ ID NO: 4163 - DNA, 670 bp, Triticum aestivum
cccgtgcgcccgctcgacccgacgcgcgaccctgccgactgcgtccggaggacgccgggcaaggtgctggtgaacgtgaccgtgcagaggagcctgtggccgctgcacgtcatggcgtcggcggactggagcgtggcggaccttgtggccgccgccgtggggatttacgtgaaggagggcaggcggcccttgctgccggcgaccgacccgtcgaccttcggcctacactactcccagttcagcttggaaagtttggacccgagggagaaggtgatggagctagggtcccggagcttcttcctgtgccccaggtcctcctcggccgccgtccagacctcctcgtcctcctgctcctctgccggagcaagcggtgtcaggaagttgattaagttgtgcgaactcttacagtggtagactagcagatgtaggggaaagtaggtgtaacggtctaccctatcgtaaggtgctagcgcttctgaaagactatgtctcggtcatccgtcttctcaaacaccatgtagtgcgagaaaccaaacggaggcaatcgagtcttgtggggaaaagtgcgcaaacctctgcagagtgtataaactaatcatgattagctgtgtccccggttatggacatcttgagtatctagtacctggattatcatatgaatctcatcatg

SEQ ID NO: 4164 - DNA, 712 bp, Triticum aestivum
acgccgagcaaggtgctgtgtacgtgaccgtgcagaggagcctgtggccgctgcacgtcatggcgtcggcggagtggagcgtggcggacctcgtggccgcctccgtggggatctacgtcaaggagggcaggcggcccttgctgccggcgaccgacccgtcgaccttcggcctacactactcccagttcagcttggaaagtttggacccgagggagaaggtgatggagctagggtcccggagcttcttcctgtgccccaggtcctcttcggccgccgtccagacctcctcgtcctcctgctcctccgccggagcaagcggtgtcaggaacgccggggaggcgcctacgtcagcgggcgaaccgccggcctggctgcgctacatgccgttctggccgaccatgtagcgagcgggcacacttcatcatccatgatgatcactgcccaccctcggtccatgtctcgaattggtttggcacgcagagcttcaggggataagaccgtagcgtgctggtgcctgatagtatctcgttgtttaggcggaaacgtcatgatccactcggctcagccacgccagattcagatagtaggaaatatcaggtgcgtgattaggacagttcccgggaccgtgcccgggcaattaagattgttatagactacaggaagcatgatgtgtaattattgaattttgtatctgattatggatgcaagtaga

SEQ ID NO: 4165 - DNA, 1107 bp, Triticum aestivum
ggacagcctcgccgcccggctcccgtgcgccttgccgccggcagccgtgatccttgcgcccgccgtctgatcgcccgggtgtttggagctgtttctgcggcagcgcctgccggtcaccgccagcaagggcgatgcctcctcacgcgccttccttcgagaagagctgctccggcgaccggcaaaggcaggagtcaggagggcagctgctgcgaggcccggggcagcggtcggcgtcgttccacgggcgcggggcggagcagcggcaccagctgccaaagcagaggcccaagacgcagccggacctgctcgccggcgttaggggcaggagcttccgcgccgccgacggcggcgagccgctggcggagctggcggtccggaggacgccgagcaaggtgctggtgaacgtgaccgtgcagaggagcctgtggccgctgaacgtcatggcgtcggcggagtggagcgtggcggacctcgtggccgccgccgtggggatctacgtcaaggagggcaggcggcccttgctgccgtcgaccgacccggcgaccttcagcctacactactcccagttcagcttggaaagtttggacccgagggagaaggtgatggagctagggtcccggagcttcttcctgtgccccaggtcctcttcggccgccgtccagacctcctcatcttcctgctcctccgccggcgcaagcggtgtcaggaacgccggggaggctcctacgtcagcaggcgaaccgccggcctggctccggtacatgccgttctggccgaccatgtagcgagctagcacgtcatcatccatgatgatcactacccaccctcggtccatgtctcgaattggtttggcacgcagagcttcagaggataagaccgtagcgtgctggtgcctgatagtatctcattgtttaggcggaagcgtcatgatccacttggctcggccacgccagattcagatagtaggaaatgtcaggtgcttgactaggacagttcccgagaccgtgtccgggcaattaagattgttatagactacaggaagcatgatgtgtaattattgaattttgtatctgattatattgatgaaagtagaggagattgaccggc

SEQ ID NO: 4166 - DNA, 751 bp, Triticum aestivum
gggagaggcgcccccgcccaccgcggcagcaccgccggccccgtcgcccccgccgggtttgatcccatggcgtccaagaggatcctcaaggagctcaaggacctgcagaaggaccctcccacctcatgcagcgcaggtcctgtaggtgaggacatgttccactggcaggccactatcatgggaccctcggacagcccgttcaccggtggcctatttttggtgaacattcatttcccaccggattaccccttcaagcccccgaaggtctctttccgcaccaaggtgttccacccaaacatcaacagcaacggcagcatttgccttgacattctcaaggaacagtggagcccggctttgaccatatcaaaggtcctgctgtcaatctgttcgttgctgacggacccgaaccccgatgatcctctggtgcccgagatcgctcacatgtacaagactgatagggccaagtatgagtccacggcgcgctcctggacacagaagtacgccatgggctagagcttgacggccagctggtgaccatggatgcgccgagccagaaccgttatcacctaaataaccagccaaaagtatcaccccaccccgtgacgaagtgaatggacttttgaggccgtcgtgcccctgttgaactcgtatgaatgtactcttgccatgtcaagtccgttgggtctgggtagtctgttctacctgacgtttcgttatccgttaagttaaatctctgtcgtatctatgatat

SEQ ID NO: 4167 - DNA, 791 bp, Triticum aestivum
ccgccgcagaggggagaggcggccgccgcccgccgccacagcaccgccggccccgtcgcccccgcgcaccccgccgggtttgatcccatggcgtccaagaggatcctcaaggagctcaaggacctgcagaaggaccctcccacctcatgcagcgcaggtcctgtaggtgaggacatgttccactggcaggcaactatcatgggaccctctgacagtccgttcaccggtggtctatttttggtgaacattcatttcccaccggattaccccttcaagcccccgaaggtctctttccgcaccaaggtgttccacccaaacatcaacagcaacggcagcatttgccttgacattctcaaggaacagtggagcccggctttgaccatatcaaaggtcctcctgtcaatctgttcgttgctgacggaccccaaccctgatgatcccctggtgcctgagatcgctcacatgtacaagactgatcgggccaagtatgagtccacggcacgctcctggacacagaagtacgccatgggctagagcctggacggccagctggtgaccatggatgcgccgagcccagaaccgttatcacctaaataaccagccaaagtatcaccccaccctgcgacgaagtgaatggacttttgaggccgtcgtgcccctgttgaactcgtatgaatgtactcttgccatgtcaagtccgttgggtctgggtagtctgttctacctgacgtttcgttatccattaagttaaatctgtgtcgtatctatgatatgtgtggctatccattgca

SEQ ID NO: 4168 - DNA, 800 bp, Triticum aestivum
cctctctgcccgtgtcccaacgccgccgcggccgctgcagagggagaggccgccgccgccctgcgccgctccccgcgcccccgccggccgggtttgatcccatggcgtcccaagaggatcctcaaggagctcaaggacctgcagaaggaccctcccacctcgtgcagcgcaggtcctgtaggtgaggacatgttccactggcaggccactatcatgggaccctcggacagcccgttcaccggtggtctatttttggtgaacattcatttcccaccggattaccccttcaagcccccgaaggtctctttccgcaccaaggtgttccacccaaacatcaacagcaacggcagcatttgccttgacattctcaaggaacagtggagcccggctttgaccatatcaaaggtcctgctgtcaatctgttcgttgctgacggacccgaaccccgatgatcctctggtgcccgagatcgctcacatgtacaagactgatcgggccaagtatgagtccacggcgcgctcctggacgcagaagtacgccatgggctagagcctggacggccagctggtgaccatggatgcgccgagccccagaaccgttatcacctaaataaccagccaaagtatcaccccaccccgtgacgaagtgaatggacttttgaggccgtcgtgcccctgttgaactcgtatgaatgtactctttgccatgtcaagtccgttgggtctgggtagtctgttctacctgacgtttcgttatccattaagttaaatctctgtccgtatcatgatatgtatggcttt

SEQ ID NO: 4169 - DNA, 800 bp, Triticum aestivum
accaatgtacaccatgacatgggtttgctctctcgtaggttccatctcggtcatgagtgtgaaagctcttgggatagctttgaagctcaccttttccgtaacgaaccaactcatatatccacagacatgggcatttagtatggttgtcatctcatgcatcattactcaaatgaattacttgaacaaggcccttgacacgtttaatacggcagttgtctcccccatatattatacgatgttcacatctttaaccatcttggctagtgtgattatgttcaaggactgggaccggcaaaatccgacacaaatcgtgacagagatgtgtggcgtcgtcaccatcttctcgggaacatttctacttcacaaaacaaaggacatggctgatgggctttcgaactcttcttcattccgtcttccaaccatttcatcggcgcggtccttcaagcaaacagatgagtatagcgaaggggttcctctcagatcgtcggactcgttccggtcactgcattgatgcccggtcagccgcgctgaccatcgattttcaccgagctagggctcaggagcaagcttgtaatcaaatctgtctcgtgtgcgttgtatctcggctgtttcgtatgttctgggagcattgtggctgagccccaaggtatctaagtagcaggttgttagcatagcaccggagtgggagttgttctgtataatggatggatgggttatcaagcaggcagggtgctgaaattttaaccttgctgttgagatggtttcatccaatatggtagttgaaagtaaacttaaataca

SEQ ID NO: 4170 - DNA, 636 bp, Triticum aestivum
gggagagctacacgagtgttgtgtctgggataagaagccggccgccgagagcaaggtcgagaaggcggcggagaagaccccggcgggcaagaagcccaagaccgagaagcggtttccggcgggcaagacggcggccaaggagggcgccggcggcgagggcaagacgaggggccggaagaagggcggcaaggcgaagaagggcgtggagacgtacaagatctacatcttcaaggtgctgaagcaggtgcacccggacatcggcatctcctccaaggccatgtccatcatgaactccttcatcaacgacatcttcgagaagctcgccggggagtcggccaagctagcgaggtacaacaagaagcccaccgtcacctcccgggagatccagacctccgtccgcctcgtcctccccggcgagctcgccaagcacgccgtctccgagggcaccaaggccgtcaccaagttcacctcctcctagactgaatctgaatgcgtcgccttgttgttccaaatgtagtactagttggctgctgttgactctgcctgtctctctgcgagtagtggtagtggtagatgattgccaacgcttcgttggctccttggttgttagaggtgaacttgttgcttttgcaaact

SEQ ID NO: 4171 - DNA, 669 bp, Triticum aestivum
gtacgcgttgttatacttgcctatgcagattgagttcttgcaattccagcagtaccgttgaccatgtctgcaggtctattatttggtagtgttactggtactattatggtttcaatcagtgggacactagctgccgctgtggcctttctcatcgctagatactttgctagagagcgtattcttaagatggttgaaggaaacaagaagtttctggcaattgataaagcaataggtgaaaatggattcaaggttgtgactctgcttcgtttgagtcccctattacctttctcccttgggaactacttgtacggcttgacttcagtcaagttcctaccctacgtgttgggcagttggttgggtatgcttccaggaacatgggcttatgtcagtgctggtgcatttgggcgagctataattcaagatgagacggaaatcggtctgggaggaaacaaccagctattgacactgggcatagggctattagttacagccgttgctgctacttatgtaacacggctcgctaaggatgctgtaaaggatattgacgacgaatagaatggtaggattacatagcaaaagggccattcaaatagcaaagtagcacgagaatgtacatcactggcatcttttggtgcaatctaatctagaaatacagcgattgtcagagag

SEQ ID NO: 4172 - DNA, 684 bp, Triticum aestivum
ggttcattgaggctatggcactgctggtacgcgttgtttatacttgcctatgcaggattggaggttcttgcaattccagcagtaccgttgaccatgtctgcaggtctattattcggtagtgttactggtactattatggtttcaatcagtgggacactagctgccgctgtggcctttctcattgctagatactttgccagagagcgtattcttaagatggttgaaggaaacaagaagtttctggcgattgataaagcgataggtgaaaatggtttcaaggttgtgactctgcttcgcttgagtcccctattacctttctcccttgggaactacctgtacggtttgacttcagtcaagttcttaccctacgtgttgggcagttggttgggtatgcttccaggaacatgggcctatgtcagtgctggtgcatttgggcgagctataatccaagatgagacggaaatcggtttgggaggaaacaaccagctattgacactgggcatagggctattagttacagccgttgctgctacttatgtaacacggcttgctaaggatgctgtaaaggatattgacgacgaatagaatggtaggattacatagcaaaagggccattcaagtagcaacgtagcacgagaatgtacaacactggcatcttttggtgcaatctaatctagaaataca

SEQ ID NO: 4173 - DNA, 604 bp, Triticum aestivum
cgcgtccgctctactactccaccccagccaaacttcgaagaagcagcagtcgccgcaccatccatggcccccaaggctgccgagaagaagccggtggagaggacccccgcgggcaagaagcccaaggcggagaagaaggtgccggcgtccaaggagggtggcgacaagaaggggaagaagaaggccaagaagagtgtggagacgtacaagatctacatcttcaaggtgctcaagcaggttcaccccgacatcggcatctcctccaaggccatgtccatcatgaactccttcatcaacgacatcttcgagaagctcgctggcgagtccgccaagctcgcgaggtacaacaagaagcccaccatcacttcccgcgagatccagacctccgtccgcctcgtcctccccggcgagctcgccaagcacgccgtctccgagggcactaaggctgtcaccaagttcacctcgtcctaggctcctcctgcattagttctagtgtttatttcctctccctcgtctgatgaattctgtagctagctgtgtgtgttctgacagcgtcatcctgtaacaatggtgctgcctgaataaatagtcatgttgctgcttg

SEQ ID NO: 4174 - DNA, 720 bp, Triticum aestivum
cagatcccgaacacctgccggcggcgaagcaacccacccacccttctcgtccctcccgaagcagcgatggcccccaaggcggagaagaagccggcggcgaagaagcccgcggaggtaggagccctcggcggagaaggccgagaaggtccccggcgtgcgaagtaagcctcaaggccgagaagcggctgcctagccggcaagaccgcctcccaaggagggcggcgagaagaagggcaagaagaagagcaagaagagcgtcgagacctacaaaatctacatcttcaaggtgctgaagcaggtgcaccccgacatcggcatctcctccaaggccatgtccatcatgaactccttcatcaacgacatcttcgagaagctcgccggggaggcctccaagctcgcccgctacaacaagaagcccaccatcacctcccgggagatccagacctccgtccgcctcgtcctccccggggagctcgccaagcacgccgtctctgagggcaccaaggccgtcaccaagttcacctcctcttagattgcgtcgcctgtatctagtagcaaatgcagttccttcctgttggtttagtgcttgtctgtggactctggttatctgcaagtaatattagtcctactgttggatgaaaattgccgaatcattgccaatgcttttttggctcgtcggaaacaatgttgcgttgttggttctatatatactgatttccg

SEQ ID NO: 4175 - DNA, 694 bp, Triticum aestivum
agccaggtgcgcaccagctccggacgttcctccccaagtagcaggaccaagttgtggcgaggatagaggagaggatcgccgcctggaccatgctgccacaggagaacggcgagagcatcccaggtgctccggtacgagagcggccagaagtacgagccgcacgtcgacttcatccggcacactgccaagggataccattcccgcggggggcaccgcgtcgccaccgtgctcatgtacctgtccgacgtcaagatgggcgacgagaccgtcttccccaactccgacgccgagtcgttgcagcccaaagacgacactatggtcagagtgtgcacgaagtgggtacgcagtgaaacctgtgaagggcgacgcggtgctcttcttcagcctgcaccccaacgggacgacggacccggacagcctgcacgggagctgccccgtgatcgacggcgagaagtggtcggcgaccaagtggatccacgtccgacccttcgacagccgccctcgcgtgccgtccaccgccggatgcggggacgagaacgatctctgccctcggtgggctgccaatggcgagtgcgccaagaaccctcgctacatggtcggaacccccggcaaccccggcttctgccggaagagctgcaacgcgtgcaccggtacactgtagatttggaaattgtaatggcatgccactgactgg

SEQ ID NO: 4176 - DNA, 990 bp, Triticum aestivum
tcaaacgacccgaccgtctcgtcaccgcatcccatggctcccctgttccagcgcgccctcctcgccgccctgctgctcgccagcacggcctcctcatccttcgccaccgccagccgcgacgacggcggcgggcgcttcgaccccacccgcgccgtccacgtctcgtggcgccccagggcgttcctgtacaaggggttcctgtcggaggcggaatgcgatcacctcgtcgcgctggcggaggagggtggcctgcagaagtcgatggtggtggaccggctgacggggaagagcgtgatgagccaggtgcgcaccagctccggaacgttcctccccaagaagcaggaccaagttgtggcgatgatagaggagaggatcgccgcctggaccatgctgccacaggagaacggcgagagcatccaggtgctccggtacgagagcggccagaagtacgagccgcacgtcgacttcatccggcacacagccaaaggataccattcccgctgggggcaccgcgtcgccaccgtgctcatgtacctgtccggcgtcaagatgggcggcgagaccgtcttccccaactccgacgccgagacgttgcagcctaaagacgacacatggtcagagtgtgcacgacgtgggtacgcagtgaaacctgtgaagggcgacgcggtgctgttcttcagcctgcaccccaacgggacgacagacccggacagcctgcacgggagctgcccagtgatcgatggcgagaagtggtcggcgaccaagtggatccacgtccgacccttcgacagccgccctcgcgtgccgtccaccgccggatgcggcgacgagaacgatctctgccctcggtgggctgcaaatggggagtgcgccaagaaccctcgctacatggtcggaaccgccggcttccccggcttctgcaggaagagctgcaacgcgtgcaccagtacattgtagattactatattgtaatcgcaggccactgactgg

SEQ ID NO: 4177 - DNA, 784 bp, Triticum aestivum
  misc_feature (10)..(10): n = any nucleotide
  misc_feature (23)..(23): n = any nucleotide
  misc_feature (43)..(43): n = any nucleotide
  misc_feature (47)..(47): n = any nucleotide
  misc_feature (50)..(50): n = any nucleotide
cctcaagatngccaccggcggcnaaggccgtgggcgcattctngatntcngccggcgtcggcgtctggaacgccgtggtcttcgagatcgtcatgaccttcgggctcgtctacacggtgtacgccacggcggtcgaccccaagcgcggcgacctcggggtcatcgcgcccatcgccatcggcttcatcgtcggcgccaacatcctcgccggcggcgccttcgacggcgcctccatgaaccccgccgtctccttcggccccgctgtcgtcaccggcgtctgggagaaccactgggtgtactggctcggccccttcgccggcgccgccatcgccgccctcgtctacgacatctgcttcatcggccagcggccccacgagcagctccccaccgccgactactgaaaacctcactctcaatctcatccatccatcaccgccatgagagattgaaatcgattcaaaaaattccagcaagtgtacgtcgtcgtgtcatcatcagtaagccagtttagtttcattctctctccctctctctcacgtgtctttgagaaattcagggtaaacagtgtgagtcagtcagtcaggaataatctcttgtcttggtgtatgtcctcaattatgaatgcttctattccatggtcaagattgatgtttgtacaaaggtattgtctgtcctggcaacttgatgtcttgccaatcttgtgtccatattttctgtagattttgtcctgtcacgacatgatatgtatggtaagcattggtgattatgatggatgggaagagtt

SEQ ID NO: 4178 - DNA, 736 bp, Triticum aestivum
tggtgtactgggtggcgcagctgctcggctccgtcgtggcctgcctcctcctcaagatcgccaccggcggcgaggccgtgggcgccttctcgctctccgccggcgtcggcgtctggaacgccgtggtgttcgagatcgtcatgaccttcgggctcgtctacacggtgtacgccaccgcggtcgaccccaagcgcggcgacctcggggtgatcgcgcccatcgccatcggcttcatcgtcggcgccaacatcctcgccggcggcgccttcgacggcgcctccatgaaccccgccgtctccttcggccccgctgtcgtcagcggcgtctgggagaaccactgggtctactggctcggccccttcgccggcgccgccatcgccgccctcgtctacgacatctgcttcatcggccagcgcccccacgagcagctccccaccgccgactactgaaaacctcaatctcatctcgtccatccgtcatcgccatgagagattgaaatcgcttcaaaaattccagcaagtgtacgtcgtcgcgtcatcatcagtaagccagtttagtttcattgcgctatcttgtccttgagaaattcagggtaaacagtgtgtgcgagtcagtcagtcaggaataatctcatccttctcttatcttggtgtatgtatgtacgtcctcaattatgaatgcttctattccatggtcaagattgatgtttgcacaaatgtatttgtctctcctagca

SEQ ID NO: 4179 - DNA, 1051 bp, Triticum aestivum
gaaaaaaaagagtgcccgtcgaaaatgccggtgagcaggatcgccatcggcgccccgggggagctgtcccacccggacaccttccgcgccggcgtcgccgagttcatctccatgctcatcttcgtcttcgccggctcaggctccggcatggccttcggcaagctgactgacggcggcgcgacgacgccggcggggctgatcgcggcggcgctggcgcacgcgttcgcgctcttcgtggccgtctccgtgggcgccaacatctcgggcgggcacgtgaacccggccgtcacattcggcgccttcgtgggcggcaacatcagcctcctcaaggcggtggtgtactgggtggcgcagctgctcggctccgtcgtggcctgcctcctcctcaagatcgccaccggcggcgaggccgtgggcgccttctcgctctccgccggcgtcggcgtctggaacgccgtggtcttcgagatcgtcatgaccttcggcctcgtctacaccgtctacgccaccgccgtcgaccccaagcgcggcgacctcggggtcatcgcgcccatcgccatcggcttcatcgtcggcgccaacatcctcgccggcggcgccttcgacggcgcctccatgaaccccgccgtctccttcggccccgccgtggtcagcggcgtctgggagaaccactgggtctactggctcggcccctttgccggcgccgccatcgccgccctcgtctacgacatctgcttcatcggccagcgcccacacgagcagctccccaccgccgactactgaaaatatcaatccgaatcccatccatcagtcatcgccatgagagactgaaattgcttcaagaatcaagcaggtgttatcgtgtcatcagcaagcccgtttagtttcatcgtctctctctcttgtctttgagaaattcagggtaaacagtgagtcagtcagtcagtcaggaataatctcttgtcttggtgtacgtacgtcctcaattatgaatgcttctattccatggtcatgattgatgtttgtacaaatgtattgtctctcctagcaa

SEQ ID NO: 4180 - DNA, 607 bp, Triticum aestivum
agtggagataaggaggctacttttccttaaagacacctatggcaatggtggcatggaaagcaaaagtcgtggctggtagcccgaacacttctctggtttcaagtgccaggaagttgcaacgtgagagggagatgctctgcaggcaaatgcagaagcggctctcgatcgaggaaagagagagcatgtacaccaaatggggagtttcgctgtcctccaagaggagaaggcttcaggtggcacgtcgcctttggaccgaaaccaaaaacctcgagcatgtcagggagagcgcttcccttgtcgcccgattgatcggcctcctggagccaggaaaggcgctgagggagatgtttgggctaagcttcgcgccgcagcagttcagccgacgatcccacaatagctggagatatggccgttcttctctggactgattacgacatgcaaatgaacacaggaggttcccttgtcctcccccacccccacctcacctcgccttggtgggtatagaattataggagcattgttagttatagcctgtaggccctttgatgtgtgtatgatactgtaatgcgttcagaagctctgtctactgctctgggtgatcaaacat

SEQ ID NO: 4181 - DNA, 667 bp, Triticum aestivum
ttttcttgttgtttaaaggagatccagccgactccatttacatggaagtggagataactaaggctatctttccttaaagatacctatgccaatggtggtatggaaagcaaagtcgtggctggtagcctgaacacttctctggtttcaagtgccaggaagttgcaacgtgagagggagatgctctgcaggcaaatgcagaagcggctctcgattgaggaaagagagagcatgtacaccaaatggggagtttcgctgtcctccaagaggagaaggcttcaggtggcacgtcgcctttggaccgaaaccaaaaacctcgagcatgtcagggagagcgcttcccttgtcgcccgattgatcggcctcctagagccaggaaaggcactgagggagatgtttgggctaagctttgcgccacagcagttcagccgacgatcccacaatagctggagatatggccgttcttctctggactgattgcgacatgcgaatgaacacgaggttttcattgttcccttgttggatatatagaattatataggagcatagcattggcggttgtagcttatataggcccttcagtgtgttttctgtatgatattgtaaaatgcatcgaccctactcaatcttacaccatcaagttcgattgggaagctctgtctacagaact

SEQ ID NO: 4182 - DNA, 826 bp, Triticum aestivum
ttcgagttcatcgccgacgagaggagcagccacacgggaagcagcagtagcagcaacgctgccggccccgggatgtcttccggtctaaagactgtgtgtggactgtggactagctaccacatcctcatgtactcctaccatgaagtaataagttgtgccctcctcaaaagtttcggacgcgtggggccgccagcaccaccgctcctcctccacctcgatccaaatcacacatcagctcaaaggaaggaagccgtcagccatgtccggccgcggcaagggagggaagggcctcggcaagggcggcgccaagcgccaccggaaggtgctgcgcgacaacatccagggcatcaccaagccggcgatccgccgtctggcgcggcggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtatacgcgctcaagcgacagggccgcaccctctacgggttcggcggctaggccgcgccggtccgggcaagaaggacccgtctcgcaccaccggatttgtgctagtagctacgcgttgtctgatggtggtgttcatgtcctcggtgtaatggccgcatctcgctgctgtttgccctggatttgtttgttgtttggatgtactaggatggaatggaaatcgcagcattttacccctgaattcgtacgtaatctgtgggtctgtcgatgtttgttggtgcttgtggtcacatattaccagtgcgttaa

SEQ ID NO: 4183 - DNA, 804 bp, Triticum aestivum
cttcctcccagtcccattccacagccatgtccgggcgcggcaagggaggcaagggtctcggcaagggcggcgccaagcgccacaggaaggttctgcgcgacaacatccagggcatcaccaagccggcgatccggcgcctggcgcggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctagggccgtccggccgacggtcgtcgctcgttgtcgccgcctgcagattccaaaagcctgatgagaccctgacttgtttagttcgctatttcctctgtagctcgaactgaatcgtggaccaaagttattcgcatgtgttgttggaaatgaaacctgtctctgttgtgataccgtgtttctgattttgtctcgctggtcggtctctgttattgaagcggcaacgagttgatttgccataatttaccaggagccccggatgagtcgtagtactacttgtttgcagtctattttgtaatgccatagtgactgaacaattgtgtgtcccgattcagcaacatcatttgctcaccattgatgttacttctgtggtaattgagattggggttagtctgcatttcatacattgagttctggattgagttgctgtccttggcgagagttctgggcgtacgaatttgctctcttgtaa

SEQ ID NO: 4184 - DNA, 596 bp, Triticum aestivum
  misc_feature (69)..(69): n = any nucleotide
tgttaatcaagaaatgtgttcaggtatgcgatcacccacatcccttgcatgtcaagagtatggtgaaanatgtactcgatgggaagtttgatgaggcctgctctggcctaaagcaactctatgatttgggctactctcctactgacatcatcactaccctcttccgtgtcatcaagaactatgacatggctgaatatctgaagctggaactgctgaaggaaacgggatttgcgcacatgaggatctgtgatggcgttgggtcattccttcagctttctggccttctggccaaatttgctctggtgagagaaacagcaaaggcctaacgctgtgcagctgctctgacaccagttaacagtgttgtcatgcatagcctattttatcgctcctctgtcgtggtatctcagtgtgtaagatagttctttgctgaagtgaactatttatgcttgtttagcatcggagatgtagttgtagcctgtagtgactagtgaggagactgagtcctcgtagttcgagtactgctgtatttcggaactaatctgggtatttttcgggtcttttgtagtctattgagctgtcgtaccaccatcatgaag

SEQ ID NO: 4185 - DNA, 653 bp, Triticum aestivum
tctgaaccataattttactgctgatgtgacatgagcaagcttgaacatttgcaagctacatcattggtttcgttttgttaatcaagaaaatgtgttcaaggtatgtgatcaaccacatcccttgcatgtcaagagtatggtgaaaaatgtactcgatgggaagtttgacgaggcctgctctggcctaaagcaactctatgatttgggctactctcctaccgacataatcaccactctcttccgtgtcatcaagaactatgacatggctgaatttctgaagctggaattgctgaaggagacaggatttgcgcacatgaggatctgtgcagctgctctgacatcagttaacagtgttgtgatgcgtatcgtgtttatcacgactctgtcttggtatctcagtgtgtaagatagttcttcgctgaagtgaactatttatgtttgtttagcgtcggagatgtagttgtagcctgtagtgactagtgaggagactgagtcctcgtagttcgagtgcttttggcccagccatccgtgcttcacgcgctgctgtatttcggaactaatctgggtatttttcgggtcttttgtagtctattgagctgtcgtaccagcatcatgaaggaaccgtcagttatcccaagtcaactgcatatcaa

SEQ ID NO: 4186 - DNA, 657 bp, Triticum aestivum
aaatgtgttcaaggtatgtgatcaccacatcctgcatgtcaagagtatggtgaaaaatgtactcgatgggaagtttgacgaggcctgctctggcctaaagcactctatgatttgggctactctcctaccgacataatcaccactctcttccgtgtcatcaagaactatgacatggctgaatttctgaagctggaattgctgaaggagacaggatttgcgcacatgaggatctgtgatggcgttgggtcattccttcagctttccggcctactggccaagtttgctctggtgagggaaacagccaaagcgtaacgctgtgcagctgctctgacatcagttaacagtgttgtgatgcgtatcgtgtttatcacgactctgtcttggtatctcagtgtgtaagatagttcttcgctgaagtgaactatttatgtttgtttagcgtcggagatgtagttgtagcctgtagtgactagtgaggagactgagtcctcgtagttcgagtgcttttggcccagccatccgtgcttcacgcgctgctgtatttcggaactaatctgggtatttttcgggtcttttgtagtctattgagctgtcgtaccagcatcatgaaggaaccgtcagttatccaagtcaactgcatatcaattatggattggc

SEQ ID NO: 4187 - DNA, 605 bp, Triticum aestivum
gtgactcgcaaaccctagctcgcgagcacagggccacaaaaccacacccctctccctgcccgccgccacttgccgcaactcctccaccagaaagggaagcacgccggagtcccatctccccggccgtcaaaatggtgaatgttccgaagaccaagaagacctactgcaaaaacaaggagtgcaagaagcacacacttcataaggtcactcagtacaagaagggtaaggacagtctgtctgcccagggaaagcgtcgttatgacaggaagcagtcgggatatggtggtcagaccaagcctgttttccacaagaaggcaaaaaccacaaagaagattgtgctgaagctgcaatgccagagctgcaagcactactcccagcgtgccatcaagaggtgcaagcattttgagatcggtggagacaagaagggcaaggggacatctcttttctagactgctttcacctatctggagtggtggtggtcaagaagtattactacttgtgttaagagtttgttgttaggagttaaattaatcagaccttgtcatgtatccaaactcctgtgtctcgcatttaagcaagaggcgacttttggctaagtgaagttt

SEQ ID NO: 4188 - DNA, 547 bp, Triticum aestivum
gggaagggaagcacgccggagccccatctccccggccgtcaaaatggtgaacgttccgaagaccaagaagacctactgcaaaaacaaggagtgcaagaagcacacacttcacaaggtcactcagtacaagaagggcaaggacagtctatctgcccagggaaagcgtcgttatgacaggaagcagtcgggatatggtggtcagaccaagcctgttttccacaagaaggcaaaaaccaccaagaagattgtgctgaagctgcaatgccagagctgcaagcactactcccagcgtgccatcaagaggtgcaagcattttgagatcggcggagacaagaagggcaaggggacatctcttttctagactgctttcacctatctggagtggtggtggtcacgaagtattactacttgtgttaagggttcgttgttaggagttaaattaatcagaccttgtcatgtatccaaactcctgtgtcttgcatttaagcaagaggcgagttttggctaagtgaagttttgtagcttgaatcctctttcattccgtata

SEQ ID NO: 4189 - DNA, 471 bp, Triticum aestivum
cgccccaccgtctccacccaattccatctgctcggagctccaagccgccatcatgtccggccgcggcaagggcgggaagggcctgggcaagggcggcgccaagcgccaccggaaggtgctgcgggacaacatccagggcatcacgaagccggcgatccggcgtctggctcgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcggcaggggcgcaccctctacggcttcggcggctgatctgctgctgctgctccgtccagtctctgccagctcctgttccatctgagtgtgcgtgttgctccgtcgttctgtgtagtagtggatgccatgagtatggatgcaat

SEQ ID NO: 4190 - DNA, 679 bp, Triticum aestivum
tgcatgcggcgcgggtgcatgtgccagaggaagatggatctggagagtcacgaattggattaaaactggcatgccttatagtatataccctaaataacaagggcatgcgttgtgtcgtgtgttatattgtgtctttgtgttgatccaattcgggctccaccccctcccagcgagaaatccccaattccttcgtcttcttcctcgcgagacgcacacagcagagcagagagcgagaagatgtccgggcgcggcaagggcggcaaggggctgggcaagggcggggcgaagcggcacaggaaggtgctgcgggacaacatccaggggatcaccaagccggcgatccggcggctagcgcggaggggcggggtgaagcgcatctccgggctcatctacgaggagactcgcggcgtgctcaagatcttcctcgagaacgtcatccgcgacgcagtcacctacaccgagcacgcgcgccgcaagaccgtcaccgccatggacgtcgtgtacgcgctcaagcgccagggccgcaccctgtacggcttcggcggttaggcgatagctagctaggcttcaatgtgtctatcaggtcgctggtctgcgaatgcttgtgcctgtggtttgatttaatgcttgttatagaggaaatgctgcctggatgtgtttctctacacctataggcagt

SEQ ID NO: 4191 - DNA, 689 bp, Triticum aestivum
tacctttcccttcgagcaaactcacacaacccacaccaccgcagcccccaaccccacccgaagcagcagccatgggcccccaaggcagacaagaagccggcggccgagaacaaggtcgagaaggcggcggagaagacccccgcggggaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctccagggagatccagacctccgtccgcctcgtcctccccggggagctcgccaagcacgccgtctccgagggcaccaaggccgtcaccaagttcacctcctcctagactgacggcgtgcagttggtttctgcatctgcatctgtactgttgactctgcttatctatctatccgcaagtagtggtagcagtagtagcacctgtgctgggtgattgccaacgctttgttggcccgttggttgtaagaactgaagttgctgctt

SEQ ID NO: 4192 - DNA, 730 bp, Triticum aestivum
ccctgcctctctccagcaactacgcccctccaccaccgaagctccctaccccacccgaagcggcagccatggcccccaaggcagacaagaagccggcggccgagagcaaggtggagaaggcggccgagaagacccccgcggggcaagaagcccaaggccgagaagcggctgccggcgggcaagacggcgtccaaggaggccggcggtgagggcaagacccggggccgcaagaagggcagcaaggcgaagaagggcgtggagacgtacaagatctacatcttcaaagtgctgaagcaggtgcaccccgacatcggcatctcctccaaggccatgtccatcatgaactccttcatcaacgacatcttcgagaagctcgccggggagtcggccaagctcgcccgctacaacaagaagcccaccatcacgtcccgggagatccagacctccgtccgcctcgtcctccccggggagctcgccaagcacgccgtctccgagggcaccaaggccgtcaccaagttcacctcctcctagactgacgacgcgccgcttgttgtgacagatgtggccgtctgctgtatctgtagtcgctgttgactctgcttatctccatctgcaagtagtggtagctgtagtgcgcgtgctgggtgatgattgccaacgctttgttggctggttggatgtaagaactgaacgtgttgcttttgcaactgatgaaatctatctagaaaat

SEQ ID NO: 4193 - DNA, 857 bp, Triticum aestivum
gtgatgatgatgtagaaaaaataaaaggatttcctatggaaacaagtatatcatttcgggaacggctgaagatacttggacgggtggctaatctggaggaccttcctttaagtgccgcggagaggaagctaatgcatgcatacaacgagaagcctgtgctttctagacctcagcatcagtttttcctgggtgataactactttgaggttgacattgacatgcatagatttggctacatctcaaggaaaggtttcgagacattcctggacaggctaaaaatatgcatgctagatgttgggctaaccatccagggaaacaaacccgaagaattgcctgagcaggtcttgtgctgtgttaggttgaacgggatagattatgcaaagtatcagccactgatgacaaacggtgcctgaacttggtgacttgcaaggaccagctaaccattgtttgtttgggatctgggaggtggcctgatcatgccaaggcgcggcggcgaggcccctcgaggtttccggccaggaaaccggaggcggactctcctcgtcggttcaccgccgtgagaagctagcgcgagcggctgcatgtaaaatctgtatatcgttacatgagctctgactgcctctgctgctgttgttgctgcccgtgattctggagctagtaaatatggctaatttgcccgtggaatggtaggtttcgatgcgccgcctcgacgagaaataggttcggtcgggcgcacctggaacatgaggaggacctgtggtgaacgcgagctgcttgcgatggtgtggaatgttgagcaccggaggcgttgtgtaagtgtaacccataccctcacatgacctcacatgagacgaaaa

SEQ ID NO: 4194 - DNA, 702 bp, Triticum aestivum
tgtgctttctagacctcagcatcagtttttcctgggtgataactactttgaggttgacattgacatgcatagatttggctacatctcaaggaaaggtttcgagacattcctggacaggctaaaaatatgcatgctagatgttgggctaaccatccagggaaacaaacccgaagaactacctgagcaggtcttgtgctgtgttaggttgaacgggatagattatgcaaagtatcagccactgatgacaaacggtgcctgaacttggtgacttgcaaggaccagctaaccattgtttgtttgggatctgggaggtggcctgatgatgccaaggcgcggcggcggcgaggcccctcgaggtttccggccaggaaactggaggcggactcctcgtcggttcaccgccgtgagaagcgcgagcggctgcatgtaaatctgtatatcgttacatgagctctgactgcctctgctgctgttgttgctgcccgtgattctggagctagtaaatatggctaatttgcccgtggaatggtaggtttcgatgcgccgcctcgacgagaaataggttccgtcagacgcacccggaacatgaggaggatctgcggtgaacgcgagctgcttgcaatggtgtgggatgtgagcaccggaggcgttgtataagtgtaacccatacctcacatgacctcacatgagacgaaaaataat

SEQ ID NO: 4195 - DNA, 896 bp, Triticum aestivum
ctcaaaagagctttcacccttattcatagagaatatcagaaggttggttgatgatgatgtagaaaaaataaaaggatttcctatggaaacaagtatatcatttcgggaacggctgaagatacttggacgggtggctaatctggaggaccttcctttaagtgccgcagagaggaagctaatgcatgcatacaacgagaagcctgtgctttctagacctcagcatcaatttttcctgggtgataactactttgaggttgacattgacatgcatagatttggctacatctcaaggaaaggtttcgagacattcctggacaggctaaaaatatgcatgctagatgttgggctaaccatccagggaaacaaacccgaagaactgcctgagcaggtcttgtgctgtgttaggttgaacgggatagattatgcaaagtatcagccactgatgacaaatggtgcctgaacttggtgacttgcaaggaccagctaaccattgtttgtttgggatctgggaggtggcctgatcatgccaaggcgcggcgaggcccctcgaggtttccggccaggaaaccggaggcgggctcgtcggtcaccgccgtaacaagcgcgagcggctgcatgtaaatctgtacatcattacatgagctctgactgcctctgctgttgttgctgcccgtgattctggagctagtaaatatggctagtttgcccgtggaatggtaggtttcgatgcgctgcctcgacaaaaaataggttcggtcgggcgcacctggaacatgaggaggatttgtggtgaacgcgagctgcttgcaatggtgtggaatgtcaacaccggaggcgttgtataagtgtaacccatacctcacatgacctcacatgagacgaaaaataatggagca

SEQ ID NO: 4196 - DNA, 735 bp, Triticum aestivum
gccccccgccctcgtctttctcatgcatggggcggcctacgggacgcccagacgcgtcgggtggcgtccatgggagtcatgcggccggagcttgtcatgaagtccatcgtgcccgtcgtcatggcgggagtgctcggaatctacggcctcatcatcgccgtcatcatcagcaccgggatcaaccccaaggccaagccctacttcctcttcgacggctacgctcacctctcctccgggctcgcctgtggcctcgcggggctcgccgccggcatggccattggcattgtcggtgatgctggagtcagggctaatgcgcaacaaccaaagctgttcgtgggcatgatccttatcctcattttcgcagaagcacttgccctttatggtctcatcgtgggcatcatcctctcgtcccgtgccggccagtcccgtgcggattaggcgcctcgctctaccattctgcaattgccacacaggctacattcttgagaagctgaagcattgaaaagttctaattttgatgtattaaggagatatttgtagatttttaaggaaggtgacacttccagtaccgttttcattctttttgggttgtggtgggcgtttgctgttcgtgcagaggattttggggtaggctggattgctgctcctgggaatatgggttttaatcctactggtggtgaataaaaacacgcattgtagctaaataataaatttatgattatattatgttcatct

SEQ ID NO: 4197 - DNA, 937 bp, Triticum aestivum
ggcgaggagaggagaggagaaaatagaagcaaactggagaggccctctgttcctctccctagcaaccatcttccttagcgacgaggccaccccgagttccacaggaaagaagcgcgaccggaggaggaagaagaggagcaagatgtcgtcggtgttcagcggcgatgagacggcgcccttcttcggcttcctcggcgccgccgccgcgctcgtcttctcatgcatgggggcggcctacgggacgtccaagagcggggtcggggtggcgtccatgggggtcatgcggccagagctcgtcatgaagtccatcgtgcccgtcgtcatggcgggtgtgctcggaatctacggcctcatcatcgccgtcatcatcagcaccgggatcaaccccaaggccaagccctacttcctcttcgacggctacgctcacctctcctccgggctcgcctgtggcctcgcggggctcgccgccggcatggccattggcattgtcggtgatgctggagtcagggctaacgcgcaacaaccaaagctgttcgtgggtatgatccttatcctcattttcgcagaagcacttgccctttacggtctcatcgtgggcatcatcctgtcgtcccgtgccggccagtcccgtgcggattaggcgcctcgctctaccattctgcaattgccacacaggctacattcttgagaagctgaagcattgaaaagttctaattttgatgtattaaggagatatttgtagattattaaggaaggtgacacttccagtaccgttttcgttctttttgggttgtggtgggcgtttgctgttcgtgcagaggattttggggtaggctggattgctgctcctggttatatgggttttaatcctactggtggtgaataaaaacacgcattgtagctaaataataaatttatgattatattatgttcatct

SEQ ID NO: 4198 - DNA, 765 bp, Triticum aestivum
tcttccttagcgacgaggccacccagagttccacaggaaagaagcgcgaccggagaaagaagaagaagagcaagatgtcgtcggtgttcagcggcgatgagacggcgcccttcttcggcttcctcggcgccgccgccgccctcgtcttctcatgcatgggggcggcctacgggacggccaagagcggcgtcggggtggcgtccatgggagtcatgcggccggagctcgtcatgaagtccatcgtgcccgtcgtcatggcgggagtgctcggaatctacggcctcatcatcgccgtcatcatcagcaccgggatcaaccccaaggccaagccctacttcctcttcgacggctacgctcacctctcatcagggctcgcctgtggcctcgcggggctcgccgccggcatggccattggcattgtcggtgatgctggagtcagggctaatgcgcaacaaccaaagctgttcgtgggcatgatccttatcctcattttcgcagaagcacttgccctttacggtctcatcgtgggcatcatcctctcgtcccgtgccggccagtccgtgcggattaggcgcctcggtctaccattcttgcattgcacacagggtacatcttgagaaggttctaatttggagtatcacgcgacttgcccatataaccgggggaacttcaggacgcggccaccctcgggggcggggggcgcggccgccagaatgggggacgaggggcccgcgagggggaacacccggggaaaagcgcgggata

SEQ ID NO: 4199 - DNA, 572 bp, Triticum aestivum
gcgttcctggggcagaatcccactgaggcagagcttcaagacatgatcaatgaggtggatgctgacggcaatggaacaattgatttccccgaattcctcaaccttatggcccgcaagatgaaggacactgattctgaggaagagctcaaggaggcattccgtgtgtttgacaaggatcaaaatggttttatctctgctgctgaactgcgccatgtcatgaccaaccttggtgagaagttgactgatgaggaggttgacgagatggtccgtgaggctgatgttgatggtgatggccagatcaactatgacgaatttgttaaagtcatgatggccaagtaagttgcattaccatctgagggaagcttcagtaatcagaccaaaatattacctatccaggtgccattttgtgggatggctattgtattaaaccgaaaacgataacactgctgtgtcatatgttgtaggcaatgattgtttgccttgaagattttatagatcctgctctggtctttctgattttgtctgttccgtttttttatgtttggttcgtttcaacttttcaagcgtgtagc

SEQ ID NO: 4200 - DNA, 780 bp, Triticum aestivum
ttcccggtcgaccaagcgtcgcgccattccgacccgactgcggccaatgcggacctagctcaccgacgaccagatcgccgagttcaaggaggctttcagcctcttcgacaaggatggggacggttgcattaccaccaaggagctgggaactgtcatgcgttccctggggcagaatcccactgaggcagagcttcaagacatgatcaatgaggtggatgctgacggcaatggaacaattgatttccctgaattcctcaaccttatggcccgcaagatgaaggacactgattctgaggaagagctcaaggaggcattccgtgtgtttgacaaggatcaaaatggttttatctctgctgctgaactgcgccatgtcatgaccaaccttggtgagaagttgactgatgaggaggttgacgagatggtccgtgaggctgatgttgatggtgatggccagatcaactatgacgaatttgttaaagtcatgatggccaagtaagttgcattaccatctgagggaagcttgagtaatcagaccacaatattacctatccaggtgccattttgtgggatggctattgtattaaaccgaaaacaatataacactgtgctgtgtcatatgttgtaggcaatgattgtttgccttgaagattttatagatcctgctctggtctttctgattttgtctgttccgtttttttatgtttggttcgtcaacttttcaagagtgtagccacaatctgttaatgaataactatatgtcagtgttccatgattacccct

SEQ ID NO: 4201 - DNA, 657 bp, Triticum aestivum
gccaccaccgttcctccgattccaccacatccgctcgcagctcgagatcgtgagccatgtccgggcgcggcaagggaggcaaggggctgggcaagggcggcgccaagcgccaccggaaggtgctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggtcctgccgactgtcgcctgtctctgtcgccgcctgcagatccgcaaagcttgatggaactctgactttttcagttcgctgtttactctatctgtgtagttcgaactgaatcgtggaacaaagttatttgcatatcttgttggaaatgaaacttgcctctgtcagcatgtcgtaaatctgattctgttcgctattgggtacgattgttgtttcccttgtgatgcttgggccccggatgaatcgaacttgtttgcaggctaatttgtaatgtgatgaaaaaacgccatta

SEQ ID NO: 4202 - DNA, 681 bp, Triticum aestivum
tccgattccaccacatccgctcgcagctcgagatcgtcagccatgtccgggcgcggcaagggaggcaaggggctcggcaagggcggtgccaagcgccacaggaaggttctgcgcgacaacatccagggcatcaccaagccggcgatccggcggctggcgcggcgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctatggcttcggcggctaggccaccaccggatagtcgttgtttggtacagtactagcagtgttcgtggtcctcgggtctgaaaaatcgccgcatctcgctgctgtttgccctggccctgtttgttgtctggatgtactaggatggaatggaaattgcagcagtttacccttgaattcgtccctgatatgtggatctgttgatgtttgttcatgcgcgtggtctgatattaccagtgcgttcttcagttgtcttgctctgtaaatttcagcctccaaatcagcttcggatttggatcctactctgtgttggcttcagtgttggactcaacaaatcctattatgtgtt

SEQ ID NO: 4203 - DNA, 883 bp, Triticum aestivum
gtagccaccgccgttcctccggttccacatcccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccaggggcgcaccctctacggcttcggcggctaggcccggccgacggtcgcatgtctctctcgccgcctgcagattcgaaaagcttgatggaaccccgacctgtctagttcgctgtttcctgtgtagctcgcatgtgtttgttggaaatcaaacttctctctgcaaatgccgcgtttctgaatttgtttcgccgtttggtctctgttgggtcgatattgaggtggcgatgagttgatttgccataatttaccaggagccccggattagccgtacttgtttgcagtctaatttgatgttacttctgtggtgcaatgtgtgaaaatggagatggtgatttgtctgcatttcatactacatcgagttgtagattgagtttctatccttgaccggacttcctggtgtacaaatttgttgcctgacttgtactgtgaaactatctcagtgaccaattcatcatgtggttcgtgctaactgctagtgctataagttaattaggatcatcatttgtgcttttatttctgttgatttgtatgtagttactacaata

SEQ ID NO: 4204 - DNA, 590 bp, Triticum aestivum
  misc_feature (7)..(7): n = any nucleotide
  misc_feature (106)..(106): n = any nucleotide
gcagctngctgggcagatcgtgaagatgagccaacaaaaatttgcttccaacgttgttgagaagtgtctgtcttttggttctcctgaggagcgccagattctaatnaatgaaatgcttggcactactgacgagaatgagccattacaggcaatgatgaaagaccagtttgcaaactatgtagtgcagaaggttttggagacttgcgacgaccacaaccgtgagctgattctttcgcgtatcaaggtccacctgaacgcactgaagagatacacctacgggaaacatattgttgcccgtgtggagaagcttatagccgcaggagaaaggcgtatcggggtctcgtcgcagtcttgcagagattgaatggttagtttgacagaataacccctgtacagacagatagcgaggctagccttaccagtagtcgttgtccagtgccgtcgtcggagaagttggagctcaagaaagcctttgattgtaaataaaggagggggcctctgggaataaagaaagagaaagagaagagattttgcttgttcaaaaggagagaagttgtatatttgtacctttttccctcttcgagtaagat

SEQ ID NO: 4205 - DNA, 702 bp, Triticum aestivum
tctactactccaccccagccaaacttctctctcgccttcgaagaagcagcagccgccgccgtagcatccatggcacccaaggctgctgagaagaagcctgtggagaagacccccgcgggcaagaagcccaaggcggagaagaaggtgccggcgtccaaggagggcggcgacaagaaggggaagaagaaggccaagaagagcgtcgagacgtacaagatctacatcttcaaggtgctcaagcaggtgcacccggacatcggcatctcctccaaggccatgtccatcatgaactccttcatcaacgacatcttcgagaagcttgccggcgagtctgccaagctcgccaggtacaacaagaagcccaccatcacgtcccgggagatccagacctccgtccgcctcgtcctccccggcgagctcgccaagcacgccgtctccgagggcaccaaggccgtcaccaagttcacctcgtcctaggctcctcgtgcattagttcttgtgtttctttcctcttcgttgtctgatgaattctgtagctagctgtgtgtgttctgacagcgtcatactgtaacaatggtgctgcctgaataaatagtcatgttgctgcttgaatggacgactgtcgccttggattcagtttcatctcgggctaagagctgggaagatggtttcttatctctgaaagttttgcacagatgcttg

SEQ ID NO: 4206 - DNA, 573 bp, Triticum aestivum
tccagcccagccaaacttttctcaccttcgaagaagaagcagcagcatccatggcccccaaggctgctgagaagaagccagtggagaagacccccgcgggcaagaagcccaaggcggagaagaaggtgccggcgtccaaggagggcggcgacaagaaggggaagaagaaggccaagaaaagcgtggagacgtacaagatctacatcttcaaggtgctcaagcaggtgcaccccgacatcggcatctcctccaaggccatgtccatcatgaactccttcatcaacgacatctttgagaagctcgccggtgagtccgccaagctcgcgcgctacaacaagaagcccaccatcacgtcccgcgagatccagacctccgtccgcctcgtcctccctggcgagctcgccaagcacgccgtctccgagggcaccaaggccgtcaccaagttcacctcgtcctaggctcctcgtgcattagttcttgtgtttctttcctgttccctgtctgatgagttctgtagctagctgtgtgtgttctgacagtgtcatcctgtaacaatggtgctgcctgaataaa

SEQ ID NO: 4207 - DNA, 708 bp, Triticum aestivum
agacgagaagaagaacaggaggagctcaaggagaaattcgagggtctgtgcacaggtcatcaaggagttgctgggtgacaaggtggagaaggtcatcgtctctgaccgtgttgtggactctccttgctgtctggtgactggtgagtatgggtggactgccaacatggagaggatcatgaaggcccaggccttgagggactcgagcatggctggctacatgtcgagcaagaagaccatggagatcaaccctgagaacgccatcatggacgagcttcgcaagcgcgccgacgccgacaagaacgacaagtctgtcaaggaccttgtgatgctgctcttcgagacctccctgctcacctccggcttcagcctggaggaccccaacaccttcggcaccaggatccccgcatgctcaagcttggcctgagcattgacgaggacgacgaggcgcctgagaacgacaccgacatgccacccctggaggatgacgctggtgagagcaagatggaggaggtcgactaagcgcaaggccgtcggctgtcgtcgttggatgtccatgccctgcgttgtttttatctttagtgtcgaagttcgatggttttggcacgtttagctgtatcggttttgtcttttggctggccaacattaagcgcggttagctgtttgtggtactcgtggaacagttcgttattgttggttctacatatgtgt

SEQ ID NO: 4208 - DNA, 655 bp, Triticum aestivum
gtgacaagttgagaaggtcatcgtctctgaccgtgttgtggactctccttgctgtctggtgactggtgagtatgggtggactgccaacatggagaggatcatgaaggcccaggccttgagggactcgagcatggctggctacatgtcgagcaagaagaccatggagatcaaccctgagaacgccatcatggacgagcttcgcaagcgcgccgacgccgacaagaacgacaagtctgtcaaggaccttgtgatgctgctcttcgagacctccctgctcacctccggcttcagcctggaggaccccaacaccttcggcaccaggatccaccgcatgctcaagcttggcctgagcattgacgaggacgacgaggcgcctgagaacgacaccgacatgccacccctggaggatgacgctggtgagagcaagatggaggaggtcgactaagcgcaaggccgtcggctgtcgtcgttggatgtccatgccctgcgttgtttttatctttagtgtcgaagttcgatggttttggcacgtttagctgtatcggttttgtcttttggctggccaaacattaagcgcggttagctgtttgtggtactcgtggaacagttcgttattgttggttctacaatatgtgttagctatatttttatattc

SEQ ID NO: 4209 - DNA, 545 bp, Triticum aestivum
gggacaagcaccttcaccactacattatatacggggagactgtacaggacagattcgaacactaccgccggctgagaaatccttccacgactgctgtccagcaagcgatacacgggctctcgtactgcgtctacggcaagcctgatgtgcggcgcttgatgttcgaggtgtttgacttcgaacaggtccagccgaaagctgtatgaggaggatatgctccgtgtcggtttgtgttgaactgatgaccggcgagattgtcagcgcttgaaggaaaaaatgcagggtcgtcaaaatcctagcgcgggtcagatcgcgctcttccgaagcctgagcccaaagccggcccgcagattaaagcaagcactgcccgtccagcctcttctggacccccacagctcttgtaacctcttgtcttgcgtactagagataggcagctgtattagagatgattaaaattgaacgccgtagttttttcgaagttacagttttgagagttgactgtaaattccagtttgagcagaaacacaaacagctgcagctgcagc

SEQ ID NO: 4210 - DNA, 665 bp, Triticum aestivum
gaagcatctcgacgcgcctggcaggtgggctgtcagagaagcataggaggttgctgatgaacaagtattgcgggcggtacctgcgggacaagcaccttcaccactacattatatacggggagactgtacaggacagattcgaacacaaccgccggctgagaaatccttccacgactgccgtccagcaagcgatacatgggctctcgtactgcgtctacggcaaacctgatgtgcggcgcttgatgttcgaggtgtttgactttgagcaggtccagccgaaagctgtatgaggaggatatgctctgtgtcggtttgtgctgaactgatgaccggcgagattgccagcgcttgaaggaaaaatgcagcatcatcaaaatcctagcgcggatcagatcgcgctgtttcgaagcctgagcccaaagccggacggtggattaaagcaagcactgcccgtccagcctcttctggacccccacagctcttgtaacctcttgtcttgcgtactagagataggcagctgtattagagatgattaaaattgaacgccgtagttttacagttttgagagttgactgtaaattccaatttgagcagaaacaaaaacagctgctgctgcagcagcaggaagatatagagttatccgtgagaaacatgctttgtaatgt

SEQ ID NO: 4211 - DNA, 656 bp, Triticum aestivum
aatgtgcgcaaagtcgtgattttggagtagctttgaagacgttttactgcaacaccatggaagatgacccaggcacatacagatggatggcgccggagatgtgtaagcgcaagccatatggtccgaaagtcgatgtttatagttttgggctcgtcttgtgggaactggttagtggttcgatcccttatgaagagatgactccgctccaagcagcctatgcagttgttaataagaacttgagaccagttgttccttcgagctgcccgacaccattgcaacaattgatggagcaatgctggtccgctcaacctgagaagaggcctgagtttactcagatagttaaaacccttgaaaatctcaaggcgactcttgatagagatggaaccattgagaagaccagctgccaggaagcagctcaggagcaaaacaagaacaggcttgccaactggatcctaaagctctcatatagcccaccggatttctcagggcccccgccgccgaagctgctgtgattgtgtgccctcttcctcccagaacgtgttatgtggagtagatcacaactctgtaaatcaatttttcgttgtatataaaaacaactacacgagacacacctttctttttctttacattatagatcacaataaatattttctgga

SEQ ID NO: 4212 - DNA, 681 bp, Triticum aestivum
cgttgattttggagtagcttttgaagacgtttactgcaacacgatggaagatgacccaggcacatatagatggatggcgccggagatgtgtaagcgcaagccatatggtccgaaagtcgatgtttacagttttgggcttgtcttgtgggaactggttagtggttccatcccttatgaagagatgactccgctccaagcagcctatgcagttgttaataagaacttgagacccgttgttccttcgagctgcccgacaccattgcaacaattgatggagcaatgctggtccgctcaacccgagaagaggcccgagtttacccagatagttaaaacccttgagaatctcaagacgactcttgatagagatggaaccattgagaagaccccaacccccagctgccaggaagcagctcaggagcaaaacaagaacaggcttgccaactggatcctgaagctctcatatagcccaccggatttctcagggcccccgccgccgaagctgctgtgatcgtgtgccctcttcctcccagaatgtgttatgtggagtagatcacgactctgtaaatcaatttttcgttgtatataaacacaactacacgagacacctttctttttctttacagatcacaataaatatttccgggactctgtttttagaagaaaaaacatctcatagaatag

SEQ ID NO: 4213 - DNA, 703 bp, Triticum aestivum
  misc_feature (372)..(372): n = any nucleotide
cagaagataaaggagtccacctggttccggaaaggtgcccggggagaaccttacagcgaaggagagactgccaagtgagaatgccaccacagatgctgtcccaacacttggtgtgaggcgccaggaagaacagccatgaagacgggaagcccctgcagtgacaaatttaaatgcctttgaaatcatctctttctccacagggtttgacctctctggcctattcgtcgagaaggagagcaaaaaggaagcaaggttcacttcagaacagcctgcctcagccattgtctcgaagctggaagccgtcgcgaagacgctgaatctcagggtgaggaagaaggataatggtgttgtcaagatgcaagtgaggaaggnaaggcaggaatgggtgttcttcagtttgactcggagatctttgagatcagcccctcgtaccatctcattgagatgaaacaaacaagcggcgattcactggagtaccagaagctattggaggagagcatccggccagcactgaaggacatttgtctgggcatggcatggagctgatggtcagcaggagcctcaagggtagatttagatgtctcacttattatgtttagttctgctttttttttcagctcgagtaattgtgttatatactctacatgagtgtgctctttgtcacaaataaattgttccttcttttgtattcgacaagtaataa

SEQ ID NO: 4214 - DNA, 604 bp, Triticum aestivum
atggcgttcgacttcacgaccaagggcatcctgcagtcggcggtgcagggcgagctgtggaggatgcgtgacaaggagggcaacgctcccgggatgatcggcttgttgccggagaaggcggtcacgttcgtggacaaccacgacacgggctcgtcgcagaagaagtggccgttcccggccgacaaggtcatgatgggctacgcctacatcctcacgcaccctggagttccatgcatcttctacgatcacgtgttcgactggaacctgaagcaagagatcaacgcgttggcggcggtgaggaaccgcaacgggatcaacgccgggagcaagctgcgcatcctggcggcggagagcgacatgtacgtggcgacggttgacgagaaagttatcgtcaagcttggaccgaggttcgacgctggcagcgtcatcccgtcggacttccacgtcgtggctcacggcaataactactgcgtctgggagaagagcggccttcgggtgccggccgggcggcgctagctagctagacgcaccggctgccagaccgttgtactcctacaagaaatgtttgattccagttcgtaggctacccaataaagtttgtacc

SEQ ID NO: 4215 - DNA, 492 bp, Triticum aestivum
ggtcacgttcgtggacaaccacgatcacgggctcgtcgcagaagaaatggccgttcccggccgacaaggtcatgatgggctacgcctacatcctcacccaccctggagtcccatgcatcttctacgatcacgtgttcgactggaacctgaagcaagagatcaacgcgctggcggcggtgaggaaccgcaacgggatcaacgccgggagcaagctgcgcatcctggcggcggagagcgacatgtacgtggcgacggttgacgagaaagttatcgtcaagctcggaccgaggttcgacgctggcagcgtcatcccgtcggacttccacgtcgtggctcacggcaataactactgcgtctgggagaagagcggccttagggtgccggccgggcggcgctagctacctagtagacgttagcaacttcgcaccggcggccagaccgttgtactcctacaagaaatgtttgttccagttcgtcgtagactaggcaata

SEQ ID NO: 4216 - DNA, 514 bp, Triticum aestivum
tgaatccctttgtcgtggatcttgatgaacacaacgctctacacctcaccaagacaggtctacctcaccggagagaaaagaagagaagcgaagatgtcggggcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccaccaccagattagagtgtctggggttcgtggtcgttgatgtaattgcagcatctcgctgttgtttgctatcttctgtagaatggaatggaatggaaattgaac

SEQ ID NO: 4217 - DNA, 460 bp, Triticum aestivum
caaagacaggtcgacctcaccgaggagaagaaaggagaagcgagaaagatgtcggggcgcggcaagggaggcaaggggctcggcaagggcggcgccaagcgccaccggaaggtcctccgcgacaacatccagggcatcaccaagccggcgatccgtcgtctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccaccatcaccgccagattagagtgtctagggttcgtggtcgttgatgtaatcgcagtatctcgctgctgtttgctatcttctgtagaatggaattaaa

SEQ ID NO: 4218 - DNA, 851 bp, Triticum aestivum
agcttgatgacagcgaggaagagaagaagaggaaggaggagctcaaggagaagttcgaggggctctcaaggtgatcaaggagtgctgggcgacagggttgagaaggtgatcgtctctgaccgcgtcgtcgactcaccgtgctgcctcgtcaccggcgagtacggctggaccgccaacatggagaggatcatgaaggcccaggccctgagggacacgagcatgggcggctacatgtcgagcaagaagacgatggagatcaacccagagaacgccatcatggaggagctgcgcaagcgcgccgacgtggacaagaacgacaagtctgtcaaggacctggtgatgctgctgttcgagacctccctgctcacctcgggcttcagccttgacgaccccaacaccttcggcaccaggatccaccgcatgctcaagctgggcctgagcatcgacgaggacgaggaggctgctgaggctgacacggacatgccgccgttggaggaggacgccggcgagagcaagatggaggaggtcgactaggcgtgtgcatttgcttgctatccgagtcctagagctagtttatcttttgggttactgtcgcgtggtcggtttgtcttttgtggtttactgtgcctagcctgccctaatggggctaggggagtggtctgtggagtccccggaactgcgtaccgtaatcgttgcttatatatatcgtctttagtaccttccgagttaatcgccttgtttgctctttttgctttctgctggccttcttggctttttattgcgaattcctgtatttctcggtgaagtttttctcgagtttggtgctgacttgttcttgaatgaatacaaat

SEQ ID NO: 4219 - DNA, 734 bp, Triticum aestivum
tctgccactaaaggaaggcctgaagcttgatgacagcgaggaagagaagaaagaggaaaggaggagctcaaggagaagtttgagggggctctgcaaggtgatcaaggaggtgctgggcgacagggtcgagaaggtgattgtctctgaccgcgtcgtcgactcgccgtgctgcctggtgaccggcgagtatggctggactgccaacatggagaggatcatgaaggcccaggccctgagggacacgagcatgggcggctacatgtcgagcaagaagacgatggagatcaacccggagaacgccatcatggaggagttgcgcaagcgcgccgacgctgacaagaacgacaagtctgtcaaggacctggtgatgctgctgttcgagacctccctgctcacctctggattcagcctcgacgaccccaacaccttcggcaccaggatccaccgcatgctcaagctgggcctgagcatcgacgaggacgaggaggctgctgaggctgacacggacatgccgccgctggaggaggacgccggcgagagcaagatggaggaggtcgactaggcgtgtgcgttcgcttgctatccgagtcgtagagctagcttatcttttgggttactgtcgcgtggtcggtttgtcttttatggtttactgtgcctagcctgctgtaatggggctaggggagtggtctctggagtccccggaactgcgtatcgtaatcgttgcttatatatat

SEQ ID NO: 4220 - DNA, 707 bp, Triticum aestivum
gaggaagagaagaagaggaaggaggagctcacaggagaagttcgagggcttctgcaaggtgatcacaggaggtgctgggcgacagggtcgagaaggtgattgtctctgaccgcgtcgtcgactcgccgtgctgcctggtcaccggcgagtatggctggaccgccaacatggagaggatcatgaaggcccaggccctgagggacacgagcatgggcggctacatgtccagcaagaagacgatggagatcaacccggagaacgccatcatggaggagctgcgcaagcgcgccgacgcggacaagaacgacaagtctgtcaaggacctggtgatgctgctgttcgagacctccctgctcacctctggcttcagcctcgacgaccccaacacgttcggcaccaggatccaccgcatgctcaagctgggcctgagcatcgacgaggacgaggaggctgctggggctgacacggacatgccgccgctggaggaggacgccggcgagagcaagatggaggaggtcgactaggcgtgtgcatttgcttgctatccgagtactagagctagcttatcttttgggttactgtcgcgtggtcggtttgtcttttgtggtttactgtgcctagcctgccctaatggggctaggggagtggtctgtggagtccccggaactgcgtatcgtaatcgttgcttatatatatcatctttagtg

SEQ ID NO: 4221 - DNA, 687 bp, Triticum aestivum
ggcttcggcgcggagtactgcggcgccggctgccagggcggcccctgccgcgccgacatcaagtgcggcagccaggccggcggcaagctgtgccccaacaacctctgctgcagccagtgggggtactgcggcctcggttccgagttctgcggcgagggctgccagaacggcgcttgcagcaccgacaagccgtgtggcaaggacgccggcggcagggtttgcactaacaactactgctgtagcaagtggggatcccgtggcatcggtcccggctactgcggtgcaggctgccagagcggcggctgcgatggtgtcttcgccgaggccatcgccaccaactccactcttctcgcagaatgatgatcttgctaatggtagtattgcaacgacgaataatccgtggcagttccattgccacgtacggttttcccttcacttacttttagtactagtacttaataattctctagcttgcaatatgacatgcaggttactgcagcagaaacaaaatattgctgtagtacatgcatggaaatattaccgagagaagtgctgtgtggcaatatagagtgtactattgttgccacaaattagtgttcttgttatgacctgctgtcaggatgcatgcatgcatcgctgttgtaatgttggagtacttcgtgatatcgttacaatatattaccatga

SEQ ID NO: 4222 - DNA, 678 bp, Triticum aestivum
aatccggcttaaactgataccaacatagttaagggcctggatgtccgaaagctgtggtgaacaaccaatctgcatactggccagagcactttcgtgcaagtattcgagggatcaaacttcatcgaagttgatgtggatattgggtcttccatagttcaaatgcaattgttcatctggcatttggttacgtggcgacactgactatagatttagcatttgttattgagagtcaagctgaatcagagctccccgagagacttcttggagctgtaaggttctctgagttgagtccgggatcagctggtgtgtacgaagtgccatctgaagagcagcaggaaattgctccaattctgccttcaagattatggcggagtttttcccaactgctacagaatccaggcaactcaatgcagccgtcgcctagctcagaaaacactaacggaaactttcacaagaagatgctggtaacaacgataattgatatccctgaatcccatactagaggagatgtatacacctcccatcaaaggatgccttcattggttgaggataatatgccagttcaggcgatgtgtaaaagttgaatttgtttttatgacgatggacgacggcctcaggcacttgtggattatcatagtcccgggccctgctgtaaaaatgatacatagtggtcagaga

SEQ ID NO: 4223 - DNA, 671 bp, Triticum aestivum
ggtgaacaagccatctgcatacttggcagagcactttcgtgcaagtatgtcgagggatcaaacttcatcgaagttgatgtggatattgggtcttccatagttgcaaatgcaattgttcatctggcatttggttacgtggcgacactgactagatttagcatttgttattgagagtcaagctgaatcagagctccccgagagacttcttggagctgtaaggttctctgagttgagtccgggatcagctggtgtgtatgaagtgccatctgaagagcagcaggaaattgctccaattctgccttcaagattatggcggagtttttcccaactgctacagaacccaggcaactcaatgcagccgtcgcctagctcagaaaacactaacggaaactttcacaaagaagatgctggtaacagcgataattgatatccctgaatcccatactagaggagatgtatacacctcccatcaaaaggatgccttcattggttgaggataatatgccagttcaggcgatgtgtaaaagttgaatttgtttttatgacgatggacgacggcctcaggcacttgtggattatcatagtcccgggccctgctgtaaaaatgatacatagtggtcaagagagaacaacatctttctgtacatattaactaaatttaccttacagcc

SEQ ID NO: 4224 - DNA, 564 bp, Triticum aestivum
caccaccgttcccctccaaatccacccgatccaatctgcccgctcgcagctccaaggaaggaggaagccgtcgaccatgtccggccgcggcaagggcgggaaggggctgggcaagggcggcgccaagcgccaccggaaggtgctccgcgacaacatccagggcatcaccaagccggccatccgccgtctggcccgcaggggcggcgtgaagcgcatctccgggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggccgcaccctctacggattcggcggctaggccccctgctccgtccagtctttgctctcccggctgttacatctgtccgagcgcgtgtgttgttcaatcgttggtgagtgtttggtctgtgtagttagtgcaaggcgatgtgtatgaatgcaatggaatcagcgttggtattaatactatcttttcccatctctcgatgcttaata

SEQ ID NO: 4225 - DNA, 554 bp, Triticum aestivum
gccgcagcaacacccacacttacagagaagcccaatctcgccggagagggaagcgtcgaggatgtcgggccgcggcaagggagggaaggggctgggcaagggcggcgccaagcgccaccggaaggtgctccgggacaacatccagggcatcaccaagccggccatccgtcgtctcgctcgccgtggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggccgcaccctctacggattcggcggctaggccacgccggtccagcagaacccacctcgcgccgccagattcactagctagccatggttgttcagtgttcattgtcttcggtgtaatggaacggccgcatctcgctgctgtctgttgttcagtgtactgtgtttggatgtactaggatggaatggaaatcgcggcgttttacccctgaatt

SEQ ID NO: 4226 - DNA, 784 bp, Triticum aestivum
cgccctgctcgcgctcgccttcgagcacatggccagcgtcgactcctaccctccggatgtcgaccccgccaagcacaccgcccgcgtcgtccgggccattggtgagctcgcgcgctgcatcggatcagagggcctcgtcgccggccaggttgttgatctggagatgactggctcaactgagactgtaccacttgaccgccttgagtacatccatctgcacaagactgctgccttgcttgaggcctcagtggttattggagcaatcatcgggggtggctcggaagagcagattgagcggttgcgcaagtacgcgagatcaattgggttgctgttccaggtggttgatgacattcttgatgtgaccaagtcatcagaggagctagggaagacagctgggaaggacttggcgagtgacaagacgacatacccaaagttactagggttggagaagtcacgggaatttgcggagaagttgctttctgatgcaaaggagcaacttgctgattttgatgaagagaaggcagcaccgctattgtacttggccaattatattgcctatcggcagaactaaggtgatggttattctgttgtttgttgttgatctgtaactttgtaagaacatcaagtctgggatttgaggaatatctgaattcttcccctcatatatactagttgagttttctaccattgtgtcatgagaatatttaggtgacaaaagccacatgagttaggtggcaaataccaatgtcccattgagatagccaagactttataatgggaatca

SEQ ID NO: 4227 - DNA, 704 bp, Triticum aestivum
aggatatattgccgcaagacgagcttgcggaggcagggctctccgatgaagacatcttcaaaggagtcgtcaccgacaagtggagaaaattcatgaagaggcagatcaagagggcgaggatgttcttcgaggaggcggagcgaggggtgactgagcttaggaaggagagccggtggccggtttgggcctctctgttgttgtaccggcagatccttgacgagatcgaagcgaatgactacaacaacttcaccaagagggcctatgttgggaaggcgaaaaaggtgcttgcgctccctgtcgcgtacgggagatcgctgctcttaccgtattcactgagaaataaccagacctagaagaaagaacaaagcaagatgaagatggtcaggttaggctagatagaatgaaacatggcagtgtggcgacatctgccttggagctctgcatccagttagttggccaaacaatgcggcgaatcgatcagtacaatcctcagtgatcaatgttgtaggcatgacatgaagttctggcaaaggaagggagaagaacactgcagccaaccgagatgaagaccaaatgtttgcatgtatattattattctagaacatgtgcctttgaagacagaacaacatgtatatatatactcgttgttggtcccgaattcgggaaacatgtatgttattctgtaagcatatatattcgaataa

SEQ ID NO: 4228 - DNA, 705 bp, Triticum aestivum
gccccagtgatctcagccgagaaggcttaccatgagcagctctctgttgccgagatcaccaacagcgccttcgagccttcctccatgatggccaagtgtgacccccgccacggcaagtacatggcctgctgcctcatgtaccgtggtgatgtttgtgcccaaggatgtcaacgccgctgtggccaccatcaagacgaagcgcaccatccagtttgtggactggtgccccactggtttcaagtgtggtatcaactaccagccacccagcgttgtcccaggcggcgaccttgccaaggtccagagggccgtctgcatgatctccaactccaccagcgttgtcgaggtcttctcccgcatcgaccacaagttcgacctgatgtacgccaagcgtgccttcgtccactggtacgtgggtgagggcatggaggagggagagttctctgaggcccgtgaggatctcgctgccctggagaaggactatgaagaagttggtgctgagttcgacgagggtgaggatggtgatgagggtgatgagtactagagcagctgagattgcgacctgatgatctgcccgagtggctttatctgttttctgtctgtttgaattgaatgtttgctgtgtggtgtttggtttacaacctgttgtgttgtatgaacctgcttcgcaccttggtcaatatgcatgttatccggtttgcctacacc

SEQ ID NO: 4229 - DNA, 811 bp, Triticum aestivum
gtgaatgagtttcagaccaacctggtgccctacccgaggatccacttcatgctttcctcctacgccccagtgatctcagctgagaaggcttaccatgagcagctctctgtcgctgagatcaccaacagcgccttcgagccttcctccatgatggccaagtgtgacccccgccacggcaagtacatggcctgctgcctcatgtaccgtggtgatgttgtgcccaaggatgtcaacgctgctgtggccaccatcaagacgaagcgcaccatccagtttgtggactggtgccccactggtttcaagtgtggtatcaactaccagccacccagcgtcgtcccaggcggcgaccgtcgccaaggtccagagggccgtgtgcatgatctccaactccaccagcgttgtcgaggtcttctcccgcatcgaccacaagttcgacctgatgtacgctaagcgtgccttcgtccactggtacgtgggtgagggcatggaggagggtgagttctctgaggcccgtgaggatcttgctgccctggagaaggactatgaagaagttggcgctgagttcgacgagggcgaggacggtgatgagggtgatgagtactagagcagatgagtttgcgacctgatgtacgtcaagcgtgccttcgtctactactatcctgtgatctgcccaagcggctttatctgttgtctgcctgtttgaatgtttgctgtgtggtgtttggtttacaacctgttgtgttgtatgaacctgtggtatgtttgaacctgcttcgcaccttggtcaatatgcatgttatctcgtttgcct

SEQ ID NO: 4230 - DNA, 853 bp, Triticum aestivum
ttgacctatgccgtgaccgtatcaggaagcctgcagacaactgcactggtctccagggttccttgtcttccacgctgttggaggtggaactggctctggccttggttctcttgctccttgagcgtctctctgttgactatggaaagaagtccaagcttgggttcacagtgtacccatcccctcaggtctccacctctgttgttgagccatacaacagtgtcctgtccacccactctctccttgagcacactgatgtggctgtcctccttgacaatgaggccatctatgacatctgccgccgctcccttgacattgagcgcccaacatacaccaacctcaataggctcgtttctcaggtcatcttatccctgactgcttccctgaggtttgatggtgctctgaatgttgatgtgaatgagtttcagaccaacctggtgccctacccgaggatccacttcatgctttcctcctacgccccagtgatctcagctgagaaggcttaccatgagcagctctctgtcgctgagatcaccaacagcgccttcgagccttcctccatgatggccaagtgtgacccccgtgaggatcttgctgccctggagaaggactatgaagaagttggcgctgagttcgacgagggcgaggacggtgatgagggtgatgagtactagagcagatgagtttgcgacctgatgtacgtcaagcgtgccttcgtctactactatcctgtgatctgcccaagcggctttatctgttgtctgcctgtttgaatgtttgctgtgtggtgtttggtttacaacctgttgtgttgtatgaacctgtggtatgtttgaacctgcttcgcaccttggtc

SEQ ID NO: 4231 - DNA, 515 bp, Triticum aestivum
ggactatgaagaagttggtgctgagttcgacgagggtgaggacggtgatgagggcgatgagtattaagcctgcctcctggtgctttcccaaggcggtgaccttgccaaggtccagagggctgtgtgcatgatctccaactccaccagtgtcgtcgaggtcttctcccgcatcgaccacaagtttgacctgatgtacgccaagcgtgccttcgtccactggtacgtcggtgagggcatggaggagggagagttctctgaggcccgtgaggatctcgctgccctggagaaggactatgaagaagttggtgctgagttcgacgagggtgaggacggtgatgagggcgatgagtattaagcctgcctcctggtgctttcccaaggcttgctactgctatcctatgatctgcccgagtggctttatctgttatctgtctgtttgaacgtttgctttgtggtgtttgttttacaacctgttgtgttgtaagaaccttgtatctttgaacctgctttgcacc

SEQ ID NO: 4232 - DNA, 766 bp, Triticum aestivum
tgccctacccgaggatccacttcatgctttcctctatgccccagtgatctcagcgagaaggcctaccatgagcagctgtctgttgccgagatcaccaacagcgcctttgagccttcctccatgatggccaagtgcgacccccgccatggcaagtacatggcctgctgcctcatgtaccgtggtgatgttgtgcccaaggatgtcaacgctgctgtggccaccatcaagaccaagcgcactatccagtttgttgactggtgccccactggcttcaagtgtggtatcaactaccagccacctggtgtcgtcccaggcggtgaccttgccaaggtccagagggctgtgtgcatgatctccaactccaccagtgttgtcgaggtcttttcccgcatcgaccacaagtttgacctgatgtacgccaagcgtgccttcgtccactggtacgtgggtgagggcatggaggagggagagttctctgaggcccgtgaggatcttgctgccctggagaaggactacgaagaagttggtgctgagttcgacgagggtgaggacggtgacgagggcgatgagtactagagcctgcctcctggtgctttcccaaggcatgctgctgcaatcctatgatctgcccgagtggctttatctgttatctgtctgtttgaacatttgctttgtggtgtttgttttacaacctgttgtgttgtaagaaccttgtatgtttgaacctgttatgcaccttggttaatatgcatgctatctggttatc

SEQ ID NO: 4233 - DNA, 807 bp, Triticum aestivum
ccactcagcttttcctccgtatgccccagtgatctcagctgagaaggcttaccatgagcagctgtccgttgctgagatcaccaacagcgcctttgagccttcgtccatgatggccaagtgcgacccccgccacggcaagtacatggcctgctgtctcatgtaccgtggtgatgttgtgccaaaggacgtcaacgctgctgtggccaccatcaagaccaagcgcactattcagtttgttgactggtgccccactggcttcaagtgtggtatcaactaccagccaccaggtgtcgtcccaggcggtgaccttgccaaggtccagagggctgtgtgcatgatctccaactccaccagtgtcgtcgaggtcttctcccgcatcgaccacaagtttgacctgatgtacgccaagcgtgccttcgtccactggtacgtcggtgagggcatggaggagggagagttctctgaggcccgtgaggatctcgctgccctggagaaggactatgaagaagttggtgctgagttcgacgagggtgaggacggtgatgagggcgatgagtattaagcctgcctcctggtgctttcccaaggcttgctactgctatcctatgatctgcccgagtggctttatctgttatctgtctgtttgaacgtttgctttgtggtgtttgttttacaacctgttgtgttgtaagaaccttgtatctttgaacctgctttgcaccttggttaatatgcatgctatctggttatctacaccatagcctccattttcctgttttataatttgtattgtttcatttgtattac

SEQ ID NO: 4234 - DNA, 746 bp, Triticum aestivum
gatccacttcatgctttcctcctatgccccagtgatctcagctgagaaggcctaccatgagcagctgtctgttgctgagatcaccaacagcgcctttgagccttcatctatgatggccaagtgtgacccccgccacggcaagtacatggcctgctgtctcatgtaccgtggtgatgttgttcccaaggatgtcaacgctgctgtggccaccatcaagaccaagcgcactatccagtttgttgactggtgccccactggcttcaagtgtggtatcaactaccagccaccaggtgttgtcccaggcggtgaccttgccaaggtccagagggctgtgtgcatgatctccaactccaccagtgtcgtcgaggtcttctcccgcattgaccacaagtttgacctcatgtacgccaagcgtgccttcgtccactggtacgtgggtgagggcatggaggagggagagttctctgaggcccgtgaggatcttgctgccctggagaaggactatgaagaagttggtgctgagttcgacgagggtgaggacggtgacgagggcgacgagtactagagcctgcctccaggtgctttcccaaggcgtgctgctgctatcccatgatctgcccgagtggctttatctgttatctgtctgtttgaatctttgctttgtggtgtttgttttataacctgttgtgttgtaagacccttgtatctttgaacctgttatgcaccttggttaatatgcatgctat

SEQ ID NO: 4235 - DNA, 757 bp, Triticum aestivum
agatcactggattgtttagcaacaggttcctaaagtctggtgtgcagaaggctggcagcaaaatgagccatgacaaagctggaaatgaacaatttgtgacagagacgagcaaatgggtcttccatgagaggggtcatctgaaggcagtgaatgtcaagcaccataaggttggggagacaaatgagcctagcatgtaccgcatcaatgatgacttggaatactcagttgagatatatgaatggtctggtacaagctggaagccatatgttgctgatgatgttcagattcagtttttcatgatgagcccttatgttctgaaaaatatgtcaactgacaaaactgctgtatattcagcatccttcaaagttccagatgtttatggagttttccagttcaaggttgagtaccaaaggcttggatacactggcctctctcttgcaaagcagattccagtgcgtccatacaggcatgatgagtatgagaggttcataacttcagcgtttccgtactatgctgcctcattttcaacaatgggagccttcttcatattctcagttgcgtacctctatcacaaatagatagctcatcgagtagtggaagtaaatcaaggtggcgatggaattgtgatgtcataagcctggtgatcttaggtgcaattttatggaaccatatttttgtagcgccaatctgtagtacctttatttttaagaaatgggcttctccctgcccccaacctttattaacatttttgctaata

SEQ ID NO: 4236 - DNA, 819 bp, Triticum aestivum
tcggcgtcactacaagatagcattccatgcactctaccgtatcaccgctgatgaaggcgtccttgcgctttggaagggtgcaggcccaactgtggtgagagccatgtcactgaatatgggtatgcttgcgtcctatgatcaaagtgttgagctgttcagagacaaattgggtgccggggaatatcagactgttattggagccagtgccatttctggattctgtgcggctgcttgcagtctgccctttgattacgtgaaaacacaaattcagaagatgcaacctgatgccactggcaagtacccatacactgggtctttggactgcgccatgcaaaccttgaagaccggtggcccatttaagttctactccggcttccctgtatattgtgtcaggatcgccccgcatgtcatgatgacgtggctcttcttgaatcaaatccagaagtaccagaagaagatcggcatataagatctccagttggagacaagagtaccaatccttgttcgacacatttaataactttccagcagctttgcactcccgtggttgtttttggtagacagagttttaagcaatttttaccgtagcttacatttgctgtggtactcttgacgttgttacaataatcacataatcacattatttgttgtatttggggcaatttttttggcgggcatacttctgtaggttgggcacagacatagacaatactactacctgcttgtgccatcttgtcttgtatggtatgtgttcaattttatctgtggctcgaaaaaataaatcctttctacctgtgccttgcaccatatgctcttaaa

SEQ ID NO: 4237 - DNA, 1406 bp, Triticum aestivum
gccttccctccgctcgcgtctgctacacttcctctcccggcccggctagatctcgccggcaggagatggcggacgcgaagcagcagcaggccgcggcgcccactggcgtctggaagacgatcaagccattcgtcaatggcggcgcctccgggatgctcgccacctgcgtcatccagcccatcgacatgatcaaggtgaagatccagttgggcgagggatctgcagctcaggtcgcaaagaccatgtatgctaatgagggccttggttccttttacaagggtttgtcagctggtttactaaggcaagcgacctatacgacagctcgtcttggatccttcagggttttgacaaacaaagcaattgaggcaaatgatgggaagccattgccacttgttcagaaagcttttattggtctgactgctggagcgattggcgcatgtgtgggcagtcctgctgatttggcactcattaggatgcaagctgactcgaccctaccagcagcacagcggcgtcactacaagaatgcattccatgcactctaccgtatcaccgctgatgaaggcgtccttgcgctttggaagggtgcaggcccaactgtggtgagagccatgtcactgaatatgggtatgcttgcgtcctatgatcaaagtgttgagctgttcagagacaaattgggtgctggggaatatcagactgttattggagccagtgccatttctggattctgtgcggctgcttgcagtctgccctttgattacgtgaaaacacaaattcagaagatgcaacctgatgccactggcaagtacccatacactgggtctttggactgcgccatgcaaaccttgaagaccggtggcccatttaagttctactccggcttccctgtatattgtgtcaggatcgccccgcatgtcatgatgacgtggctcttcttgaatcaaatccagaagtaccagaagaagattggcatataagatctccagttggagacgagagtatcaatccttattcgacacatttaataactttccagcagctttgcactcccgtggttgtttttggtagacagagttttaagcgatttttaccgtagcttacatttgctgtggtactcttgacgttgttacaataatcacattatttgttgtaattggggcaatttttttggcgggcatacttctgtaggttgggcacagccatgagacaatattactactccctccgttctaaattactcgtcgcagaaatagatgtatctagaactaaaatacatctaaatatatccatacctacgacaagtaattcggaacaagtaattcggaaggagggagtacctgcttttgccatcttgttttgtatggtatgtgctcaattttatctgtggctcgaaaaaatcaatcctttct

SEQ ID NO: 4238 - DNA, 870 bp, Triticum aestivum
cgcatgtgtggcagtcctgctgatttggcactcattaggatgcaagctgactctaccctaccagcagcacagcggcgtcactacaaaaatgcattccatgcactctaccgtatcactgctgatgaaggtgtccttgcactttggaagggtgcaggcccaactgtggtgagagccatgtcactgaatatgggtatgcttgcgtcctatgatcaaagtgttgagctgttcagagacaaattgggtgccggagaatatcagactgttattggagccagtgccatttctggattctgtgcggctgcttgcagtctgccctttgattacgtgaaaacacaaattcagaagatgcaacctgacgccactggcaagtacccatacactgggtctttggactgcgccatgcaaaccttgaagaccggtggcccattcaagttctactccggcttccctgtatattgtgtcaggatcgccccgcatgtcatgatgacgtggctcttcttgaatcaaatccagaagtaccagaagaagatcggcatataaatctccagttggagacagagtatcaatccttgctccacacatttaataactttccagcagctttgcactcccgtggttgtttttggtagacagttttaagcaatttttaccgtagcttacatttgctgtggtactcttgacgttgttacaataatcacataatcacattatttgttgtaattggggcaatgtttttggcgggcacagccatgagacaatactactgcctgtttgtgccggcatatttctgtgggcatatttctgttggctgggcacaaccatgagactattactaccggtgtgccatattgtcctgtatggtgtgggctc

SEQ ID NO: 4239 - DNA, 697 bp, Triticum aestivum
cggcagagaacaagaacgacggggcagaagaacaagatcaccatcaccaacgacaaggggcggctgagcaaggaggagatcgagaagatggtgcaggaggcggacaggtacaaggcggaggacgaggagcacaagaagaaggtggacgccaagaacgcgctggagaactacgcctacaacatgcgcaacacggtcaaggacgacaagatcgcctcgaagctcggggcggacgacaagaagaaggtggaggacgcgatcgagggcaccatcagctggctggacgccaaccagctcgccgaggccgacgagttcgaggacaagatgaaggagctggagggcatctgcaaccccatcatcgccaagatgtaccagggcgctgcgccggacatgggcggcggcatgggcatggacgaggacatgccggccggcggcggtggcgccggccccaagatcgaggaggtggactaagcttttgttgttccgtggtggtctccggtctgcgcgttgcttgatgggtgtcctttcgatgggtggtgtcagtcgtctgtcgtcgtgtcatctagtagctggaagtagtagtagtagtgcgtcgtgggagtcgttggtctgaaggacatgatggatcatgatgtttgcttgtggtttgggaacccttgaagcttagagcttctcgtttaaatttgggtgcttccctact

SEQ ID NO: 4240 - DNA, 706 bp, Triticum aestivum
aacggcatcctgaacgtgtcggcggaggacaagacgactgggcagaagaacaagatcaccatctaccacgacaaggggcggctgagcaaggaggagatcgagaagatggtgcaggaggcggagcggtacaaggcggaggacgaggagcacaagaagaaggtggacgccaagaacgcgctggagaactacgcctacaacatgcgcaacacggtcaaggacgacaagatcgcctccaagctcggcgccgacgacaagaagaaggttgaggaggcgatcgagggcaccatcagctggctggacgccaaccagctcgccgaggccgacgagttcgaggacaagatgaaggagctggagggcatctgcaaccccatcatcgccaagatgtaccagggcgccgcgccggacatgggcggcggcatgggcatggacgaggacatgcccgccggtgctggcggcgccggccccaagatcgaggaggtggactaagctgttcgtccaatgtctgcgcgctacttgatgggtgttctgtctcggtgtcctctggatgccgctcggtggtgtcagtcgtctgtcgtcgtgtcatctagctgcaagtagtagtagtggttcgttggagtcgtttgatctgaaagacatgatggatgatgatgtttgcttgttggtttggtacccttgatgcttagtgcttctcgttgtttaagtttaa

SEQ ID NO: 4241 - DNA, 601 bp, Triticum aestivum
ggcggagaggtacaaggcggaggacgaggagcacaagaagaaggtggacgccaagaacgcgctggagaactacgcctacaacatgcgcaacacggtcaaggacgacaagatcgcctccaagctcggcgcggacgacaagaagaaggtggaggaggcgatcgagggcaccatcagctggctggacgccaaccagctcgccgaggccgacgagttcgaggacaagatgaaggagctggagggcatctgcaaccccatcatcgccaagatgtaccagggcgccgcgccggacatgggcggcggcatgggcatggacgaggacatgccggccggcggcggcggcgctggccccaagatcgaggaggtggactaatttgttggtccgtgcccgtggtggtctccggtctgcgcgctacttgatgggttcgctgtctcggtgtccgtcctttggatgccgctcggtggtgtcagtcgtctgtcgttgtgtcatctagctggaagtagtagtagtcgttcgatggagtcgttggtctgaaggacatgatggatcatgatgtttgctttggtttggaacccttgaagcttagagcttctcgtttttaag

SEQ ID NO: 4242 - DNA, 502 bp, Triticum aestivum
  misc_feature (11)..(11): n = any nucleotide
ccattatcccntgttagactgcttccatctcatctccggcgatgtctgggcgtggcaagggcggcaaggggctcggcaagggcggcgccaagcgccaccggaaggtgctccgcgacaacatccagggcatcaccaagccggcgatccggaggctggcgaggaggggcggcgtgaagcgcatctcggggctcatctacgaggagacccgcggcgtcctcaagatcttcctcgagaacgtcatccgcgacgccgtcacctacaccgagcacgcccgtcgcaagaccgtcaccgccatggacgtcgtgtacgccctcaagcgccagggccgcaccctctacggctttggcggctgagcgccatcagctcgctggctgaccctgctgtttcctgcgttgctctgtagtcgtatcccccctgtcgtgaatctagtgcgctggctatgcttgtttctgtagtttgtctagtgaaatccaacttctagttgtaactcctatcgtttcct

SEQ ID NO: 4243 - DNA, 834 bp, Triticum aestivum
cttttcattgttgcgaaacgaaacgataggagttacaactagaagttggatctcactagacaaactacagaaacaagcatagccagcgcactggattcacgacgggggggagtaagactacagagcaaagcaggaaacagcagtgtcagccagcggcagcgcgctgatggcgctcagccgccgaagccgtagagggtgcggccctggcgcttgagggcgtacacgacgtccatggcggtgacggtcttgcggcgggcgtgctcggtgtaggtgacggcgtcgcggatgacgttctcgaggaagatcttgaggacgccgcgggtctcctcgtagatgagccccgagatgcgcttcacaccgcccctcctggccagcctccggatcgccggcttggtgatgccctggatgttgtcccggagcaccttccggtggcgcttggcgccgcccttgccgagccccttgccgcccttgccacgcccagacatcgccggagatgagatggaagctgtctaccatctcgtcgtcttcgtcagcaagttatcttcagtgtcgtctgtcgtcgtgttcctgtgtcagtcagtcttgagtcgtgtgtgtcgttcggtcctgtggtgtttttgatcgcgagctcgagtgtcgctctgtccggggttaattagagctggttacgcgaggaagaaacacatgtgttatctttcggtcggtcggtcggtcgtgttcgtcggtgatgcagcaatcccttctgtgccgaaagggggatgtgctgttggaatcctatgtttgaactcagtttaaatggatgaagaaaatgcaagtgatagctgcgaaatatcc

SEQ ID NO: 4244 - DNA, 610 bp, Triticum aestivum
  misc_feature (547)..(547): n = any nucleotide
aatccccaatcccctccaatccaactttcgggacagcagccagcaagcgtcgccagccatgtcaggccgaggcaagggaggcaagggcctgggaaagggcggcgcgaagcggcacaggaaggtgctgcgcgacaacatccaggggatcacgaagccggcgatccggcggctggcgcggcggggcggcgtgaagcgcatctccgggctgatctacgaggagacccgtggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggctttggcggctgagccagggtcgtgcctcgcgtgggatttagatgtggttaggcgggtcgtcgttctgtggtgtgtgcttgtcctgtgtgtgcgtgtgcagctgcgtgctggtggttgtaatgagttccagattataatatgggtgttcatctcgccttggattgaatcgtgtgttttgctctgatctgnccactggcgaggtctgtccctgcagacttcgaacattaggccgtttgtttgtactactagtat

SEQ ID NO: 4245 - DNA, 489 bp, Triticum aestivum
aatcccctccaatcccaccttcggaacagcagccagcaagcgtcgccagccatgtcgggccgcggcaagggaggcaagggcctgggaaagggcggggcgaagcggcacaggaaggtgctgcgcgacaacatccaggggatcacgaagccggcgatccggcggctggcgcggcggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagcgcggttcgtgcctcgcgtgggatttagatgtggttaggcgggtcgtcgttctgtggtgtgcttgtcctgtgtgtgcgtgtgcagctgcgtgctggtgcttgtaatgagttccagattctaatat

SEQ ID NO: 4246 - DNA, 476 bp, Triticum aestivum
  misc_feature (14)..(14): n = any nucleotide
  misc_feature (29)..(29): n = any nucleotide
  misc_feature (35)..(36): n = any nucleotide
  misc_feature (38)..(38): n = any nucleotide
  misc_feature (80)..(80): n = any nucleotide
  misc_feature (208)..(208): n = any nucleotide
  misc_feature (475)..(475): n = any nucleotide
aggtgggttgcccnaccgcgtgggcatcnggcttnntngccccttaatggactaaatggactgccacgactccgacccanacgcgctcggcccttcacatggccacgaagctcaatgaccacggcatcctttatctccacatgattgagccccggatggcccctcgtcgacggccggcgcgtggtcccgcaccgcctgctgccctacngggaggccttcaagggcacctttattgcgaatggcgggtatgaccgggaggagggggacaaggcggtcgcatcggggtatgccgacctcgtctcgtttgggcggctcttccttgcgaacccagacctgccgaagaggctagagctcaacgcgccgcttaacaagtataataggttgacgttttacatctccgatcccgtcgtcggctataccgactacccgtttcttccttgatgtgtcattgaaccatgaataatgattgatccana

SEQ ID NO: 4247 - DNA, 425 bp, Triticum aestivum
tggactgccacgactccgacccgcacgcgctcggtctccacatggccacgaagctcaacgaccacggcatcctctacctccacatgattgagccccggatggccctcgttgacggccggcgggtggtcccgcaccgactacttccctacagggaggccttcaagggcacctttattgcgaatggcgggtacgaccgggaggatggggacaaggcggtcgcatcggggtacgccgacctcgtctcgtttgggcggctattcctggcaaacccagacctgcccaagaggctagagctcaacgcgccgcttaacaagtacaataggatgacgttctacatctccgatcccgttcgtcggctacaccgactacccgtttcttccttgatgtgtcattgaaccatggataatgattgatattatgtcatt

SEQ ID NO: 4248 - DNA, 887 bp, Triticum aestivum
gttcgggttctggttcggttcgggtccgagagtagctagcctagtctagggtttccgtagagaggaagggagagggagatccatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcggcttcgtcacgttcggcagcgaggagtcgatgcgccaggccatcgaggagatgaacggcaaggagctcgacgggcgcaacatcaccgtcaacgaggcccagtcccgccgctcgggcggagggggcggcggcgcggcggctacggcggccagcgcggcggtggcggcggcgactccggcggccagtggaggaactgagcctcgaatctcccagttatcgatctatctaccgtgtcgtcggtcgtcgtcttcgttagcaagttatcttcggtgtcgtcgtgttcctgtgtcagtctgagtcgtcgtgtgtgtggtgtttttgatcgcgagctcgagtgtcgctctgtccggggttaattagagctggttacgcgaggaagaaacaacatgtgttactatctttcagtcggtcggtcggtgtcggtcggtcagtcggtgatgcagcaatccccttctgtcatggattgggatgtgatgttggaatatcctatgtttgaacaagtttaaatggatgaagaaaatgcaagtcatagctgcgaaatatcctctctctttgttccttaaatttctcttgttctgaagcatccattcaactttcttcaagctataaggattgaattgctctgtgaagcatgcaaacttgctcccatttcag

SEQ ID NO: 4249 - DNA, 634 bp, Triticum aestivum
  misc_feature (39)..(39): n = any nucleotide
  misc_feature (76)..(76): n = any nucleotide
  misc_feature (78)..(78): n = any nucleotide
  misc_feature (86)..(86): n = any nucleotide
caaaggaggtgggccgcccaccgcgtgggcatccgcctntcgcccttcatggactacatggactgccacaactccnanccgcacgntcttggcctccacatggccacgaagctcaacgaccacggtatcctctacctccacatgattgagccccgtatggccctcgttgacggtcggcgggtggtcccgcaccggctgctgccctatagagaggccttcaagggcaccttcattgcgaatggcgggtacgaccgggaggagggggacaaggcggtcgcatcggggtacgccgacctcgtctcgtttgggcggctcttcctggcgaacccagacctgccgaagaggctagagctcaacgcgccgcttaacaagtacaataggatgacgttctacatctccgatcccgtcgtcggctacaccgactacccgtttcttccttgatgtgtcattgaaccttgaataaagattgattcatatattgccatgtgaacttctaatggaaccttttctttttctcggctcttccctttttcccacatgtacatgtggctttcttatgtacaatttttccggctgtatagaagtcgcaaaattccgagtgtttaagttttgaaagattaaatttgaaaatatt

SEQ ID NO: 4250 - DNA, 714 bp, Triticum aestivum
  misc_feature (590)..(590): n = any nucleotide
cgctcctccaatcccacattcgctcgcagctcgaaccaaggagagaccgtcagccatgtccgggcgcggcaagggaggcaaggggctcggcaagggcggcgccaagcgccaccggaaggtgctgcgcgacaacatccagggcatcaccaagccggcgatccggaggctcgctcggaggggcggcgtcaagcgcatctccggcctcatctacgaggagacccgcggcgtgctgaagatcttcctcgagaacgtcatccgcgacgccgtcacctacaccgagcatgcccgccgcaagaccgtcaccgccatggacgtcgtctacgccctcaagcgccagggccgcaccctctacggcttcggcggctaggctcgtcctcacctccgtgcaaattccgatgtgcctatccccctgtgcgccgtagtctcgctgtccagaaaacttagctgaaatgagttccccatgtttatctccgctgtttccttcgtaggattagctgtatcgtcaaacaaagctgttcgcatctgaagtttgaatccaatcttgtgtctacgcaaatattgtggttgtggttttgctgtgatttttactntgcgctgttgcaattgtggtgtgtcgattgttccttctgtagcgcaagatctggttgctagtactgaattacagaacgaagtttccagaattcagtctgcatttcggacattgtagatttgcct

SEQ ID NO: 4251 - DNA, 717 bp, Triticum aestivum
gactgcgacggcggcctctccgtggaccaggtctcctcggcgcagaggaagaaggtgaagcgcgcgctctcggtctcgtccatgaacgacgcgctgctcgccgcggcggcgacggtggcctcgccgcccgtggaggtcctggagctgcgcgtgtcggaggtgagcgagaaggtgctggtggtgagcgtgacgtgcagcaagcagcgcgacgccatgaccaaggtgtgccgcgcgctcgaggagctccgcctcagggtcatcaccgccaacatcacctccgtctccggctgcctcatgcacaccctcttcgtcgaggtagatgagatggaccgcttcgagatgaaggagacggtggaggctgctctctcgcagcttgactctacggggagcccgccgcttagttcgatgagctattagggatcactgctacggtcactagtcgctggtcacctattttcacctcacctagtctctcttttgcaaggccaatattatatacgtatataccttatgtaatgtatgccagaattttgcccccttttttgcaacacccgtttatatgtgtggacggaggtgactgctttttttagtacgaggcaataactcaagggatagataaataggctaggcgtgctctggacctcaacgtgtaaaggtcttcatgagcatggcatgatatgcttctggactatgacatatttatatgtgataaataac

SEQ ID NO: 4252 - DNA, 871 bp, Triticum aestivum
  misc_feature (102)..(128): n = any nucleotide
  misc_feature (620)..(664): n = any nucleotide
gactacgacggcggtctctcccgtggaccaggtctccctcggcgcagaggaagaaggtgaagcgcgctctctcggtctcgtccatgaacgacgcgctgctcnnnnnnnnnnnnnnnnnnnnnnnnnnncccgtggaggtcctggagctgcgcgtgtcggaggtgagcgagaaggtgctggtggtgagcgtgacgtgcagcaagcagcgcgacgccatgaccaaggtgtgccgcgcgctcgaggagctccgcctcagggtcatcaccgccaacatcacctccgtctccggctgcctcatgcacaccctcttcgtcgaggtagatgagatggaccgcttccagatgaaggaggcggtggaggctgctctctctcagcttgattctacggggagcccgccgcttagttcgatgagttattagggatcactggtacggtcactagtcgctggtcacctaatttcacctcacctagtctctctgttgcaaggctaatattatatactccctccgttcctaaatacttgtctttctaggcatttcaacaagtgactacatacggagcaaaatgagtgaatctgcactttaaaatatgtctacatacatccgtatgtagtagtcatnnnnnnnnnnnnnnnnnnnnnnnnnnnnnnnnnnnnnnnnnnnnntcttatgtaatgtatgccagaattttgcacctttttttgctacacccgtttatatgtgtggatggaggtgactgcttttttcgtacgaggcaataactcaaggggtagataaataggctaggtgtgctctggacctcatgtgtaaaggtcttcatgagcattgcatgatatgcttctggactatgacatatctatgctgataaataa

SEQ ID NO: 4253 - DNA, 1243 bp, Triticum aestivum
cgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccgccggtggggcgcggcgcggcgcgctacggcggccagcgcggcgcgtagcggaggctacggcgcggcgcggtggctacggcggccagggcggtggcggctacggccagggaggcggtggcggctacggccagggcggtggtggctacggcggccagcgcggtggcggcggctacggcggcggcggcgcgcggctacggcggcgcgcggtggtggctacggcggccagcgtggtggcggtgactccggcggccagtggaggaactgagcggcggggccctccagttatcgatctatctaccatctcgtcgtcttcgtcagcaagttatcttccagttcctgtgtcagtcagtctgagtcgtcgtgtgtgtcgttgagtcctgtggtgtttttgatcgcgagctcgagtgtcgctctgtccggggtgagaaggcaatgcagcttctcgagagtgggctgaaggtgaaggagtacgagctcttgaggaggaacttcagtgacactggttgctttgggtttggtattcaggagcacattgatcttggcatgaagtatgacccatcaaccggcatctatggtatggacttcttcgtggttctggagcgagctggataccgcgtctcccgccggcgccgatgcaaggcccgtgttgggatccaccaaagggtgaccaaggaagacgccatgaagtggttccaggtcaagtatgagggtgtcatcctgaacaagtcccacgctagctagtaacctttcgagtgattgagttgtcgttagagctttaagtcagtcaagcttaatctggatcatggaatcgtatgtttattgaatacaaagttgcactatcaattttgccttgtctgctgggctgacctgcatctataattccatcaaatcttcat

SEQ ID NO: 4254 - DNA, 937 bp, Triticum aestivum
tccaccggcggcctccccggtcagatcaccatgtcgacggagaagaagccagttgaaccccatgcgggagatcaaggcgcagaagctcgtcctcaatatctccgtcggcgagagcggcgatcgcctcactcgcgctgccaaggtgttggagcagctcagcgggcagtcgccagttttctccaaggcgaggtacactgttaggtcttttggcattcgtcgtaatgagaagatcgcctgctacgtgacgatcaggggcgagaaggcaatgcagcttctcgagagtgggctgaaggtgaaggagtacgagctcctgaggaggaacttcagtgacactggttgctttgggtttggtattcaggagcacattgatcttggcatgaagtatgacccatcaactggcatctacggtatggacttctttgtcgtactggagcgagctggataccgtgtctcccgccggcgccgatgcaaggcacgtgttgggatccaccaaagggtgaccaaggaagatgccatgaagtggttccaggtcaagtatgagggtgtcatcctcaacaagtcccacgccagctagtaaccttccgagtgattgagttgtcgttagagcttaagtcagtcaagcgtaatcaggatcatggaatcatatgtttattggatacaaagttgcactatcaattttacctcaactgttgagcttaagtcgagcgtaatcaggatcatggaatcatatgatttctggggtttttttgttcagattatcattctgttgagtggttttagttgaattagagcattacaaccggacggcctgtcctgatgtaaaattgccactcaactgcgcttgttggcaaaccctatatccatccataacgccttggacgtgcccaccacgctggatttagcagggcgcccgtcactatggccgatctgactatgt

SEQ ID NO: 4255 - DNA, 784 bp, Triticum aestivum
atcttcggattcctctccaccgcggcctcccccgtcagatcaccatgtcgacggagaagaagcagttgaaccccgatgcgggagatcaaggtgcagaagcttgtcctcaacatctccgtcggggagagcggcgatcgcctcactcgcgctgccaaggtgttggagcagctgagcgggcagtcgccagttttctccaaggcgaggtacactgtcaggtcttttggcattcgtcgtaatgagaagattgcctgctatgtgacgatcaggggtgagaaggcaatgcagcttctcgagagtgggctgaaggtgaaggagtacgagctcctgaggaggaacttcagtgatactggttgctttgggtttggtattcaggagcacattgatcttggcatgaagtatgacccatcaaccggcatctacggcatggacttctttgttgttctggagcgagctggataccgtgtctcccgccggcgccgatgcaaggcccgtgttgggatccaccaaagggtgaccaaggaagacgccatgaagtggttccaggtcaagtatgagggtgtcatcctgaacaagtcccacgctagctagaaaggcttttgagtggaatcttatgtttattggatacaaagtttgcactatcaattttgcctgttccgttgggctgacctgcatctataattccaccaaatcttttcatggtttcatatttgaagttgaacatttcatcaacttttttcctactatatactattgtctatcattctctcatttagccagcaaagca

SEQ ID NO: 4256 - DNA, 1834 bp, Triticum aestivum
  misc_feature (118)..(142): n = any nucleotide
ggcgatcgaggcgggcggtctcgcggcggcgggggcgatggtcctcgtgctgggcgcgctcgcgctcgcggcctactacagcttctactcggacgtggccgtgcagttcctcgggatnnnnnnnnnnnnnnnnnnnnnnnnncggaacgagaccaagtcgttcctgttccagctctaccccaaggcgcaccagggccgcgcgctgcgggaattcggcgacatcaagctcgccgccaagagggtcgatgacggcggcggcaggaaggtcacgaagaagctggatgtcaagggggcgacatcggctgggacgaactccacagttctgctcccgatcaagggcaatgtgttccccgatgggcagtattacacatctatctttgttggcaatccaccaagaccttatttccttgatgttgatactggaagcgatttaacatggattcagtgtgacgcaccatgcacaaactgtgcccaaggacctcatcctttatataagccagcaaaagaaaagatagtccctcccagggatttgctatgtcaagagtttgcaaggcgatcagaactactgcgaaacttgcaagcaatgtgactatgagattgaatatgccgatagaagctcgtctatgggtgttcttgcgaaggatgatatgcatctaatcgctacaaatggtggaaaggaaaagctagactttgtatttgggtgtgcatatgatcagcaaggccagcttttgtcctcaccagcaaagaccgatgggattcttggtcttagcagtgcagcaataagccttcctagtcagctggccagcaaaggaattatttccaacattttcggtcattgtatcactagagaaacaaatggtggggggtacatgtttctgggtgatgattatgtaccaagatggggaatgacatgggctcctattcgaggtggtccagacaacttataccacacagaagcccagaaagtaaattatggagatcaggagctcagcatgcatgggcacgcaggaaattctgttcaagtgatttttgatagcgggagctcatatacataccttccagaggaaatgtataaaaaccttattgatgctattaaggatgactctcccagttttgtccaggatagctcagatacgacattacctctatgctggaaagctgatttttctgttaggtccttcttcaagcccttgaaccttcattttgggagaagatggtttgtcgtgccgaaaacattcaccattgttcccgatgattacttgattatcagtgaaaagggcaatgtttgtctggggctgctaaatggaacagagatcaatcatgggtcaaccataattgtcggagatgtttctctgcgcggcaaactagttgtgtatgacaatgagcggaggcagatcggatgggccaattcagagtgcaccaagccacaatcacagaagggctttcccttcttcctctgaggggcattgttgcaaaatatacatatgtaagcggcacatagagaataccattggagctgcctctggatagcagctgccatcgcgtgccctatttcatctacagtcgctagccatggttcccgctgtctgttgtaatacttgtttgtaatgcaccgcattgtttgtatatacgcaagaatcaatgtactccctccgtccagaaatatttgtcggaggaatggatgtatctagatgtattttagttttagatacatccatttttatgtatttctccgatgagtatttccggatggagggagtatgtacgtattattgagctgtagatagaatttcagcctatattgaagtcaatagcacgtcctgaaattatgaaa

SEQ ID NO: 4257 - DNA, 636 bp, Triticum aestivum
tctctgccaccgcgcaggtcacgctcgcctcccgcaccccatgccgcgtcggcatcttctacaggcgcctcgacgtcttcgtcacctaccgcgacgagcccgtcaccgtgccgatctccctgccgcccatgtaccagggccaccgggacgtcacaatttggtcccccgtgctgtccggggagtccgtgcccgtggccggatacgttgccgaggccatgaagcaggacatcgcctccgggtacgtgtcgctgcaggtcaagatcgacggccgcgtcaagtggaaggtcgggagctggatctccggcagctaccacctcttcgtcagctgccccgccatgctcgccgccggccccggcggcatgccgctcgggggtggccccaacggcaccgggggcgccgtcgcgtcactgaaattcacgcagccgacagggtgcaccgtcggcacgtgatagaatggactctgcatacggtcgcacgtccgtactgtaagtggaaggaactacatagcgcggttcttcggttgttgtgtttattgtagtagtaatatataaattgtctaaagctcttaatttctgtatgactcgttaagaataaactgtgttgatgcatgtactcattcaattttggaattaaatg

SEQ ID NO: 4258 - DNA, 899 bp, Triticum aestivum
  misc_feature (895)..(895): n = any nucleotide
gccactgcacgcacacctaccagtcacacagagcagagtacagagagcagagccatgaacaaggagaagcatcacaggaacgagcacctcctccggcgctgctgcggcggcttcgcggcgtgcctcctggcgctggtcgtcgtcgtcgcattcatcgcgctcgtcgtctaccttgcgctccgcccgaccaagccttccttctacttgcaggacctgcagctccactccatcaacctcggggacccctccctttctgccaccgcgcaggtcacgctcgcctcccgcaaccccaatgaccgcgtcggcatcttctacaggcgcctcgacgtcttcgtcacctaccgcgacgagcccgtcaccgtgccgatctccctgccgcccatgtaccagggccaccgggacgtcaccatttggtcccccgtgctgtccggggagtccgtgcccgtggccggatacgtcgccgaggcaatgaagcaggacatcgcctccgggtacgtgtcgctgcaggtcaagatcgacggccgcgtcaagtggaaggtcgggacctgggtctccggcagctaccacctcttcgtcagctgccccgccatgctcgccgccggccccggcggcatgccgctcgggggtggccccaacggcaccgggggcgccgtcgcgtcactgaaattcacgcagccgacagggtgcaccgtcgggacgtgatagaatggacttgtgcatacggtcgcacgtccgtactgtgagtggacgaaactacgtacgtagcaggctagttcttcactccgtgtctctacataacttatgtttatattctactagtaaattgtctacagcttctaatttttgtatgtctcgtgtaacgggagaataaactgtgttgatgtatgtacaacantcag

SEQ ID NO: 4259 - DNA, 779 bp, Triticum aestivum
cttcaagccatcgcctggttcacatcataaacagtagtggtggtccagataacacttgttaggggcgagaccaagcagagaggcgattgtggaggtgatcaacaagttgatgtggctggcttctgtatgcaccacggtggcattcatatcctcctcttacatagtggtgggtcggcacttcaagtgggcggcgctgctggtgaccctcattggcggggtgatcatggccagtgtgctcggcacgatgacatactatgtggtgaagtccaagcgcacgcggtcgattaggaagaaggtgaagtcaacaaggcggagcggctcaaactcatggaaccacaactcggagtcagattccgagatagaccggatatacgccatatgagggtgatctccggtcttctatggatcttcagtgttttcggcggcgccacacgacacggatgtaaaaagaaaggtgggatggcactcaatatgaacagctttcaccctccaggtgccaagggttttaccgtatacattccaataagctggtgttcctggatcggcaggaggagccaggacgcgacggtcgtgttgtatacatcttctacagatagattgtgatcatcagaatatgcatgcagcctgtgctgtgctccctatgcatggctggctggctggccttcataaaatttctctcagcctttttctgtaccttttgttaatatgctgtggtagcagaatggtcggtatgtgtacttagcactctgtaccttgtatttcatctgatagctgagaag

SEQ ID NO: 4260 - DNA, 627 bp, Triticum aestivum
cggacgcgtggccgaacgcgtgggttttttaagcagcgaatatagaaatataatgactaacacatattgtagaaccaacaataacgaactgttccacgagtaccacaaacagctaaccgcgcttaatgtttggccagcccaaagacaagtcaacctcaccgaggagaagcagagagaagggagaagatgtcggggcgcggtaagggaggaaaggggctcggcaagggcggggccaagcgccaccggaaggtgctccgggacaacatccagggcatcaccaagccggcgatccgtcgtctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcactgccatggacgtcgtctacgcgctcaagcgccagggccgcaccctctacggcttcggcggctaggccaccgccagattagctagcctgtgtctagggttcgttgtccatgatgtaattgcagcatctcgctgttgtttgctatcttctgtagaatcgaatggaatggaaattgaactatttatcattgaatct

SEQ ID NO: 4261 - DNA, 516 bp, Triticum aestivum
  misc_feature (23)..(23): n = any nucleotide
  misc_feature (49)..(49): n = any nucleotide
tgcatcgcagaaaggaaaatatngtagtagatattgaataaggagcatncgatagcacatatccccccacgcgtccggcagctaccacaaagacaagtcaacctcaccgaggagaaggaaggagaagggagaagatgtcgggccgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaagaccgtcaccgccatggacgtcgtctacgcgctcaagcgccagggacgcaccctctacggattcggaggctaggccgccaccagattagctagcctgtgtctagggttcgtggtcgttgatgtaatcgcagcatctcgctgct

SEQ ID NO: 4262 - DNA, 869 bp, Triticum aestivum
  misc_feature (21)..(21): n = any nucleotide
tgaagaagaaggctatgagtncatctacatgtttgacgccattgatgagtatgccattggtcagctcaaggagtttgagggcaagaagcttgtctctgccaccaaggagggtctgaagcttgatgagagcgaggacgagaagaagaagcaggaggagctcaaggagaagtttgaggggctgtgcaaggtcatcaaggaggtgctgggcgacaaggttgagaaggttatcgtctctgaccgtgtggtggactccccttgctgtctggtgactggcgaatatgggtggaccgccaacatggagaggatcatgaaggcccaggccttaagggactcgagcatggctggctacatgtcgagcaagaagaccatggagatcaaccctgagaacgccatcatggacgagctccgtaagcgtgccgatgccgacaagaacgacaagtctgtcaaggacctcgtgatgctgctcttcgagacctccctgctcacctccggcttcagcctggaggaccccaacaccttcggcaccaggatccaccgcatgctcaagcttggcctgagcattgatgaggatgacgaggcgccagagaacgacaccgacatgccgcccctggaggacgacgccggcgagagcaagatggaggaggtcgactaagcgccaaggctgcctgtcggctgtcgtcgtcagatgtccatgccctgcaccgcctagttgtttttatcttagtgtcgacgttggatggttttggcacgttttagctgtatcggttttgtcttttggctggccaaacattaagcgcggttagctgtttgtggtactcgtggaacagttcgttattgttggttctacaatatgtgttagttattatatt

SEQ ID NO: 4263 - DNA, 552 bp, Triticum aestivum
caccaccgttcctccgattccacatctgctcgcagctcgaagaggatcgtcagccatgtccggccgcggcaagggaggcaaggggctcggcaagggaggcgcgaagcgccaccggaaggtgctgcgggacaacatccagggcatcaccaagccggcgatccggcggctggcccgtaggggcggcgtgaagcgcatctcggggctcatctacgaggagacccgcggtgtgctcaagatcttcctcgagaacgtcatccgcgatgccgtcacctacaccgagcacgcccgacgcaagaccgtcaccgccatggacgtcgtctacgcgctcaagcgccagggccgcaccctctacggattcggcggctaggccaccaccagatcagtagcctgatagtcgggtgtagtcgcagcatctcgctgctgtttgtcctgccttgtttgttctctggatgtacttctgtactaggatggaatggaaattgcagcagtttacccttgaattcgtacctagtctgtgggtctgttgatgtttgttcgtgcgcgtggtcagat

SEQ ID NO: 4264 - DNA, 898 bp, Triticum aestivum
gtcccagctagcagcccttcactcgtacacacagagactgagcccagttgatcagatcaggtcaccatgagcaagggcaaggttcaccacgactggatcctccggcggtgctgcggctccgtcgccgcctgcatcctcacgctcgccgtcctcgtcggcttcgtcgcgctcgtcatctacctcgccctgcacccctccaagccctccttctacctccaggacatccagctccgctccatcgacctcgccgatccggctctctcctgacgtccaggtgacctcgcgtcccggaccccgaacgaccgggtggcatctactacaagaccctgcacgccttcaccacgtaccgcgacgagccggtgacggtgccggtgtcgctgccggcgatctaccaggggcacaaggaccagtcggtgtggtcgccggtgatgtccggggactcggtgccggtggcgccctacgtggcggacgccatgaagcaggacatcgcggccgggtacgtgctgctgcacgtgaaggtggacggccgcgtcaagtggaaggtcggcagctgggtctccggcggctaccacatcttcgtcaactgccccgcgctgctctccgccagcggcggctccgtcggcggcgccttcgccatgagcgccacggtgggcggcaagcagaccgtctcgctcaagttcacgcagccgtcctactgcaccgtcgacgtgtgacgcggacgcacgtcgtgtctcgccggggcgacgtcgagcgctcttaattatttgcaggagtaaatcttgtagagtagcaacaaccatgatatgatagtgtataattatcaccatttccttaccctgtttttctgaatctgtgcagaataatgctactgcttttttatacatcctattataagttg

SEQ ID NO: 4265 - DNA, 675 bp, Triticum aestivum
acctcgccgatccggctctctcccttgacgtccaggtgaccatcgcgtcgcggatcccgtacgaccgggtgggcatctactacaagaccctgcacgccttcaccacgtaccgcgacgagccggtgacggtgccggtgtcgctgccggcgatctaccagggacacaaggaccagtcggtgtggtcgccggtgatgtccggggactcggtgccggtggccccctacgtggcggacgccatgaagcaggacatcgccgccgggtacgtgctgctgcacgtgaaggtggacggccgcgtcaagtggaaggtcggcagctgggtctccggcggctaccacatcttcgtcaactgccccgcgctgctctccgccagcggcggctccgtcggcggtgccttcgccatgagcgccacggtgggcggcaagcagaccgtctcgctcaagttcacgcagccgtcctactgcaccgtcgacgtgtgagtgacgcggacgcacgtcgtctcgccggggcgacgctgagagcgacgtcgagcgctcttaattatttgcaggagtaaatcttgtagagtagcaacaaccatgatatgatagtgtataattatcaccaatttccttaccctgtttttctgaatctgtgcagaataatgctactacttttttatacatcctattataagct

SEQ ID NO: 4266 - DNA, 834 bp, Triticum aestivum
ctgatcgtagtcactaagcataccaatttggtcatcacgaaataaaggacattcatactacatagtgagtatctgaaacagtattgctctggtatatatctgacgcaggtgaccatcgcgtcccggaacccgaacgaccgggtgggcatctactacaagaccctgcacgccttcaccacgtaccgcgacgagccggtgacggtgccggtgtcgctgccggcgatctaccaggggcacaaggaccagtcggtgtggtcgccggtgatgtccggggactcggtgccggtggcgccctacgtggcggacgccatgaagcaggacatcgccgccgggtacgtgctgctgcacgtgaaggtggacggccgcgtcaagtggaaggtcggcagctgggtctccggcagctaccacatcttcgtcaactgccccgcgctgctctccgccagcggcggcaacgccggcggcgccttcgccatgagcgccacggcgggcggcaagcaggcagtcacgctcaagttcacgcagccgtcctactgcaccgttgacgtgtgagtgacgcggacgcacgtcgtctcgccggggcgacgctgagagcgacgtcgagcgctcttaattatttgcaggagtaaatcttgtagggtagcaacaaccatgatatgatagtgtataattatcaccaatttccttaccctgttttttctgaatctgtgcagaataatgctactacttttttatacatcgtattataagctgttctatttacccctgagtatcaaatttgtttctcatttggcaatctgtacgtcgggcgagcagagtctacttgtaaaagcagag

SEQ ID NO: 4267 - DNA, 1168 bp, Triticum aestivum
tatgacgtatgagcatcctcacgagaaaaccatactgcaattcagtttcagagtttcatattacaatctagagatgcaaaaatgcaaatggtagataaatcccgatcacaaatttgccaagttagcttcggagaaccgaatgcaaagaatttcacaaactcatacggtagcaaatcagaagttgtgaacggactgacgatattgaacagagaaacaaatccaggtagcattttctcataacaagcattttaaattaaaccacaagcacgagcattcgcagagcggcgacctgatagacacactgaagccaagctagccatcccctaaccgccgaagccgtacagggtgcggccctggcgcttgagcgcgtacacgacgtccatggccgtgacggtcttgcggcgcgcgtgctcggtgtaggtgacggcgtcgcggatgacgttctcgaggaagatcttgagcacgccgcgggtctcctcataggagcgaaacacctctccctcactctcacctccgagaagctccagcggcagccatggccccaaaggcagacaagaagccggcggccgagaacaaggtggagaaggcggcggagaagacccccgcggggaagaagcccaaggccgagaagcggctgccggcaggcaagacggcgtccaaggaggccggcggcgaggggaagacccggggcaggaagaagggcagcaaggcgaagaagggcgtggagacgtacaagatctacatcttcaaggtgctgaagcaggtgcacccggacatcggcatctcctccaaggccatgtccatcatgaactccttcatcaacgacatctttgagaagctcgccggcgagtcggccaagctcgcgaggtacaacaagaagcccaccatcacctctagggagatccagacctccgtccgcctcgtcctccccggcgagctcgccaagcacgctgtctccgagggcaccaaggccgtcaccaagttcacatcctcctagactgacgacgcgccgcttgttgtgacagatgtagttggctgctgttagtcgctgactctgcttatgtatctgcaagtagtggtaggagtggtcgtctgtgtgccaacgcttcgttggctagttggttgtcagaactgaagttgctaatctatctgaatgttactgtttcaa

SEQ ID NO: 4268 - DNA, 734 bp, Triticum aestivum
  misc_feature (5)..(5): n = any nucleotide
gttgnatttctcgcgcgcggtcaattcgccggccgctcgaggccccaattccttcgtcctcctcctcgcgagacgcgcacagcagagccgagagggagaagatgtccgggcgcggcaagggcggcaaggggctgggcaagggtggggcgaagcgccaccggaaggtgctgcgggacaacatccaggggatcaccaagccggcgatccggcggctggcgcggaggggcggcgtgaagcgcatctccgggctcatctatgaggagacccgcggcgtgctcaagatcttcctcgagaacgtcatccgcgacgccgtcacctacaccgagcacgcgcgccgcaagaccgtcacggccatggacgtcgtgtacgcgctcaagcgccagggccgcaccctgtacggcttcggcggttaggggatggctagcttggcttcagtgtgtctatcaggtcgcccgctctgcgaatgctcgtgcttgtggtttaatttaaaatgcttgttatgagaaaatgctacctggatttgtttctctgttcaatatcgtcagtccggtcacaacttctgatttgctaccgtttgagtttgtgaaattcttttcattcggttctccgaagctaacttggcaaatttgtgatcgggatttatctaccatttgcatttttgcatctctagattgtaatatgaaactctgaaactgaattgcagtgtggttttctcgtgaggatgctcataggtc

SEQ ID NO: 4269 - DNA, 620 bp, Triticum aestivum
cacaactcccacacatcctccggcgaaaccaaaccccagcccgccgcaccgtcagcacccatggcgcccaaggccgagaagaagccggcggcgaagaagcccgcggaggaggagcccgcggcggagaaggcggagaagacgcccgccgggaagaagcccaaggcggagaagcggctgccggcggggaagtccgccgccaaggagggcggcgacaagaagggcaagaagaaggccaagaagagcgtggagacgtacaagatctacatcttcaaggtgctgaagcaggttcaccccgacatcggcatctcctccaaggccatgtccatcatgaactccttcatcaacgacatcttcgagaagctcgccggcgaggccgccaagctggcgcggtacaacaagaagcccaccatcacgtcccgggagatccagacctccgtccgcctcgtcctccccggcgagctcgccaagcacgccgtctccgagggcaccaaggccgtcaccaagttcacctcctcgtagagtgctcctgctcctgtgtctcgtagttagctgtccgggtgtgtttgtggccgtgtaatcgtgtaagaatcgcaccgtgatgtttctggatctcgagaaat

SEQ ID NO: 4270 - DNA, 588 bp, Triticum aestivum
cgagaagaagccgcgcgaagaagccccggaggaggagcccgcggcggagaaggccgagaagactcccgccgggaagaagcccaaggccgagaagcggctgccggcggggaagtcggccgccaaggagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctgttcgtcttcctgtgtctcgtagttagctgttcgggtgtgtttgtggccgtgttatcctgtaagaatcgcaccgcgatgtttctgtatctcgagaaatggtaatggtgcctgcctcatgttcagtacgtacatgctagtctta

SEQ ID NO: 4271 - DNA, 793 bp, Triticum aestivum
cccgccgccatgtcgacggagaagaagcagctgaaccccatgcgggatatacaggtgcagaagctcgtcctcaacatctccgtcggtgagagcggagatcgcctcacccgcgcctccaaggtgctggagcagctgagcggacagtcaccagtgttctccaaggctaggtacactgtcaggtcgttcggtatcaggcgtaatgagaagattgcgtgctacgtgactatcaggggtgagaaggcgatgcagctgctggagagtggcctgaaggtgaaggagtacgagctgctcaggaggaacttcagcgacaccggctgctttggcttcggtatccaggagcacatcgatctcggcatgaagtatgatccatctaccggcatctacggtatggacttctttgtggtgctcgagcgtgctgggtaccgcgtctcccgccgccgcaggtgcaaggcccgcgtcggtatccaccagagggtcaccaaggaggacgccatgaagtggttccaggtcaagtacgagggtgtcatcctcaacaagtcccatgcgagctaagaaggatgtagctctcgttagaccttgagttaattaagttcacctggttgctggatatgtatgttacctagaaaccaaatcctttgtcagttttgcctgtactcaagctggatgatttctgtttgatctgcactttcgtctaagaggctcactactgttttatcctctttgaacatagatgtttggcttatgtgatgacctgccttttgtttggtcactctcgaatctgctctaagttttt

SEQ ID NO: 4272 - DNA, 798 bp, Triticum aestivum
cccagatccgctgccatgtcgacggagaagaagcagctgaaccccatgcgggacatcaaggtgcagaagctcgtcctcaacatctccgtcggcgagagcggagatcgcctcacccgcgcctccaaggtgctggagcagctgagcggacagtcacctgtgttctccaaggcgaggtacactgtcaggtcgttcggtatcaggcgtaatgagaagattgcgtgctacgtgactatcaggggtgagaaggcgatgcagctgctggagagtggcctgaaggtgaaggagtacgagctgctcaggaggaacttcagcgacaccggctgctttggcttcggtatccaggagcacatcgatctcggcatgaagtatgatccatctaccggcatctacggtatggacttcttcgtggtgctcgagcgtgctgggtaccgcgtctcccgccgccgcaggtgcaaggcccgtgtcggtatccaccagagggtcaccaaggaggacgccatgaagtggttccaggtcaagtatgagggtgtcatcctcaacaagtcccatgcgagctaagaaggacgtagctctctttagaccttgagttaattaagttcacctggttgctggatatgtatgttacctagaaaccaaaaatgctttgtcagttttgcctgtactcaagctggatgatttctgtttgatgcgcactttcgtctaagaggctctcttctgttttatcctctctgaacaatagagtatatgtttgtcttatgatagactgccttttgtatggccactctcaaatcttctcta

SEQ ID NO: 4273 - DNA, 747 bp, Triticum aestivum
gctcccagatcccgcgccatgtcgacggagaagaagcagctgaaccccatgcgggacatcaaggtgcagaagctcgtcctcaacatctccgtcggcgagagcggagatcgcctcacccgcgcctccaaggtgctggagcagctgagcggacagtcaccggtgttctccaaggcgaggtacactgtcaggtcgttcggtatcaggcgtaatgagaagatcgcctgctatgtgactatcaggggtgagaaggcgatgcagctgctggagagtggcctgaaggtgaaggagtacgagctgctcaggaggaacttcagcgacaccggatgctttggcttcggtatccaggagcacatcgatctcggcatgaagtacgatccatctaccggcatctacggtatggacttctttgtggtgctcgagcgtgctgggtaccgcgtctcccgccgccgcaggtgcaaggcccgcgtcggtatccaccagagggtcaccaaggaggacgccatgaagtggttccaggtcaagtacgagggtgtcatcctcaacaagtcccatgcgagctaagaaggacgtagctctctttagaccttgagttaatgaagttcacctggttgctggatatgtatgttacctagaaaccgaaatgctttgtcagttttgcctgtactcaagctggatgatttctgtttgatctgcactttcgtctaagaggctcactactgttttatcctctttcaacaatagagtata

SEQ ID NO: 4274 - DNA, 640 bp, Triticum aestivum
ggactctggagctgaaggccatggctgataggataattagctgagggagcgaatacataggcctaattacaagcttaagttgactttcaaccttaacagctatatcatctcaccacaccgctgcaacaaccaccaccagcaacacacacacacacagcagccaagagaagctcgccggagagagaagagtcgacgatgtccggccgcggcaagggagggaagggcctcggcaagggcggcgccaagcgccaccggaaggtgctgcgcgacaacatccagggcatcaccaagccggcaatccggcgtctggctcggcggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctgaagcgccagggacgcaccctctacggattcggaggctaggccgcgcctgcccactcgaatccacctcgcgccaccgcattagtatctagctatgaatgttcagtgttgatggtcttcggtgtaatggaatggccgcatctcgctgctgtctgttgtttcgatgtactgctta

SEQ ID NO: 4275 - DNA, 726 bp, Triticum aestivum
gaagaagaaggccaagaagagcgtggagacgtacaagatctacatcttcaaggtgctcaagcaggtgcacaaagctccacctcctccccacaccttcgcacaaagctccacctcctccccacaccgtcgaagcacccatggcgcctaaggcggagaagaagccggcgctggagaagaccccggcggggaagaagcccgcggcggagaagagacccgcggccgggaagacggcgtccaaggagggcggcgagaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctggcccgctacaacaagaagcccaccatcacgtcaagggagatccagacctccgtccgccttgtcctccccggcgagctcgccaagcacgccgtctccgagggcaccaaggccgtcaccaagttcacctcctcctaggcgtcttcctcgtttcatgagctgatggcggcgttctgtgtgtagttagcagtgcgatgttacaatctctgtaagaattgtgctgcttgttggtttgaagaattagtgttgttgctgtctgaattattgttcaacgtgtgcttgtattattcagttttgattggaaggt

SEQ ID NO: 4276 - DNA, 750 bp, Triticum aestivum
cggccgctcgcgatctagatccatcccagccaaacttttctctcgccctcgaagcagcagccgccgcagcatccatggcacccaaggccgccgagaagaagccggtggagaagacccccgcgggcaagaagcccaaggcggagaagaaggtgccggcgtccaaggagggcggcgacaagaaggggaagaagaaggccaagaagagcgtggagacgtacaagatctacatcttcaaggtgctcaagcaggtgcacccggacatcggcatctcctccaaggccatgtccatcatgaactccttcatcaacgacatcttcgagaagctcgccggcgagtccgccaagctcgcgcggtacaacaagaagcccaccatcacgtcccgggagattcagacctccgtccgcctcgtcctccccggcgagctcgccaagcacgccgtctccgagggcaccaaggccgtcaccaagttcacctcggcctagtttcctggtctgattcttgtgttcccttcctggtccttgtctgatgaattctgtaggtagctgtgttctgacagtgtcatgcgacattgtcatcttgtaacagagtttctgcttgtgggtttgtggctgttattcggtctggttaaatagtcaacttcacctcatcctagtattctcatctaatgtggtgaactgtagttagatgtgttctgaaagtgtcatcatgtaactttgtgctgatggtggctgttttcagtctaaataaata

SEQ ID NO: 4277 - DNA, 676 bp, Triticum aestivum
gccgtgtgacgtgggacatcgcagcatccgcagtccccccagcccacaccttccaaccaagcaccaagctccaccgccgtcgaagccacccatggcacccaaggcggagaagaagccggcgccggagaagaccccggcggggaagaagcccgcggcggagaagaggcccgcggccgggaagacggcgtccaaggagggcgggggcgagaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctggcccgctacaacaagaagcccaccatcacgtcgagggagatccagacctccgtccgcctcgtcctccccggcgagctcgccaagcacgccgtctccgagggcaccaaggccgtcaccaagttcacctcttcttaggcttcatccttgtatcatgagttgatggcggtgttctgtgtgtagttagcagtgcgatgttacaatctctgtaagaattgtgctgcttgtgggtctgaagaattagtcaggttgctgtctgaattattgctcaatcgtgtgcttgttttattcagtttcagt

SEQ ID NO: 4278 - DNA, 635 bp, Triticum aestivum
caaagacattccaatcacttcattggttctccaaagtaaaaacaggggttccaccaggcgatttactcaaccggggaacatttagcgcacaccaccattttaccaatcacactggagcgagaagaggaagatgtcgggccgcggcaagggaggcaaggggctgggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggtcgcaccctctacggcttcggaggctaggccgagggttcatcgatccagctcgcgacgccgccgtccgaccgagagtagtagtggtatctatctagttgctgtctagggttcgtggttctccgtgcaagagcagtagtatttccttggtgtttgctcccgtcttgtgagctgatgttgctgttgtagagatgtactggaagaagtttggaatggaaattgc

SEQ ID NO: 4279 - DNA, 542 bp, Triticum aestivum
accaccaaaacaatccaatccaatcccccaagagagagaagaggaggaagatgtcgggccgcggcaagggaggcaaggggctcggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggccgagggcccagccgtccagctcgccacgccgccgtccgaccgagagtagtagtggtatctatctagttgctgtctagggttcgtggctctccgtgtatgcgcagtgtttcgctggtgtgtgtctgctcccgtcttgtgagctggtgttgtactggaagaaatctggaatggaaattgc

SEQ ID NO: 4280 - DNA, 540 bp, Triticum aestivum
gcagcactccctcttcttcccaatcacacacctgtcggagctaaccggagcggcgatgtcggggcgcggcaagggcggcaaagggctgggcaagggcggcgccaagcggcaccggaaggtgctccgcgacaacatccagggcatcaccaagccggcgatccggaggctggccaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggttcctgggttccgttggtggcagcagcagtgtggttgcggctgtgtctgtcttgtgccctctgtgatgtgtgctgtgggagatgggatttactgctgctcttggcgtgcgtcgttgtgttccgtgtcttgtgttcagtaggctgtaatatcttgttgcggtcaatgaaacta

SEQ ID NO: 4281 - DNA, 636 bp, Triticum aestivum
gtttcattgaccgcaacaagatattacagcctactgaacacaagacacggaacacaccgtcgaccaccagcagcaacacaccaccacaccgaggccaagcgaagatgtcgggccgcggcaagggagggaaggggctgggcaagggcggcgccaagcgccaccggaaggtgctccgggacaacatccagggcatcaccaagccggccatccggcggctggcccgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggccacgcgaatcgacccccccaccaccagatttgtgctagtagctagctaatggctgtgtagtgttcgtgggctttggtttaatggccgcatcttgctgctgtatgtcctggccttgattgctgtttggatgtagttctggggtggaattgaaattgaagtggtttaccttgaattcttctgcgacctcccactcttttgatgttgatttgggtaagttg

SEQ ID NO: 4282 - DNA, 857 bp, Triticum aestivum
  misc_feature (529)..(529): n = any nucleotide
  misc_feature (553)..(554): n = any nucleotide
cttgaacggtatgtgaatcttggacccattgtggacttctgcgtgtttgaccttgatagtcaagggcaaggtcaggtggtcactttgttcaggagcattctaagacggttccattcgagtggttcgtaacggtatagggattaatgagcaggcttcagtagagctgcaaggcatcaagggattgtggtcactgaagtcttccttcagtgatctgtatgacatgtatctgtgtgtgagctttataagtgagactcggttcttggctatgaacatggaagatgaattagaagaaattgagatagaagggtttgatgcacaaatccagactttgttctgccaaaatgccatcaatgatatgcttatacaggttactgctaattctgtccggttagtcagttgcacttctcgggagctagtggatcagtggaatggcagcgacatacagcctgttggtcgtatacactgcagagttgttcccaacagctgtacgtaccgcagcgatgggatgtacagcacaggcatcgcagantggcgccatactggcgcccttagnngtggtgcttggggagcaagtgccattcgcggtgttcggcgtgtttgggatcattggtgggctgcttgtgatctgcctcccagagactatgaacaagcccttgtacgacaccatgttcgggctggagaaaggggagagggcacctagaagtgaagaagaagttatatcggggaactccgaaatttgactagtttttgtaattattgtgacttgaagatgttagcatggaaatgttgcacacaagagcgattggcacatgcttgaacgaattgttatttggcgttgtgctaatgcgtagcttaat

SEQ ID NO: 4283 - DNA, 1028 bp, Triticum aestivum
aaaggagatttgtttctcacttctcgaattagaaacaccaacactgatggaaagcctttctcatttacatttgcatatcatacatacttctccgtgtctgacataagcgaagtacgtattgaagggctggaaacaatggactactttgacaacctgaagggaaaagagcgattcacggagcagggggatgctcttgtgtttgaatcagagattgataaagtatatctggacacaccaccaaaaattgcaattattgatcatgagaagaaaagaacatttgtgctcaggaaagatggtcttccagatgctgttgtatggaacccatgggagaggaggtcaaaaaccattcttgattttggtgatgaagaatataagcacatgttgtgtgtggaacctgcagctgtggagaagcccattaccttgaagcctggtgaagagtggaaaggaaggttggagctctcagctgttccttccagttactatagtggccagttagatccagacaaggttcttcatggttgaaaatcctcacttggtgcatctcgtacaggaacacttcagggcactttatattacctggtgctttgtctgtctggtgttgatgctatgtggagttgcgggctttcatctcctcatcgtctccacctacatatgtttatttcttcatgtatagatggaggaggcgagcaccggaataacgaaacagcctgagtggctctatctcgaaatctgtcttcggtgcgctcagctcagtgttcagttgcagcaaaaaagaagcgaataatagcattccgtagtttagggtcgcctcctagccctggacaatgggtgatttgttgtacttctgcatcgggctaggaaatctactaccaattgttatcagactattgtctgtactcctctaagatctgtacatatgctatctttagggacttcctggtgtgagataagttaaggagccaccatttatcatgtgctgctggtaaagcattatgcaagtgtgtttttaaccttaataacacagggga

SEQ ID NO: 4284 - DNA, 704 bp, Triticum aestivum
gattgccatgtagggaagcaaaggaggtttatgagaatggacacaaacactgccttggttgcatccatctttggctctcgctagctagtctagaggagaggataaacggcttgagtaagtcgcgcgctttcctcaccatggcaaggaaaaagaatccagctacacctgaactatggcttgcagcaattcgagctgaattgaggcacgggaacaaaaggaagctgattctctactagccaaggcattacaagagtgtccacaagtggcattttgtgggctgcagctattgagatggtgccacgtccccacgcaaatcaaagagctcagatgctataaagcgatgtgatcatgatccacatgtcattgcagctgtcgccaaacttttctggcatgacaggaaggttgataaagcaaggagttggttgaacagagctgttactcttgctcctgacattggggatttttgggcattgtactacaaatttgaactccagcacggaaatgcggacacacaaagggatgttctgaaacgatgcattgcagctgaaccaaaacatggcgagagatggcaagctataagcaaggctgttgagaactcacatcagccagttgatgccatcctgaggaaagtcgttctggctcttggtgcagaagaaaatcccaatgctgcagaaccttagtccttactgtttcgttaaggtcat

SEQ ID NO: 4285 - DNA, 759 bp, Triticum aestivum
cacgatattgagaagaccaagaatgactggaaacaaaattatggaaatgataacagagccgtataggttgacacggcggtgcgaagtgactgcaattctcattctgtatggtctcccaagattgttgacaggttcaattttagctcatgagatgatgcatgcatggttgcgacttaaaggataccgcactctcagtccagatatagaagagggcatatgccaagtcctcgcccacctgtggatcgagtcggagatcatggcaggatcaggcagcaacgccgcgtcgacatcctcatcctcttcgtcgtccgcatcgtcgaagaagggcggaaggtctcagttcgagcggaagctcggcgacttcttcaagcaccagatcgagtcggacacctccgttgcctacggggacggtttcagggctgggaaccgggttgttcagcagtacggcctgaagcgcaccctcgagcacatccggctgacagggacattgccgttctgagaatgtcagagatgcacctttctgcggaagttatataccgatttgttgtcgagagtccgtttacaggaaagagaaaatgaattttgaaatgcacaaattgtacaaacgtgtggctgatattttttcttggaagggctgagcacagtatattattagagatgcatcgaggtggcttgccctgaccatctgttgtattgagggagatcaaaaatggaaatggaaacagtggtatttcttatgcgacgataaagttaataagg

SEQ ID NO: 4286 - DNA, 740 bp, Triticum aestivum
aaaattatggaaatgataacagaacctataggttgacacgccgattgtgaagtgactgcaaattctcattctatatggtctcccaagattgttgacaggttcaatttttagctcatgagatgatgcatgcgtggttgcgtcttaaaggataccgcacactcactccagatatagaagagggcatatgccaagtccttgcccacctgtggatcgagtcggagatcatggcaggatcaggcagcaacgccgcatcgacatcctcatcctcttcatcatccacatcgtcgaagaagggcggtaggtctcagttcgagcggaagctcggtgacttcttcaagcaccagatcgagtcggacacctccgttgcctacggggacggtttcagagctgggaaccgggttgttcagcagtacggcctgaagcgcaccctcgagcacatccggctgacagggaccttgccgttctgagaatgccagagatccaccttttcaccggaagctatataccgatttgtcatcgagagtccatttacaggaagaaagaaaagaaggaaatgaattttgaaatgcacaaattgtacaaacgtctggttgatattttttcttggaagggctgagcacagtatattattagagatgcattgaggtggcttgccctgaccatctgttgtattgagggagatcaaagattgaaatggaaacagtggtatttctcatgtgatcttaaagttaataaggaaa

SEQ ID NO: 4287 - DNA, 767 bp, Triticum aestivum
tattgaggagaccaagaatgacgggaaacaaaattatggaaatgataacagagccgtataggttgacacggcgatgtgaagtgactgcaattctcattctatatggtctcccaagattgttgacaggttcaattttagctcatgagatgatgcatgcatggttgcgtcttaaaggctaccgcacactcactccagatatagaagagggcatatgccaagtcctcgcccacctgtggattgagtcggagatcatggggggatcaggcagcaacgccgcgtcgacatcctcatcatcttcgtcgtccacatcgtcgaagaagggcgggaggtctcagttcgagcggaagctcggcgacttcttcaagcaccagatcgagtcggacacttccattgcctacggggacggtttcagagctgggaaccgggttgttcagcagtacggcctgaagcgcaccctcgagcacatccggctgacagggaccttgccgttctgagaatgtcagagatccaccttttcaccggaagttatataccgatttgtcatcgagagtccatttacaggaagaaaaaaaagaaggaaatgaattttgaagtgcacaaattgtacaaacgtttggttgatattttttcttggaagggctgagcacaggagattgttagagatgcattgaggtggattgccctgaccaatctgttgtatggggagagatcaaaaatggaaatggaaacagtggtgtttcttatgtgaccataaagttaataaggaa

SEQ ID NO: 4288 - DNA, 767 bp, Triticum aestivum
  misc_feature (434)..(454): n = any nucleotide
gaaatgagcgatggagtaatgtgcagaagcagatcgttcgctgcagtcaagcctgtcgttggcgaagaagagcctggcccctgtacgagacgcctcgggatgtcggactcgtccgtggagcagagctgggagagcaacgggaaccacgtgggcgggggctcctcccagcagctggccgcggcgccgcggatcaccgggcgcgatatgaacgccagcatgagcgtcatcgggcggctggcggaggagctggagcagcggagccaggtgttcgccgacgacgccaagttcctggtggaggtcaagtccgggcaggcggacgcgagcctgaacccggacgtggagctccgcaggctgaagcagaacttcgactcgtggaagaaggacttcggctcccgcatcagggagaccaaggtgatcctgaacaagctcgcgannnnnnnnnnnnnnnnnnnnnagtcctcccccaactcggccaagcggaagtggtggggcaggctcaacacctccaagttctcgtgagtgtatggtgatggtgacggtgtagacgcgccggcattttacacgccggcgctagtcctagagaggtttgtgagtgctgctgcggagtccagtgttttgggctggatgagtatgtatgtgattcgtggagggcgagttgtatagttcttccactggggggctgcttcttttctaggccacccatgaaccactgagttgtgatgtaattacttgctaagatataccactacttgaaggggagagattgg

SEQ ID NO: 4289 - DNA, 885 bp, Triticum aestivum
gcatctccgacgaggatcaaggtcgactcccatgcccgtcggcaagtacagcatcgtcgcccccgactccagctaccccgacgccagctccccgagtcgcaccgcgtctcccctcagggtgacgtcgccgtacgggaacagcatgcactactccgagaacgtgcagtcggggcacttcgccttcacgcggtggagcccggggactacctggcctgcttctgggcgcctgaccacaagccgcccgtcaccgtcaccttcgagttcgactggaagagcggcgtcatggccaaggactggtccaacgtcgccaagaaaggcaaggtcgatatgatggaactagagctgaagaagctagaggataccatcaaatctatccatgaagaaatgttttatctacgtgaaagggaggaggaaatgcagaacatcaacaggcagacaagctcgaggatggggtggctgagtttcctctcgctcggcatctgcttatccgtggcagggctgcagctgtggcatctgaagacctttttcgagagaaagaagctgctgtagttcccccatgatcacaaacaaatcgttgcgaattagggtatattgtttctgccagctgttaacctatgtttccagcgaatactcgaaccatcagtaagaaagaaaccgtcgatcatcatacttgtgaaatgcctttctgtgccctatcttctgcccgatcaaatacagttgtaaaatgtttccccttttttcttgaacagggctgaaatgtttctgttgatggtttcatatgatgtaacgtagagtgacattgttttctttttctagagctgagtagagccacatcgtcgctactgttatgactcgtgagtaatgttgtagtgacccaataataca

SEQ ID NO: 4290 - DNA, 759 bp, Triticum aestivum
gcgcgcctccggttcgacctcgagtccggccacaccaagtgcatctccgacgagatcaaggtcgactccatggccgtcggcaagtacagcgtcgtcgcccccgaccccagctaccccgacgcccagctccccgagtcgcaccgcgtctccctcagggtgacgtcgccgtacgggaacagcatgcactactccgagaacgtgcagtcggggcacttcgccttcacggcggtggaggccggggactacctggcctgcttctgggcacctgaccacaagccacccgtcaccgtcaccttcgagttcgactggaagagcggcgtcacggccaaggactggtccaacgtcgccaagaagggcaaggtcgatatgatggaactagagctgaagaagctagaggataccatcaagtctattcatgaggaaatgttttatctacgtgaaagggaggaggaaatgcagaacatcaacaggcagacgaactcgaggatggggtggctgagtttcctctcactcggcatctgcttatccgtggcagggctgcagctgtggcatctgaagacctttttcgagagaaagaagctgctgtagtttcccccatgatcacaaacaaatcgttgcgaattagggtatattgtttctgccagctgttgacctatgtttccaagcgaatacttgaaccatcagtaagaaagaaaccgttgatcatcatacttgtgaaatgcctttctgtgccctatcttctgtctgatcaaatacagt

SEQ ID NO: 4291 - DNA, 1104 bp, Triticum aestivum
cccaacaccacctcgtgacttcgtccgcagaccttccctcgcgcttcgactcccactccgatctccggccatggccgcggcgcgccccggatcccccgcccccagacggctgcccccctccacgctcctcctcctggccgccgtcctcctcgcggcctcgccgccggcgcgcgccctccggttcgacctcgagtccggccacaccaagtgcatctccgacgagatcaaggtcgactctatggccgtcggcaagtacagcgtggtcgcccccgaccccagctaccccgacgcacagctccccgagtcgcaccgcgtctccctcagggtgacgtcgccgtacgggaacagcatgcactactccgagaacgtgcagtcggggcacttcgccttcacggcggtggaggccggggactacctggcctgcttctgggcgcctgaccacaagccacccgtcaccgtcaccttcgagttcgactggaagagcggcgtcacggccaaggactggtccaacgtcgccaagaagggcaaggtcgatatgatggaactagagctgaagaagctagaggataccatcaaatctattcacgaggaaatgttttatctacgtgaaagggaggagcaaatgcagaacatcaacaggcagacgaactcgaggatggggtggctgagtttcctctaacttggcatctgcttatccgtggcagggctgcagctgtggcatctgaagacctttttcgagagaaagaagttgctgtagtttcccccatgatcacaaacaaatcgttgcgaattagggtatattgtttctgccagctattaacctatgtttccgagcgaatactcgaaccatcagtaagaaagaaaccgtcgatcatcatacttgtgaaatgcctttctgtgccctagcttctctccaatcaaatacagttgtaaaatgttctttttttcttgaacaggggtgaaatgtttctgttgatggtttcatatgatgtaacgtagtgcgacaccgttttgtttttctaaagctgagtagagccatatcgttgctactgttatgagtagtggtccttttagcgagtgtgggcaagtttgccaaccaaataa

SEQ ID NO: 4292 - DNA, 819 bp, Triticum aestivum
tcatcaccggcctcgtcaacgtcttcgccaccttcgtgtccatcgtgaccgtggaccggctgggccggcgcaagctcttcctgcagggcggcacccagatgctggcctgccagatcgtggtgggcagcctgattggcgccaagttcgggttcaccggcgtggccgacatccccaaggggtacgcggcgttcgtggtgttcttcatctgcgcgtacgtggccgggttcgcgtggtcctggggcccgctggggtggctcgtccccagcgagatcttcccgctggagatcaggtcggcggggcagagcatcacggtgtcgatgaacatgctgtgcaccttcatcatcgcgcaggcgttcctccccatgctctgccgcttcaagttcatgctcttcttcttcttcggcgcgtgggtggtcgtcatgaccctcttcgtcgcctacttcctgccggagaccaagaacgtgcccatcgaggagatggtgctcgtgtggaaggcgcactggtactggggccgcttcatccgcgacgaggacgtgcacgtcggcggcgcagacgtcgagatgcgctccaacggcaaggtccaggctgccaagctcccgtgacgtcgaaacgtcgtcgctggccaataagctgttaccatccgaggccgatcgaggacttttttgagtcctcgtctgaattttcaattgtcttcttctgtattatattgccatactacctaggatgatgacgacaatcagtgcgtcactaatcattctcagttccttttctttttatgaagttgctcctatgtgccgggtatatactctgtgccgtgag

SEQ ID NO: 4293 - DNA, 765 bp, Triticum aestivum
tcgctccacgatgcctacgcgaccgaagggatagcctccagtccccacatgtcgcacgctttcgaccacatcatattcgctttgctggacgacctgctggagatcgcccagaaccactccgcagaaggaccacaggaacatggaaggatccctcgtgctcgccgtgagactggtagcgaaggtgtaccttgagctgttaccggacctcttcgggctgagcagcttctgcaagctgtggctgggggtcctcagccggatggagaagtgcatcaaggccaaggtccggggcaagcgcagcgacaagcttcaggagctgatcccggacctcctcaggaacgtcctggccgcgatgaagggcagggggatcctcgccaagaggagcacgatagggggcgacagcctgtgggagctgacgtggctccatgtgaacaacatctcgacgggcctgcagtcggaggtgttcccgagccaggagtatgagccgccgagcaatgccggtagcccgagaggggggctgaacgatgccgagatcaagaactagaagaagctcatttcaacagggacgttaaggttttgatattgtaaccgcatttcgccgcctccattgtatgtatatttgttctgtccgagttgagttgctgttgttgtgtaaaacgatgtgagcagattgacatgtttgcgctgctgacctgatgagtggctgtgatgcacgtatcatcatcagcactaaaaatgctgttgtttcgcaagtttgtgtgctggttt

SEQ ID NO: 4294 - DNA, 536 bp, Triticum aestivum
gcgaagttctaccttcagctgttaccagacctcttcgggctgagcagcttctgcaagctgtggctgggggtcctcagccggatggagaagtgcatcaagaccaaggtccggggcaagcgcagcgacaagcttcaggaactgatcctggaccttctcaggaacatcctggtcgcgatgaagagcagggggatcctcgccaagaggagcacgatagggggcgacagcctgtgggagctgacgtggctccatgtgaacaacatctcgacgggcctgcagtcggaggtcttcccgagaggggggttgaacgacgtcgagattaagaactagaagaagctcatgggtatttcgcatttcgcccattgagacgtaaggttttgatattgtaaccgcatttcgccgcctccattgtatgtatatttattctgtccgagttgctgttgttgtgtaaaactgtggcagcaatgtgagcagattgacatgtttgcgctgctgacctgatgagtggctgtgatgcacgtatcatcagcactggaaat

SEQ ID NO: 4295 - DNA, 697 bp, Triticum aestivum
atcacgtcatattcgtgttgctggacgacttgctggaaatcgcccagaaccactcacagaaggaccacaggaacatggaaggatccctcgtgctcgccgtgaaactggtagcgaaggtctaccttcagctgttaccagacctcttcgggctgagcagcttctgcaagctgtggctgggggtcctcagccggatggagaagtgcatcaagaccaaggtccggggcaagcgcagcgacaagcttcaggaactgatcctggaccttctcaggaacatcctggtcgcgatgaagagcagggggatcctcgccaagaggagcacgatagggggcgacagcctgtgggagctgacgtggctccatgtgaacaacatctcgacgggcctgcagtcggaggtcttcccgagccaggagtatgagccgccgagcaatgccagtagcccgagaggggggttgaacgacgtcgagattaagaactagaagaagctcatgggtatttcgcatttcgcccattgagacgtaaggttttgatattgtaaccgcatttcgccgcctccattgtatgtatatttattctgtccgagttgctgttgttgtgtaaaactgtggcagcaatgtgagcagattgacatgtttgcgctgctgacctgatgagtggctgtgatgcacgtatcatcagcactggaaatgctgttgtttca

SEQ ID NO: 4296 - DNA, 575 bp, Triticum aestivum
  misc_feature (77)..(77): n = any nucleotide
gatctctcatcagagctgttcacccaatgaactcgatgaggagtttgacacattccccacaagccggagccaagagnttgtaaggatgaggtatgataggctgaggagtgttgctggaaggatacagactgttgtcggtgatatcgcaacccaaggggagagagttcaggcactgcttagttggagggatcctcgtgccacagcaatatttgtgctattctgtttcatagccgcgatagtgctgtacgtcacaccgctccaggttcttgcagcattgggagggttctatgccatgaggcacccaaggttccgacacaggcttccttcgacgccagtgaacttcttcaggcggctgccagcgaggacggacagtatgctgtgaagaagctaccatctggtggccttatcgttgtaatccctagaattactccatgtctgtcgctgtagctcgacttgccgtgttgttatttgtgactgttcgtcgttcaggacttcgagtctgtctatcgtattaggtgctggaccaagggaataatgtgctgacagcttatcatgacttgccaggttttggaagc

SEQ ID NO: 4297 - DNA, 630 bp, Triticum aestivum
gttaccggcctcgctaccctccacacatgtacaccaagatctctcatgcagaagctgttcacccagatgaactcgacgaagagtttgacacattccccacaagccggagccaagaggttgtaaggatgaggtatgataggctgaggagtgttgctggaaggatacagactgttgttggcgatatcgcaacccaaggggagagagttcaggcactgctcagttggagggatcctcgggccacagcaatatttgtgctattctgtttcatagccgcgatagtgctgtacgtcacaccgctccaggttctcgcagcattaggagggttctatgccatgaggcacccgaggttcaggcacaggttgccatcaacgccagtaaacttcttcaggcgactgccagcgaggacagacagtatgctgtgaagatgctaccatctggtggccttatcgttgtaatccctagaattacaccatgtctgtcgctgtagctcgactcgccgtgttattatttgtgactgttgtcgttcaggacttcgagtctgcctatcgtattaggtgctggatccagggaataatgtgccgacagcttatcatgacttgccaggttttggaagcatgctgatcgtttatg

SEQ ID NO: 4298 - DNA, 816 bp, Triticum aestivum
  misc_feature (46)..(46): n = any nucleotide
gccatcaagaaagagatctttttcctggttcttggatcgagaaccngccgaccatgtcgttcgccatcgcccggagctccagtcccgagagcaacatcgacgcgcacgcacggctccgccgtgacgagcgcaagcgcaagaggatgctgtccaacagggagtcggcgaggcggtcccgcgcgcgcaagcagcagcggatggaggagctcatcgccgaggccagccgcctccaggccgagaacgcgcgcgtggaggcccagatcggcgcctacacgaccgagctgaccaaggtggacggcgagaacgccgtgctccgcgcgcgccacggcgagctcgccgggcggctgcaggcgctcggcggcgtcctggagatcttccaggtggccggcgctcccgtggacatcccggagatccccgacccgctgctccgcccgtggcagtccccgttcgcgccccagctggccgccgccggtggcatgcccgacgcgttccagttctgagccaagagccgccaagacatgtcatgccactgcattggaccaccatggatatggttgctgctcatctactgctgctgaagaatactagtactaccagtttgtttggttcatgtttaattatggtttgattcgtgttgcttatgtaatcctagaccattattagtacttattttgtgattgtaatcttcctatgctcctagccagtggatatggataagaacaatgtcattgatgtgtgggggagcgcaaatggattgtgcctatctttgggtgatttgtaataacatcttgacatggaacctatatatatgtttgc

SEQ ID NO: 4299 - DNA, 1244 bp, Triticum aestivum
tgcttatgcattagagcccccggagttgcttcgattcgcggctaagtcctgctttctcccttcccgttcttacgtttcagtccttgtagcttctttttccttagagtctactccctgttccgttgcaaataagcccctgagctctgtcacattctagcctcgactccttggcctcgggaggagttcgtcgtagatccgatctagagagcctccccgcaccacccatgtttaccttccccttcctctgacggccgccgccccccgatgaagctgcgcgttcgctgccgctcccactccttctccgtcgccttcctctactggttctacgacttctcatgaactcctcgcccctcgagaccgccgcatatccatccagattctagttgatttgtagatctagctttgttcctccccctttctggccttcttccttcccaccatcacagaaaagagaaattttttccggttctgggatcgagaacccgaccatgtcgtcgccatcgcgccggagctccatcccggagagcaacatcgacggcggcagcggcagcggctccgccgggcgacgagcgcaagcgcaagaggatgctctccaacagggagtcggcgaggcggtcccgcgcgcgcaagcagcagcggatggaggagctcatcgccgaggccagccgcctccaggcggagaacgagcgcgtggaggcccagatcggcgcctacacgaccgagctgagcaaggtggacggcgagaacgccgtgctccgcgcgcgccacggcgagctcgccgggcggctgcaggcgctcagcggcgtcctggagatcttccaggtggccggcgcgcccgttgacatcccagagatccccgacccgctgctccgcccgtggcagtccccgttcgcgccccagctggccaccgccggcggcatgccggacgcgttccaattctgagccaagagccgccaagacatgtcatgccactgcattggaccaccatggatatggttgctgctcatctactgctgctgaagaatactactagtactactagtttgtttggttcatgtttaattatgtttgattcgtgttgggtatggtaatcctagaccattattagtacttatttcgtgattgtaatcttgcctatcgtgtcctgtgctcctacccactggatatggataagaacaatgtcattgatgtgtggcggagcacaaatggattgtgcctatctttggggtgattcgtaataacat

SEQ ID NO: 4300 - DNA, 1067 bp, Triticum aestivum
cgcagattcgatctagagagcctccccgcaccacccatgtttaccctccccttcctctgacggccgccgtcccccgatgaagctgcgcgtccgctgccgctcccactccttctccgtcgccttcctctactggttctacgacttctcatgaactcctcgccccccgacaacgccgcatccatccagcctctagttgattagatccagcctcgtttcttccactttcttgccttcttcctccccaccatcaaagaaaagagatctcttttctggttcttggatcaagaacccgaccgaccatgtcgtcgccgtcgcgccggagctccagccccgagagcaacatcgacggcggcagcggcagcggctccgccggtgacgagcgcaagcgcaagaggatgctgtccaacagggagtcggcgaggcggtcccgcgctcgcaagcagcagcggatggaggagctcatcgccgaggccagccgcctccaggccgagaacaagcgcgtggaggcccagatcggcgcctacacgaccgagctgaccaaggtggacggcgagaacgccgtgctccgcgcgcgccacggcgagctcgccggccggctgcaggcgctcggcggcgtcctggagatcttccaggtggccggcgcgcccgtggacatcccggagatccctgacccgctgctccgcccatggcagtccccgttcgcgccccagctggccaccgccggcggcatgcctgacgcgttccagttctgagccaagacaagtcatgccacggcgacattgcgccaccgtggataaggttgatgattactgctgctgctgctgaagaatgctagtactactagtttgtttgcttcatgtttaattatggtaatcctagaccatcattagtacttattttgtgattgtaatcttcctattgtcctagccagtggatatggataagaacaatgtcattgatgtgtggcggagcacaaatggattgtgcctatctttgggttgatttgtaataacatcttgacatggaacctatatatgtttgcagttatttagctatctgttactttg

SEQ ID NO: 4301 - DNA, 839 bp, Triticum aestivum
attcgccaggctctgctgggaatgcgcactgagaaagctcagcttatgcttcttcgggagatagcacaacagttagccaaagacgccgctccagttggcactggggctgggtctgttccagttgtccaccatttgcccagaaagcaagctgtgggggtcgcagatacaacggtcagggaagacaagaagacagcacccgccgggacattctccaagcccttgttgtttaagtgggccatcgcattattttgctctcgaaaaaagaagccatcacaaagcaggtatacatttggattatcaagtaacaatgtgggtttgctcatactcttggacaagtgccctcggattcagaaaactctcatgagaagaaagtaaagcctgtctgaagaagctgctgctgcctaatgtaaataacatagccgttggttgggaagtctgcatcaaatcacattttcttattcaagggttgggagatggtgttgttttaattctttagttgttgatgatttctctttggccccaggaggggatggggatccttgtgccatgatccagaaattgtcaatgtgggttttggggggttgcttttgcttatattttctcaccagcaaaggctatatgcttgtatagtgcgcgtgtgaacgtgcggtgactgctggttgtttttgcttgctttcagattgatgacggatgagttgatatcaaggaaattagctgcacatttgtgcaaactgtatctgatgtgtcttttttgtcagtacagaatctgttggcgtggttgatttggtgtgtacacatgtgtgaagctatcatgtcatcttgggagaaaagcacgcttc

SEQ ID NO: 4302 - DNA, 677 bp, Triticum aestivum
gccgccgggggacaaccccccggtcacgtacccgtcgcctccggtgaacacgccatgccctcctccgcctccgcgacgcccgcggcgcagacgtgcccggtggactcgctgaagatcggcgcgtgcgtggacctgctgggcgggctggtgcacgtgggcctcggcgacccggtggtgaacaagtgctgcccgctgctggaggggctggtggagctggaggcggcggtgtgcctctgcaccaccatccggctcaagctcctcaacatcaacctcgtcctgcccctcgccctccagctcctcctcacctgcggcaagacccctccccccggctacacctgctccatctgatcgagctaagctcggtaagtcggtgcacgtggagatggtggatcatggatggatcgacatgagaggatgtcgaacgtggtcgtagtacgtagcgagcaagaagaagagattgatcgatcagctatgaagggatcgatgagtacgcgtttgtttttcttcatttcttgtggtttcctttttgtgtttggttattaggtcaggtctgtgtgctctggtttggccgatgcaagaggtgataatcggtgtgtttactgattaattaattgtgtggtcacagactcacagctgatggccaattggttaagctagcagacacctagtactatcag

SEQ ID NO: 4303 - DNA, 1097 bp, Triticum aestivum
ggttttgcttcgcttgctcggattgcaggagggtatgagagacgaaaacaacagctagaggatagctcagattaagctctttcatcaaggatagaatgggtggctgctgctgttgtgcatcaagagcggaagcggatagagcaccggttcacatctatcatcagcaaaaccaagaggagcatgaacctttatcttctgcctttgacgggtcatctccagcttctgctatagtcgcagttgacacaaatctggacacatccactcctgacacttatcgggcaccacctgcaccattgccttatgatgttagtttgccagttacagaaaacccagatctggagaagtcagatatcaaaagcaaaacagatgatcagcaggaatctctgaaggtggatgaatacgaatcatgtgaaaaaggtgcccctgaagataagatcgaggaggaggatgtttgccctatctgccttgaagaatatgatgaagaaaatccccgctctatcaccaaatgcgagcatcatttccatctttgttgcatactcgaatggatggagcgaagcgagacttgcccagtctgtgaccagataactttgatagatgagatgtatgaatagcatgttgaccctggtggatcctctctaggagcccgtgcgtgcctaccgaggaggtttagtactagtccttttctctatggggaagtaaaatcagcaaactactctgctcctaatatgatagtatgatctggtggaggaggtgctactggaatgcatcttgggagaacaaatgggaaataatgaaaggaaggaacccgcaagaaatatgctctaaaaaaaaccatccatccctgtgtttatactagcatttgtgtcaagtttatggtaacaggaggattagcaggctgcatctgcaatatgcacttcatactagtcgaaactctgaatccagctctctttatttttcgtgctttctggattttgggttgcgtttttctgattcgtcgagcgtctgtataaaccatcgcatactagatatagggtgacagcaagtataaaagactggttctgaactgtgtcttcatttgtacattacttaccggtgat

SEQ ID NO: 4304 - DNA, 764 bp, Triticum aestivum
  misc_feature (71)..(71): n = any nucleotide
ccattgccttatgatgttagtttgccagttaccagaaaacccagatctggagaagtcagatatcaaaagcnaaacagatgatcagcaggaatctctgaaggtggatgaatacgaatcatgtgaaaaaggtgcccctgaagataagatcgaggaggaggatgtttgccctatctgccttgaagaatatgatgaagaaaatccccgctctatcaccaaatgcgagcatcatttccatctttgttgcatactcgaatggatagagcgaagcgagacttgcccagtctgtgaccagataactttgatagatgagatgtatgaatagcatgttgaccctggtggatcttctctaggagctcgtgtgtgcctgccgaggaggtttagtactagtccttttcctatggggaagtaaaatcagcaactactctgctcctaatatggtagtatgatctggtggaggtgctactggaatgcatcttgggagaacaaatgggaaataatgaaaaacacaagcatcaagaaatatgttacctaaaaaaacatccatccctatgtttatactagcatttgtgtcgagctgtggctgtttatggtaacaggaggattagctggctgcatctgcaacatgcacttcatactagtcgaaactctgaatctagctctctttttttcatgctttctggattttgggtcatgttttctgtgattcgtcgagcgtctgtataaaccatcacatacttactagatatagggtgacagcaagtata

SEQ ID NO: 4305 - DNA, 710 bp, Triticum aestivum
cacatgggataccaagctatcgcaggctgagttcacacaccctgatgagcttgatgaggagtttgacacattcccatccaacaggccagctgacattgtaaggttgcgctacgacaggctgaggagtgttggaggtcgtgtgcagacggtggtcggggacctggcgacgcaaggtgagagagcccatgcgttgctgagctggagggacccccgtgccaccgccatcttcatattcttgtccctggtggtggccattgtgctgtatgtgacgccgttccaggttttgctggtcatcaccatgctctacttgctgcgccatccccggttccgcagcaggatgccctctgtcccgttcaacttctacagaagattgcctgccaagtccgattcgcttatttgaagataaaatgagggaagcttgtaacattgcccccctctctcgttctgttccttctggttagcatcagatcagatgtgaatatacttaatgagttgattaatttagagccaggcagctggtggccctgtaataaggtgtcggtttatatgttggtctgcttagctaggcagaaaacgaagggaatggccgggggatcccttcgtagttttggatggaaaatgttggctttggggtttctggtgtagagctgggcacaagttgagttccagaatgttatgtttatgtattggtgccagttttgtttatgttc

SEQ ID NO: 4306 - DNA, 833 bp, Triticum aestivum
ctaccatcttcctctacatgtttatgatcggactgtggaactatcgcttccggtcaaggcacccaccacacatggatactaagctatcgcaggctgagttcacacaccctgatgagcttgatgaggagtttgacacattcccatccaacaggccagctgacattgtaaggttgcgctacgacaggctgaggagtgttggaggccgtgtgcagacggtggtcggggaccttgcgacgcaaggtgagagagcccatgcgctgctgagctggagggacccccgtgccacagccatcttcatattcttgtcctggtggtggccattgtgctgtatgtgacgccgttccaggttttgctggtcatcactatgctctacttgctgcgccatccccggttccgcagcaggatgccctctgtcccgttcaacttctacagaagattgcccgccaagtccgattcgcttatttgaggccagagcattcgacagaagataaaatgggggaaccttgtaacattgtcctcctctctcattctgttccttctggttagcatcagatcagatgtgaatatacttgatgagttgattaatttagaggcagctggtggccctgtaatatggtgtcggtttatatgttggtctgcttagctaggcagaaaacgaagggaatgaccgggggttcccttcatagttttggatgaaaaatgttggctttgggatttctggtgtagagctgggcacaggatgagttccagaatgttatgtttatgtattggtgccagttttgttgatgttctgttaattccgttgcgtcgatcatgttcctgccctaatcttt

SEQ ID NO: 4307 - DNA, 615 bp, Triticum aestivum
gtcatgaacgtcaacttcggcgcatcaccgttatgaccaacgagcagctcctggagttcgcgtgggggcttggccaagagcggcaatcattttctctggatcatccgtcccgacctcgtcaagggcgacaccgcagtgctccccccggagttctcggccgagacggtggagcgtgggctcgtggcctcctggtgcccgcagcagcaggtgctgaaccacccggccgtgggcgcgttcctgacgcacagcggctggaactcgacgctggagagcatatgcggcggcgtgcccgtcatcagctggccattcttcgcggaccagcagaccaactgccggtaccagtgcaaggaatggggagtcggcatggagatcgacaccgacgtccggcgcgacgccgtcgcagaccttatcactgagctcatggagggggagaatggaaaggtgatgaagaagaaggcacaggagtggagggagaaagcggtgagggcgaccaagcccggcggtcgtctcaccgcaactttgatgcgttgattcagacgtgttgctcctataccgctttgtggtatgtgtacttgtttttaatttttttttttctgaatcccttcttaaacggat

SEQ ID NO: 4308 - DNA, 998 bp, Triticum aestivum
tcttctgaggttatttgatttgggtggttatcctccaacctcaacctatgtattcctcggagactacgtagatagaggcaaacagagcttggaaactatatgcttactgctggcatacaaaataaggtaccctgacaagattttcctgttaagggggaaccatgaagatgcaaaaatcaacagagtttatggtttctatgatgaatgcaagaggagattcaatgttcgtctgtggaagatattctctgattgcttcaactgcctgcctattgcagcactcattgatgacaagatactgtgcatgcatggtggcctttcacctgaactgactaacctcgaccaaataaaggatattgagaggccggctgagattcctgattatggtctcctgtgtgatttgctttggtctgatcctagccctgacggagaagggtggggggagagtgacagaggtgtttcatgtacgtttggtgcagataagcttatagaatttttggaaaaaaatgatcttgatcttatctgccgagcccatcaggtggtagaagatggttacgagttcttcgcacagcggagattagtcacaatcttctcagctccaaattattgtggggaattcgataatgtaggtgctctgttgagcatagatgaaaatctaatgtgctcatttcaaatcttgaagccaaatgaaacaggcacaccgcgtgtgaaaagacaaatcccaaataagccagcaattgggggaagtgcctgatctgataaacatccaattccttcaatattaccattgtcagctcgaagggggtgatctgatctattgtttggatccaccagggcatggcaatattcatccaccagccaattgtcttgcttaaccacccttagttgccgagcatttgtaaatgtccattggctctgcacttgttttctcatgtacagaattaggccggatttaacagcaccacctattactggttgatattgctttgcgactggcatct

SEQ ID NO: 4309 - DNA, 838 bp, Triticum aestivum
  misc_feature (16)..(16): n = any nucleotide
  misc_feature (85)..(85): n = any nucleotide
  misc_feature (88)..(88): n = any nucleotide
  misc_feature (107)..(107): n = any nucleotide
actacaagtccgtgantaagcccagtttgggcagaagggaccgggtaccgcaacttgctggatatgaatgcgcggctttggcggnttngctgcggcattggcgggtnaccctatgtgggtgatgaacatggtcccaaccgttggaaattcaaccacccttggggtgatatacgagcgcggcctcattggaaactaccaagactggtgcgagggcatgtccacctatccccggacctacgacctcatccatgctgattcggttttcagtctgtacaaggacaggtgtgagatggacgccatcctgctggaaatggacaggatcctgaggccggagggcacggtgatcatcagggacgacgtggacctgctagtgaagataaagagcgtcgcggacgggatgagatggaatagccagatcgtggaccacgaagatggtccgctcgtccgggagaagctcctccttgttgtgaagacatactggacactcggggacgagaaacaatagcagcaccccgaaataaaagcatgagaaatgagaaaatcgacagatactgggcagatgccacacacatccggcttcctctcaccgtgttcgccctgtggttttgaagtttcatcttgtttgggtagttcgtttggtgaaatagtgaaacatagtggagacatgcccacgtctgttcacagagggcaagcctgccaagattttgacatggggaaggacagccagccagccaaatggggttgacagagatttcattgtgtttcttgctgtacaaagtgttggttatgtgtaagttcccctcggctgttctgccctccttactgaatcagacccaag

SEQ ID NO: 4310 - DNA, 954 bp, Triticum aestivum
cggcggtgagctgaagaagtggccgcagaggctcaccgccatgccacccaggattgctagtggcagtattgagggggtcactgccgaaatgtttaacgaagacaccaggttatggaagaagagagttgggcactacaagtccgtgataagccagtttgggcagaaggaccggtaccgcaacttgctggatatgaatgcacgctttggcggcttcgctgcggcattggcgggtgaccctatgtgggtgatgaacatggtcccaaccattggaaattcaacgactcttggggtgatatatgagcgtggcctcattggaaactaccaagactggtgcgagggcatgtcgacctatccccggacctacgacctcattcatgctgattcagttttcagtctgtacaaggacaggtgcgagatggacaccatcctgctggaaatggacagaatcctgaggccggagggcacggtgatcatcagggacgacgtggacctgctagtgaagataaagagcgtcgcggacgggatgagatggaatagccagatcgtggaccacgaagatggtccgctcgtccgggagaagctcctccttgttgtgaagacatactggacactcggggacgagaaacaatagcaacgccccgaaataagcatgagaaattgacagatactgggcaaatatcacaactggcttcctctcaccgtgttcgccctatggttttgaagttttatcttgtctgggtaattcttttgctgaaatagttaaacatggcggagacatgcccaagcctgttcacagagggcaagactgccaagattttgacatggggaagggcagccagccaaatggggtagacagagatttcgttgtgtttcttcctgtacaaagagttggtcatgtataagttcccctcggctgttctgtcttccttactgaatcagacccaagaatgataa

SEQ ID NO: 4311 - DNA, 999 bp, Triticum aestivum
cactgccgtgccacccagaattgccagtggcagtattgagggggtcactgccgaaatgtttaacgaagataccaagttatggaagaagagagttgggcactacaagtccgtgataagccagtttgggcagaaggaccggtaccgcaacttgctcgatatgaatgcgcgctttggcggcttcactgcggcattggcgggtgaccctatgtgggtcatgaacatggtcccaaccgttggaaattcaacgacccttggggtgatatacgagcgtggcctcattggaaactaccaagactggtgcgagggcatgtccacctatccccggacctacgacctcattcatgctgattcagttttcagtctgtacaaggacaggtgcgagatggacaccatcctgctggaaatggacagaatcctgaggccggagggcacggtgatcatcagggacgacgtggacctgctagtgaagataaagagcgtcgcggacgggatgagatggaatagccagatcgtggaccacgaagacggtccgctcgtccgggagaagctcctccttgttgtgaagacatactggacactcggggacgagaaacaataggaacgccccgaaataaagcatgagaaatgagaaaattgacagatactgggcagatgtcacacacatctggcttcctctcaccgtgttcgccctgtggttttgaagttttatcttgtttgggtagttcgtttggtgaaatagctaaacatagtggagacattttttttagaaaagggggactccccggcctctgcatcagaacgatgcatacggccacaacatagtggagacatgcccaagtctgttaacagagggcaagcctgccaagattttgacatggggaaggacagccagccaaatggggtagacagagatttcattgtgttccttcctgtacaaagagttggttatgtgtaagttcccctcggctgttctgtcttccttactgaatcagacccaag

SEQ ID NO: 4312 - DNA, 553 bp, Triticum aestivum
cttcctttcgtcttcagccgtagcaagcagtacgagtggaatgctagaacacaggtgacaatgtggtacgacgacacaaagatcgagcagagcaaactccatgactacgccaataaattctggagtgggcttctgaagagctactaccttccaagggcatctaaatacttcactcggttatcgagaagcctccaagagaaccggagctttcaactggaggaatggaggcgagattggatctcctactctaacgaatggcagtccgggaaggagctgtaccctgtgaaagccacgggtgatgctttggcgatctccaggtctctctttgcaaagtacttcaggtaaggtagatgtgggctgcggccacaaaactttgaggaatgtttgttataaataaagcaaaataatgtacgcatgagatcgttgtgaagtgagcggtgtacatccgctctcgattccgcaactagtcccgtttcaagtaaaaggttcagccgtcaatactgtactttttgcagtgggtacatcgaataacgaaattgaaacctttcatgcg

SEQ ID NO: 4313 - DNA, 621 bp, Triticum aestivum
actttcacacaaagaaattcctccgaagtcatcatggatatcgaagacgctactagcttctgatgacaatttcctgctgggcccttggttagaaactgcaaaaagccttgctacgactgaagacgaaaggaacagtacgaatggaatgctagaacacaggtgacaatgtggtacgacgacacaaagaccgagcagagcaactccatgactacgccaataaattctggagcgggcttctgaagagctactaccatccaagggcatctaaatacttcactcggttgtcgagaagcctccaagagaaccggagttttcaactggaggaatggaggcgagactggatctcgtactctaacgaatggcagtccgggaaggagctgtaccctgtaaaagccacgggtgatgccttggcgatctccaggtctctctttgcaaagtacttcaggtagatgtgggctgcggccacaaaactatgaggagtgtttgttataaataaagcaaaataatgtactgcatgagatgttgtgaagcaaacggcgtacatctgctcttgactctgcaactagtctcatctcatgtaaaaggttcagccgtcaatacttttcgcgctgggaaataaat

SEQ ID NO: 4314 - DNA, 620 bp, Triticum aestivum
gcctggagccgccatgaaggacctcgcctccatcaccggccagtaccccgtcaagaccaaggccaagaactccgtcgccagcttcaagatccgcgagggcaacaccattggtatcgccgtcacgctccgcggcagggtgatgttcaacttcttggataggctcatcaaccttgggctccctaggaccatggacttcctaggtgtcaaccccaacagcttcgacggccacggcaactacaccatcggcctccgcgaccagggcgtgttcccggagattccctatgaggtgggcggcaagaagaacggtatggacgtcaccattgtgaccaccgccaagaccgacaacgaggcgcaaaggctgctcgcgctcctcggcatgccattcgccgagaacatcaagtctgatcagttcaagaagaagaggttgaagcgccaccacttcatgagcaagggcaggggaagaaagtgaagatcgagcggcgtttgagctttgcttcccactttgtcaattgtgatccttttgcatagtttggtttagatatttgatgatcctttcgctgtctgttataacttgcagttcatgttgtacctactgccacagaacaaaatggaaatttttg

SEQ ID NO: 4315 - DNA, 694 bp, Triticum aestivum
ccagtgcccaagcttgagagattgtggtgaactccgagcttggggtgattcgggaacaacaaggttctggagccgccatgaaggacctcgcctccatcaccggccagtaccccgtcaagaccaagccaagaactccgtcgccagtttcaagatccgcgagggcaacaccattggtatcgccgtcacgctccgcggcagggtcatgttcaacttcttggataggctcatcaaccttgggctccctaggaccatggacttcctaggtgtcaaccccaacagcttcgatggccacggcaactacaccattggcctccgcgaccagggcgtgttcccggagatcccctacgaggtgggcggtaagaagaacggtatggacgtcaccattgtgaccaccgccaagaccgacacgaggcacagaggctgctcgcgctcctcggcatgccattcgccgagaacatcaagtcggaccagttcaagaagaagaggttgaagcgccatcacttcatgagcaagggcaggggaagaaagtgaagatcaggcggcgtttgagctttgttgcttcccactttgtcattgtcatccttttgcatagtttggtttagatattggatatctgatgatccttttgctgcctgttattacttgctcttatattagtttacagagggagtactacagaacaaatggaaagttt

SEQ ID NO: 4316 - DNA, 616 bp, Triticum aestivum
ccgccaccccctccggcatcatcctcgtcgacccgccgaggcccagaaggtgcaccgcctcaagaccgtctacgacaccaaggtcatccccgtcatcaccgaggagttcggctacaccaatgtccaaccaggtgcccaagctggagaagattgtggtgaactgcgggctggggggtggatgcggggaacaacaagggcctggaggccgccatgaaggacctcgcctccatcaccggccagtaccccgtcaagaccaaggccaagaactccgtcgccagcttcaagatccgcgagggcaacaccattggtatcgccgtcacgctccgcggcagggtgatgttcaacttcctggataggctcatcaaccttgggctccctaggaccatggacttcctaggtgtcaaccccaacagcttcgacgggcacggcaactacaccatcggcctccgcgaccagggcgtgttcccggagatcccctacgaggtgggcggcaagaagaacggtatggacgtcaccattgtcaccaccgccaagaccgacaacgaggcgcagaggctcctcgcgctcctcggcatgccattcgccgagaacatcaagtcggaccagttcaagaaga

SEQ ID NO: 4317 - DNA, 968 bp, Triticum aestivum
cttcaacctggcaaagtgaaggatgtctggctgaagcttgtaaaagatttggagattcaaagagacaggaaagatcgtggtcaggtgcaccttgagctagtctattatccatataacatgaaggatgagactccaaatccttttaaacaacatttttcgatgacttccttagagaggacaatgacaactaatggaaatggatcagcgagcaaagattatggcaggttgtcatcaaggaagagaaaggaaattatcctgcgaggggttctccaagtaactgtgatatctggtgaagatctgccagcaatggatatgaatgggaagtctgacccatatgttgtagtttctctcaagaaaacaaaaaccaagcacaagacaagggttgtgaatgaaagcttgaaccctgtttggaatcaaacttttgacttcgttgtcgaagatggcttacatgacatgctcatgctggaagtttatgatcacgacactttcagtagagattacatggggcggtgcatcctgaccttaactaaggttttgatcgaagaggattacaccgacagcttcccgttgcagggagcaaagaccgggaggctgaagttgcatctgaagtggtcgccgcaatcaatcatgcgtgattcgggagaagcagcttaactttcagaccattcaagtatatgcgcctctggtttcagtgggtggatattgggctgactgttggccatgcttggctttcttttctgaaaacaagctggggttcggtcatcatttttcaggtgtaaattgtctccatcgtttcgtcgcagcagagtgtcatggtgtcgatagattgaattctgcaatggcagtgacagtgaccaaaccgtgtttaaattccttgtaacggcatgcttcaaagcgcgtctgtaaatgcagtagaaacaaattcagctattgtggacaatcgtgggtatcactcatgaggatcaatc

SEQ ID NO: 4318 - DNA, 1274 bp, Triticum aestivum
  misc_feature (1247)..(1247): n = any nucleotide
atctggaactgaagcctgttggcacattggaagtcaagcttgtgcaagcaagagatttgacaaacaaggatctgataggaaaatcggatccttttggccacgtttatatatccgaccattgcgcagacggaaccgagagaagtagaaacaattaacaatgatctcgatcccatttggaatggacactttgagtttattgttgaagatgctgatactcagagcgtgacagtcaagatttatgacgatgacggtattcaggaatctgatctgattggctgtgctcaagttagcctgaaggatcttcaacctggcaaagtgaaggatgtctggctgaagcttgtaaaagatttggagattcaaagagacaggaaagatcgtggtcaggtgcaccttgagctagtttactatccatataacatgaaggatgagactccaaatccttttaaacagcatttttcgatgacttccttagagaggacaatgacaagtaatggaaatggatcagcaagcaaagattatggcaggttgtcatcaaggaagagaaaggaagttatcctgcgaggggttctccaagtaactgtgatatctggtgaagatctgccagcaatggatatgaatggaaagtctgacccatatgttgtagtttctctcaagaaaacaaaaaccaagcacaagacaagggttgtgaatgaaagcttgaacccagtttggaatcaaacttttgacttcgttgtcgaagatggcttacatgacatgctcatgctggaagtttatgaccatgacactttcagcagagattacatgggacggtgcatcctgaccttgacaaaggttttgatcgaagaggaatacaccgatagcttcccattgcagggagcaaagactgggaagctgaagttgcatctgaagtggtcgccacaatcgatcatgcgtgattcgggagaagcagcttaactctcagaccatccttgtttgcgcgcacatatgtgtgcctctggtttcagtgggtggatattgggttgactgttggccacggttggctttctttttgaaaacaagctggggttcagtcaatcatttttcaggtgtaaatgttttcccatcgtttcgtcgcggcgcagattcatggcgtcgatagattgaattctgtaatggcagtgacagtgatcaaacagtgtttaatttccttattgtaacgccatgcttcaaagcgcgtctgtaaatgcagtagaaacaaattcagctcntgggggtaatccgtggatgctttatca

SEQ ID NO: 4319 - DNA, 714 bp, Triticum aestivum
cgcaaatgttacagttgcgtcagttgaggataccctgcaaatcgtgacccggcgtcacaaagtttaatctgatagctgacatgatgttggacgaagctgctaaaatggaatttgatctgattgtcatgccgggcggtctgtcgggtgctcaaaagtttgctagtacagacaaacttgttgatttactaaagaagcaggcaggatctggtaaagcctatggtgcaatatgtgcttccccagctcatgtcctcgagccccacggtttactgaaggggaagaaggcgacggcgtttccacccatggcgcacttgcttactgatcggagcctatgtgagaacagggttgtgattgacggtaatcttatcactagcagagccccagggactgcgacggagttcgccctggccattgttgagaagctatttggtcgagagaaagcggtcagtgtagctaaggagtttgtttttatgtgatcacaacctgagttggtgctgtgtgcagtgcaaagtgcaaaactgtggataaccacacctctgtgtacataatgccctgcactggtaggaactgcttgtgcatctgatggaactatagaagcataccttaaacagagaggtgaatgtacaccataatttccatgtacatacggagttatcatcttagcttcgtcgaggaactgagaaactgcagtaagtcatactatcaattgttaataag

SEQ ID NO: 4320 - DNA, 699 bp, Triticum aestivum
tgcaaatcgtgacccggcgtcacaagtgttatctgatactgacatgatgttggacgaactgctaaaaatggaatttgatctgattgtcatccggcgatcttcgggtgctcaaagtttgctagtacagacaacttgttgatctactgaaaaagcaggcaggatctggtaaaccctatggtgcaatatgtgcttccccagctcatgtcctcgagccccacggtttactgaaggggaagaaggcgacggcatttccacccatggcgcacctgcttacagaccagagcctatgtgagaacagggttgtgattgacgggaatcttatcactagcagagccccagggactgcgacagagttcgccctggccattgttgagaagctatttggtcgagagaaagcagtcagtatagcgaaggagtttgtttttatgtgatcacaagctgagttggtgctgtgtgcagtgcaagtgcaactctgtggttaaccccgcctctgtgtagataatgcctgcactggtaggaactgtgtgtacatttgctggaactatagaagcataccgtaaacagagaggtgaatgtacagcatattttccgtgtgcaactggaggtatcatcttagcttcgtcggggaaaagctgagaaactgcagtaagtcccactttcattgttaataagctgtttggtcaagaaaatccgttcgcc

SEQ ID NO: 4321 - DNA, 844 bp, Triticum aestivum
ttgcgtccagttgaggataccccggcaaagttgtgaccgcggcgttcacaaagttaaatctgatacctgacatgatgttggacgaagctgctaaaatggaattttgatctgattgtcatgccggccggtctgtcgggtgctcaaaagtttgctagtacaaacaaacttgttgatttgctgaagaagcaggcaggatctggtaaaccctatggtgcaatatgtgcttccccagctcatgttctcgagccccacggtttactgaaggggaagaaggcgacggcatttccacccatggcgcacctgcttacagaccagagcctatgtgagaacagggttgtgattgacgggaatcttatcactagcagagccccagggactgcgacagagttcgccctggccattgttgagaagctatttggtcgagagaaagcagtcagtatagcgaaggagtttgtttttatgtgatcacaagctgagttggtgctgtgtgcagtgcaaagtgcaaactctgtggataaccccgcctctgtgtagataatgcctgcgctggtaggaactgcgtgtacatttgctggaactatagaagcataccgtaaacagagaggtgaatgtacagcatattttccgtgcgcaactggagctatcatcttagcttcgtcgaggaaaaactgagaaactgcagtaagtcccaatttcaattgttaataagctgtttggtcaagagaatccgttcgccccgcgttgctaaaacgtcgctgttttgcggtgcattgcagtcgtctgttcttaacaccagtgtacctgtgactgtagttcatctctttgttttgtttaacatggtgag

SEQ ID NO: 4322 - DNA, 662 bp, Triticum aestivum
cgcctggcgcaccggatcacggcggcgccgacgcgctcctcatgccctcccggttcgagccgtgcgggctgaaccagctctacgccatggcctacggcaccgtccccgtcgtgcacgccgtcggcgggctgagggacaccgtgccgccgttcgaccccttcaaccactccggcctcgggtggacgttcgaccgcgccgaggcgcacaagctgatcgaggcgctcgggcactgcctccgcacctaccgggactacaaggagagctggaggggcctccaggagcgcggcatgtcgcaggacttcagctgggagcatgccgccaagctctacgaggacgtcctcctcaaggccaagtaccagtggtgaacgctagctgctagccgctccagccccgcatgcgtgcatgcatgagagggtggaactgcgcattgcgcccgcaggaacgtgccatccttctcgatgggagcgccggcatccgcgaggtgcagtgacatgagaggtgtgtgtggttgagacgctgattccgatctcgatctggtccgtagcagagtagagcggacgtagggaagcgctccttgttgcaggtatatgggaatgttgtcaacttggtattgtagtttgctatgttgtatgcgttattacaatgttgttacttattcttaa

SEQ ID NO: 4323 - DNA, 1110 bp, Triticum aestivum
gtgggtggtgaacacgccaactacttcgccgccggcctgaagatggcggaccaggttgtcgtcgtgagcccggggtacctgtgggagctgaagacggtggagggcggctgggggcttcacgacatcatacggcagaacgactggaagacccgcggcatcgtgaacggcatcgacaacatggagtggaaccccgaggtggacgtccacctcaagtcggacggctacaccaacttctccctggggacgctggactccggcaagcggcagtgcaaggaggccctgcagcgggagctgggcctgcaggtccgcggcgacgtgccgctgctcggcttcatcgggcgcctggacgggcagaagggcgtggagatcatcgcggacgcgatgccctggatcgtgagccaggacgtgcagctggtcatgctgggcaccgggcgccacgacctggagggcatgctgcggcacttcgagcgggagcaccacgacaaggtgcgcgggtgggtggggttctccgtgcggctggcgcaccggatcacggccggcgccgacgcgctcctcatgccctcccggttcgagccgtgcggactgaaccagctctacgccatggcctacggcaccgtccccgtcgtgcatgccgtcggcggcctgagggacaccgtgccgccgttcgaccccttcaaccactccgggctcgggtggacgttcgaccgcgcagaggcgcagaagctgatcgaggcgctcgggcactgcctccgcacctaccgggactacaaggagagctggagggggctccaggagcgcggcatgtcgcaggacttcagctgggagcatgccgccaagctctacgaggacgtcctcgtcaaggccaagtaccagtggtgaacgctagctgctagccggtccagccccgcatgcgtgcatgacaggatggaattgcgcattgcgcacgcaggaatgtgccatggagcgccggcatccgcgaagtacagtgacatgaggtgtgtgtggttgagacgctgattccgatctggtccgtagcagagtagagcggaggtagggaagcgctccttgttacaggtatatgggaatgttgttaacttggtattgtaattt

SEQ ID NO: 4324 - DNA, 632 bp, Triticum aestivum
gtgcgcctggcgcaccggatcacggccggggccggacgcgctcctcatgccctcccggttcgagccgtgcgggctgaaccagctctacgccatggcctacggcaccgtccccgtcgtgcacgccgtcggcggcctcagggacaccgtgccgccgttcgaccccttcaaccactccgggctcgggtggacgttcgaccgcgccgaggcgcacaagctgatcgaggcgctcgggcactgcctccgcacctaccgagacttcaaggagagctggagggccctccaggagcgcggcatgtcgcaggacttcagctgggagcacgccgccaagctctacgaggacgtcctcgtcaaggccaagtaccagtggtgaacgctagctgctagccgctccagccccgcatgcgtgcatgacaggatggaactgcattgcgcacgcaggaaagtgccatggagcgccggcatccgcgaagtacagtgacatgaggtgtgtgtggttgagacgctgattccaatccggcccgtagcagagtagagcggaggtatatgggaatcttaacttggtattgtaatttgttatgttgtgtgcattattacaatgttgttacttattcttgttaagtcggaggccaggg

SEQ ID NO: 4325 - DNA, 560 bp, Triticum aestivum
gacaggtccgatgtagctctcggtgtccatcagcaacgctagcgaccaagagagggaatgggttgaggaagaccagcctggtgtatatattaccatccgggctttgcctggtggcatcagagaactccgccgtgttcgattcagccgagagaagttcagcgagatgcacgcgaggctatggtgggaagagaaccgagcgaggatacatgaacagtacctctgagacagaagaagaagcacagatgaaaacaatactgagaacttcgccgttgacatgagccagccgtcgatccatgttgtacatttgcagtttgagctaacattaccccctctctggtgaaggcgtcttgagaaactgaactatactgatctgcaaggctctgattatgtggccatccacatgttctcatgcatggtttttggctttagattgcgcaggaacttcgttcgtgttgggtagctcgaaagggtgcgtactgtgtcattggcctagagataccatctgttctgaaactgtggcttgccaaaccattccccacctggaatgctggaattttttg

SEQ ID NO: 4326 - DNA, 1022 bp, Triticum aestivum
cgatgtcatagtgctgatgacgacttcacaactataataaacgttgcaggtgggtcgtccggtttacataaacatccagaagttcgtgcagtttcagttgactgtgaacattgttgctttggtgatcaaactttgtctcacgcgtgcatcacagggagtgctcctctcactgctgtgcagctgctgtgggtgaacatgattatggacacattaggggctttagctctggcaactgagcctccaaatgatgaaatgatgaagaggccgcctactggacgaggggaaagcttcatcaccaaggtcatgtggagaaacatcattgggcaaagtatataccagctggttgtgcttggcgttctcatgttcgccggggaaaatcttctgaacatcaagggtccagattccaagactgttctcaacacgctcatcttcaactccttcgtgttttgccaggtattcaacgaagtgaacagcagggaaatggagaagatcaacattttccgcggtctcatcggcaattgggtcttcctcggggtaataagcgcgacggtggtattccaggtggtgatcatcgagtttctcggcacttttgcaagtactgttccactcagctggcaattctggttggtgagcgtgggtctaggatccatcagcttgattattggagctatcttgaagtgcattcctgttaagtcaggtgaaatctctggaagtccaaatggttacaagccactcgccaacggccctgatgacatatagctggagaagggtgatttcaggatggatccaggctgcatttgctattttggttctgttgcatcgccagccgctaattttcttgaattcatttgtagtgcaagtgtgcgctgcaggattgctttttggtgctgcatttgtttgggaagtcaactccggcttgagaatcctattgctggatttggatttatttgcatttgaatgcagtgtaaagacttttttttgtctacgattttagcagtgatatgctagcaaaaataataaaa

SEQ ID NO: 4327 - DNA, 728 bp, Triticum aestivum
caccgaagctgttcaagtataaattggggccagacagagacgtcatcgatggatgcgtcaatgaggacgagttcattctgccagaagagtcgacaggtcacggtgagctctcagtgtccatcagcaacgcgagcgaccaagagagggaatgggttgaggaagaccagcctggtgtatatattaccatccgggctttgcctggtggcatcagagaactccgccgtgttcgattcagccgagagaagttcagcgagatgcatgcgaggctatggtgggaggagaatcgagcgaggatacatgaacagtacctctgagacaggagaagaagcacagatgaaaacaataccgaggactttgccgttgacatgagccagccgtggatccatgttgtacatttgcagtttgagctaacattactccctctctgggcagcgtgtgtgaggtgaaggcgtctacagaaactgaactatactgatctgctaggctctctctgattatgtggccatccaaatgttctcctgcatgggtttttagctttagattgcgcaggaacttcgtttgtgtcgggtagctcgaaagggtgcgtactgtgtcattaggctagagataccatctgttctgaaactgtggcttgccaaaatcaattccccacctggaatgctggaactttttgtgggttttcacctgaactgctgtcagcatgtcaaattctaagcaggccaaaaagt

SEQ ID NO: 4328 - DNA, 1111 bp, Triticum aestivum
cggcaaggaggacaacgccaaggagtgggtggcgcaggtggagcccggcgtctcatcaccttcgtcttcgctgccggaaggtggcaacgaacttaaaaggcttccgattcagctgtgagatgttcaacaaatggcaagcgcaaagatggtgggctgaaaactatgacaaagttatggaactttacaacgtgcagaggtttaatcatcaaagtgttcctctccctactactccaaagtctgaagatgagagctccaaggaggacagcccggtaacaccaccactggacaaggagcgagtacctcgttctttacagagaccaacatcggggggcggagcgatgggttactcttcatctgattctcttgagcaccattctaaccactactctaatggcctccaccatcaccacggacaccagtgctatgattcagtggggctggaatcgacaccaaagctgtcaagtataagtggggccaagacagaaacctcatcgatggatgcgtcaatgaggacgagttcatctccagaagaggtcgacagatccggtgagctctcggtgtccatcagcaacgcgagcgaccaagagagggaatgggttgaggaagaccagcctggtgtatatattaccatccgggctttgcctggtggcatcagagaactccgccgtgttcgattcagccgagagaagttcagcgagatgtacgctaggctatggtgggaagagaaccgagcgaggatacatgaacagtacctctgagacaggagaagaagaagcacagatgaaaacaataccggggacttcgccgttgacatgagccagccgtcgatccatgttgtacatttgcagtttgagctaacattactccctctgggcagcgtgtgtgaggtgaaggcctcgtcttgagaaactgaactatagtgatctgctaggctctcccagattatgtggccatccacatgctctcctgcacggtttttggctttagattgcgcaggaacttcgtttgtgtcgggtagctcgaaagggtgcgtactgtgtcattagcctagagataccatctgttctgaaactgtggcttgccaaaccattccccacctggaatgctggaa

SEQ ID NO: 4329 - DNA, 1117 bp, Triticum aestivum
acaagctgagggagatggagatgttcggggaggacggccgggatagggtttggacggtgatggcgaatgtgatggaacccgagagcctgcaccgggcgttcgacggctgcaccggtgtgttccacacctcggcgtttgtagatcccgggggcatgtccggctacacgaaacatatggctagcttggaagcccaagcagcggagcgggtgatcgaagcgtgcgtgaggacggaatccgtcaggaagtgcgtcttcacctcgtccttgctggcctgcgtgtggtggcagaaccatcctaatgaaagacggggcccgaccatcctggacgagaactgctggagcgacgagagcttctgccgcaacaacaagctatggtttgcacttgggaagacagcggcagagaaggacggctggagggcggaccgggggagagacctcaagctcgtcaccgtctgccccgcgctggtcacgggtgccggggtttcagccgcacgcaactctacggaatccatcgaagtaactcaaaggatctggtgtcatgctcgcggatggcgtcctggcgacggagaacgtggcgacggaggccgaggcccacgtccgggtgtacgaggcgatgggcgacaacacggccggcggcaggtacacatctgctacgaccatgtgatccggagagccgaggagttcgccgagctggagcggcagctcgggatcccgagaagaacggcggcaacgcagagcgtcgacgacgaccgtccagcgaggttcgagctctgcaaaaggaagctggggaggctcatgtcctcgaggaggaggtgcacgtacgatgactattactgccctgttacgttccaatagggcgccaagacaacgctgctggtggatttgaaggcagttaattctattgggttcgcgcggcaggtgacaattcaatcgagcaccgactcccctgggttgcacatgctgcttgaagaggtcaaaaccagaatgggagggggtggaaaaagagtagtagtgctttgattgtacattgtccctgtggacaaagaggagtagagacgtacgcgagtgcgatgatgtatatagggatagtgcgatcttgtaggttatttgacgcaaca

SEQ ID NO: 4330 - DNA, 988 bp, Triticum aestivum
ttgagtttgtacggaggcagataaaagaagtcactgatggatctgcccatgcgcaagagacagtccagaacagggaacaagctctcacactgttctttgtgggagaccaaaggggtgccgactcactggagaactggttgtgttacgaatggatttccagcgacttctattcatggtgatagaaaccagcaggaaagagaatatgctttgagatccttcaagagtggtcaaactccaattctagttgcaactgatgtggcggcccggggcctcgacattcctcatgttgctcatgttgtgaactttgatctccccaatgatattgatgactacgtacacaggattggtcgtacagggagggcaggaaaaagtggaattgcgactgctttctttaatgacaacaactcttcgatggcaaagtctctagctgacctaatgcaagaatctaatcaggaggtacctgcatggcttactcgctatgcagctcgcccatcctatggtggtggtggtggaaggaacagacgtggtgccggaggtgggagccgctttggtggccgtgacttccgtagggaatcttcttcctttggcaagggtgtggcgccagtgactatgtctggagcagcagctacggggtggtggctatggtggtgctggagctcccagtgcctgggattaatgttgcagttgttcgcttagggtctatcaagtttaggttgcttttattctagcttcttattagatatacatttttggcaggagctgagatgcagcgacagtatgagtgaactgtgtcgtccccttttcttctggttacaaccaaggtagtcttatcttcagatatccgttatggagagaatcttgaggactttcaagcacacaccgaggttcgcagttaggaataggatttctagagactgaaattccttgttagggataatagtagctggtgttggcagactgacagcgcttgatgtggaatttctctccg

SEQ ID NO: 4331 - DNA, 1131 bp, Triticum aestivum
ctgtcagccacttcaaggcaaggcgtccgagagttcttgactgaacttacagcaatttcagacatcaagcatgaaaacctcgtcacgcttgtcggctgctgtgctgaagggtcccataggatcctcgtttacaattatcttgagaaaaacagcctttcacagacattgctagggtctggctacagcagcatccagttcaactggagggctcgtgtcaaaattgccgtgggagttgcccgtggacttgcatttcttcatgaggaaatccgtcctcacattatccaccgcgacataaaagcgagcaacattcttctcgacaaggacctgaccccgaaaatttctgatttgggattggcgaggcttcttcctgccaatgcaactcatgttagcacccgggtggcaggcacattaggatacttggctccagaatatgctatccgaggtcaagtgactaagaagtctgacatctatagttatggggttcttctcttggaaattgtcagtggcagatgtaacaccaacacaagattgccttgtgaagatcaattcctccttgagaagacatgggcattctacgagcaagagcgtctagaagagatcatagatgccgacatagacgaagaccaggagatcgaggaggcatgccggttcctgaagatcggcctgctgtgcacacaggacgcaatggcacgccgtccccacatgcccaccgtcgtgaggatgctcacgggaagcaagagcatctccatggagaagatcaccaggccagccatgatcaccgactttgcggagctcaaggtcagcaccaagccgcacggagcgaaccaggcacggtccaacacatcgagatccttctccaccacggagatatcggagcccttctcgtcgtcggagaatcacacacagacatctgtatgaggagctggacaggaaattagcgccgttcgatttgtacattgtcgtggtgatagatatgcctgcatttttggaggatatattgctttgttttttgttttttttccttttttgattccacgaggaagggttgggttaatggggcacctgtcgtttgcttgttgtgtagtacgatgtgaatatctggagatggagatgatcaagataggctcttgc

SEQ ID NO: 4332 - DNA, 628 bp, Triticum aestivum
gttttgcttgcatggtacaattaattaagcctgtgtaactgatcaacgcggcatgtcaatactggcggaaggactgccacggaaggtggccgacccgttcgactatggaggtgggaacatcaacccttctagggcagcccatccaggactggtttacgacattaatccacgcaattacaacaaattcttccaatgtgcaatcatcaatcagaggacatcgacatccgtgggctgcaacgccacactactggcgtacaacctcaacttgccgtccatttcagttcccgacctgaggggtccgatcaccatcccaaggatggtgacaaatgtcggcgatgtccattcagtgtatcatgccatagtgcaaagcccagacggagtcaagatggaggttttcccacctgttcttgtgttcgacaatgcgaacaaagttcaaaagtttgatgtgaagctgtcacctatgtggaacttgcaaggggactacacgtttggcagtcttacttggcataacgacctacatactgtgaggattccagttgcggcccggattacaaatcaggatttctatgcggatgttgcataataaaatgtaaatcccatcacctcacttgcaataaaaatcagacct

SEQ ID NO: 4333 - DNA, 716 bp, Triticum aestivum
  misc_feature (574)..(574): n = any nucleotide
tctgctgcaatcaaatcagccatcatcactaccgcccatataacctgatgagcatcggcatgtcgatactggcggaaggtgctgcctcggaagattgtctgacccgttcgactacggatggctggcaacatcaaccctcatggggcggctgatccaggcctggtttacgtacattgatccacaagattacgataaatacttccgctgcaccatcgtcaagagggcctccgtgcactgcaatacgacgggaatgctaccggcgtaccacctgaacttgccgtccatctcggttcccaacctaagaagtccggtcaccatgtcaaggacagtgacaaacgttgggggtgtcgactccgtgtaccatgtagaaatccagagccctgtcggagtaaggatggaggttgatccgcctgttctagtgtttgatgcgaagaacaaggttcacacgtttcaagtgaaactatcccctgtgtggaagctacaaggggattacacttttggcagccttacatggggtaacgatcagaaggtggtgaggattccagttgcggcccggattacaattcaggatttntatgcggatgttgcatagttaattgggcgaaacatgcaaaacataagattatattacatgattgcatgattattcactttcacatgcacatgattattattatgtgtcaccgtgttgacgagagatgctactagtgaactta

SEQ ID NO: 4334 - DNA, 1934 bp, Triticum aestivum
taatcatcggagttgttgacaccgggatctggccggagtcaagaagcttcagcgatgtagggtacggaccggtgccagcgaggtggaaaggggagtgccagaccgggccggactggggcatcaacaactgcagccggaaaatcatcggcgcgcggttctacaccgctggggtccccgacgagtacctcaaaagggactcgctgtcaccgcgggaccactacagccacggcacccattgtgcttccaccgcagctggctcagccgtaggcgtggacggcgaggaggctagcttccacggccttgctgcgggggtggcgcggggaggcgcaccgcgcgctcgcatcgcggtgtacaagtccatctttgctggctacggtgattcagccactgtgctggccgccattgatgacgcaatccacgacggggtggatgtattgtcgctgtccctcactgtgccgtacgagaactcgtacggtgccctgcacgcggtccagaaggggatcactgtggtatactccgcgggaaacgacggacccaggccgcagaccgtcgaggatacctcgccttgggtcctcactgtagcggcgagcaagatcgaccgctcgttcccgacggtgatcacgttgggaaacaagcagcaaatggtgggccagtctctctattaccaagtgaagaacatcaactcatcatcacacacggctagaaatttcacaaagcttatatgtgcacaatcttgtgtgccgagacatgaggttcttcatcatattgacgtgaaaggggctatcctggtgtgcttaaatgataatgacgcgatcaatccatcagatgatttccaccatgcggcgaagtacgtggtggaaggcgggggatccgggctcatcttcgcgcaatacacaacggacaccctgagttccacagtggcttactgcccgggcatcgcctgcgttatcgtcgacatctacatctccaggaggatatgccaatacgcattcgactcaagctcgcccacagcaaaaatcgaacccacgcgcaccgtcatgagcaaagatgtgctggcttcgaaagtggcgtccttctcttcgagaggcccatcggctgattacccggccttcatcaagcctgacgtagctgcgcccggagccaacatcttagcagcagtgggagattcttacgtaactaagtcaggaacgtccatggcagccccgcatgcagcgggtgtcgccgcgctgctcaaagctctgcacccggattggtctcctgctgcaataaagtcagccatcgtcaccactgcgcatgtaactgatggacacggcatgccgatcctagcggaaggactaccgcggaaggtcgccgatccattcgactatggaggcgggaacatcaacccatgcggggcagctcatcccggcctaatttatgacattgatccacacgattacaacaaattctttcaatgcgccaatgtcaaggaggggatatctgcgatcgcaagctgcaacaccacctctatgccagagtataacctcaatctgccgtccatctcggttcccgattttaggagcgcgatcaccgtctcgaggacggtaaccaatgtcggcgagctccattctgtgtaccacgttgtagtccagagcccgactggagtcaatatggaggttttcccggatgttctggtgttcgatgctgcgaacaaagtccggaaattcgaggtgaagctgtcacctatctggaactttcaagggggctacacgtttggcagcatcacttggcagaatgaccgacaagtagtgaggattccagttgcgacccggattacgattcaggatttctatgcggatgttgcataatgataaaataaaaccacatctcatgcttaaaataaaatcaagacccacatgacacctactaggaagccatatcacctgacatgtggg

SEQ ID NO: 4335 - DNA, 1157 bp, Triticum aestivum
gtgatttcaagtcaagcaacatactgctagagcatgatttcacaccaaaagtttcagactttggactggccaggactgcgaggggggaggggaaccagcacatctccacccgcgtcatgggaacattcggttatgttgcaccggagtacgccatgacgggccatcttcttgtcaagagtgatgtatacagctatggagtcgtattacttgaacttctcacaggtaggaagcctgtggacatgtctcagcctgcaggccaagaaagcctagtcgcatgggctcgcccatatctgacaaatgtggtgggcttgcgtcaagctgttgatccacttcttggccctcatgtgccactggacaacgtggcaaaagcagctgccatcgcatccatgtgtgtacagcctgaggttgcacaccgaccgagcatgagcgaagttgtgcaggccttgaagcttgtctgcagcgagggtgatgagggtctaggttcgggaagtttcagccaggaatgggcggctcgtacaacagcggcttacgatgtaactggcatggaagcggagagggtgctattatctgagatgtttggttcaacgcctgtcttcactccagctgacgattcaggttctttccgcatgcagtccagctctggccccctgatgacaggcaagaacaagaagttctggcagaggatgcgaaacttgtcgagaggtagtatgagcgagcatggcgcctcgccagattttgagacacactcacagtgtagcaataggtgagtttttcttcttctgtccagcttccagtctcgacatggatattcagatgactggacataaagagtttgaagacctagtttgtgtacattatgcatgtggagataaaaggctatatatatagttcaggattatcagagtacctgtacaagatctgctcagatttggctctacatttggtttgatttaacgggttctgccgtactgctatgtggccatacacagatacgcctgccttccgatttgtaatgtttctcttttttcggcatgtcagtttgagttagtttgttttcccttttgtttggttagctgtttggtaggaattgttaatgtatagatttggagtttcggactacattttgccatgtgaatttcagctccatgcacgtacac
